United States Patent 9,328,346 (POLYCOMB-ASSOCIATED NON-CODING RNAS) - sequence listing, part 4

SEQ ID NO: 348 - RNA, 134317 nt, Mus musculus
cgccgucgccccgcugugccgcgcucccgccaccuccuccugcuccuucucaguaacgcggguaagagaugcuguccccucccccgcggcgccccgggaauaacgcgcucgcuccccucccccgcccgccaaccgguagcgcuaacggagcgggagagugaggcagccggggagcuaagcgcugaggagacggcgucccuccccucuccuccggcccgccaggggccgucggguucugaggcgagcccucuagucgccuccaccgcgcggugcccgccgcuucgcugggggccaugugcagcgccaaccccuugaggccuagcgggggagcuggggacagguucccgagcgucccugcugcagcugcugcucuugcgagcccuggagauccggggaggacggaggggaaaagcaacauagucaggccaggcuggagcagggaccguucgcggaacuguucuccggggccuggaccagaugcccggggcugauacccccgcuccggggaauugucacacacaccaaaagggaaacagcacgucgugcccguacugcccguacugcuagaaaaaacacaguggggaaauuagcaagaaaguugaaugacugucagagccuuggucguugauggacgaaccuacgggggacguuaugauguaaaucccccuccccccuuuccaucccuguauauuagaaguuuuuuuuuuuuucuucuugugguuauguaccagagauugucacuguugucugaaguugcuuuuaaggagaaacaaaauuggguuuggcuguugugacuucugugaauuggguccugagagagcaaguccccuaaacuaguuagaggugaagagguaucuuccaaagcagugcugcuuacuaaauaauaaggugcauuucugaagagguaaaaauagaauuucuagcaugaaugaauacacacaaacacacauaucccacuccuaagguuauaguuuggcugggucacguuaaagaaucucauaccauacuccccuuuauuuuagauuuuuucccuggacagggucucucuguguagcccuggcuguccugguacucacaauguagaccaggcuggccuugagcucacagaauccaccugucucugccucccaagagcugggaucaaagguguggccccccaucgcccagcuaaagaaaccucuuaaauuuaaaugucauugauuccaagagcaucgagucauaaaaagaugaaaucaaccucgaagccccuuccuuauaauacuugaaucaguagaguucauguagcuacccauuuaacugaagaaauaucauucucuucagauuuuaugucuuuauauuuuaggggauugucuuauaauuguaucagauuuugauagugugcccaucuuuucaaauuccacucugcuuuuucagccuaggagaauaugacuuuaguggacccuguaaucuauaauaggcauggcuacagaccaccccauuucuaagauuuauuuguuuuagagagaacacugguucugaauaaacaaccuaugcuuugacuaauagacuauuucuucugggucacagaaguaccuuaggaaucugccauguucucaaaauaaugcaaguagauacagaaguaaaauagauccauucacuuggauuaagaaggaaucugguuauguguuacugauuuuuuuaauguaguacauagcuuuugaagauuaguucccucagcuucuccauugaguccccauagcauacauucccuagcauaguuccccaaacuugauaauuaguuggcaauuuaugcagugauauauuuaggucucaugaauucuuuguauggaaggucugaugaaaauacaggggacuacauucuuuuacuauuugugggaccauuuuaugaggcuaaucuaaccuaaccucgguuaauaauggggaggauaaugcuuaaucuauggagcuguaaauagacuauguaaagcuacuaggauugugucucacauguauauauuuguuacauuaaguuuuuaucuuuguuuucucauuuucauauuuagagaaugaauuugcuguucauaugcagaguauuguugcagucucaaaaaucucuucuacuguugaguguuaauguacacaguggcuuaaaacaauaucucauagccaauuuuuuuguuuuuguuuuauuacauuuacugggguacggggcgcagcacagaaguaccaugauacauuuuaggaggguggaggacagugguaagguuaggagaaaucaguucuucuucuauccuauuggucucugggauugaacucagguggucugauuugaaggccaagugccuuuaugcacuaaaccaucuugcuagccuuuagccauuuuuuuuuuaagcagacagaauauaugaaauuggucauuggguaucaaagagaauuuugucauacacaguaucuuuuuuccuuuuguuuaaaauuucugcguuuggaacauauuucaaauagauuacccauaauaaaaaugugcuuuguguuuuaguguuuuaguaguaaacuaggguuguuguccugcuuuacuuuguuaauauguuucaaggucuaguuuacaguugcuuuuggacucauucuguuaccagagaaaccaagugacugauacaaaguuaagacugagaaaguuaucuuaccagacuguugcuuugugcucuugagguuuguugguuuuauuuuugcuauuuuuuuuuccucaaugcuagggauugaaccuuucaccucauacaugccagcaaguauuccaacauugaguuaaauccuugcucuuuaguuccuacuccauuguuuagcaguccuuggguauuuuuuuuucuuugaaauaccauauuccucccuguucccaaguauauuugaaaguauaguuuucacacauaaagguguccuuggaguuggugcagccgagccagguuucgauuagcaugccaacaguuguguuaugaaguguugcugguacuauccaagauugacagcaucuacauggucacaugccacugaguuauugagcucuguguacuugggugcuucucuaaagggacuuacccaguaauuaaagagguuuuuguuugaacugacguuuuaaauauccaguuauaaccauuuggguuacuauuaagcugcaauucuuauaaacaaggaaguguaguaagaguuguguaugcuaaagacuaaugaaacuauaauauucuguuccuacuugaaguagaaaacuucccaauuaacccuucccaugaccuguuguaaaaauguccagcacucacaugucauagagguggauguguuuccaaguggaaaugaaaauuucggauugcucuuguugcaaaccacagaaccagcccuccauuucccauucuugccuauaggaagaauaauuuauuuaugguuuuagguaacuaaauuggcaggugauagaaaaggaaauguauuaguuuuuucccauauaauacuaaauguuaaaaaaaaaaaaaagauuacauugccuggcacuuaauccuuugagcucacuauaaacuuuuauuaguaauacaaacaugcaucaugcaccaaauaacauaauaaaauuucuaucaaauuaacuuggauccuuauauaagggccuggcuaaauuaaguaaaacaacuugcuuauaucugguguuaacuuacauaugaauauauauaaucuccacaaugcaguuuaauaagucagugauggacaagugaaauaaguucuaaaucauggcucaaagcuaguucucugccugaauuucccugcaguuuguuuuauuuccagguuuuguucuuuacuguugugcugcccacccauucuuaguguucacacauacauuaagguaaacaguuuccuuuagaguucuauugcucuuugcuuugucaguugguagguuuguaccuuuucggggaguggaaggaggauguuucauggcaguuucucuguguagcccuugcuguccuggaacucucuuuguagaccaaacugggccucacacuuuagagauccacuugccucugccuccugagugcuagguuuaaaaacacgugcaccaugcuuggcaguuuauaccuuuuuaaaaguuauuucuuauuauguauauggauguuuugccugcauguaugucucugcaccucuuguaugucuggugcccucaggucagaaaaacuguauaggaucuucuggaacugauguuauacacuguugugaacugccauguggcugcugggaauugaagauggguucucuaaaagagcacucagugcucuuagcgccucagcugucuuuccagcccuugugacucuucuuaauuuuuaccuguaaacucacuucucaggaaagcauuuuugagccucuuauucuguaaauacuagaucacuuagcauuuuuggaugggagcucuuugggcuucuccauuuaugucaucuauaacuugguguaauuuucuuuuaaaagaaauuaaaugaaauuauuuguuuguguuucugacuuuuagagguguaaucugaugucugaugcaaggaaaguucugccauuugacuuaugccaauuuuaguuuagugacagauugaagcugacuuuguaguugugcugguagcuuuacuaaccucuucuacaugaaaggguuccauaacuacaugguugugucuccuugcaauuugagguacaaguuuaaucagcugcaggucauuauacuaagggaugaucuagaauauaaaaauaaaaugaaaaguucuaauaugaaauuaaaauuuucugcaugugugcaagcuuaaauaguguuagacuuuuuuaaaucuugagaaaggaauuuucuuauuauggaauuucuguuuaaaauuaguaauuggguuguugauuucuggaaauaacuccaaugucccucacugaguaaguuaaacugugguguauccauaccaucuauguuuggaauacuaugcagcaauaaaggggcccaaguuguagcuauaguaauagcuuggguagaccucaaagaaaauaugauaacuuaaaaaacaaaaaucuuaagcaguuacauaccauaugguucuguuuauguaauauucuugaaaugaggaaaauaggacgacaaugaugggaaacaggaagcagaaugauaaccuagggaaggggugggguggaauuggggugugugaugagauaacucugcaucuugauuguggugguugguuuuuuuuauuaaaccuauauguuuaauaaaaguauacgucacuacacacucugauaaguaaaguauuaaguauguuuuuguuuuguuuuuuuguuuuuuguuuuucgagacaggguuucucuguauagcccuggcuguccuggaacucacuuuguagaccaggcuggccucgaacucagaaauccgccugccucugccucccgagggcugggauuaaaggcaugcaccuccacgcccggcucuuguuuuguuuuuugauguggaguuguuuagaaacagcuuuuuacuauguaucccuuggcuggccugcaacucacuauguagaccagugaggcuuuuuguuuuuguuuuuguuuuuguuuuuguuuuuguugggugggggguagggaguauaagagaggguuucucuguguagcccuagcuguccuggaacuuuuuugcugaccaggcugaccuugaacucaaacacccaacuaccucugccuccuggaguacuggaauuaaagaccuacuuacacaucuacugcccagcucagagugagauuuuaaacuaaauaaaaagcaaugucuuagcuuugaaaguaaaagauacaccuguaauggcauuagaggaagcuaauugaauggaaugguacuuuuuagauuuugcuuucauugcaaaacuuuauuguuauguuaaugcuaucugagcauagaagaaacucugagggcaaacagacccaagguguucuguuuucauguuguaugcauaauagaugcaauaaagaccaagccaucacauuguaugacuuguuucccugcgagucaguuacuucucccccccccccccugcuaccuaucucacucccuuccucccuuucuccuuccuucuuuccuuccuuccuuuguuccuugguucauuacauuacagcuuuuguuuuccaacuccucuucuuacaaacucaaaagaaucuaugugucagucaucaaaacuguucuuugguugguuucugaaaugugauuuuaucaagaggcuauucauuaaauaauaaaauauuuuauuuaccccuuuugagaugggaaccugucaucauuuuuguacccauguuuauucagcuauuuaaaaaauuaucuacuagacagguggugaugguuguaccccuuuaaucccagcacucagaaagcacaggcaggcagauuucuaaauuucaaggccaagccuggucuacacaucugguucaaggacagccagggauacacacacaaaaaaaacccugucuccaaaagaaaaaagaaaaaaaugauuuacuuuaaaauuuuuauguggaaaaaaaaaccaaaaauuuuaugugaauauguuguguacuuaauaugaauuuauaugcaccaaguaugugcaauauccuguggcaccaggaaaggacauugaaucuugaagaacuggaauuacaggugguuguuuguaagccaccauguggguacuggggacugaaccuauguccucugccagaguaaauggugcucuuaacugcugagacaucucuguagccccauaucuaguuuuugucucaacauuuuuuucaaaaguuugggagugguuguaggggggcuaugagggauucguugggggucagguaggggggaguuuguugaacugucucaguacugugguuggaaauuuguugaccaaaaaugaggauguuagcacacuguaaguuuuaaaagaguuuuaaaaugcuaaaacuguuuaaaugucuugaaagaggggauuguuugacuguucaagguccccuaccccauguguauuuuauuaccauaucucucuuaaucaguaauaacuuucuuaagaauccagcuugagccgggugugguggcgcacgccuuuaaucccagcacucgggaggcagaggcaggcggauuucugaguuugaggccagccuggucuacaaagugagugccaggacagccagggcuacacagagaaacccugucucgaaaaaccaaaaaaacaaaacaaaacaaacaaacaaaaaagaaacccuaaaaaaaaaaaaaaaaaagaauccagcuugaauuuucauuaggauuuuauuaaaacauaggcaaauuuggauaauacugccaucuuaacaauauuaaauaaaguauauuuacauaaagauucacuagaauaacaagcuuauauauuuacauaaauacuauauuguaugaacaauaacuuuaaaacaaugacauugauuuuguuuuuuccuuaauucuacucuggcacuuucccugauaggauaugugguuuugauuaaacuauaaaugauauaugaauaugcagaauguggcucagagguaaagcccuugucuaauaugaguaaggccucugacuuuuaauccuggcagaaugugcauaucaggaacacauacauaaacacaaacacagaagagcacaguuuagugaugcaaauagacaggggagaaccagauggaccuuuugaacgaaucuucaugaccccauaguggaccuuagacuaaacuuaugagaaguacuuacccaauggaaaccuucagaccuggcugaaagaaucuccugcuauuuaggagcuaguguauaauuuugagcaaguugcagucagucuauaccaagacuugaguugaauucacauaccuuucuguuacacuaaucuuugguuuggcagaguuuugaagaauuaguuuguuuuaagauuuuuuuuuuacuuagguguuugugacuguucuccauaugugugaguuacugcaaaagucaaaagaggguaggagaugccuguaccuggaguuacagcaguugucuuuuuuauacucgaugaggaugcugagaaccaaguauggcuaaaguaguaguuacuccuaaaugccaagccaucccuucagccuuauuuguucuuagacaagguuuuucaguugucauggaugaacucaaguugauguucuugucuccccucccaacugugccagugugacuaauuuuguuguuugguuuuguuuuuuccuggauaggauuucuuaguguacuggcuauucuagaauucucucuguagagcagauuggucuugaacucagagauccucuugccacugccuccugagagcuggaauuaaaggugugcaccucuaccacccucagucauggggcuaauuuuuuuuaauuguacucuuaaaaaagaagaaaagaaaagaaaugaauagauaaauaaaagaaaggcuggccaccuuuggccucauggucuacugagacuaauuuuauauaugcauauguauauauguguauauauaugcauauguauauaugcauauauauauauauauauauauauauauauacacacacacacacacacacacuaugacgucaggaagaaauuguuaaaauggggagaauggggaggaaagauugagaaauaaauaauggacuuuagggccaaaguagccagggaagaagucucuugacuugagaaagaguggcauuaagugaggacuaugagacagaaaaaauuaauagcauucugaggccuuauaaugggagaaacggaaguaccaugggaaguaugaaaauauauuuauagaguccagaaaugcuucagaucuuuucucucuguauaacaagcccugcuucucacuuaaccaaaagaugucuaagcuauuuuuagcauugccugcauuuaaauaagugauauaucuguugguaugagaaguuacucugacucuuuugagcuuaguuuaaugaguaacuggguaacuuucaaagucuacuuucggugcuggagagauggcucaacaguuaagagcacugacuguucuuccagagguccugaguucgauucccaacaaccacaugguggcucacaaccaucuguaauggggucugaagggagcuacaguguacuuauauacauuuaauaauuuuuuaaaaagucuacuuuuuuuuucuuuuuccagagaguaugaauggaaguagauagauaaagauauauagauauaugugcgugugaguguguguguggauguauguauauguauguguguguauauauauauauauauauauauaucccuuuagaacaggaaugugcagauuguauauagaaaucaggcaaauaaucaagucuuguacuauucucgugacaaaaacacauuccugaggaaucuuuuuuuuuccuuuuuuuuuuuuauuauuauuggguauuuauuucauuuacauuuccaaugcuaucccaaaaguuccccacacccucccacacccacuccccccccacccacccacucccaccucuuggcccuggcguuccccuguacugaggcauauaaagucugcaugaccaaugggccucucuuuccacugauggccaaccaggccaucuucugaugcauaugcagcuagagacacgagcucugggggguguggggggguacugguuaguucauauuguuguuccaccuauaggguugcagauccccccaucucccuggguacuuccuccagcuccuccauugggggcccugugauccauccaauagcugacugugagcauccacuucuguguuugcuaggccccggcauagucucacaugagacagcuauaucaggguccuuucagcaaaaucuugcuaguguaugcaauggugucagcguuuggaggcugauuaugggauggaucucuggguauucuaaguuuuugggcuaauauccacuuaucagugaguacauaucaugugaguucuuuugugauugaguuaccucacucaggaugaugcccuccaggucuauccauuugccuaggaauuucauaaauucauucuuuuuaauagcugaguaauacuccauuguguaaguguaccacauuuuuuguauccauuccucuguugaggggcaucuggguucuucccagcuucuggcuauuauaaauaaggcugcuaugaauguaguggagcauguguccuucuuacugguuggaacaucuucuggauauacgcccaggaaagguauugugggauccucugguaguacuauguccaauuuuuugaggaaccgccagacugauuuccagagugcuuguacaagcuugcaaucccaccaacaauggaggaguguuccucuuucuccacauccucgccagcaucugcugucaccugaauuuuugaucuuagccauucugccuggugugagguggaaucucagaguuguuuugauuugcauuucccugaugauuaaggaugcugaacauuuuuucaggugcuucucagccauucgguauucccugaggaaccuuuuaucuuuaccuuuuuauuucuuucaauuauccugcacccccuccccuuuuguccugugugugucugucucugucucucugucagucuaucucuguguuucaguacacaugcauguguacuaagguauauugcuagagauggaacccauuuugaaauccagucuaagcacgccuauaccacugagguguaaacccuuagugcuuacuuuuuaguguuggaagggaaaugaauaagcagagggcaagacuccaacugguccagaaacuaauaaggcaucagaaaagugcacuauugucauugugaccugcuccucuccacaagacacuacuagagaauagaaauuaggugugaauagggugggggacuuuacuugcuucauuggcucuaaggcucucauugaccuuggccuuaaaaagaaaaaguuuuagaggaguuaaacauaaauacccuucagaguuggcuccuguuuauacuugcacaggauguucacccuucuuaaccuuaccuaguaguguaugauauuuacuucauggcuuucuugcaauaugacguggguguguacauaugcacauaacuaugguucacacagaaauaagaggagugggugcuuuccuuuaaccuuuaugguaggucaugggaaucacauguagguugucaggccugcugagcuguuucauuggccccuauaaagcucuccauuuaccuuaccacugacauggucagauuaaguggcaguuaagagaauuaauugacugaaauguuaagugagcuucuauauugccacuacauuauuagcacccaacacuuuaauuuuagaaagguauuuccagacuuuucuaauguaaauuuuuuccugguuuauaggcaucuugugaaaauucaugcaaaaaugauaauauuaagagauaauuaauauguuuuuaaaaguucacagaauuggcuacaaagcaaauuguuucugucauuaaagaugcaccucugcucaugacuugauguggguccauuugaugucagaugucaacauuauuaaaucugcagcuuucucuucucuuuccuuucccuuuacuuuucucaucugcugcuuugugucaguuuuggauacauuugcuuaaaggacagaauagguagagccauugaaaaggggaaauaaagaacucaguuuuuuuuuuguuuuguuuuguuuuauuaauuaaauuaaauacaugcaacucagaggaguacauggggcuuauagugaaauuuaaauaacuguuaguuggacuuguuuuacuacucugucacaauuugaaugucacuuaagaguuuuccuugugcugggcgugguggcacacgccuuuaaucccagugcucgagaggcagaggcagguggauuucugaguuugaggccagucuagucuacagagugaguuccaggacagcaaccagggcuauacagagaaccccugucucaaaaacaaacaaacaaacaaacaaacaaacaaacaaaagaguuuuccuuguuucuuaacucuucauuugguguuuucucuggaguucucaguuacuggcaggagagacaguccaagacccuuagguaguuccaaagcaucuguacacugauuuuuuuuuccuagucauguagccuuaugaaauuaacuuauaacuuagguaugagguaagauuaacaggauuaacuaacaauaaaacagaaaaguuacuauguucuguaauaaaaggauaauguggucuuucuguccgaaugccuuacuuugcucauuugguugugaugagacagggaugugagugacaaaguguugauugggccauuugaacacagauaguacaauaccuaaguaaauaauuuuaauagcugagauggcuucugagugacucaggagccaggagccaguuguauauacaguauaacuguacuaaucaaagggauggugcacaccugccaggguacuggaugugacaaucuuaagguuucauugugccauuuagaaugccauguacuuguaaacucaugaauugucaauuuugugaauuuuccacauaauauuuuuagaccacugucaaccaugacugcuaaaaccauagaagacaaaauugccaauaacagaggacugcuguguuuaccugaagugaacacaacagcgaacuuaaaauacaggccuucgaucucccaggccaacuagcaucauuuuuaccaaguauaaaucauuuuaggaauuacucugugcuuuucuuuaucccagaauuagugaaggcaaaguugcuaguacucacuacuaaauuugguauuuuuaaauacuagaguauuuaaaaaucaguuaaaccccgagguuuuaaugguuuguuugguuguuguuguuguuguuuuauaauuuuuuauuuauaugggugggguuacuuccugcagugcaugcauggaaauaggagacaacuuugagaacuuguuucucauuuuccaucacaugggccuuagggauaaaauuccgguuagcaggcuugguagugagcaccuuuaugcuuagcuuuaucacuaacccaaacuuuguuuuauucuuccagacuuuuuaacacugcucuuacaguaaauguuaauauucuucagaacugauccuagugccucacaugucuauuacucacauuacuuaaggucaagaaaaccacacuagugagugaguagcuggcauaucaucuaaaccuuaaaucuaggugauuuacucacuuugguuuuuaagaguaaacuuggccuggcaguggugguacaugucuuugaucccagcacuugggaggcagaggcagguggauuucugugaguuugaggccagccuggucuacaaaaugaguuucagggcauccagggauguuacauagagaaagccugccuucaaaaaaccaaacuaaauaaauaguaaauauguguguugcagaaguagguaaguuaaaaggcuaucugcuacaggaaugccaguagcaagccaggacaaagaaggaaauggaagugugaaaagcacauaucacacuccaaaagcacagcuauuaaugucacuuagcguaggaguagguuguccauguacccauuuuuaaaacucaccagguuuaauauauuacaauuugguuucuguuauuguugcuguugucugauuucuguuauuguuguuguuauuguuaaugguggcuuguuuugaaaaaggggaaaggaccagcuucaaaauccacucuucuuugauaugauaacuaauuuauggauauuuugggguaggcauuaaaucauauuauuuuucaugugaaaagagcuuauugacacuuagccaagucauguguaauuaugauuuugccuguuacacugugaggcuugagggaacaucuuuacucauugaguucuaggaaauguuucuuucugauucuuugcuuuuuaaaauuugaguggcaugucaaagauaauugcuaaccugauuugaacaugaguuuuauuaucugauucacuaagcuuuauuuagauuuucagucaguauuacacugaagauaaauguuuauuuuguaagaaaaugacagcucauuguuaguguuaguuuuaacaacuagauuauaacccagguagugguggugugcacuuuaguccccauauucuagagacagaagcaggcagaucuaagugaauucuaggauagccagggcuacacagaaacccugucuugaaaaccaaacagaaacaacaaaacuagauuauaaacgaaccaaagcuguucaguucuuguaauugcaaaauagcaaaguuagcauaguuugucuaugcuauaucugagaaauaauuucaggcuguuaauuaaagagguuuuauuuguaugcauuuacagaucccaauagaaaguuuucagcauugugagacuaagaaaacauaaccaggaaugugucauguaucugaaaucccauuacuguaaucccaacaccaucaccugagaugggcaucuagacuuuagagcaagccuggguuacauucauaacaagacacucuucacagagcagggggaggugaaaacacauacaugcaaacuuuguacucugcaaccauuaugaaagcauaccuguauuccuuuuaaguaaaugacuugaucuaaugcaaaaucuucaaacuguaagucaaccagucauaacuugaagagagugagagaguaagucugguuacugaugcuuaguacuuuaucaagcccaaaaugcuggauuuaguuaguaugguaauuaaaaaugguuuugaaggauguugguagagauugagacacuucaguaaaccagauccacugggcauggacaugugccuaucagguggcugaagucagaguauuccaaguaggaaaccagucuggggcuauauagcaagagccugucuaaacagagagcuaaaacaaaaacaguaucaaaaaucaccaguaauggacuauuaaaguaacuaauagggaccuuuagaaauaaaaauaaggaguuucuuaaaaguugugaacuagacuaugcuguuuaaaaugaaguuaaguuuugagaaguaagacuuuuuuaaaauuuugauuuugcuuauuuuuaauaauucuggauagcauacccagggccauuuguauggugggcaagcacuguaccacugugguaggucaccagcauugguuuuugagaugagauuccauucuguugcccagguugaucugaacuucugaauacaaacaauucuuguuccuccgcuuccaaguaacucagcaugcuguuguaccuggaugaagagaacauuuuaauaccuaguauauuguaaccgauauuucacaucccuuccaugacuuagcuuaugaauaacuuuucuugguuaucuagaugauuuaugucuuugaaagucuuuaugaacuaaagugcauucaaacuggaagaagcucaguuagauuucauuaugaaaugaaguacaguauuugauucccuuuucaugaaguauguucucuaugaaacaggaagauugauugaaauuucaaggacaacuuaggcccuauaggaggaccaagccagccagggguacauagcaacuuaagaguuuguguaugaucuaacauacaaauaauuauaaaauuggccacuguaaauuuucuuguuugaaacagcuuuaggggccaauucauauaucauaagaguuaugaauuugaacuauacagcucccuggauugaguauauucacgaguuauagccauaauccaacucuagacucucucuuuauuguuccaaauagaaauccuaugucuagcagaggucguucucuccacacacacuuccacauuuuagcguaaaauaagcaggaaucuuugucucacauuugucuguucuagucauuguguauauaugacauugugcaguauguguggaucuuucacuugguguguuuuuaaauguuaagguucacccauguuacagcauagaucaaugcuauguucuuguuuauucugcugaaaagugucauugugauauuuguaucacauuucuuuuaagauguuggguguucuuguuuuuuauuuuggguuauuaugaagucagugcugcaagacauugugugaauucuucauacagguacauuuucauuucucuuggguguguaucuggacauauagcaucauuggguucuguuuaaagaacugccagacaguauuccagagcaguuccaccauuccacauucucaucggcaguauguuacaguuucaacucuccaucccagauacuuccccauuacuuguuauuaagucuuuuaaaaauauauaauaugcaugcuaauagauguauagugguaucuucuuauuuugcuucauauuugucuauggacuaaagauggccagaagcuuuguauaugcuuauugggcaguauugauuuuguguagacuuuaguccauuaauaucuagauguugucuaucuuauccaucccucaguuacuugggauuuugaaugugcauuccauguaaaauuacuguauggaugugaacacauuaaaggccuacuuauaaagccaaaucaaacaauuggauagguuuuuuuuuuuuuuaacacuaaaaauggucugccgggcgguacugcagugaugcacaccuuuaauuccagcauuuggaaggcagaggcagguagaucucugaguuugaagcuagucuggucuacagcaaguuccaggacagacguggcuacacagagaaacauuaucucaaaaaacaaaacaaaaaaaaaucuauauguaucuguguauguaccaccacauauguguggaggucagaaugauucucuucuuccauugcgugggcccugaagauugaacuaaacucagcagacuuaguagcuuagucuuuaccugcugaguuaucugacuagcuuuaaguuagcuuuuaacuuaguauuucucacaccugaaaaacuaagcaguaacuaguuuaagaaaauuucaguuuaugcuuguuuuccuaccauaaacuauaaguuuaucuucuuuuacucucaacuauaucuuuauuuggauaauaaaacuuaucaucguucuucuuguuuuaaauauacuuuaguuaaauguaaguauuuagcuaccuaaugccuugcucuauacauuauccugcuucaguagaauggugaguuccauccaucuucaagugauuguagaaaagcugagguucuguuuuuuaacagccgugcaugacauaaaguauagugguugcagguuggagccauguaagaaggcaugagcaaagcucagcucaacaauauuuuccuucaaguguagcagauguaccucauauauauaagcaagagauaagaauuauuggagaacuagagauagauagaaaauagaugcaguuuuugauuuuagagccaucagagaaugguaucacuuuuuuuuuuuuaauguggaagucaguaaaguuuucuaauacuuagauauaggucauuuguaaggccuuuuugguuuuucaaggcaguguuucucuguguagucuuggcuguccuggaacuugcucuguagaccaggggugccucagacucacaggagaccugccucugccuccugaaugccgggaaugccgggauuaaagucaugccuccaccuucuugauaagcccaacacuguauuuuuuuuuuuuuaauguaugggugcucuguuugcauguacaacuccauguuaauagaaagcaucagaucccuuuauagaugguugugagccaccaugugguugcugauaauugaacuuagaaccucugggagaacagucagugcucuuaaccacugagccaucucaucagcccucaggcccaacauuuuuaaagauaguuguacuugcuuaagaggucucugaugccuaccugagcuuucaguuguauuuauuuuuaucuuugucuuguaauuauauaacuauuguugagagugugaaugcacuggagucauagauaugcugaugguuguggaaagauuguuugaaccauuuacacuuucuuaugugagauuaccuuuuagaaauaaugccacacccuuaagaaacaguuaucugaacucaccgauguuacugguuugugauuaugcacuagcuagaaauuugcgacaguucuuuaggccaugacacuaacaacacauacacugucuucaguguaauuacuuacauaguauauuuuauccaaaaacucuuuaaaucagugaaaaaucuguuaccaacuuuuaagguaugauuaacauacaauaaacuauauacauccaaaauauauacuucaaaaauacuuuuuaauauauaguuuauuauuauuuuauaugcauugguguuuuaccugcauguauguuugugugugucagaagcccugaaacugggauuuacagacacaugugaggugcuauuuuuauauguauggauguuuuaccuaaacauguaucugugcaccucauguuguuccuugaacccugaaacuggaguuauuaaugguucugagcugaauuaaacucagguucucuguaagaauaaccuguacuuucuuaagcacugagccaucuuucuaauccaaaaagauuuuuuuuuucuaauggauagcuguucaaguuugucuccuaugcauguaggaucuagauagaaaaauaaggggcuggugagauggcucaguggguaagggcacccgauugcucuuucgaagguccgaaguucaaaucccagcaaccacaugguggcucacaaccacccguaaugagaucugaugcccucuucugguguaucugaagacaacuacaauguacuuacauauaauaaauaaauaaaucuuuaaaaaaaaaaagaaagaaaaauaaaauaucuccccugcuaauaccgguugucaauuuggauaagacacaccuaauauuaguaagucauacuaacucaugguacauuauggcaaagaacuugucugcauuuccuuugugugaaacuaacuuuaaagauaacagacuauuacagugaagaaauuuuaggguagcccgacauuuaggcugcuguuugguuaguacuagcuuuuuuaaaccagauuuauagucugaauuuagaaacgaaagcagugaaaaacaacuuggaaaacuugugagauuggcuaggaaaaguuguggacaaggaaagcuuauuuuuuagugagucauuagaagaagccaaauacuugacaauagaaaaaaugucucagaaauugaccauaccccacuaauggcaaucaaggaaauaaggguuuuuguuuugguuugguguuuugguuuuuuguuuuuguuuuuguuuuucgagacaggguuucucuguauagcccuggcuguccuggaacucgcuuuguagaccaggcugaccucgaacucagaaauccgccugccucugccuccugagugcugggauuaaaggcaugugccaaggguuuuaauucauuaaaagacugcucugagaagagaguuccagggcuaucugcuggcacaauaucaccugugaaaauacuuauugguguucagccauacagguagaagaucugcuacucuggucuaagaggucuugacuacuacuugaauuuacaguagauauuggcaucaaucaaacuagacugguuuuguaggcauacaggauacaaaguaaugugucauggagaccuccaccuacaucucaacggaagguuuugguaguguauuauaaagucaagacuccugcagucagacugagcagauaguguaggaaacugaggacaaaacccaaacauuacaguagcgagcccaggaagcuaagaaaugccaggaugccaaaugauuacugaggaaaaccacacuacauaagcagagccacccacacaaaauaccauauuggcuacagcuagaaagcuguaggggcagugcuacccacgacuuuaggcacccacaacucugccuaggcugccaggcaguguacuguuguuggauauaauguuugucuugcuggacuuuguucuuuaguuccaucucuucuaucuguacccuucuuccuuuuugaaguaguuauauuuacuguucuauuuuuaucuugggaguauauaauuuauuuuguauaauuucauacaggcucacagcuaacaauugucugagucucagaagaggccugggccuuuuguggguugcugggacuguuaagacuuuagggacuccuggaacuagauugaauacauuuuacauuaugagauggaggugagccuuugugaaacaggugcagaaugcuguggcuugaauaugaaaugcccauauaugguugguuugguuguuagcugguugguuuuugcagaguguuggacccugagggcucuuccuaaaagggaauugauguuacgauuaauuuauaauaugaugacauuauuaggagaugguaaaggaggagguagcacuuggaggaaguugaucacugggagugugugcugggaauauguaucuuuucucugcauguucauuucuguuucccaguugccaugaaguaagaacuuugccagaccauggucuuuuuccaucauauucuaccucagcacagguucaaaaauagaaccugcugaccacaaguugaaaccucugaaacccugagccaaaauagaucuuucuuccuucaaguuguuuuucuuagcuguuuguuauagugauggaaagucugacuaacacacguuaaucugagaaaaaaaauggcacaaauuguccacagaauauuuuauauucucuuauuuucuuuuuuuaaaaaaagauuuauuuauuuuuauguauuuaaguacacugucacugucuucagacacaccagaaguuggcaucagaucacauugcaggugguugugagcuaccuugugguugcugggaauugaacucagguccucuggaagaguagucagugcucuuaaccgcugagucaucucuccagcucuauucucuuauuuucacgauuugugcaucuuguggagaaaauauucuucuaccuaaauucugugcuugugccuuuuaaugcauacaucuuuaaaugagaaacugugagcaaauauaagcaugccauauugaucucaugaaauaguaaaugcucagagcaaaggauuuugcuagacuggagaauuaaagaauguugugaggaggacaguagauuaugaaaccgaaagacuaguagaagaagcagugcuuuggagccagugccuagagaagagaugugacucaucucuagguuauggccugaaagggaucuagguaacagucacaggccguggugaguucugacacaagcaaggucccuggguuuauagcuuugcuaccugcagugcucaucagaagcaugcuccguauauauguuuguacugaagcuggcuuuuuguucuggaacauguguaguagagcagcuaaguuugauugagcuaccacuuugcagcuaggguugauuauggccauauaguuacucuacagguucauugcugacuuaagagcugcaucuuaacuugggaacuuaauaauaguacccagaaauaaguucuauauaguaauucuaguacucagaccacuaguuugagaccugugaccuaaaacgucaugggccuuguuucuuauugccuaaugcuuuuaacugguuuccuuaagagugacagcuuuguuacacagaacacaaagaaacuguuaagauccccaagacuguaggacuguuccuuaggauuucuauugaugugaagagauaccaugaccacuuauaacauuaauuggugcuaguuuacuguucagcgcuuuaguucacuauuaccaugaugggaagcauggcugcauacagggagggagacauggugcuggagaaguagcugagaguucaacaucuguaugagcaggcuguaggaagagagaguggcacuggaccuggcuugaacaucugaaaccccaaggcacaccuccugauagugcuauuccugaugagucugugggggccauuuuuauucagacuaccauauacugauugaugaaguccacaccuuuuuuucuuauugacuggagugguuuuaccugucaguauuaacaguuuguuucuuggaagaucaaaugugaguuuccugaagagauucucaaggugacugagguagaucauuaggaauacuugagaaacucauguuucugcccaguuagagauuauuuuuaguuuacuugcugacauuguacuauuuuagauugggaaaaaguggcaauguaguuaguuacuaagaauacuauacuuggucuuagccagaagucugagaagugauaauuguuuaaggauaagguauacuaaccugaaaaaaaguaucucuguuaagccauacauaaaauuuucuuaauaagaauguuuucaaauaagagauuaguaucuccuguuuuucucuucauacuugacugaauucacugccuugaucguaacucauaacucccauauggucuuuuuaacuguguuuuuucuggaguaacagugguacuuagcuguguaagcuuuaaaugacuaaguacccauaggaggaggguacugcuccccaguuucagcugaagauaugucuuuuucaaacuuacuuuccaacuuucccuagaauuucucaguuccugaccacaugucagagacugaugggcaaaaugcuugcccacaggacggcacuugugauuccaucucugucuaucuguauucuucuuaucucuuuuaccuuuugcuuuuaaaacauuuuuuuaauggaaggaagaucucuuucucucaaggcaauaaaaggaagcaucuuuuuuuuuuuuaaguuauguuuauuuuaguguuuugugugugagagucugucugucugucugucugucugucugguguucucugcaugccuuuuccuggaacuaaagacauagauggagucacagucaccaugugaaugcugggaauuguacucagauugucuguaaggggagcagguggcuuaguggcugcugagccaucucugaagcgccagcaucuuucagauuguaccuucuccaucuuucccuuugagauuuccgauaagaaaauguuauguaugauggcacugggaggcugagacaggaagguuauuugaggguagugucagacaucuaagaaauuguaucuuauaaaaaggaauaugcaggcuaagguuguuuaaccuuacacuggcugcucuuacagagaacuggauucaguucauaguaccuacauggcagcucacacauguccuuaacucuaguucaggagaucaacccugucuucuggccuucauggguauuagguauguaugugguacauguacauacaugcagaugaaacacauacauauauauaauaaaaauaagucuuuuaaaaagacacuaaacugagauaugaucucaaaccuccuagacacguguuagugaggaucuagaagaaaguguccuccuaaugcucuguguagcaaaugugacuuggugugggaaaauaguacuuaaguuccuuuuuaaaacuaagacugucuuacaucccucuuaauucauguuuaauucauuuauucauguuuaauucauuaguauuaaauauauucucauuauguucaacuagucccuaacauucuuuuuaacucauaaaccuguggaacuaaauccuaauuuuuauucccuaacuccuugcagucagcauucagcuuucuaucucugaauuugacuccugggcaccucauauuauagacucauacaggauuuguugauucauauaacaugaugguucauuuguguuguagcaagugucgcuuuuuagagacugaaucauucuuggcucuauauguguacaacaugauguuuuccauucauuuauccaaguuuuuaaauuuuagauuuugcccuuuuaaacugucaacuuaauaaccuacagucaucuaagaggaaagcuuccauggaggaauugcauauaucagauuggccuugugggcauaucuaugggaaauugucuugauuauuagucaaugaaagaggacccagcccgcagccuagguaggcaguuggaguaagacagacucgcuaaguaggagccuaggagccacccagcaagcagcacuccuccacggugcuugcuugaguuccuguccugacuucccuugcuuauggaccuuacccacuuggaaguguaagccaaaagaaaaacauuuucucuucugaauugcuuuuagccagacuguuuuaucacagcaacagaaauuaaacuagaagagauuuugaggaacuaauauucuaauuaguuaugccauuuuccauuacugccaacaguccacaaagauuuccaguuuucuggacaucuuuccacugcauuuuauuuucuggauuuugaguaguacauaucccaguagguauacauuaacauuucuguuucccuaugcugagugagguugaguauccauucauguggcuguuaacuauuuguacauuuucuuuuuuuuuuaaaagauuuauuuauuuauuauauguaaguacacugcagcugucuuuagacacuccagaagagggagucagaucucauuauggauggucgugagccaccaugagguugcugggauuugaacucuggaccuuuggaagagcagucggguacgcuuaccaacugagccaucucaccagccccuguacauuuuucuuauggaaauuaaagucaaguucuuuuaugugcaauuuauaauuauguauuuugcuuauuuuuaaauuggauuuuuguugcuauguuuauauuaauuugguuuauuguuuuuuaucaacuuuguugaaauuuaauauuaagauaagauggggggggggcuguguacauauaggauuuuuuauucuccacagagugauacaugcuaaggugggcugggcuugggccaguguccccauauguacagaauugaauaaagugggucccugauuugccuugaugugaaaagggacaugggaagaagauggcuguuaagaccagaauuguguuaguccugugcugguccugguuuggaauguagggagauaaagcagcucuuccuguguggucccuucuaggcagggaugccugcuggguuuggagggcuuucuauaccacauuuucccacugaguauucaguaucuuuugaacccaggcaggaacccucgguccaggcaggcuuucuccagccauugucuucuucaccagcuguguguucuggguccauggggauagagcugcucaaugcugcagcucccucucaucuucauccucacucucuaaugugagucuggcaaaugaagccccagggccugcauccgguuuuggauaccaucagcucagucuucucccucacccacuggugccgguuccaucucuucuuguucaggaucuugacugaggggcuggcacuuguagccugcugggccuguucguguuuccuccugcucuuccucagauucuucacugcuguaggacucugauguggcccuaaguccacagucugauuaggggagauaugcucagggaccauggugucuccccuaaaaguacuccugccaucugggcaggggcuucucagagcccacagccagacccucaccuucacuucugucggggcaggacaugcugggacucuuuuauguuuuucuuacuaaacauuuuaaaaugugcuagccauaugaaguucuauaaacacuaccaauuuuaauuuuucaaaauuaucacuuggucauaauugggguaaaaguaauaacauuugaagaaugcucacauuaaaauucugauagcuauaucagccauuuuauuacuguuuuagucugcacaauugggauaauaaguucaguguucuuuuuaaaaucuuaucauucauuucuaguccucaagauuuauuucuaacaauucuauauaaaaagauuuuuguacuuuuguggaaaaauuaacacucaagcaaaguguagaccagaaaagaugaaaagcagaugaaauacaaaguugacuuuugaucuuuugauuuugugaacuggaauacauuaugagauccugcauucuuuuacuccuugaaaauguucauggcaauagcagaggacucacauaugaaaagacauuuuuaaaaaaggacucugucauugcuuccaccaucaccauguuuaaauuacaauguuuguaacacuuguguguugaauugucuaaaacugguguguugucauuccaagucucaauccuccacauguaaccuuauuuuaaauauccauuaauuaguuaagaugaggucauaauagagaguauuuuaaguuucuaguccaguauaacugaugacccuuaaaaaggaaauuuagagacagguguuuauuuagugaaguuccauaugaaggugaaaacagcuguugguacaccaaggagagaggccuguaagagauuguucagaacccuugaaaagaaccaagccugccaccaaggacuaugguuaucacaugucuuugguuucuuauacuucauuacugucaccuucaaacacuaauaaagccuuuaaguaggcccugcccuauuugucuuagaaaugaacuucauccuuugugcugaugaccacugcugcucaggggaacacuugaaaaucauguagauaaaucagaaacaaucuuugucaucagcauagccagcaucaugaaguaugccaguaccaugacuagguaaaucauuuaaaaacgcuuaaaugguugaaugugaguuuccauaugacuaaagaauuccauauucuuaaauagaaauuaaaauauauguucacaagaauuuguauaaaaauguuuguaaaugaccuuauuuguaauuuugagggaaguaaaacuaacuuagugucuauuaacuauacauagauuauggcuacauguguauauuagaaugcauauggcuuacagaaauuaguacaauauuauuuucacaaauuauguuuguaucuugaaaggcaugcuaagugaaaugaugguuacaaaagaccaaauacuuguaaucaucccagggauaugcuauaucugaggucauuuguaaaucucugcguaugagaacaugauugagagccguagguuccgacuuacuuagaaaauauuuuacuuuuauaaaauaaaaaagauuguuauuuugaaacaguguauuagaauucagauuuuuaaaaacaguaaaauucuacuauaucuugaaauuucaacaucuaccuauauaccacaucauguuauucuaguguauuagcuauauauuuuacccuuuuuugcaaagaagggcauuuuuuaaugauuaaaaaugauaaaacacagacugaggccuaagaccauacaccaccugcuauccccagugucuuucaaaacccugcuugacucuaaugacagauccagaacagggaguuugggugugugcugcuugguucacauguuucuuagggguaauuagcaauaaaaagauugucaaagaaguaguuguuuguugcuagcuuacuuuugucucuuugucuaauuugaaggguauuuacucuuuuucuuuuuuuuuuuuuuagugguuauccucuuuuaccauauauagcuaauaaagauacauuucuuacagcuguacucuccuuuucaugcaaauacuaucaugaaacucagagcuccuauagcugaccauucuuccuuuguucguuuaauuguaugcaaaagaaauucauaaugucuuaacacaggauaaguuuauuaaugaauucaaguuguauuuaagauacaacgaggcccaguucucccaguuaugaucucauuuucaucucuuugugcaggcaaagugcagcuucaugcuuguugccccagcagacaucuaggccuaucuagacuuuauggcucugaucuaaguagaaugaacuaaugacaggaagaaucauuugaugcauucugagugacccaacuuaagauacacauucaauucuaaucuaugaccagauacucugguauaauucauuucuguaucauucauucauucugagaccagaaguagaaggagaguucagugccagacagagcugauaacaagagugauauauucucagauguaaaggacguuaguuagcacucaggacacaaagguaacaaggaucagucaguauacauagugaggauucauugaacaaaauacaugagucccuguacgagauacauuuuuuauaucacucuuagaauucaguagauacaugugauucuugaaacugggcuauggaauucacaguacuagaaaaguaugcugaguugguggcaugugcuuguaaccuggaacuuggggagacugaagaccaaccugagcuaaaccguggacggagggcagaaaggagagaggguugauuucagaagacauuguggauaaugauagacagugaguuggaacagugauaaaacauuggaaauguugaaccauugguugaaauauuuaaaguacauauugguuuuuacccuuaaagcgaacuacauggugguuaauaucuuagaacaguguagguccuauguaaaauagaucuuuccacaguaacagaaauaacucaugucagcauuuccauguauaacauccacuagcacacugguacugagcaaaugaaauguacuuaaugugacaaaagaauggaguuuacauuuuuauuuaauauuaauaaaaucuaaauagccacuuguggcuaaauguaccuuaguagaaaguccaagauucagacuuguacuuuauucucuucuuccccuacauuuaguucuuguaaugcccugagcagcuuacuaaacuuucuuugccccuauuucugcauauauaugaugaagauaaacggcauacauaucuucaugaauuacuuuguaagucuaaugacuuaguucauauaaaguauguugacauuucugugauauauggcacuuagguguuaaucauuguucuuauuuucacuguuagaacaggagcuaaggaaacagccaguaaucuaacaacuagaggcuuuuuaaaaauauuuauuauuuaaauuguauauacauagauaugguacacacacguaaguacuggagccauguuggaucucucuccuugacuccaaaauaaaauuacaggugaacgugaacuggcgauguugaaaacuaaacuguucuuuggaagaccagcaugugaucugaaccacugagccaucucucuaguuuccagccacuaaaggcuguuauuagaaagcuuugacauauaguuuugauccauuuauugacaauguacauguuacaaauauaguaaacaaaguuaaaauauauuuggguauauuucggggcuaucauuuaguguuaaauauugccaaauuuguugcuaaaagagaugaugagauuuuuaucaaaccaguguuggggguggggauuugccgcauuaaaaaaauauuuuagucauuugcuuguaauaccauucaucucacuaauucacaucuuuaucucuuguauguguagugcuaggguugaacucugggccuugugugcccuauacaaggucucuaccacuaaacuguagccccagcccuuuuucauugagguaggauccugcuaaguuccauacauuggcguugaacuugcuauaugucucaggugggucuuaggcuuguaaucuuccugccuuagccuaccagcuagcuggaauuauaaacucacuccuauacuuuucuaaagggagauuuguauaguuuaauugccaaguuucauuaguuagauuccuguacugagcuccuuaugccuuuucauuucccugccucucacccaauaauuuauuguaauauucagaccguuguauagagguugguugauuguaaucugcuaagcuauagacucugaaguaugcccugccagacucugguuuuagcuuuucauuuuauucauguuaaaagugguggacuuuauuauagcuaggucaucauauauugaaguccaucuacuucuauaauuuuuguaucuuucuccauuuagguauuuccuaagauauaccaucguaaggggggugggacccuaaauuuuuuagcuugauuuugagauguuggcuuuuuaaagaauuauuuuccagucuuccuuaucuguugcaaguaauuuuuucucuuuaucaguuaauauuuucagguuuuaaaauacuuuuuuucauuuuggaccaauaugcugauguauaguuuuuagaauuuuguuuuuaauccaucuuaaauugugaacaaauuguuuaauucuuaacauuuaagugaaauccucugaccaaguuacaaaacagacacauuaaauuaagaauaaaagauaguguuuaguaugcauauuagauacagaugaacuauguaaaaaauacuucacugucuuuaugaauuguccagcauacaugucuuccauaauuuacuacaucaauucaauaagaaugagauuucuuuuuaaaguuuuuugucuguuucauacagauaaacccaccuuacacucuuucuuucuuuuuuucccauuaguuuauuuauucacuuuacauccugaucauugccccuaccuuccuucuggucaagccucccucuuccccccacagucccuccucccauaccucccuccuaagccuaguccugcagagccuugaugugccaggguggugggggauacccaguugagauuucuuaaauagcaguuucucucuguagugaugacauacaaauuguuuuacauuuuauuuacaaagucacauauauaauucucuuuaagacuuguguagaucuuuaaguuuuaaauugcauaauuuuuagaauuucaauccuuuaugauuauauaguaauauguauguguacucaagauggaaaacugaaaaggaacaaauuuaaacauacuaugggaauaauuagauaccuuuguuuuaggacugacucaaagcuuucugaauucauuuuauuuuuaaaaccaugucauuaaaauuuuucuuaaaaugaaaauuauaguugagaucuuuagaauuguacacucuuugaguacaaauaaaaacuauauaacucauggugagacaugaguccuuagccacacucaguguucuucugcuuuaugggcuucuggagucagauacacccauccguacugcagcuuuuuugaaacauggaacuuguucugaauugugaggagggggaugcauacaagcuguguguuaaaaugguagagccacuuagagaaugacaccaggaaccaaaaaauggaauuaagccuggaucucugagucaccacauagaauaaauauuucaagaucucuaaaccauuuuccacuacuguguuauaguuuucuuccugugauuguuucauguuguuucccaaauuuuaaagacucuaaaagccuuccuuaguauaagggacuguagugcuugcagugcugguagcugugugagucuugcaguaauucugaaaaauccuaggauauacagcacuaggcucaaaauuuucuguuacuucucuuuacagacuuuguccucuuaggacccaguauaauuagcuagugcucucuucugaguguuauauacccaagcacuuugaauacuguugggcaguaacaugauuuauuaccaagcgcagauuucucugugcacauagauaauguaagcuugcucucuacuuucaaagagaaacaggaugacacugagucuuagaugguuaaaaugaaauuugucuuauacuucucugaucuucacaauauuugauuaauagcuguuuguuggaaugaggcauauaggucaccccagaucugggucuggugagguuuuuuauuuuuuauuuuauuuuauuuauuuguuuguuuguuuguuuguuuuucguuuuuucaagacaggguuucucuguguagcccuggcuguccuggcacucacuuuguagaccaggcuggccucgaacucagaaaucugccugccucugccucccaagugcugggauuaaaggcgugcgccuccacugcccggcaaggcuuuuuuaaaaguuucugaacuuuaauauaaaaugaacacuuauucugaaauuguuugcagauaguagcuagcaucuucuaguguguuugacuaucauccccaaaacuuguaaggauauuagugaagauuuuuaagacauggccucuccaaguagucccagcuguccaauaacucuuuauguagaccagauuagccuugagcucacagagauccuccugccucugccucucaagugcuaagauuaaagaugugugccacugcuuagccuaauaaagaauuuuuuaaaagauuuauuuguauuuuauuuguguaaauacauuguugcuguccucagaaacaccagaagagggcauuagauuccauuacagaugguugugagccacugugugguugcugggaauugaacucaggaccucuggaagaacagucagugcuuuuaacugcugagccaccucuccagccccugauaaagcauuuuuaauuggauuugaagaaauggcucaguggguaagagugcuugguaugaaagcaaggcaaccuuauuucacaucccccaggacccauauaaaaaaagguuguuggugcuuguaacacuagccuuaauggggagagaaagugaauucuggaaguuuaccuugcuuaccuuaaugaaguucucucuucccagaugacaguagaugauguaaaauugauuuagaacaaaaauuauuguaccaguauacucuccuucaaauuaauuuacauugaaaguuaaaauauaguuagaaaucuguuugaauaggaaggaguuuaagcuggaggauaaaauaauugguugaaugaucugauagaaauauguuuguccuagagaaaccaccaaauguuuugaaccuugguagaaucaagugugaaagaauuuguaauuucaagaggauuagcaguagugcuugcagugcugguagcugugugaaucuuguaguaauucugaaaaauccuaggauauacaacacuaggcucaaaauuuucuguuacuucucuuuacagacuuuguccucuuaggacccaguauaauuagcuagugcucucuucugaguguuauauacccaagcacuuugaauacuguugggcaguaacaugauuuauuaccaagcacagauuacucugugcacauagauaauguaagcuugcucucuaccuucaaagcaugauauacaacaauguuuugaacugaauggugcucacuccuugccuguauguaccagagcaguaguaccccuagaguauacuauauuuagcuacugccuuuuaccuuuugaaaagcaaauuugaaucuuuuauuuuuaauuaaauaucuaaaauagcacaauguucauaacagcuucuuuccauugaagggcuaagccauagcuugccugaacuccuggugcgacuucuccauccucucuccugugguggaaacccuguuuuguuugcucccuuuguugcauuaaccuucuguuucuagucuuuucgguuguccaauccucauuuaugacuuuccaugcucaucugcucuuucuuucuuuggaauagacucucuuuauucuugacucuuuucauucaguaaaucauaaaggcagcuuguacuccaucuuacccaggaaagcugugguaacauuuuaauaaauguucuaggauaucuaaguagcuauuugggaaaaagaugaaauuugacucuugucuagcucuuuguacaagaauaaauacagaaauggcuaucuauguaaguauucauaacaaaaaaggaauuaaccuaaguguuucaucggccaauaauugauuuaaaaagcaugauguaucauccaguggaguguaauauaaaugaaauuacugcagcuuacucuuuccuuucacuuugggauggugucucuuuguuuuuguuguuucgaggaagacuuuaucuguauaguucuggaacucauucuguagaccaggcuggccuugaacucaagagauuggcuuguuucugccuuccuagcgcugggauuaauguaugcaccaccacugcuggcucaaaucuuuucauuuuaaacugaugccuuuuaauggucuuuuauaauugagucaguauuuuauuaucuuuaauuuuuacauagaaacauaauaguauacuaauuuaaaauaucgccugauugguuuaaagccaguauuccauuuuaaucuuagagaaugcugaggauuuaguccuuaucuacuguauuucucacaccucugucuuuuccauuuugauaucucuuugggagguuauuuaucacaaguaccaaggcagauaccuaguuagcauacuacacauuuuuuauugauagcaaaaagagaggagcauuauuacacuaaucuuagguaaugaaugaguuaucaggcacggaaaucuuucuuaauguagcuacaggcuaauuauauauucagcagggaggaaauacuaagcuuuugauaauguagcucaguagaauagugcaugcuuagccugcacaaaaccugaauucaguuguagaccugagaaagauuucuuauaaaaauuguuacaugagggauuauaagaugucucaguggguaacucacauuguaggagaagaugagcucuacagaguuguccacacuaugaaugaauaaauguugcuucaugacaucaaaucauaccuaaagauauaagucauuuuaauggcacaggagcuaggcaagacagggaagaaauuuaggaaagaaucuuuguggcucauaagucaaguggacgacuuggugugguuccuaaucccuucauguuuguuacucuuuuuugugguuuuucgagacaggguuucucuguauagcccuggcuguccuggagcucacuuuguagaccaggcuggccuugaacucagaaauccgccugccucugccuccugagugcuggauuaaaggugugugccaccacgcccggcuguuacucauuuucaagucaucaaauaaauaagaguaaaccagccagguuuguuggggccaucucccaaguaaugucgaaaaggacuguuaguguagaaucucauuagcugguuaaucuuacuaccuguaaaacagggaucagaugccuugaguuuuaguuauugaacucuaacuaagguauagaauagaauauuucugagaacacuguguuucuuuguuauuuccuguuaaagcauaauacuacagaugugugggcuguuuaagaguucagcaaacugaagaccucuguaccuuuauucuuuauugucaguuacuaggaaucuaugucuuuauugaguauauuaugcuguuugagaaauaaaaauuaaguaaaaacuuagacuacuagagugucugcuugguauaaaagaagcccugguuuucguccccaugcuacaaaaaaaaaaaaaaaaaaaaaaaaaaaagggaagggaagggagaaagaaacaaagaaaacagaccacaggaauuaaauuucuuccuuccuuuugggcauuauaauuuccuguucagauaaaacagacaguuaaggaaugaaggaaaacuuucaggguuuaaaugccuuuuuuguccuuagggcuccuguagugucuacagcacaagaugcuagguugugggcuauugugcucacuagaagacccacaggaggggcagacacacacacaaauucuaauaaacauacucucacaguuuaaaacuguuuugaguuaauaguuagagaauuuuaccucacaaaagaaaggagagagccaagguugaaaaaaaggauucugcguucaaaaccagccuggguuauuauauaggaagccccuuucagacugccagggagagggccaacugggaaagguuguacaguugcuaguggacaggcccaaacaacauuuggcaucuguuuucuuucuuccuccucuucccucuuuccacucuauuguuuuuucuuauuucuucccucuaauuuuuaucauacccccaaaaauugacaugggugaaaaaaaauuacguauucuaaccauacgaauacuguccuauacuuauacugucuuuguuguuccacgauuauccucaauuuuauuuauuuauuuauuuauuuuuaauuuuuugguuuuuugagauaggguuucucuauguagcccuggcuguccuggaacucacucuguagaccaggcuggccuugaacucagaagucugccugccucugccucccaagugcugggacuaaacgagugcaccaccacgccugguuuauccucaauuuuaaaaacaucuaaaauccaaccaaaugcagugcuuuauuuagguucauuuagugguuuguaggcuucugauuuuuauaaaaugcacacacacacauauuuauguauuuguguaacugucugcaugugugccugcacacuagaagagggcauuagaucccauuauagaugugaggcuguguguuguugauugaaauugaacucaggaucucuguuaagagagugcucuuaacagcuaagcuaccuguccaacccccucagauuuacauucuuaagaguuuaggcuagcuuuuuagcuagagaaugaccaauaaucuaaauugugugauuauuauguauuuggagauuaauacagcauauauaacuauuacaucagaagacaaaaacaagucauagcguaucuugaagaauuucgcacuagauaucugcaguuucuuccuaguucucauaucuucauuguaccauccuguagcauguauguucuuucuguuuagcuguucuaaagauauaaaaauuaaaugcuagccuaaguucccccaaagcaaccaucccagcucaucuccccccccccacacacacaccagaaauagucacuacuucuaacaaaagguacaagugauuuuuuucucagaugaaaucuuugcuaaguggcaagcauaauuucaaggcagcuuuacuucaaaauggcaacaagaacuuguuauguagcagauggacaugcugacauacauaauaaaaugaagcaagacacuuauggcaaaaacugaaaugaguauuuccaugcuucaaaugauaaucuuucuuuuuaagauuuggaaauacuuaggucuuauaaauucuaaauuagugagaaaucauaauuaaaacauuuucagauagcuuuaucaacuaaaggcuucccuuuaauuugaaaaaaggguaagcaagcuguugguagugaaccccaguagcacacagugcuuguuuagcagcugacuuaagguggacuccauagcacuggagggagagaagcaaaguccaguaauaaacaguccccauucagucuuuacauuucaagcgucacacagaaccuuauuuucacugcuguagcaguaauuaccuaaguugacuuuguuauccuaucacuguuaaaccaauuuagaaagcuuccuuucuguucucuuaccuuuaucaugcauugucaagauuaucuuuuguucuauagucagaaaaaaguauauauaaaucugugaagcugagccagagccuguuuuggggaaaggggcguuagaaaggaauacuuuaaggaaaauaaguauauuauaaugucuguagcuuuugucuuggugcuugccguacugcucuaaagagcccugcugaucucagaaacuauagaauuguauacuuuguacaagacaaguuugauuucuaguuagugguacauguauuuuuuuccuucaguuagugcagguaauaugugagcauuguccuuagagcauuucugcauucuuguggaaauagaaucuuuguuuaacagaagaggaaacuaagauaaauagaauaaagacuuuucaguuacucaguguauuauccaaaaggugagacuaaucuuuauuuuguuuuucuuuucaugcuuaaugaguuucuuuucauuugauuccuugucuuacuuaagucauccuugggcuaagguagacagcaucugacagcaagcugagauauccuuugucauaguucugucacugucuccaucuauuggugugaagaaguaaugcuucuuccuaaauaugcagaugcuuuguuuuagcaaaaacacauuaagcaacaaggaauugcccccuaaauguauuaucuuuuccugugacaaaaagucaguuuaaagauacuaaaagugucaugagaugucagcuuuuggaguguguguguguguguguguuuuagugauacuaaagagucacuuaaaacuuauauauauuauauauauuaaaacuuauauauauuguaaguggugugguagugcacaccuuuaaucuuaguacucaggagccugagucaagcagauucuuuggaguucaagggcaggcagagguacauagugagacccuguuuugaaaaaacaaaaccaaccccuccaaauuauauauauuaacaauaucagauuccuuacuuuauucuuuaggaaauaugaucauuuuaucuuuuuugcaauaugaucggaucaggugucauggugcaaaaaaguaauuuuuagcaagaaaccucccaaauccuggcagucuuugcauagucagauuguuagcucuuacaucauugcuucugacuuacuaaugaagagcucaagauagcuucugaugcauuccagauauucuggguggugacuggcuagagaaucacugacaucacaaccagcagcuguugauuucuauugucucuuaaguccucaguaagugcuuuauucugcuccuggugccugacuaaucugaguguucagcucuguagaggagcaaugcagagugucaguguacagacacuauggaaaaugugcuuucaguaacucuguaugaugaagcagaugacaguacaaugaagguaugugguucuaaacucauuuuuauguuuauagaagguaucaaaaagauaaauuauuuuuguuuacuuaguaccauaauuuuuauuaaugauuauaugcaauaaaaucuaaaauuagggcauuuaaaauauuauuuuuacaaagauauauaugcauuuagaugguuaagagucauauaccuacaguagugccaauuccuuccuauaucucagauuuucaacauuucuuacagcauguaaauagagugguuuaccugugugcugguuuguuuuuauauauagcaaaacaaguugucaguugaaagaaauguuuuguuuaaguucauuuuaaaauagaucagcugcauggcuuguucaauuguuaaauuucauuauggagcaaauaacaaugugaacgagauacugguuggaaaugaagaaacugaguucuuuaacucuuagaacccauguuaguauuuguggccuugauuaaggaaggcauagauaauuuuuaaaguacuuaggaaaaaauguaaauuugucuuugcugugagcuggcauaaugaaauaccauguuacaaagagaagaaauguucacucccacucgaauucuuagaauuaccugauuuucuaauuuuaccgucugaaaacuugacauccccuuguuuuccucaaaacuggaaucuuacuucaugguuaugcugauagggacagugugucuacaaggaugcaacugacuuguuuauaaaaauuuuuuuagguuuuuuuugucuuugguuuuuuuuuuuuuuuuuugagaguucacuugcuuuuuaccugacauuaguugagauuuuaacaagcuuugcaauugcuguggcaucuuuaaacauuucuacuuguaugacaauucuuuuguucuuaagaaauaacucauuucaguuuuagagaacauagaaucacuaaauugccacguaggaagacugaguaucgucuuuuguucucaacuguguuuguaauuagguucauaaauauacugauaucuguuauugaaacuagacuuuuaccagaugcaucauuucaaucuugcgcuuggaaaaaacuaccaccaucuuuuuaagcgucggauuuuuaaaucuuuauauugaauacuuccaaaaaagaauaaaaauuaacaugagcaguauuuaucuuuuuguuuguuuuuguuuuguuuuacgagacagggauucucuguguagcccuggcuguccuggaacccacucuguagaucaggcuggccucgaacucacagauacaccugccucugccucccgagugcugcucucaccuaaacaucuaguucacuuuuaaucuuuuccucauccccuguuccuuugggguuugucuguggcucuuuuugccucuucucuuaauucaucuccccucuuccaucuucuuccccacuuugucuugggcuuucugcaucagaaaacuacaucuacuugaugucuuaccuuccuuucucugauggagucuauauuaaccuuuucucuccuuaauccccuccucucguuucauaacauucacugccuuuucuuucucuuuccuccuuccucuccuuuucuucuagucucuggucugguugucucgaccucugucugugacuaccgugugcuuccuccucucucccuauaccuucauccuccucugugugucacccucauucccuguguuucucuuguugacaugucuguaucuccugccucuggcuuuugagguuuuuagguuuccauuccucccucuugcagcuaucuucuuucuuugcuucauauauaagauuucaaugucaccgaauggagaagaucaguugacuuuaaucuguuuuguuguugcugcugcauagucagcagcaguuccugguugcauuuaauuuuuguuaaaucuguucucccucaaacugguagauaaggaguuaugaucuuaagguuauauauuuuaaguaaacagacuaauuuuagucuuaguucauucuuuuaaauuuauuuauuauuauauguaaguacacuguagcugucuucagacaccccagaagagagcaucagaucucauuacagaugguugugagccaccacgugguugcugggauuugaacucaggaccuucguaagagcaguccaugcucuuacccacugagccaucucuccagcccuuaguuuauuuuuuuagagcuucaugcuugaagcauuguaauuaaauugaaguuaucacauauuaaauauuuuuaaauacuuugucuucccaaguuguacauggguagaucauuacgagacagguuucuuuucguaagaguuuuuuuuuuuuuuucccuauuaaaauuucagguucauaggaauugaaaggaauucaaaaucaagacacuuuaguuauuucucucuuuauaauugugcugucgguuaugaauaaauuuguauuuauuuaauacuccuaaggccuuuuaugucauuacuuuucaaaugugucaugguagacuuaauaugcucacauuuucuaacuugugauuuguauuuugaaguaacuauagauucaggggauauuacagaaauaaauaguacagagaaguuuccugguagguuuuguuuguuuuaaauagauuuuguuuuuguuuugcuuucuuuugcuuuguuaguaaggaaugaaccccagaccuuguacaagcuaggcaaaguacucugccauugaccuuuaucuucaggcauuuuaaaauuauuuuuuagccagagucuugcugaguugcauaaacuacuucauuauuacucgauagcaucuacccaguaaauacaagauccuuccugagucuccacaguagcuaucauaugaguacacuguaacaggaaaacacaagaugcuuuaaagucuugacacuuuaaaagugauauccucaagauuuuguaacgaguuuuuaaaauacccuaaagcacaagaguucacuucccauuuaccuaaauacaaaaauccuaaaucuuuuaaaccuugcaauaguccuauuuccauuaaaagcaaauuaagacgacuuguugaaauauucuauguauuaacaguaccaugaugguuuuauaacuaguauaaucuuaccacaaaaggaaaugcgugaaguuuucuguacauguauuccuauguguguucaagaaacagauauagaaauugaauuuuuucagaguuaaauuaaaugcuguuuuuacauauauacuuccugcccccauaaaauguagcaauuauuacuucuacauuguuuugaugacucuaauguuuuauuacugucucugguaugugauuguugugggcaauauaaggugaaguuagaacccuacuuccaauugucucuauaagccucuguagcuaaucaguauucauuuuaauugaucuguguuaauuuugguacagaauacagccugaccauuccuaauccccaacuccaaaaugcuaaauaaucuuucugaauggcaaaauggugccacauaaaauauauucugcgacucaucuuaugucaaagucaaaaugaagacacaccaaaaauauaaauaaaacugccuccaggucagaaagauagugucuuaguuaggcuuuuacugcucugaacagacaccaugaccaaggcaagucuuaggacaacauuuaauuggggcuggcuuacagauucagaaguucagugaauuaucaucaaggcaggaccuggcagcauccaggcagacuuggugcaugaggaggugagaguaauauaucuuccucugaaagcugcgaacagaauauuggcuuccaggcagcuagugugagggucuuaaagcucacauccacaaugacacaccuacuccaacauggccacagcuaccuuaacaaagccauaccuucuaauagugccacucccugggcugagcauaugaaaaccaucacagauagauagauagauagauagauagauagauagauagauagauagauagauagauagauagaugugugugugugaaugguugguuguugguuggauacacacauauauccacaugcauaugcaaaugugauuuuaauaaauuauguguguguguuccugccugucuguauaugcaccauguguguucagguguucaacaaggccagaagaggguguuagagccccagaaguuggaauaacagguaaucaugagucacuugauauggaugcugagaacugaccuuagguccuaugcaagagcagcaaauauucuaaacgucuaagccuaaacuaugucuccaagucuaaaauauguuaaauauguuuuaaauaaaaaaaaacacaccugaucucuaguauuuggggcaaacgcuguuuaguuuguauacucaguuuuacuaagccaaaauucuacaaaaguauaacucaguaaauuuaauggagaaagcuccauuaauaucucauugcucagucuuaauucuuacuugaguagagcaaguuuauaugaauauaaauaaauuucuugguucuccagaugcuuauguaugaccagcauauaaauguacauguauauuguguguaagauaggguuucccuguacaguuaaaacugacuucaaacuugcuguucuccuauuguaaccuagaauaacagauagacaccaaauagcccuuuauuuuauacacgcauguuauaaaaugaagugcauuauguagcauauaaacaucacaaauaauguuauguaaaucugauauuuuugcaaauauuuuauuaucuaguauacguauuuucuaauggcuuuauagcuaauauaaaucuauggauguucauuuauauaauauacaugcaggaaauaaaaaacaggguuuguuaagauuuauguggugcuuguaaggaaccaugagucuguaaaacugcauguggauuaugaaucugcaugaggaaggaagcaccuguagaggugcuauaucugacuagaaguccuuggauuuauuaauaaaauuucaagaacucaucauggucuaagaauugccacuuuaucugcuuuauaaauugaugcuaggucuguuauuuuuuacuuaucauuuccuuauuuuuaaauguuccaaggaguguguggcuguuggcuagaauagcagacauucacacagacaccacaguguuuucgagcagcuuuugcuguuguucaccuaagcagaaucccauguaguccaggugggccuugagcucugcauauagugauaggguuacuuuuaacuucugauuuucuuuccucccccucaacaccacacccaguuuauuuggugccuguuuauggaacacagucuaccaauugaacuauauccccagccagacauggcuauaaaauacacaaugaccuaugaaaacugaacauauaagacagggucaucaagaaaguaacaggacauuuuacugucaguaauuuugcaguuguuacugaaccacagcucuccuuaccugguauagagugagcaacaacaaaagcugggcagugcaugaaaugggcaguuguaaaauaacacaaaagaaauuuacuaaguauugacaacaaaaugagugagacauggcuaggaaauaaugagggaaagucauuuaaaagugaaacauucuacccauucagcuuccagccauaggaagcugagccaauuaagauagcaguguagguacuuuaaaaagacuauacaggucuuccagcuccucuugcucaguaugcucuguaaugggucuccagaaacagugagcagcugagcacuguuugcccuuaacagcaggcaaacaaacagguaaaguuguuuguacuuuacguaaaaggauaguuuuguaguguaugaggaugggugauggaaacagaaagaacgcuccuggucuaccaaaaaucugguuuuaaccuauuuguuacuuauuauaaaaugauuguuuauucaaggaagauauaaaaccuuuugagacccucaccccaacccuauauaauccuuagagaugcuguuuugaauaagagcuggucuuuuguuagaauguaguuggcaacuuaauuaagaauaacacauuaaaaauuauaaaacaggugucugccaguuguaucuuuaauuaaaauucuauagaagauacgcucagcaucauaaagggacaaaguuauguuagauaauagaaguuccacauguugguaaaauauauuaagccacuaaagaauuauugggugaauuagauaaauuugccugaaucccaguaugaacuuuguaagaugcugaugguaaaccauuguaucuuugaaacucucaaaaggguuuucauuauuaugaccuugaaaugcaaagucauggguaaaggcuauaaaacaauaauuuacuauauagucaguacagaaaacuauuaaggaaaagauaaucauggaauaccacauuagagucuauuaaauuaucauaaaaacaaguuuuuuccaucagauuauuauaaaacagaugugugcacauugauaauaugagaaaugauugaauaaagaaagagauuaauccaaacaugaugccuuaugacuuuaaucacagcacuaggaagguagaggccagucuggucagggacuggaacauagggaguuccagacuagcuaaagauacauagugagaccuguuuguagagagaccaaaacagagcagggugugugugcauguguacgugugugugauuauacugagaauggugugagccucccauagaccacaucagucagagacccauccagcaucaucucccuaauaagacugcucaguggcccaaaugagucaccuuacagggauaaacauagcaggcccacuaugaauggcaaagauaguucuauuucagaaauaccagccacaaaagccagucagauccuucauuuuacgauacuuguuucuauaacuugauaaaauagaguccuucauuagggaaauaauaggcuuuucuuauuuaugagauaacucugaguuugagaauggaugaguaaaugcugcaaccucugauugauucucuccuauugguucuauaccuuuaagcaucuccaaauaaauaauagcuaucacaauuuuggggacgaauuucaaucaauucaaucaauucaaacucaguauuaaaaccaagggaaaucuuuguucucucaucuuuuauguccauuaucuugagcucucuucucacaggaauauucucuauuguuuauucccuaaauuugagcauagauguguuaggaaguuauuaauacaccuuuuaugcagagcuacaauacuggaccugauuucaguauguuauccuuugcuccaucugccgguagcuaaauuccuuccacaggauucuccauaugcucugcaaucaauagccaugauuuuccaguuuuucuucuucugauccaugaccugcuagcaucucacaugauuuaauucacuuuguugcugaaaguucagucucuaacaguucuggaagccauugaucugcauguugcugcuucuaagaaucuucagcaccauccucagagaacuggaaccagccuuuccccugguuaccagacaccgcaggcuguuccuuuccugcuucucuccugcuucgguucucuaaugaaaacuggaccuucuauucuggcuuaaaccaggaucccuaguuaauaauauaagcauaugaguaaaauucuuuuaauacuuagcacuccuaauaggucuugauuugggggacagggggccuaggcugugcauaugugcugcuuuuuuuuuuuuuaauguguagauauugacacguauaccuauggaggccacaagacaacuucaaacgcuguuccucuaucauuaucaacuaaccuggaauucacuuaguagguuacgauuaccagcuaagaaaccccaaggaucucaucuagcacuggaauuacaaguacgcccuuucauaccugacauuuuuuacaugguuucugggaaucaaacucagaucuucaugauuguacagcacauauuuuacccacugaccucucaccccagcugugaauuaggcuuuuuuagcuuuuaguugucaguucuuuugguuuuucaagauaggguuucucuguguaguccaggcuaucuuggaacucagucuguagaccaggaugaccucaagcucagagauccaucucccucugccuccuggggcagcagucuaaugcuauauguagauaaccuuacuucaguuucaguguacuuuuauacaugaaugaaacaaagaaaacaaugauccaaagaaguugaguucagaaaaacauguaaaugaaugccaguaagcauuuacuaaauauuaacagagcagcucuuucccagaacuuucuguagacagacuaauuuaaacacaauugccuggcaugauuauaucuggguaagcacaaaagcaagacagaagaauguauccagauucaggguacacugaccaaauuggauucuguagcuguguucugacauccaaaaagaguaaacaugucuuauacauugaauguaaauguuugucacaggaagcacaaaauuauguccaagaacaauccaagaaacaaaaugcaccugagguaaaaggcccccugccuuucuuuucuggagccucucucauaguuccccaaagcauugcucaccgugcaucauucuucugacuguguucugacaccaggcuuacaguaaaaacugcaggaaaguuuagaugacaaaagaugcauacaacgagauggcaauaauaauuugauuuauuaaagcaaaaauacuguuaauuaauauuaaacuauucuguugaaaccagacuugugucuuuuaaaaacaaaaaaaguacuaacuugcuaacuuugaucagauggagcagcacaguuuagucauuugauaaacauuagaaaaauguacaaaauuuuuauuuuaaacaaaaauugagagguauaguuuuucaguugggugguagagacacacaucuuuaaucccaacacucagcaggcaaauaccugugaguuccagugcagccacgccggggcuacagacacucugucucaaaaaugaagguugaaaauaucuuuucucucaguguuuuauaauauauaauauauguuacugacaggucagcuauguuaauauugucagguccaaaagaaacccaggacaaauaacuaacugccaguuagcauaccaaagugcuugcuggccuccaggcucucucaacauugcaggguccaggcuagcguccuggcucuucauacccugucccuacaugggcuucccucccuccaccuucuuaauccuaaauaacccucccauuuuggccauugcccuuucuuguuuguauuaccaccuccaccacaaccucacccacccccaucccacgcuacccccugucugucugucuuccucucuugcucucacccuccuuuuucuccugcuuuaagagaaaccauaguuuuggagguugagugauucaugaaguagagcugccaccuucucugaugcucuaaccauaucacugucuguucuuuccucuuuucccucucugccuuucagaucacuucuuuugguuuauauaacuaaugcauuuuagaauuaguauucugacccuugcuuaggaugagaaaguaauaagaccaucaauaauagcucuuaaguuucuaaauuauuauuaaguaauuuuucuguccucauuuuuguuuguuugucuguguuaauguuucuuguuuguuuucauuuuaggccacugaaagguaugauauauuugauccaagacaguccauuucagcccaggaaucuacaguggugacaaggacaugggacuccucccgccagauuacuguugguucaauacauuugacauccuggcugacaacugugaagaggaaccuuggguuauuuuauuuuauuuuuguggaacaccacaaucucagauccauaggacacaucagguaauguucuucuauuucuuuggguagccuauuuucuuuauaguucauccauaagaaaaugaaggagccugaauaucuuucuuagccaguuuaccuucucuuugcuuugcaaccugaacuguuuucagaaugaaccaaugaacuugugguuuguggucaaauuacagaaggcauacugcuugcuugcuuguuugcuugcuugcaugcaugcaugcaugcgugcauaccccagagcauugccaaacuucuuuuauuccaggucucuugugggucauccccucccucauacaggaacuggauugcagcccugccuaaauaaaauguuguuuuguuuuuauuuuuaaauucaaauuagucuauuauuuuucagacuauuuuucagcuuccagauguccuuguauuuaacuguaaagcuauuuugaaaaaagagcuuuuaauuuuucagcuuguuuagaacagauaaauuucaucaugacuuuauauggaaauuaucaaaaguacagaaaagcuggaagaauuuuauucaaauaccaagcauucuuugauuuagcuuccauaccugcuugacccacacauggaaaugcgugccuucuucuagcuuuagcuuagucucugauacauuucuauuucuaauaccugggauggaauuucuauuguuuucuuaaauucacuaguuacaugaacuguucuauaaugugugauuacacauauuguuuggcauugaaucagucgagucaggagacuuucauguuuuauuugcauuauaaaacagaauuguuaacccagacucacaaauacauuuugauagaauggugcuuuuuuuaaaaaaauuaaaucagagcaauuuuuaaagcuuggaaauuuaggaauguagauguaaacugugaaaaugcacuuacuauaugacuguagugaaugcucugaguaccggagggacaacauuauagagaaaacuaauucaauaucaucuaaguauauuuagccaucacgucuuaucuugaucuagcucaugucuucucaccguauugugauauuuuaagaaacauguacaauaaauauuacagaucuuagaggcaggaguuuugcuuuuguuuaugugcacucagcauuauucuuagaaagauagaagucuuagaaagauagauagauagaagucacuuacuuaauauuauguagcaacugacugugaagaauguuucaaauucaauugagauuacuuuucuuuuuuuugucaaggcuucaaguucccuguagaauucuaaaauaaccuuugcuaaugaggaugucugauauuguuauuauaaaagaugaaacugaaacaaugaaggauuuggaggcagaaaugagagauacaaccagaguugaaaaucuuaucaaaucagaaaacuaugggaagauuucggcagagaagaaugaacauuguauugacaacaauauugauuugcagguaaacagagguuuuuuucccauggcuacaaauaccuaaucauuguaugauuaugcuuuguuucauauagagcucacuuuucacaauuauuuuuuuguuucuuguuuuuuguuuucaaaacaggguuucucuguguagcucuggcuauccuagaacucucucuguagaccaggcugcccuugaucucagggaacugccugccucugccuccugggggaauuaaagaugugugacaccacugcccagccacuugucacaauucugaaagggaguugacccuucaguacauauuuacuagcuuacuuuuucguuaccaggacagcuugccgagccuuaggucuuugauuuuccuauguauaucacaggauaugauucuuuaaauuauguagcuaguauguuuuuguuggcuuucucccuuuucauuucacccuccuccuuaauuaucagugcuguaauuauuaaaaccucuuagaggagagagaaaaaggguucagacaugcagaaggccuacuggcagaacuagcccucuagagguuuaucaguccaucagccauuucugagaaaagagguuuguggggaagggauagauguuaccuaauacuuuuguugcuguguaugcaugauauuuuauaaccaaccauuuagaagucuuuuaaucccaagcaaagaugcuuaaguuugagaaaauggcugaaccccugguuuagcuagaccuuggauguacauuuacaugauuucuccaguauggcauuuucaauguagccaggugaauuauguggcugcucagguaucuuggggagaauguuacaacagauaagugcaccaagaagcuuggauccaggcugaugccugaaaaaccuccuuuguacuauuuuuugacagcacauacagauaauuccugucuagaggaagaacacuuagauacuaucugccaaauaggaaagaauuuguguuaaucugaaaucuacaacugaaaguuauccuaauauugucuuuaacauuaauggcuuacuguguuagcuuuuccuaccugugacugauaccuaaaaacaacagcuuaaaugagcaguguuugaggcucaguuucaaagauuucaguccauguuggcuggcugcagugacuugaggcauguagcaaagcaaaaauagggggggggggggaacuauagcauaagaaagcuuuuucaccuccuaugagcagaaaggaguuaauguaaagcagccuugagcaagacaauaaccuccagacgcacacccugauacagccugcuuccuccaacuagacuccaccuuucacaguucauuacuucuggacagauuauuuaaguuuuauguucaucaguaaacugugaaauugguuuggucaaagcccuuaugaucuaagucauagacacuuguagaagugugccuuacuaacauccuggcaaucucacacuauuaaaguugaaaacuaagaucaaccaucagaaacuggggagcuugcucaacugguuaaguguuuccuguacaaacaugaggaccugaguucaugucuccagcaccauuauaaaagccaaauguggaagcaugugucuguauaucggguguuuaggcaguguggaaguagagaagaaaaccccuggagcuugcugccagccaguuuagucaguucauugcgagacugacuguaagguacaaagcauagaacaagacaccugacauucgcuauugacaaacaguuguguguacaugcaauacacucacacagagguacucaaaauacuuaugaaaaaaggaauccuucuuugagaaaauacuguuacuuuagaaaaugguauuaauuuuguuuauauguccauguuguauguggaauacgcacuuguguaguucagaggacaauuuuagucuuuuguucucuccuuccuuuuuuaugugggaucugggcaucaaacuuggguggccagacuuucaaaucaucucucuccaccaagaaaccuugcuggcucuuuucugucauucuuaaaauauccagaggacuuuggccaaaugcuguugccugggcccaucaugcuagcgucugggaggcugauguaggaaguucuaagucauccgggcugcauacugauuacuugucucaaugaauaagugaaaauccauaagcguaccaaagaaagaucgaccuugaaggcuuuggcaaagguuacuguuucacuuuuuucuuuuauucacagguaaagaaaauuccuuuaaggggcaucucaucccucuuuuccauucacucauaagauuuguauuuuccuauaaauaugucugacaugaaguuagacaaugaugcuaacuuuaccacuuucaaaaccauuuaaguuucugaacugauuuacaguaucucccaaugauuaaguauaaucaaaggguauauauuuuuuuauuuuuaucuuucucccuuuuccuuuuccacccuuccucccucccuauucgcaccuuuuuuuguuuuguuuuguuuucccuuuaagauaacaucucauuuagccuaagcuaggcuugaauucacuguggcccuggcuacucuucaauuccugaccuuucuuccucugccuccaagugcuggugucacagaucugugccaccaugccuaacuuaaauuguaauuuucuaagaaauuaggaaaaauaacauuuccccaugucauuuuuaauuaaacuuuuuaaaacaagaaaauucccuucucuaaucaguauggucauuagcagugauugcauuagagaaaguuugcaaagagucuuuguauuugugauuaaaauaaugauucaggcuggaaagauggaaauuacuugaaaucagccuaagcuauguagugagacuuaucuuaaaacaaaaguuaauaaugcgcaguuaucuuuuaacuuaaucugagguuacuagcuauaaccuacuaguaaacauucguuuuucuuuuguacuuuuaagauauagccugaaauauauacacaauguacacuacauuuuggaaagaacaagcauuguuuccccagucuauaccccaacacauauuguuuaucaauaguagaauggcuauauccacauuuuguuaguaacuguuaugggcuaaaagagagcugguuuuuguuaacacauaguguuauagaguaccuuaagagaaaaacucccuagaagcccgaauaaaucaaccaucacuacagacuggaaacaaccuugaccucuugguuugaguuuuuaagggcaaauugggacauauacaggaaaacagcucuggacaucugcaacaaacaagcauuguuuacagaaacugagauauuaacaguuaaaugguccagcaguuaaccuuuauuuuuagcucagguuacauuauauuggaguuuagguucagagacuaguuuaccuuaugaauuuagggcugguucagagaccaguuuuaguuagcacuuaaaguauucuugaaauacuuucaugagaugauagaacuauaguucagguguaggcuauuacaauaggccuuuguuuucaagguguauaaguuuugucugaugucuaugauuuuuuuuccacacgcaucaauguaguuaguaugacaccuuauuccucugaguuacuucaaagggguuugagaggacagguaggagacaacaaagaaaugguaaucucacaaggccguauauuuuggaccugacaaauauauuuguuucaucauuuaagaaaucugucuauguuaguauugucauuguugguaaaggugcaccaugaggugucuugcuuuuguuuuuuacugacaaaggaucauacuagguagccucugcuagugccuguuagcauaccaaagcaagugcuagccuucagcucucucaaucccaagugcccauuagcagcagaguugauccuggcucuucucaccucacccccuacccuaaacuuuuucagcuaugggcuucacuccccuagcuucucauuuccuuacaacccuguuucagcuccuauucaguucuuuugucuuacucucucggccucuucucucuugccuuucuuuuggucuccuuugcccucacucuuguuggccucuguugcucucagguuugccuuucauggccuggccugucugcuggcuuuacucaguguacuacuuugucccucugguguggacucuuccaguugccucugacuuuacucucucuucugucuacaguaaaagucuuucccucaaccguuccuugagacaguuauguccucaguuugugcacuuuacuacugucaguuacuuaauaaguuugugcacuuuacuacugucagucaguuacuuaauaagcuaagcacagcuacacagcuuuuucaguuucuccuucauugucauccaagauaaagguguuucuuuaguaauaauaaagcuguuucuuaacaucuuuccaaaauuucuauaucagcauaacuuuucucuuuuaagccuauuauauucuuugcuuuuauugaauuuuauaaacacuaaacaaguuaaacacuuuaaaauuuaggauucauuuucuaaaaugcacuucauuacuuaaaauuauuuuuagaauuucauuucaaaugacuuugggucauauccagauaugguauuaacauuuauaagcauggaggugaagagaugcuugaguauaggguguuuuuuuuuaugauuuuuuuuuaaaaaaaauuuuauuagguauuuuccucauuuacauuuccaaugcuaucccaaaagucccccauaccuacaccccccccccacucccuuacucacccacucccccuucuuggcccuggcguuccccuguacuggggcauauaaaguuugccuguccaaugggccucucuuucuagugauggccgacuaggccaucuucugauacauaugcagcuagagucaagagcucagggguacugguuaguucauaauguuguugcaccuacaggguugcagaucucuuuagcuccuuggauacuuucucuagcuccuccauugggagcccugugauccauccaauagcugacugugagcauccacuucuguguuugcuaggccccggccuagucucacaugagacagcuauaucaggguccuuucagcaaaaucuugcuaguguaugcaauggugucaggguuuggaagcugauuaugggauggaucccuggauauggcaaucacuagaugguacaucguuucgucacagcuccaaauuuuguaguuuuuuuuuuacauugguuaauuuuuauauauucaccauuucaauggagguuuucuuuuucuuuuuugccuucguuuaauauuuagaauaauaaacuaugagucuguaguuucccugggaacuuuguuuaaaggucaaaaauagaccuuuggauuuuaacauccuagucuauggccaagagauaaaguaguaacauugcaucgguguuugugcuugaguuguugacuuccuuuuuuuuuuucaguucuuuugacuuaagaaagcauuguuuuauuucauuuuaauagaaauaggcagccuggaauuuuuucacucaccauuauguuaucuuuaaguucugaauucauucuacucuuuuacauaauuacuuauuuuagaaaaauguauuuauauuauuuauauguguacacuguagcugucuucagacacacaagaagagggcaucagaucccauuacagaugauuauuagccaccaugugguugcugggaauugaacucaggaucucuggaagaacagucagugcucuuaaccacugagccaucucuccaacccccacauaaaaguacuuuuaaucuuuacuguuauauagaauugcaaugcaaauuaguaaucugcaagguguuaaaaguuucaacuauuacaguuuauuuuguuaauugaauggaaagaaaaagaaauuaaaaagacaugacugcuucuagguaugcgaaggagaaauuuuauuauagauauaugggaaagcauagccagaggcugggacaucugggagaauccagaguggacaugacccgagccuagacauauagggaagaaaagagagagaggaaccaggugcagcagccaacccaaagaguguacgguaaccuaagugguuggauuauauaggaaaagacacguggaggaagggaacuccagucacugggcuggagaagguucagguaaggaacauggugugccaaggaggagggccccuauaacagguaaaaacugauggaugcuucgagaaacucuaguuaccaaguccacuucaaugucccuugucccaggcuugaaaucuaauaauaauuacugauuauaaauaaaaaugauucucuucaugaaauaaguuggguuuccucuaaauugaauaauaugggaucagcaguuacucuuuugcuaacacacaauauaccuacccaugaagauuacucugaucucccucaauuucuggucaaacucuaguagcuggugccucucucagcguguuaucaguuaaaaaccgagaauccauuaggaauguuguauauucuguacccuuuuguugaccuaguuucugucuuuuuuucuauaaacaggauaaacuauagaaacugagguuugucuuucaccuuucuaaauucaaauucauuuaguccuucacauuaguaaggaauguaaaggguuaguuacuaaguuuuuacugucauccuaaggcucuaauaaagauaaaaugucuucuccaaauaaauaagaucuacuuagacaugauuauaaaucaaacuggaagaauucugucuuaaagugaagucuggcucccaaacugacaacagaaaaaaaauuauauguacauaaaugaaugccaucuacuuuuauaagcugaaaucauuuacucuguugugugugcagguguaaauggcaguuuucuuguguauauauuauauaguauguaucugaaaugaaaagaauuaauuuuauguaauaauaccauuguuuucucuggcugcaaaacggaucaaacuuagauaguuaaaauaacucuucauuaggagauuacaguaggcuuacccggguuuucugccuaagauuuguaucagccaugcugauccuuuucagaagaguugggagagaacaggcaucaaggugcuuucuucuuucagcaaaccuuauuuucaaaguugguauagggucuguguuuccugggugaucuaucuucaaagcaaaaaauuauuuugaauccuuugaaucccucugacuuucccauuuugucucaaccaaagaaaacucagcuuuuaagaggcucauuugaugggucagacucaccucaguuuuaaaucuguaucuuaggaugaacugacuuggaguucagcugcuucuguaaauuccuuucauggaugaggccagcuuuguauuuuguuaaguagcaggauggagacucauucuuggggacaguuuuuggaauuccaucuccucccauauauguuuguaaucugucacguaagguuauguaaguggaagguuacuggacuaagauucugagacucucagguucagguuugaguaauuuguaaaugauucuggacucugacauccuuuuguaccagacaagaacuauguuuuuauuucaguucuuagaugugacuuacagagaguaaaauguccacuuggcuauggugaagagaagagcaaauugaaauuaauccaccaacaugcagaguccucuuagauaguacuccccuguguaaaugaauucaaaccauuuuugccuccauaaauaauuugggggaggggucaguuaucugauuuucucuuuuggguuuuauuuuucacucauugauaaaaauuguaagaauauaguauuuuaaucauuaaaggcauuaagacccaaaauagugguuuuaccauuuucauacuccugcugguguuucuguuggcuuuacacaaaagucuugggauguuaggauacauaauaucucucucucucucucucucucucucucucucucucucucucucucucucucucucucucucucuuaaaaugggaagcuuuguagccugaauauuaccaauuuggaauauguauuguguuugugguugaauuggcucccuccugcuaccgagaauggaugucuggccccugccuugugaggaggagcuugauuugaaaugacagagaggaaagaggcagagggaaagagauuuuaaaaucuguucagaguuacaggcacuguaagcuuaaacucagaaaaugguugcuuccaugaguuagcugaugauguggcuagugaucacaguugugcuaaacaccuuuuauugggcaucugcuuucuuucuuucuaucauucugcuuuaucaucuuaacaggagaccuagugaguagcauucuuuacuaaaacugguggugugcccuucauauuuugcugaaaauacuuagcagaugagagaugaaaauaguauagucucugacucuguacuaaucaaguauuuucuguacaaaaguuggaauuuuucuggcuucagcuaauugaaauugucaaaguuuaauauguccaguuacucacacccaacauuaguaaaaauguuguuauaaaauauugaagaaauauacguuuuugcuaugaaaagucaaccuucaaaguuccauauugcauucauuuaacacagaaauuugcucauuuaaagaaagaugccaauccacagaaggacuaguaucguucugacugugccucuggaaggaucaguacucuuccacugacccaucuuagcuuucuuuguuuagcacacucugugguuuagguguguaaauuaagaagcaaauuuucuguuugaaugugaaauuuaauaaaaucuuucuuauuguauauucagcggcccccgcagucauuuggacagacaggaaaaaggucuaagguauaguaccuauuuggugugcuggcaugccaaggccuucucaugcuuggugaauucuuguuuucauacagcacuacauucaguuuaguuuuuucaucuuuuguuugggggcagaaagcuucuuuucuuuuauuugggauuuuuuugguuuuguuucuuuuuuucuuuuuuugucuugccuagucgcuuuugugcauugcuuuugauuaucguugguggguuuuuguuguugguucuuuuuuuuuuuuuuuuaaacuauaaagaaaauucgcuuucucaccauuuguuaaauuugagguuggaauuaugcccauucuugcuauugcuauaauuuuuaaaacuuccaauuguuuacuuucaauuuuaagggguuuuagugauauuuaaugauauaucuaacuuaaacauuucaucuacuuuuuuauguguggcaaaaacuaaaaagaaauuuagacacuccuagggggcuuuugaauaugcccuaauuuaugaaauguagcguuaauuuuaaauacuucucuuuagucaagcucaaaguuaaagcuaguucggagccuugcaguaugugaagaaucuccaccacccccugcagcagagauaucacaggagacccagguaaaaacacccacaaagcaaaacaaaaauuauuccaagacuugguggaacuggagauauucucugauaugauucaaugaaaauugaguguauauguauucuauuauuucuaguaaaugaaacugauuugcuaacacuuguuaacaaaaucccagguggauuaggaaaacuuuuuacuuugcucugaggcuuacaauagagauucuucauuuggaaaaccuuuugagacuguaugauuaccuaggaaugugacuuuaagaaaguuauaagcuauuauucaaaaguagucaauauuaaaguacuuuuggugacuauaauuaugauauaauuacccuuuuuaauugugaaauuuggaaguuuguuauguucuuguugauucucuggaaaucaccccaacuucugcuucauaguucaguuagccugaaugcacucuaaagccguugucccuuuugcaugagucuacaauaguugcuuaauacuucuaauucugccuguucuuacagaacauaggauaguaagagucaagcaaaccagaauuugaauccuauauucuuuuucaugguuugguuuugcucucuauuaaucuugacuucagauggucuuugguacugugaagaguguuuucagcucugcugcugaucauuaguaugguaacuggggccauuaguaaguggcuucuacuuuauaagguacaguuugggcaacuuaaaguuucuaaagaaaugagacaacuagugcuuauuuaagaaaccaugacaaauuuuucuaaaaggaaaaaguccugacauguuguacuuguccagaggaaugguaggauacaccuuuaacucuaacaauguggaaacagagucaaguggguccccuugaguaggccauucuggucuacuuaucauauuccagaccauccagagcuaaacagugagcccugucucaaaaacacuuuugucucuuuuuuuaaaaaaaauguuuuuugauucauacaaacguuuucuguuuuucucauggccuaagugauaccuuucaagagauacuauagauaguaaaauuaguuauaacaugcuuauaauguguccuacuuuuacaaaucauuacauuuuauuucuuaaagauguaagagggggaauuuuaaaauagauuucagguaaucuuuaaaaucuuuuuugauaguucagguguucaaaauuuguggucuucccuuggaccuauguaaaauauauguguguauguguuuaauuaaauguauuugucaguacuauuuuucuagcacagucaaaaauacucucaaaauguauaaugaguauuauugccucuagaaugcuuuaaagccuaaaccucuggguccuuuacagaauguucuacagaaugugcuggcuuuguaauuaagcuggguuuuaguaaggcuauuaagguauggcauauucugaaagggaaaaaacaauaaaaucguucuuugaaauacuaauuuuuagaaguuuucuuugagagaugacucagagguuaagaggacuaacugcuuuucccaggaaaggaaccagauuugauugcuaacaucuauaugauagcucacaaucaucuauaacuucaguuucaagggaucugauaccucuucugaucuccacaccaucagacaugcauguuguguagagaugcacaugcaggcaaaacacucauauaaaaaaaaaaaaaaagaagaagaagaagaaaacuuaaggauuuucuuuuuauuuguuuguuuuuuauuauuguuguuuuucaagacaggguuucucuguguagcucugguugucuuggaacucguucuguugaccaggcuggccucauacuccaagauccaccugccucugccuccugagugcuaggauuuaagguuugugccaccacugccugguuuggaauuuucuuucauaagucauaaucacgaauauggugguuuaugagcuguguuuugaaaguucacuucuuuggucucuugaugaaaugcuauuccauuuaugaaccagugggguugagaaaaugaguuauugacaacagaaguauguaucuucugaggaaaacugucacuauucucaauucuguguuuauuuuaccuuauaugaaaaauguuaggggcaaugggagauaccuuaugauauuacacgugcgcgcacacacacccuauguaguagggauuccucugaaaaauacuuacuaggagacauguugugugugucuguguguguauguguguugaucaaagauuauguuuuuacauuuuaagaggaguuauaccaguuaaauaagauaugucagaauucaguuaccccacuuacuguguuguuuucaguuucuuuuaaacauaauaauuuuagcuuugauaauaaucucuuuuuuucccucucuaaauaaaagaugcuuuuuucuuuaauggagaauccucuuuuuucaugccuggaauagacugaaauacaccugaaagggaacuagaaaauacguucugcuaucuguucuaguccuugaugcuauacaguuugcaacaauuuuuccauucaguguuaauuuuuagugaauuaauaugguguaaaacucauuauaaaaaagguuaagaagcaauuuuaagagagaugucacucaugugagauaagaguuuguaauagggaaaugaccuuaaucacacauguuauaauuuucauaguaaaguguaaggaauugugcuuccuguguagauguuccaguuauucauagaaggauuuauauuguaaccgcagcuuucagaauggguuuucuuuauucaaguacuagaaauaaggucagcagaugacaaggcaccagccuucucuacuaguguuuuaaaaugcaauucaucuuaauuaaauaacuuaauaccuauaaauuaauaccagugacucagaggaaagaauuuagaaguuccgucugcuagucauugaaagaaccguuuaaucaaggucucuaagaccucaauguggagucuuucccgcuacauggaugucaucauuggacuuuccaccugaguuguaagaagcugcaaagaaagaaaacuaaaaauuaauucuguugucauuuacaaacaucugaaaauuaugagaugaauuagaaacagaaacagcuuaguaaauaaaguccugaauauggcauacugguuggugaguacugccacuuuguuugguaagcaacacagagaagacaggaaguagguguccauuguccuaguggagauugcccacggacaguguugacuguguaauuugaacaugauucugccacugagcaauauccacagccccugaaauuucaacucagauggaauggaagaaaaaaaaggggaaaaaaaaguagcuaauuacuguuuugcguauauaauugaaauucugcuagcaguuguuuugugugugguggggaguuguuuaguagcacuggugcuggcagcaaguuugagaaucguguuguuuguauccucugaguuaccaacuacuucuacuacuacuacuauucagaaaaguuaaguaaguaacaaaaguguaauuuagucuaaaaauagaucacagcuuugucuuuaguuuaaaugaccuaaaguuuauuguauauuucuucuaauuuugccugaauaaacagcuugauaugaucuuugccuuucagauauauaaauuaauuuucuaguaaucuaugcugguucuaaaauugcuuuaauauaaauauuauuuucaaccuaagauuauucuccauuuuggucuuggauguuauggcuaauuuauaguuauucuauaucaggaagaaacagaaccuuauuugauaccuuucuaacgcagcuguguggugauugaaggagccauagugauauauaaaucucaagugagaaaacaggugccaugauuuugaaaacuuuucugcuuauauuguauuuguauugcaagagaaaaaagggaguguguguaugugggauacucaagaaacugaauuuaggcuagggauguaguucaguugauagagggcuuguaacaugcacaaaacccuggguucuaucccuaauagcacaugggucagauaguguacuguacacuuguaaucccagcacuugggagauagaggcaggauaucuagcucagaaucauuuuccuuuauauauaaaguucaaagcuagccuuggauacauuagacucuuaucucaaaaagaaacugaauuuuguuaauuguuuuccugaugcuaacacauuucuguugucaccggaggaauaggugaaggacugaauucugaccucuagaguguuuuguaaacaaaugcacuaaaacuguaauaggagggguuggagagaugacucagcauuuaagaccacugacugcuugcucuucuagagguacugaguucaauucucaguaacuacaugguagcuuacaaccaucuguaauaugaucugaggcccccuucugguguguuugaagacagcacugguguacucacauauauaaaaauaaagaaaucuuuuuuaaaaauuacaauaggaaaaauuuuauucuccgaaacaguuuugaagauauccuuuaguugauaaguucaaaugaacauauuagguguaguuuggguuuugaggcagcaucuccuuauguuccuggcuggauugggacucaauauguagacuagacuggucucauguucagagauccaccugccucugcuuccugauugcuggguuuaaugguaugugccaucaugccuagcugaacauacuguuuuaaguuuuuuguuuuccucagauauuuuaaguuucuuuuguuuauucauuuugagauaggguuuaacuauguagaacaggcuggccuuaaacucauagacucaucugucucucugccugugagugcugguaguaaaggccugugcuaucacaccuagcuuaaauugcuuucuaacuuagaaucuuuaauuggauuacaugaaaaaucucuucuccuuuuaguccuucauacaguuuugaauaacuuaggaagugccaauacuuaaucaguuaauauuaucauugaguaacaaauuuuuccuuccaacaggagaaaauucagauacaguuaacacaaucauuugaaaaagaggaaaagcccucaaaagaugaaacagauaaagaaaaagccagugauaaguuacccagaaaaauguuaucaagagguuaguaauuuauuuuuauauuuuagauaagaguuuauuuucauuauuaauaauucuuuacccuuugaacaacacaugucacaucuguauugaaaaugacacaguagacuggaaggguaauguaauguuuacucaucugcuaugucaugguuacauauaugagauguuaauauuuuccaaccaaaaauuauaacauaaaucuguuacuaaggaaaaugaucauaaaaaucucuuacugaucucacucauauugaaaugccaaaaucacaguuuguguaauauuggcuccacuaaguauaucacuacucacuaauuccuuaucaauacagaaaacugguaccauguuaagaauacugauggaaacccuagaaugucuucauaaaaaguuuuaaggaucuucauuauugaacauuggaguucaauaaaaaucucuaugaacuauuauguugaccaguauuaugaggauaaaggcaauacauagacauuauuugagaaaucuuugaaagcaaaccuuuguaauagaauuucgagaaucuuaaauaauuuuagacauaaaauucguaccuuccaaauuacuguuuuauuuagauacauucaugugaauuaggcuuuuuaaauugcuacaguuagaaauaauuauuaaaauccauuucuuacuugagguagcauguuugagcaugagagugugaugaguacaugaggauuauuaaagaaaugaguauaaauuaagucugacauaaagauuauuuaagaauguguguguacaugcaguuauaacagcccaugucaugaaaaauauauacaaguugacaaauagugguuaucugucuucaucauaaauuccauuuuccugcuucauuuuuuucuucaugggacaucucauuuuauguaauauagacauaauguacaaaagggaaagggauuuauguuaaaacaacuuuauacuggguuuuuguguuguuguuuuuuagauuccagccaagaauacacugauucaacuggcauagaucuacaugaauuuuuaguaaauacauuaaaaaacaaucccagguaaaaaauaaauuuauaagguuuacauugugucuagacuaccauaaucuugcuauauauguuuuuuuaauuauugauuuugaauguuaggauaagauugcagauagaaggaauauaccaguaauuuuccguuuuuaggacuaagacauuugucuacuaaauacagauguauuuaucuuugcauuauacauauuuucaugguuugagaaucauuccuauucuuuaggcauuuucaggaauaggaauucaccuauuuauauauauaaacucugauuugggauuaagagaauaaucaugaauaucuuuccauauacacuccauccgaguaagagccgugucugcucacucggcaugagugagucuuugucuuucuuguuaguguagagaucccugaucagaagcuuuuuagagcucaugugagucagcucuugaacccugaaauccauuuugcucagaauaggugauuaguuuuaagcuugcugacagggucuuuugaaggccuuuaaaaguuuauccacaauacaccuuaccaguacuuuuauguuguaaaaugucccauggaugagaaccucucuuccaguuacuagcuucccagugugguaguuagguaacagugggauauagaugagacugucucuaggaaggagcucuugggagauaaugugagucauugcuuuugucucuggggacgucuguugagauuugcuccagcaugauuguuagcuauugcucuuauucaagauuugcugagucuacuacucacuugauguucaauucuggacuuagcucugaaggagauccaccaaaauuaaaaauggucucuuuuacuacauauuagaaagaaaacaaggagggguauaugagaagguuuggauagaggacaaggaaugggaagaaauggaauuauauugcaaucucaaaaaauuauguuuaaagaguagucucauugcagugaugggaccugaaggaccauagcugugaagugaacaagaagacaagcuguucugaugacucuuucuuguuuuaaauuuauuucuuaguagucucaguagaaagauagcuuuauuaguucauugaacaaaaacuuauugacauauguaaauaugaggaagacaugugguauucuuuaucucugcuaaagacacauacuaaauaauuaaaguauaacaaauauuguaaagaagguuguucagcugcuguaaaaaccagagggaggggcuagggaaugcucagcuguuaagaacacucacuucuauuccagaagagucaaguuuagugcccaacccccacaugaggcagcucacaagugccuguaacuccagguccugaggaucccauauccucuuaugacuuccauggguuacacacacacacacauucacauaaucauauacacauguaaaauaaaaauuugcaugucuguguguauguguguauccaaccaggucauuaggcuugacagaaagcucucuuaucugcugagcuauuucauuaggacuagauuuuuauuuuuuauuuuuggcaguuuuagagauugaacugugggacuugugcaugcuaagcugaguuauagcuccaggccuucaauuuuuuuuucuuuagaucauuaaaucauuucuauuuuaauucuuggacuauuuaacuuaaguugguaaaugaugaaguaucuagauuuuucugauugcaagaaauauuuuuauaagccucacuagccaguuaauauacacuugaggcaagaaacuugaaaaguauguuuaguagaguuuuuuuguuguuguuucguguuuuuuuuuuuaauagaauaguuuauucaggauaugggaaggggaauugagaggguaguaaagaaaggggggggggggaugagugugagcagagaccggccaugagcagguggagagacagggaaaggggagaaagagggagagaagggguggggggagagagcgugcaagaaagcaagaguauuuaauagaguuauaacugauauaauuucacaccuuguugguuuuauaccuacauuugaguuacauaaauuauuacaggcagcugucuuguguaacuaauggagaaggaagcaagacacuggacuaaucuugguaaacuuuuuuuuuuucccaguaauuuggguuugcuuauauuuaguucuauguuuuuguuaaguacaccuaaaaauuacuuguuuggaauaaugauacaucacuguuuuucacauguugcagaacucugaccaggcacauaaaacauugagugguaggcaacccgaaggaccauuuuuuuguuuucuguuugcugaauuuaccaucuugucucuauaauuaguuuuauuaaagugacuagaaaacugauaacccacagauuguggcuccucguuuaacuaaaugguuuuauggaaauccucuuuuuuaaauggguuuagugauugcauauauuaguucauuuguuagcuuauauccaauaccaaaauacuuagagccucauuuacggauuuuaauuuuuggaucuugaaauauuauagugaauagaaaguagaaugaguaaauuaagaccuuagggaaguuauuguuccuuuuuuuuuuuuuuuuuuuuuuuuuuuaguauauucuacuagcaguauggaaagccuguuuaaaauaauggauagagaugauaaugauacaaauaucaucugcaaucuauaggucaccauguuaaggaagaaaagccugacuuuaauucagugacuuuuuugaaacaguagggguuguuuuuuuuuucucuuaaugcaguacauucaacccaaagaacauauaaaauaucuucaaucagcuguucauauauagaaaaccaguuuaagugcauugugaauacuauuaaaaaaacuggugcuucauaauuuuuauaugguuuuaguaagacaguuuguaaaaauggaaauauuacucaaaauuauaucaaaguaauuugaccccaaaaggucagaugaaaaagaggaucuagggccugaaaagaugacuuagcuccuaagaacauaccuuuugugaaucuaauuccaucugauuugaugacuucuauccuccacaggcaccaggcauacgcauggugcacagaugaacaugcgggcaaaacacucaauaaaauaaauaauucuauuuuuuuaauuagauguuuucuuuauuuacauuucaaauguuaucaccuuuccuaguuuccccuccgaaaaaucucauauccccucucccuucccccaguucuccaacccucccacucccucuuccuggcucaggcauuccccuauacuggggcacagaaccuucacaggaccaagggccucuccucccauugaugaccaacuaggcuacauugcagcuagagccacaagucccaccaucuguuuucuuugauugguggagcuguaggguuacugguuaguucauauuguuguucuccuagggggauacuuuuuuuuuuuuuuuaagagaaagaagauguaauaguuaagcaaaugaauuuguuucauggggugauuucuauaaaagaaaaaauccucugcuuucucccaaauuuaauggaagaagguuauguaaauacuuuauaugaaauaguuuuauuuccugcaaaacacaauuuuaugaaccuauacauuauauguaaucucuauauuuauaugauuauaaugauacaaaagaagaguuuaagagaauauaaaaggauguucuagguaaacaacuuaaauaauaacagaacaagagguacuuaaggaucaaggcugaacagagcuaauccagaguaaugagcauuuugugauuucaucaggaaaugaagccuagcucaugcuuaucuuguaggcauuuuacaaaauuugaacucuaagagcaauggcaaaccucugacagauuaaaccaaaggaaugcugugguaaccuaguauucuuaaagacuguuauguaugcuccacauauaccagguuagaccagaacaaagaaaauguugaaaucuugguuggaguguggcacaaaaccaaagaaaguagacaaaguugucaucaauaaugaacucaggaggagaauuacauauggaauggugcuagaugcaguugugugcaccuguaauccaagaauucaugugugaaaggcaggagacucuuaaauguaaagguagacuggaguacacagcaagacucuuuaaaaacaaaacaacaaaaaguauguaggccugauggugcaggucuguaauaccagcuacuuauuggggacugagacagaagaaucacaaauucaaggacuuucuggauuacaacuugaguucaaggccagucuggacaagucaauaagaucuuaucuuuaaaagaaggaaaaaaauaagaaaucguagggaaaaaaaucaaacugaagagauggcucaguuaguaaaguauuugauaaacaaacaugaucaccuacauuuacgaacagcucaguuuaggggcuggacagauggcacccaguuuaagagcacuugguguuucuucaauccuagugcugguaaguugagagaggauaaccuuagcugcucgcuugccagucagccagccagccagaucuguguuucagcuucagugaaagaucugucucaaaaaaagcuagaaagucaccaacaaaggcaaccuagcuuggucuucugucuguguguguguguguguguguguguguguguguguguguguguguauguauguauguguauauauaugcauauguauauauaugcauauguauaugcacaucaacaugagugguauccauucucucuuucaugcuucccccaucacacacaaacacauagaauguagccaacuaaaauucucagucugucacaccacuguaaauacaagguugucccauuuguugagaugagaaauagcaaagaauaaugaaauuggaucuuucuagaauuugcauuaaaauguacucauauuuuuggauuugaauuugaaauauuuuguaagcauaguucucuuuuguacauauuauaaauauaaucaguuaacuguugaauaauugacuagauuaaaguuauucuguuuuauaagacucuuuugcagugcauggggaggaucaaugauugaugcagacuuucaugugauccaagaagaggcuaccagcucuuguauaaauuuuagaagguucugcccuguaguuuuuuuuguuuguuuguuuuuuguuuuuuguuuuuauuuguuuguuuuugagaauuccucagugcuugcucuuuugaacuuuacauuuuuacaaaacaaucuauaacacuauuucuaacuuuaaguucugugagguuuuuauuuuguuucucaugugaacaggaacucugcagugagcuagagccauauucucaguguauaagaaccaaaaggaaugaugcaauuaacuuguuacagcccaagugaccuggacaggacccgagguagccaaaggagcacaugccaauauuuauuugaguucugauuuaauagauagugaaugccuuugcuucauuuucauuuuaugagaaaauuucucaaucuaauaguagccacuuaacagaauaaggaguaacugcauucgauucccuuaggaacauuccuuauuacuauuaauagcaucucauguucuuuagaacacuguuucuguggagcucaagauaaaauacaugggcucuuaggauguacacugaccuguccacaacucuacuguaaaaaguuacacugaaaaaaaaaugaucuuucauuuucuuacaacuuuuguuuucuagaauucuuauaaaauacucuaacauguugcuuaugauauuucugauucuauuguuuuuagcgagggaacuagcuauguaaauucauugccuguugacccuucaaugcuaaguuuuucauguaagagucuucauacuuucuuucagggacagaaugaugcugcugaaauuggaacaagaaauuuuagauuucauugguaauaaugaguaaguucucagauuuaacaagaaaagagauugucauugugauucuccuugacuuacuaaauuggcaauuguuuuccuuucagguccccacguaagaaguuucccccgaugacaucuuaccacaggaugcuguuacacagaguggcugccuacuuuggauuagaccacaauguugaucagagugggaagucugucauagugaacaaaacuagcaacacaagaauguaaguguauaguuauguugucuguggacuaauacuugccuuccuacagcaccuuccaucuacaguaauugccugaucacuucaugcaauagagccaaaaguacauuuaucucauuaggagcaaaaugcacaccuggauucaggcaaggcuuguuugaggaacagcaacaacauuggaggacaugcuaucagccauguuugacacccuuucuuaaugaauuuuuaaaauuaguuuagguaucugugaccaccucuagggaauuuguuuaaauaauuuuuaaaaagaagcaauaaacagauuuuaacacucacauucugucuacuacuuuauuaucauuuccaaaauccuguuuaguuuguuuuuuucugucuaucuaucuguccuucuuccuuuuucuaccucaaauuugaagaaauuugaacuucugguuaaguguagugacuuucuuacugcuguauuucuuucuugggcaauauaugacuuacugaggaaaauuccuaaugcuuagaaagaacccuucguuguaaaagcaauugcuugaaaaagcugagcauauagcuuagugguauaacacuugccuagcaaugcucaaggaccuggcucaaucccuugaauuauaaaaaaaaaaaaaaaaaaguccuggagcucugggauuauaggccugugccaccacauauggugcaaaaguauucucugugucauuuucauuuuugguagaaaagaacccaugguaauaaguagccaucaguuucaagugccacagauaauuuucuuugcuucauuguuuuucugcuuucuugaggucaaguaugccucagaguuuguccagcaucauucauuuuacauaguuacauuuaauuaaucuagucccuucaguaaucauggccuuugcucauauagcuaccauauugcuuacugaagcaaaauugaggcucuuccauuucauacagucucuuugucaaucaaauagguguguuucagauuuuaaaugacuauucguacaacuaaaauuaauaaaaguuauuuuugacagaaauuccucauaaaucucugagaauuauuagaaaauauaaauuauuagaaaauacaaaucugaucuaauuucaucaugucuauuuacuagucuuauaaacucauccuuugucaauccuuucccagcuaauuauauaauaauuauaguauccagucagauacaggugagacugaaaguggcuagaacuguacucucuuuaaccaguaccuuucaacauuacucagagcugcuggaugcccaaacacaugaacauuagcaggcauuuugacuaacauuuugacugacaacucucuaagguuuucaauacaguguaaccucaguuauuugaauucuuuaaaugaugucagaaaaagauuaaggguucuguuuguaaagguaaucaaaauuuaguuaagcagagacauuuacaaauuauggguuaauguaauuauaauuaauguuucagaucauugaaguuacacuguauucuuacuuaauaucuucugggauauguaaaucagaaaaccuuagagaucugcuccacauugaauaaaaacaaacuuaccuuuuccucauagggagauuacccgcuccagccuugaaccagugguguuguggaugucaacaaccgaguguccacuggggugucucaauggagcgggaagaugccgauugcagggcaguaaauucaggcaucuuuaaaagaaagagguaagacagucuuaagguuagcugaaaugccugccaauauuacuuugugugggaauccagcuguucuuagaaaaguugccagggccuugguuaaaccauagaguucauaucuagaacaagagucucucacauagcuacaacuucagguaauaaaaguaaaugaagcaauccugugacagauggcaugcugucauggucaggacugaauguaggaccuuucaaacucccaaagaaagcagacuucucaucauuuuggucaugaaacauuuugcucuuaccuucuccuuuacuuugauauggauuuuuucccuuuuuuaaaaauuaucugcucuguuucauucaucauuuuacaguacaaauuucuucaucuugcuuagauaauucucauuuuuaaauccuuugucagauuuaaaaggugucagcuccaguguuuuauuaaaauuuuguagauugagaugagugguggcacaugcuguuaauccuaggacuuaguggguagaagcaguaggcaucucuguguuugaugccaaccuugucuacauagcaaguuuuagaccaaccaguguuacacaaugagacccuauugcaaaaggaaaaaauuauucacuagauuggaaaaaguauuaaccauguuguuuagauucuauuuauaaugaaaugucuagucuugguuugcugaaaugucauugcuugaauuuaugaauaaaauuucuugcuugcgaggcauggaaggauugcauaccuuuagucccagccagcacucaguaauagaggcaggcacgcucucuuaguugaaggccaaaauggccagccuugucuacagagccaaguacugggcuagccagagcuacacaaugagacacugucucaaagaaaugaaaauuuuucauaguauucucauauugcuuauauguauacauauaaauaugucuuugaacuauacauaaaggaaacuuuauagagaauuuauuagacuuucuuuagguguauuaaaugguauauguuuuauauuucaaaugcguaauuccaauguaaaaugguaauaagucacagaauauugauugaauugacuuauuggagcugauaauauauugguggagguuauuuuuacauaaguuuagugucuauggcccuuaaucauuuaucugucuuauaggucuuagugaaacuuggaguauuucuaaucuggaaaaaaaaaaaaaagacaaaaaccauugugcuacaaaauauauacuaaacuccacagucauugcuuuagauuccagugugaaccucuacauaagagcuuauuuuuucuaaccuauucaaguuuguggaaaacaacuugcuugcugucauuuuauggcaugaggacuauuggaguauaaugcauaugauacaguaguuacccuuuucuuggucccuguaacauagaugacaugucagccuuauagucugacagcccaggguuccaacuauggcuuagccuugcauuuccaucuugacuuuuucacagcugcuuuagccacuugaaguuuaguguccucaggguuucuuacaauuacagaguucuggggagggcucuucaauaacuaauucauuucauuuuuagaguaacucuauuggauagauaaaguauauaauaaaguauauaaaucccaucuuauacgugagaaaauagggaaaacaagauuacuugugcauaucuuaaagccaguacuguguuaaaaagccagacuugaacccagucugacgacaaagccucuguagagcagcaucuccucgugagcauccuacugugauaggacagugagguaacaguaucaugccuuacgcagcacugauaaaucgaaacacuuuuauuaccuugcauauaauauuuuccgcuuuuagguaaauacuguacauuaaauuuguuguuccuuugucuuauuucuuuuuuuucagaccugaucagaaauuuaaugaacauauaaaggaugauagaggugaagacuuucagaaacgauacauccuuaagagagauaacucuagcuuugacaaagaugauagccagguaauuuugagaaaaauggacauuauuuuaggugcaagcuuuaaauguaccaauaguucauuuuccuaauaaucaauugguuuuuuccucuuuagaugagaauacguuugaaagaugacagaagaagcaaaucuauagaagaaagagaagaagaauaccagagagcuagagaccgaauauuuucccaagauguaugugccaacuuaacgcuuaggacuucauauauucuauauauucuagccccaaguaauauugcucauauuauuuuuaaccagauuggcucauacacaucaggucagguuuuugaaauagguguuuuguucaugugaauuugauaguaccuuaaaacaaaagagugaaguuuuaccaaaacugaacacagguagaccacaggaaucaauagagcaugguaauaaguugcuauuuguguaacuuuuuuaaagcuugugacaguuuuuauaucauuguuaacuuaaaucuuacuuugguacugaacuuaguaauuugugucuuauaaaauaaaguuaguugaucuuuuagauuaauagucauuaucugcuuuauagaugaugauauuuagagacaucugcaugacuaauuauuuuaugcauauuuggcuuuaccaacaccgauaauacaccuguucucugcaguacuuaguacuuuucaaggauacgauguaaaugaauauaauguaugauuccucuaacacagaaaggagaugugcccuguguugaaagcaaaacaaagcaguaaauaauaucagaauuuagaccaucgauuaagaauuugcaauaugugggcuggagagauggcucagccauuaaaggcuaggcucacaaccaaaaauauaagaauuugcauuaugcaacaaauaauauugagcauuuacuauaagugcuaugcuggacacugaagaccauaugcauggacagucauaauccacuagaugacccuuucuggucagugugaucguauuuguuuuuuauagauaagaaaacugaggcaaaagaaagcuauucaaagaagcuaaaauaaacagaccuagaaaauggcugaguaggaauuuuaauucaguucugcugaacucagcaucuauauuagagaaauguuaccuuugguauuuuauaagcuaaauggcauacuaguuguugcgugaaucacagagacaugugaagguguaauagacauacagcaaggagagaagcacuacagucaaacuaggaagggcaugggagaguacacuucugagagcccauaagcucaaggcgaaaaaaaaucaguauuuccagagguucucagggaagggaaaacuugaaauacaaagaccugaaugcuuuagaguagccagaacauagcuggcagaugccauaaguaagggggcuuuagacugaaaaaauacucaggaacuuccugccuuagccuuaaaccuuugguaagguagcugaacuucgggugcagguuucagucuuacuacagaaggccaugucauccauauuuaggcaucuugagucauguauuuguaugugcucaaaagugacucugguacaacagcuaccauaauacaugacaugguuaugguuguguuccgguaagucuuuauucguaaaaacaggugguuggccauuuguuccugacccuucugucaaggagucaugaaagaugagagaauuacaauuuaaagagcuugcuuuggcuucugccccauaaugugaauuaauagggcaaaaucugguaacuacaaaacucuuuagaagacuguuacaguaauacaaacagaagugauuauuaccuggcuuagaucaauagcacagcaggaacuugacaauaaguccuuaaugccugucuguuuauucucugcuuuauccauaugguuggugucuguguuaccaccgccacaaauagaaacagucacuugugguacagugaaucaaucagccuuuacuuuuuuuuuucucauuuauuauuugugaaugugugcaagugugugagaaagaaggucagaagacaacuuucaggaguugguuccuaacuuucaccaugugugucauagggcuuggacucagggcuucagauuugguaucagguguauuuaaaccugagccgacuugccagucccuucauuaacuuggucaccacuaaucaaauaguuaugaauuaacuagaaucugucaaccugaaauauaugauuaauaaaacaggucauccguuuuaagaaggcuuuugaaauuucaaauucauucugaaaguucuugacuucuaagauagaucuuuuauaaauaaucauagcgucuccaagccaugaaaaaucgaauuauaaggaauauucuuuuuuguuuugguuuuuuuggguuuuguuuauuuguuuguuuguuuuuguuuguuuguuuguuuguuuguuuguuucucaagacaggguuucucuggguagcccuggcuguccuggaacuuacuuuguagaccaggcuggccucgaacucagaaaucugccugucucugccuccugagugcugggauuaaaggugugugccaccacgccuggcuguaaggaauauucuuauauuuuuaguuguaagccuagccuucagcagcuaagccaucgcucuagcccuuaggaguguacucuuaaaguuacuauauaugguauuuuuguuguuguuacauugguguacagaugacacacagauguguaucaauaaucaaacuuguuaccuuuucuuuccagucccuguguucccaagaaaacuacauuauugacaaaagguaagaaaaauuuuaauauauauucuaguuauuaucuaguugaugcuaauaacaauuaaaauguuuuauuaaaaugucaacagaauccaagaugaggacacuauugguacccagcagaggcgccagauauuuagguauagaagcauguuuuccagacaguguuuaaaaaauuaguuuuuucuucccucccacccccaguuaacuuuucaauguuuuauuucuaaauuacagaguuaauaaagaugcuucaggccgaucgacaaacagccaucagagcagcacugaaaaugaguugaaauacucagagccacgacccuggagcagcaccgauucagacagcucccucagaaaccugaaacccgcugucaccaaagccagcagcuuuagcggaaucucaguccugacaagaggugauagcucuggaagcagcaaaagcauaggcaggcuuucaaaaacagguaucagugucuacuuagaacugugcagucagaaugguacugugccugaagucuuagcuccucgucacaugguucuaauuaucccacaauguaaaguuaccucagcucuguggcagagaagugauugccauagugacauuaggauucauuuugaccuggagguagaauuauaaauggaaauaaaucucuuugucuguugcuauauaaacuuaaugugauagcucacuggcucauuucuuguguguaggaggugacugaacauucuucguugcuuauuuaugguuggaaaguauggcuucuuaccuaggauugcauaauguuagauguaucccauacugucagauauugguugcauuuuucaugacuuauucuauaagaaaugaauacaauucugaaaaaauuuuacuaaacuuaaaaaccaaagagaaauaauacaccuacagcuauaaguagaaauuuaaauaauuugcugguucuuuuggcugcucuacuucagauccauuggucauagcaacuucuuucauuuucacuaaggagcagagcauacaaaaucucaugugucuuugaggacuuuuguauaucucuguuuuuuuaaucucaaaauaaacauagaagucagagauggcuacuucucucuagccuguuggauuagguuaaacauaaaaugaguauuguacaacuacauuuggaagguagauuaaggcaacaauauugcuuaauauuuuaaugcuuuaaauugcuaaugcuuuugaauugcauucccaucuuaaaauauaaaucuauugcaagugucuuaguugauauaauaccauaggcuaaagucauuaaauuuuaugaguguuuuuuaagauuuguauacuuaucuguauauacugcaauuuggucauaacaaaaggaaaauaaauauugugaggaagucauuuagagagugcaagagucaucugccuuugccucccagauacuggaguuaaagacaugcacaccaccaugccuggccuaaaaaaaacauuuuaaaaacuuagggccacucauauuacucagccaaucauuacucuuuccaugcauacauacacacacacauguacacacucauacaguacuacuacuaauaauaacaauaaugauaaguaaaaauaaaauuuaaagaauaacauguuauuuuaucauaagagacaguggaauguucuaauccuuuaauagguaaaagugauaauguucccccagguggaucucugaguucuaggacaacuuaauucuaagaaacccugucucagaaaaaaagauaaaagauaugugauagaguuaaaugccauucuauaugacuuauaauaaaggcuuucuucagaaggcauucugcguaguguaucauaauuauucacuggaauccuuugauacaaccuaauuaacuacaaguuugaucugaauuucauuauccaccuuuaugcuuuccaaguuaguaacagcucagucccugugagauagauuguaaagucagagcaaucaaaauucagccauaagauuagaucaaguaugguaugaaauaaauuuuaaacugguguuaacauaauuauuugaaauauuuuucauacuauuccugucacuagauaaagggaagaaaagguaguugaguuuacguuauaggaagauucuaguuauaaacugagaugaaauucuguagugaaacuuggcaguugcuucuuuuaguagauaauucaucauauuuauuguuucccacaccauacuuaaucuuucuguguucuuauauauaagcauuucugaaauguuagguuuuaggcauuuggcugugcuaaguucuuuuuccuggggaauuuguaaucuauaucucuaaguuaaauuuaaaugguaaaauguauguaacauguucuuuugagagugucaguaguauguuucuguggcugucuguggcuugggugacuguaaacuugguaaauugcaugcuuuggcuaugauuuuccugacgguuucagugcuguuguuugcuauauuaaaauuauauuuaggaggauaagcuuaaagaaccacuaggcaguaaauuauagaagccauugcugucauguuguaacugcauguuguauauuguuaauuguauuauuaggauuuuuaaacuuguaucuuuauaugaaguuucuuuuuuuaauuccguguuuuccauuacucuuccccuaggaucugagucuucagguaguguaggguccucuacaggcucucuuucucacacccagcagccucucccagguucagcucuuagccagucuucucauggcgcaccugucaucuacccggcagccagcaaucacaguucucuuuccuuugaugguggccucaguggucaaggugcaucuccuagcacuagcuuccuuuugcuucccuuggaagcaacuggcauaccaccuggcaguauucugaucaacccacaaacagguggguauccagagagagaguuuauuguaguuaacauagcagaaaauauuugaaaaucgggguacuuuuaaagauguauuauuuaaauguacauauguuguuagcuuuuuaauuuugauaaauaauugucuuuguccuaaaaacuuuaauagaaauguuuaggcuccaaaauguuaaaaacuauuuuuaucuuguaagacaauauuccccaugugccaucuaugauguauagacuaaauaagagcuugacuauauuuaaacaacaauucauuccauuagagauacucaacugccuucgagagagcuuuaugcggcauagcauuuuuauuuuguggcaaguuauauguacuuuaugaguaagaaccaaguagaaaaaaacuacuucuucuaauguccugagaauaugguaauuacuuucuuuggaggugguucagacaggguuucucuguguauacucuuggcuguucugaaucaugcuuuauagaccagguugaccucgaacucagagagccaccugccucuaccucuuccgggauuaaaggcaugugccacuaccaccagcuugguaauugcuuucuacuuaagaaacucuaaaauacauuccuucuuucuuucuuucuuucuuucuuucuuucuuucuuucuuucuuucuuucuuucuuucuuucuuuuuuuuuuaaagauagguguuauaaauuaauauugauaauauauguucuuaguccuugucauuaaccgaugauaauuaauauuauuacacauuuacuuuuaaccauauacaguuugauagaguauuuguccaaacccuacuuuguucguuauaagcaaaauauuuucuaaagggcuaaagagaugacccagucauuuaaaaucccuggcuucucuuucugaggacccagguucaguucccaacaccuacaugagcucaugcuuuaaauucuucauucaugaccuuuauacuggcacuuuuaguaggagaaauucccauuuaaaguagggaaauugaaauacguugcuagacacaaguuuuuauguaauauuuuauucugcauaaucuguugccauuaaguugguuuauaauuacucauuuaaagcugucauuuauuuauauuuuaaacguguucuucauuugucuggggguuuuuuuguuuggaguuuuuuguuuguuugcuuguuuuguuuaguuuugaauuuucaugacaggguuucucuguguagcccuggcuguacuggaacucgcucuguagacagacuaugguggccuugaacucacggccuccucugagugcuggaauuaaaggcaccacuacuuccuagcuucagccugucuuuuuuaaagugacauauguucaguauggccuauaaccuagauuacuuccuaacuccuugaaaauuugugaaugcuuuccugauacuguggagucaggcauuuucuguuugagcugagaugcaugucagcccuaauguccacggugaggcuguccagaaugcuacugacccuuuucccauggucuagugauugaguaccuggcagaaugagaucuggaacucacaacuuuccagaaaauacuuugaaaauuuuauuuucauuucuagugauuaaauguuuuugcuugcauauacauucaugcuccauaugacugcaguaucuacagggaccagaaaagggcaucagauccccuggaccuagaguuaacagaugagccugucagccaugugaauugccacaugggugauaggcuccaaaccuggguccucaggaaggacggccaguccacuuaacugcuaagccaucucucuccaaucccucaaagaaaaaaaaauacuuugauuauccacugagcucggauagguaugaaacaacaccccauccccaaaacacauuaacauuugaauauuucuaagugaaaaauauaaagaagguucuuaauagcuuuauuucaaaucacccugguacuucccaagcuaagugucuuaagaaacuugagacuuuuggaauuuugcauaagagauuuauggauguguuuuauaaaucaguagugacaguuuuauuuucaguccuauuguacauugacucuuuccucauuuuuuuucaacuuuucaggucagcccuucuuaaacccagauggaaguccaguuguguacaauccuccuaugacucaacagccaguucgaacccaagugccugguccuccacagccaccucugccacccccaccaccucagcagccagcagccagucacauguucucacaggugcacaaacccaugauucuguaaugcuaagcucaccugccuuugcauauguagggcuaaugacugagguagccagguaaguaucucuuacagcuuuaauacucuguucccgcugaugucccacucaguagucacuggaagaaaauguuaaugacagauacuuacaacuaaaaaauacugaggauguauuagaaaaagagggagugauacuaucucagggccugacugguaaguauuuuaucccuauuuuacaguaagaaguagacaagaagaagaauaaaaacaaagauugcucauuggccuagugaguaaagugaguuauuaaaauugaauaaauccaacagaagaauuggcacugggcugaucaagccaagcagaguacuuuuucuacugcagggcuugaguggguggauucugagagugcaauguuuauuuauuuacuugugcaugugugcaugcacacaacagcaugcacguauagaucaaaaaacaacuuacaggaguugauucuuuccuuccaccauguguauauuggagauagaacucagguugucaggcuuaucagcaaauauuuuuacccacuaaaccaucucucaggcuccugagagguuuuuuguuuguuuguuuuuguuuuuuaaauaggucucagcuggccuggagcuugcaguguagaucaggcuggccuagagcuuacugaggucugccugcuuaugcuuugcaagugcuggcauuaaagcuguggaucaccaugcuuggcuuuaaaagcuuucuuaaucauaucuugaauuuauauaaguaauuuacagcuuauacauacauaucuacauugucuuuuuauucccuaauaauucauuaucuauguuuagugagugauaauaucuguauaaucccuaugcucacaccagcuuuuaaagauuauguagcacucauacaccugcuucgcuacaagaucauaaaaacguuccacuggcgaaccuccuuuaguguaauuucucauaagagaugugcaguguuaacauugaaguggagaaacuugaucccauuuucuuauaagaugugucauuuaguuaaagguguccugugggaugaaggacaugcauaaguagugaguuacacuuugagguauaugaaaguagugaaagccuucuacagguaagauucuaggcugggcaugucaguuguuuucuuuugcuuugcuuugaugccuaaaguagggauuaaaacauuuuagagacacuuauaaaaccauacaaaaacguccguguaccuaaaagagauuguauuaagcucugccagagaauucuguacgaccuucuuaauccugccugaggcuacaauuccuuccuuguccacucugccuugacuucauucaacuuguuuccgaggaauugcuucccuuugcuguuguauaacugccuuuacacugcuguguuucgccaggagcuuuguaggacugacucccacuuuuacuuaauuugauggaaauaaggucaguacagcuuuuaaaaauuucaaggauuuguuuaugguuauaugucucagauuauugugucuuaggaauaauuuugccuaucgauucucaggccugugguuaagaucaaauuuagaaauaacauuguccaagguaguuuugagaccauccuagauugaggaauggagaauguaguuuugaaacaagcauucaaaagcugaauuucagaucuugaaguaaaaauccaauucucugauugauuuaacuuaaacauuuaaaaacaaaaaaacaaaaacauugcagcuagauccucucagaaauaaaaacucacugacguaaugauauccuauuacuaucuuuugcauauucugagauaaaugauuuguacaauuucacauaaccaacacuguauaucuaugaauuucaaaaacagccccuucaggagugcuguauuuccugaauacaacauaaaaucagucacuguguguggauauuucuacaagagggaaacacuaagacuuuuccuugucaauuuggugucaggauuuuacuuuguucucucugccauuuugcacucuggaagacauucauucauaccaugggggcucaucuugcauucuuucacuuuuccagcaucuaaguuuuugcauaucugacaacuugaguuggucagaaugacugauaaaggauuauaucuuauuguuuaugugacuuaaugcaucaaguaggcaguaguagauuucuagccacuuguacuuccucaacuagcugauuugguuucucagggaccaccagagacuccagaucauucagcuuuuauuucuuuucugcuuuuguuuuaaucuuguugugugggacucucagcuaucugacacuuuuagacuuuuagacuauucuguugauuuuguuggaaaagaguaaucauuguaaaucugaguugucaguauucccugcacauucuuacuucauuauuugcauuuauaauuauucuuuucagcaacauuagccauuacaggauucauuggugaauauacaguuuaaccaaaagaguguuuaucagaucaaaauuaucuguauccuucaucugcuugcuuaacuagcacaguaaaaaucacuuaaucuaucuucaucugguuuuucaucuauaaaguagauuacagugaaucaccuguuuuuaguaccuuuggaaagcaauuuuccucuccuugaaacaaaagaguguuuggcugaagaucuauagugucuaauuccucaguuccuaccaagaauucuucuaauaaaaauauauuuagcauuuagccacgaggaaaagauuguauucuuccuagacgaugauguguguuuguauauguagauaugugaugauguguguuuguauauguagauaugugaugauguguguuuguauauguagauaugugaugauguguguuuguauauguagauauguuuugguccugacgugguuauuaagauuuauuuuaugugcaucuguauuuaaguugccuguugagaaaaauacacacacacacacauacacacacacacacacacacacacacauacacauacacauacacacacacacacacacacacacacacacacaccaugugauuaugugaugccuguggaggucaaaagagggcauuagauucccuaguauuagaguuacagauggaugugagccaccauguaggcucugggaacugaaccuggauccucuacaagaguacaugcucuuagccgcugagacaucuccccagucaccaagcagguuauucuuacaguuuuuucacacaguggugaaguuuuaagaacauugucucuuagaauuuaaacaugcuuuaucaaauaagaggauugguacagaugcuauagaaauuuauaagguuuuuauuuauaauuuaguaguauagagcaacuuaaacauaggacggccccaucacaaaaaucaagaaauaagaguaagaaguuuuguuuuuacugacaaaacucagauaauaggguuucaaauggcuaaugauguuucuauuaaugacauaaaaguuaauauucucauuaugaaaucaacuugagccuagguauauucuugcuguuuugaauucacuugauacuauuuuucuuguugaaucucuuguaauuuuuaugacuuuauaaauguaaagcuguugccccaaaguguaaauuuccaugcugugcacuucuuguaacauuuucuucugacauuaacuguuuacccaccuguuauuccuagccuguugguccucugcaguccucuucucagccuguucagugcucuccagcccccuacccauccccgcuccugccagucucacccacccagcaguacuccgugguacuguaucuccuuucaccucacuguuacuaugggcauugugugaugaaugcuucagacugugcucagugugauuugcucuuuuacaggaaguuacauagguaacaaagguuuuuucuaauucuuauuaauaauaauuuauuccuuuucauaagacagugauuauaucaacuuauaguaacuauaaaagacuuaauauuauuccuauuuuucagaagggaaguuuucagguugaauguucugaacuaaguagucucagauaguuuaguuuguuuuuuuuaaaucgaagucaguuuugagucuauguaguccuggagggcagugucauagaguucuaauuaaaacaccauuacuaagaucaagaugggaggaaagaguuuauuucaucuuaccucaggagucuaacuauauuucugugggaagucagggcaugaacucagggcaagaaacuguagguaggagcugaaguggaggccaugcagggcugcugcucauuggcuugauacucaugccuuacucagccugcuuucuuauacaacccaagaauacguacuugcccggugguggcaucgcccacaaugggcuggcccuuaugacaucaaucacuauuuaagaaaacauaccacagacuugcugacagguuagucuuacugaggcuuuuucuuuuuuuuuuuuaaaagauugauugauugauugguugauugauuguuugauugauugauuugguguauaugaguacacugucuucagaaacacuaaaauaggguauuggaucccauuacagaugguugugagccaccaugugguugcugggaaaugaacucgggaccucugaaagagcagucagugcucuuaacugcugagucaucucuccagccccauuaagucauuuucuuaaugagaguccaucuucccaugugacucuaguuuguguuguguugacauaacucuagugagaacaggcagcuuuccuuuuuaaguacuaguuagguacaguaggucagaagcaguuacuuucgauggauugcagcauguagcuauagagaacuucugacuuuaucagaggucacuugacacuuaauuucuuacuguaagauaauacccuuaauccaaaguaugcccugaauuauaguugucagggucugugagaucaggcccgcacugcaaguaauuagcuuugugauguuaaaacauugcaucuuuucccauacaugaacuagcuucuacuuuuaaaaaaauuugcuuucuuuaaagugaacuuccugaaaaacuugcuuguuuuuaacuagggauauucuauguugaccuguccuauguuggaugcuuuugcuuugaauugaggagacaauauuuaucagcuuaaucucucaaugauuuuaugaaauaacuuucagccuacaagaaagagaaacaugaggcuggagagguggcccuuugguuaagaguacuagcugcucuucagaggaccaggguucagucuccagcacccacgugguagcccacaaugccuuuaauuccaguucuagggaagucugacacccucacacccaugcacaugaaauaaaacuguuauuaaaaaaggaaacauuaucuuuuaugaauggcucuuguacuuauacuacuuuuuuaauauuuagccauauuauuuuguaauuuagaacuaggaguauuuucauauauaagaagccguuuccauauauucuaagucuguugcuuccuaagagcgggcauuucauuuuaacccuaugcugucauuugggugaccaauaagagaucaugcuuaggcugucgaguuaggagcuaucugucguauggcacauaacucauagccuuggcuguaguccacugguugcuuagcaacgauccagaaacaggacgcuuugauauaaaguauccuccuguuuacauugagcggcagacugagaaauuaugccuauauuauuuuuugacauauuaaaaaaagggaaugacuaguuagauuuugauaguuggaaaugcagaagagaagagcuauuuaaaagucauuucucacagaaaauacuaaauauguaauauaaaaauguccagguuugcuucugaacccaagucaacauuuaaacuucauuaaauacauguagcuuuguuuuuuaaacugaaaaaugcacucucaucuuuuucucaugcuaugauuuccacuagguauauuuuauaaauaauauguaauaucauuauaucuucccuccuacauaggaguucucauuuucuugaaccugcugucuuauaucuuaucuguuauacaugcaugugaugcccauacauauacugcuacagcuugcuuacaaauauauaaaguguaauugaggaaaauacguaauaaaaaauauuaaaaauaaauaaauaaaauaaaauagaaauauauauauauaaaguguagggcuuggguaauauagcucaguuaguagagugcuugccucauaucaaauugucuuggguuccguccuaagcacugcacaaauuagacauugugauuuauagcugaucuccagcauucaggaagugggagacaggaggaucagaaauucaugaaauuuucagcuacguaaugauuuugaggcuauucucugagagaugagauacucaaagggaugugggguguaggguggggguguauuguagcauuugcauugguagguuuggcccaugaaugaaaggcugacugauggccaacuuuuuuucaacaggauaaccuuggcgcucaguucagccauaugagucuugcccgccagccaucagcugaugguucugacccucaugccaccauguuccaguccacuguuguacuacagucuccacagcagucugguuacaucgugacgacagcaccuccacauccgccaccaccaccuccaccaccucccccuccuccuucccuaccaccugggcagucaguccccacugccaguuucucugccucugggcauccugucagccagccugugcuccagcagcagggguuucuuccucagcccucaccacagguguguuguuuuuucacguucuuucucucucaggaaccucuaacuugggaacaauuugugagguaguguaaguaaagcccaugguuaucucuggagauugucaaaugccuagggagcagccauauaacauuuaguuacaacucaacguacgucuucuuugaauuucccucugacucugagaaguggguuuuuuuguuuguuuaucuuaggaaaacauaauaaguguguguguuaguuaggguuacuauuacugugaugaaauaccaugaugaaacaaaagcaaguggggaggaaacuguuuauuucauuugguuuacacuuucacaucauaaucuaucauugaaggaagucagcaaaggaauucaaaacaggacaagaaccuggaggcaagagcugaugcagaggucauggaggggcgcuguucaguuaacuggcuuguuuauccuggccugcucagguuucauucuuacagaacccaggacuccuugcccaggaauaguaccacccacaaugagcuggguccuuccugccaaucacuuauuaagaacaugccuuaaggcuggcuguuauagaggcaccuucucauugagguuccuuucuuuucagaugacucuagccugugucaaguugauauaaaacuaguccaccagucggcacaaaguauauaugacagcauuucaaaaauaggccaggcugaacagaaguagcaucauaguggcaacuuuccuguuauaaacaaaucucuccguucacuuccuuugaucuuaauuguuuucacuauguuuaauguggguugggggggguguuuguuuauuuguuuguuuuguuuuguagggaguaaauuugagacaguuuuucuauauagagcaagguuuccugaaacuugcucugcagacaggaugaccucaaacucaaaacucccaucuguuucugccucccaaaugcuguaauuaaaaaugugcacaacuuggcuugacuguuuugccaaaauagauaguacauauuuuauuuaguacacuugaaacauuuaaugucuuuaguugcuucuacaaaaggaacuguuuuuaaguuucacuuuuuuauuuguucacaacaaagggaauuugagcauagugauuuuauauccuguggauucucuuucucuucuguuuagcuacuuccucugaauugaaacauuccuccuuggugguaggaaggaagcuuauauagucagaaaauaagcaagacuuacuagucucagagcaucaaugaaacuuaaaauuaucaagaagguccuaaaacagaagaucacaagggccucccugauguuacagcaacaugugcugagagagauuccucuccagacuagaguguaacugccucuaguuguucagggaguuccagugauacaauugucaugaguugucacaugcacuucagugagcuauucaguaaugcaguguuugucuuuuauucauccaguaaacucauuggguuugcuaagcuagauguuccuggccucguuucucuggucuguuguuugugccauccagggugucuuggaugaauagacguuuguucacaucuccccagguagaggcagaaucaggcaacaccuuuccauggauauucauugucauaguggacuaaguucuuaguggguuuuucuuguuuugccagguugguuuuuuguuuguuugcauuaucuuuucagguuaguuugucuugauuuugccuuuccuuuaacagccauuauuaauccaagcaaucauugugcacauaguaaggauauacucuaccauuaaccuacuagcuuucuuauauagccuuuuuauggagugagguucuaguuuuauagaguucuuagaauuguguauaugacagaucauuucuccacaaaagauuguuucugggcuuuuuuuuuuaaccccuucacuacaacuguucgagaucagauuaauuuaaaaaacaaacuacacuacguguaauggcacauuacuuuaaugucaacacucaagaggcagaugcagguggaucucgagucaguagucagccuaaacagaauuccagaucaacaaugacuacauugugagacccuaucucaaaaaagaaauggguaauaucuaaacacacuaucuagaagguauucuggucaucuucuuacugucuuuccacuuugcccccucuucaaagauuuucuuuaaacaccuuuguaaaauguuuucaacugggcaugggcuccucacugauacuuacucucuugguuuuaaauaguugugaaucucuguaauggucucuguugcaaaaagguuuuuugcuacacuuacuugccuguauaaggauaaauagaguacaauuuuaaaugauugggaaaauaaugguuauggcuucucaccagcauuuauaaccucugcagccacagacgagguguauguaccaagcaagcaugaacucccuccuauugaguagguguuaaauccaauuagacaacuguugguaacccauagauaaaagugcugguuuuacuucacuggggaucccuuguccggcuggcauuguugugauuuguagcauguacagguagguaggguuguugauugcuuuuuuuuucauuguuagcuugcauagcaccuuuugauagugugagagcuauuccucagggaggaggcuuccagucacuucaacuccacuuccccaagcccugagucuaaauuaugugguguccucagaucuucgagaucuggaagcagccaugaacaaugguagcuuucaguaguauuucagccaagcaaacuugguuuuauuaaaaaaaaaaaaugugaaacaaauacagcaauaaaauuaacagcuaaaagugauuagugagcacagugguaaaugucuuuugcucugugugguuugguuugagggauuguuuguuuuguuugagacagggucuuucuauuuagcccuggcuuaccuggaagucacuaugcagacuaaguuggccucaaacucacagagauccccuugccucuguguccagaaugcuaaaauuaaaggcauuuguugccacacccacgggaggauauccuuuuaaagauaccugaaaccuggacuuuauuuuuuuuuuccauuuaaauugaaaaauccaguugguuuuaaaaggguuuauaauuacuacucauugaaugugcuucauggaaaaacuacuuuuccaaaugaaacuaauuuuuguccucguggcuuacaauuauagaugccagccuguuacugugcuccaggccacuaucacuccagccaaccucaguaccgcccuaucccuucuguccaucacaguucacaccuaaaccaaccacugccacagccugcacagcacacaggugaguugucuccaugccaagguuuucaacucuggacguuacuuugcuuccaguuuuacuuuauccuuuacauuaagauucuauuaugcucaaucuuugaggaucucaggggugugugugugugugugugugugugugugugugugagagagagagagagagagagagagagagagagagagagagcucuagucacauuacgugaagaguagaaaaucauaucuuucuuuagaaaacuacacagauuugugugauaaagggaugagggcauaacaugaagguucugcaaggucaggaucuggugaguagcuauuggguucucauagucuugguaguagaagcccuuuacagagcuauguaaaucgagauggccuccauacuauaaccagaaacaaaaagcagaaucuguuaaaugguuucauuugaaccuuaaaugucaaagauggcugaagaacuguauucuuuuucuuuugguuuugguuuugguuuuuuggagggguugugguuuuuuggguuuguuuuuuuuuuuuguuuuuuuuuugguuuuuuuuuuuuuuuuuuuuugguuuuuuuuuugguuuugguuuuuucccagagaaacuucucuguguagaccuggcucuccuggaacucauucuguagaccagguuguccucaaucuuaaagauccaccugucagagugcugggauuaaagauguauuccaccaccaccuggcuugaugaacuguauucuuauacauuuuucuuucucauuuucaguuugauaauuauuuggugaacaagaaacaaauagaaucuacuacuggaaguauaaaaauuauuagaacucaaucuugauuucuuuuuguccuauuuuuuaaagaaucuguugaacugaacuccagucucauauuuuagauacuguauuaagggcuugguaauaauuuagcaauuagugauugcuuuacaagguugagcaccugaguguagucccuauuccccacauaacaacagacauaguacgauacuuaucauuguagcgcuggcaagggagagagguggauuucugagacuugauucccagccaaccuggccugauugguguacucagaacuaaugagagacuauuuuaagaagauaaggugcacagcucuugagcaaugauacccaaggugaucucugguuuguacacauaugugcacucauugaugcaaucccacagacacacagaaagcugucuuacugaucuuaaugagcucauuucuguugccauccugguuguguacuguuacaaauuuuaaugcguuauuuaauuaaaaccuguguuacguaaauuaaagaauugagauuaaauuuuauaauugauuucuguagagcaguuugcguucuuugucauuggcgaagguacagauucugugcagaggcauuucagucaagcugcacagaggagucugcuguuaucagugcugucuccuaacucuuuagaccuacuucuggacuggucauuccagugaaaauacucacuucuugcuucuuguacaguguagucaacaacucccauugcagauaagagucauaauuagcacagcuccacauccaaacuuuuguguccuuaaccugcuauaccugaaaguuuucuguucuuagugguugggcuccuuuuucuguucacuagcccuacauuacacaugcaacagguauuuuccuacaugcuuuggcaucuucugaucauuuuagcuaaacuauaauuuuuuuugucucaaauaugacuccuuuuaaugucagauuugccugaagccuaguaauauggcccaugucaaagaauauaaacaguuuauauuuuaaguuaagaagauaucaaaguuguugcuagcuugcuaguugucucagcagguaaagaugcuuacugcgcaagccugacagccugaauuugauuccuggacuucuguaaagguagaggggaaaggaccagccccacaaaguugucauguguucuaugacacaucauguaaacucucgcacucguaucuuauaauuauaacuuuuuauaaaagguuuuuauaaaaaugagauugcucaugaacauugaucauacuauugcucauuuaaggucacauagacaauuguauuauucuaauaaaaaugauauucuagcugggaccagugacauaugccuaugcuagcgcuaugugggcugagguuaggaagaucacagcaggguuaagguacacuugggcuguauaacagcaccauaugucaaaauuaaaacaaaaaccuuaaaaaauaauaguaaagaaagcauuuuuucugugcuuucuugggccugaaaauaauugacuuuucguaguguauaucuuuuuuguuuugccuucuaaaauuauaacaucugaugugauuuguuuuuauuuaugguuuuucccccugugguccuggguauuagacuccagucuuugucuaugcucagcaggcauuugcugccuggcaacaucccuuccugugauagcucacuaauuuuauaaaaaguaaauugaguacuggagcaauggcuuagagcuuaagagcacuugcucuuguagaggacccugguucaauuccuaacacccacauguggcucacaaacaucuguaacuccaguuccagggaauccaaagcacucaccugacuccacagacaccaaaccuacauguaggcuucuacaacacuuaugcacauaaaauaccuuuaaaaaaaucaaaaaaacuucaauagaaaaaaguaaguuggggcuggagagauggcucagugguuaagaacacuggcugcucugccuuaguucaauucccagcacccacacgguggcucacacccauguguagugagaucugaugcccuguuccacugucugucugaagacagcugcaguguacucauauaacaaaugaauaauuuuuuuaaaguaaguugacucucaugccauuuauuuaaguacuuuuuauaugacucucuguguuaucaaacccuguuaauaggcagcaaagguccucugcuguguauuuaugaaagcuuuuaguuuuaucuucuuucugagguaaaaauguauuucuuaccauaaucaguuuauaaaauaaaaacuuagucaccuguugggacuguaguacuuaauucaguugcaucucuccacacaguuauccccacuuaauuaaaaaaaaaauuuuuuuuuuaaugccaaauagacauaucuaugugguagaaaguaucacuaucuaucauuuguguuaguuuaaguguggauuuucagguguuaguuaagacaaaagagaagaacacaguaagccaaccugcaucuggacagcacaagugcagaaaaggucaaccuaucuucaauaguuugugacauuaucugacuccuaggugucagguauaauaaaucacugugaugagagcuugagcuuuuauuuauuuuuuguauuugccuaguaguagcuagcuuaaguuguuaguuuugccucauucuguuugaagaauaagaagaaaauccucaaauauucuguuaugcuuguaaguauagaaagaauauauagaaauagaaacauuaccuuuauggaaauuuucaauaagcagaagcaguuauguguagguaauuguacuagccuuuuuauagaacuggugggaauuugaacucuuuuaagcaaaacugaaucuuaagacuauaguuugcuaaguuuuuuuauacuaagacuuaaaaaaaauauauaacuaaaucguaauauuagaacaaagaacuagaagauuagguaauuucuggguuuuuguuguuguuguuauuguuucucuguuuacugauuucugccccaauuuucauauguaaacauaguuuaugucuuaauauauuuucuuauguuuaaccauuacaacuaacuaaaauguaaacuuuauugaucacuguuuuuuggcucuuauccaccaugccuucauacccaaaaggagcucacaaagcuuguuauucucuuugauuucaugaaaaaaaauggagcuaauuauucagccaaauaaugaaaaauugcaccaaaguauuuuagcauggcauuacuaagacuuaaaugcuuauauaugaauuuaaagaacauuuucccuaaauuaacaaacucaucugagucaauucugagaccacguuuuguauagacaauaaaaauaaaugauuuucuguuauuuuccuccuuguagaagaaacuuugagaaauucuuuucagauaaaaugcuuuaguguuguaaccauaucuuugccaguguauugaucuccuugacaauaaauucccuuauacugugggagcccaguggagcaguauuagcauaggggagucuugucuuagucuuguguggugaauguaaacucacugacuguggucauucaaaauaagaugaagucagcacauguaaaacacauuuauggaaguccugacuguaugaagcuuuccagacaauacaguguguaaugugaaagaacggcagacuguaaaucagaaucccagugaccuaugguuuuuuuuucuuccuuuuuuuaaccuuuaauuuauuuuauuucauuuuauuuauuauaguuuguguguauagauguuuugccuucuugugugucugugcauuacauacauacauugcccaaggaggcugguagaggaugaguccucugagacugaaaucacacacaguugugagccugcaguggaugcugggaauugaaccuaggcccuccugcaggaucagccagugcucuuaacugagccaucucuccugcccccacaggcauuuuuuaaacuaauauuaguucuguuaguuaaugccugggacuuugaguuugaucacucacagaauuagguuguguuguuauauugucuagccuuuguggacuccaaaauggaaagauucugugucuuuuuuuuuuuuuuuaagucauuucugguuuagaaaggugaauaucagaauugacuuaaaauaccuuagugucuuacuguuaauaacugcagucaugcaagcagcuauuucaaaaaaucugcuaguucuuaauugcaauacuaguaacuaauuauuucaacucuuagcauacguauaggauaguauauacaguauaauacauacacuauaaaaacuugaaagaaauggaccaagaaauagugacguuagcaaugacagguuuauaggcccugacucuuugauacguagcugcuuucauucuuggacucuuuugaaaaguuugcagcuucuccuuaugugcuuauauuuuacaauaauuggccuucuuccugagcuguuggauucggggccguagcacugucugagagguuuacauuucucacagugaaccggucucuuuuucagcugcuuccugacuucuuuuuacuucuuuuugcuuuuuugcuuuuuuuuucuaugcuauauuaagauacuaauauuuguuuauauuuuccauugccuauaauuaccuuuuaauuuugcaucauacucagaaauaaggauuugaauuuaaguaacaaccuuggcuucauacaauuuauccuuaaaaauucaaauuaucuguugcuuucauuucuuuuccaaagcauauuuggaugcuuuuuuaagauucaauuugguuugcaucuuaucuaacagaguuuaacaucuuaagcaugccaaacucauuacuagacaucaaauuugucucuuucccuguuuuuauacaacuuuuuaggggcauaauuauucauuaaaaucuggaccaaaugaaccaaagauaccacaugcauuuuaagcugcuugggcccuuaccaagauacauaguucaguuuuccccuaaacuguuacuauuaagugccuaugagaaccauaauaauucugugaaacugaauauaauuuuauccagaaugaacaggaucugugauaugcagaauauaggcagcauugcgggccacagauuagaaaggaccuagggauuaaggaaagcugguaguguaacucaguugguagggugcuuugcaugaagccacaggguccaucuccuauaccacauauacuguauguuacauauaaaaguaacuagaacaugaaagacaaagaagaauggguaagcagagguaaauuauauugacaagagauugaguuacauuuuuauaagaacaaaacugaucaucucucuccugucaauuuguaaccauguaauaggaacuuuguauuacuaggugguagcccugguuuuacuuaguuuuuuguugauucugugagcauuuuucaguguugcaugaacagcauagauuucagaaauuguauaaaaaguacaacuccaccuauuuccauuuccccucuccauuaaucugcugccucugaaauauggagcaaauguauuugguaaguacuuacagguuuucuugaguuguuuaggauaguuauuuaaauaacuaagagauguaacuucucuguggcucauuuuauucagauugguuuuuccuggcauuucuguugaguuaaagcuugacagagaagaaagacuagagagguuguguuagcagcucugucucuuaccaaguauaacugagagcagucuuugguugaacuugcuuguucuccaaauaguaccugguuuauaaauuucauaaucuucuaaauuuccauuugagcaccuaguucauauguaauuuagauucagcaaaaaugccuuuuaaaggcuuaacucccuucacagugcuucuuucaacaaacccagucuuuaaagaaaggauguuaauacugguaaggaaguaaaccuagaauccuggugauggccauguugaugaaccauuucuucaguuugucuaucugauuauggcuaaucuguuuugaaggaugcuuuccauuaacacaaaugcuaguucaggucaccuaugauaaaguaagucuagcuagcacuuuucuacugagcacugauuuuccuuccugcucucuucuguugagaguuaaaaauagaaaguuccuuauaaccuuccaggauuauuguagugccaacaauucaaacugaucuugcucucucagguugcagaauuguugcugcucucagaaaguccuggaagaaguuggauaauguugcagcagcauaguucuuuaacaaagaaugggaguguuaaacacucguauugauaauaggaugucagugaauucugcuugaaaucucuuauuacuguuccuuacuuuuugaauaauacuuucccccagauugacaaauuccaauaaaagauaacucacuuaucucuuucugguuauuucuaaauaagucacagagaaaaauuuuaaaaguuuaaauucucucauacacggaaacuacuuuugauaaggaaugauuuaugcuguccugggggagggguggcuuauugugucaggauacuggaaaugcucuuguggcgcuuuuuuaacccaaugguacuuuucuuucucuaggaauucacuucuccuuccuuauccucagucucauacuuggcaaucuucacacuauauuuuugaaacuauguaccauuuccacuugucugaaggauuagauaagaaacuugaaucacagagccacuugucauaggugauacuacuaacaacccaggcugaaugcuguaaaauugcuuuguuuaaacagaaguucagaaaaaauuuucaagcaguuuaaauacuuuuuaaauaguauuauuuuuauucaauggauguacauaaagugagacaugccuuauaccaugugauacuaagugauuaaugauaggguuuucauuaaugacaggaagagucuuaucuguguuugaaauacaguauuaugcccugucauguuuuuagagcuuuccauguuucuaacuuucuuuuuuauuguagugugauaaucuuuggacagcaggcccuacaguuaccuugcacuauggaaaguccaauaauauuuuaauaucuugcucuuuagaaaguacaauccagaauugcuuauuagccauuuccuggguuuuaaaauuauuagaauaaagaaugaaucguuccauuaugauuucaaaaauaaaaacucaaauauuuguucuaauaccauuaaaauuucccucuugaugguuuugguugugauagucuuagaaagguuccauugcaaagauuccugaugucuccuaccaguaugguucaacccugguguguuuucccccuugaugcuaaaaugaauggaaagcaacucuguggguggugggggaaaguuauugcuucagacaaccccaagacaugaagcaaaacagcuucccugcuuaugagguauccuaaugaaaacagacuuagccccacugaguaagucugagauuguggagaagacagccagcaucuguuaaaaucuucuacagacucaaccagaauauggcaacagagucuuucuuuuaagcaaaaagcaaccucaaauaaaacuaccaagcugaauccucaagaagacuacuguagauugaaaggggagcacucaggaugcaaggcccagagcagcugagauuccuuaugcuuugggcuucuacucccuuuccuaauaguuuucuacugagaaagcuaaucucauaagucaagcaggcauauaacuuugaaauacacaaaccaugccaagagaguggggaaaacagugaguacacguggacugcuuguauaaccuuacucuggguggcuuuuaacuccgcaguccauauagcugcuuucgguacuaacuccuguugauuucuauuuuugauaauuaugucuguucucacaaacauucuuuaauucaaauggacaguuaguuggcugacuguuucaccucauuuauaauaauucuguuuucuugccacacaugguagcacaugccuuuaaugccaacacuuagggaggagacaaaggcaggcaaaggcagauuugucuacauaaugaggccagcuagggcuacauaguuucuucuuuuaaaaaaauauaaaaaauaaaaaaaauaaauaaaaaacacaaacucuacauuuuccccaauuaaaauuaccuagaacauuagguguguuacacuagaguagauaucuucucuaaccaaaacucucagaaaaucaaagaucacagauccuucuuauuugaguauuucuguaguacucauuccacgucaacaguugucucuggggaagguaaaacuuacaugcagaucccagcuauacacugaccggcuucugaccuuggacuaagguaugaaccuuucugugccuuuguuuccucaccugaaaaaugaggauaauuguguuuccgaaauaauugucucuauaaauguggaauaaguuauuugugugcacagagcagugcugacaucuaauaaauugaugaccguuagcugcuaauacccggaaugccuuugaggcagugauacuuaccugauauucuaagugagagagcauaggaguuuugaauuuuuaugcuagagaccagaauacaguuuguccuaaaauauucagccuuuuuagcuucucaguacauguucuccuaaagugugggagagauaaacugaguuauuuucuuaucuuuuaauuguuaaacuuaaggucuaagcauguuuuguuuuauguuguguuguauuguuuuguuuuguuuggagaccaggucucacuguaucaccuuguccagccuagagcuuacucuuuagaugaggcugaucucagccgcaccaggaucucccugccucuaccucuugaguguugagauccacguaccaccuggccuaaucaucuggucuuaagaaaaguuauuuagggacuggaaagauggcuuaauacuuaggaauacuuucagagaaccuggguucgguuccuacacccacauggaaacuuagaaacgccuguauuucuaguuccgugggacuugaugcccucuccuaaccuccuugggcacuucaugcacauaguacauagacauacauucaagcaaaacacucauauacauaaauaaaucucagguuaaaaaauugucauuuuaaaaauaaauaaauaaauuuuucauuuaaaaaagaaaauuuauuuacacacuuccuucccauagcuuguauaaucauauuuaggugcauuaaaggcaaauagaauagcaauuagugauuauagaugaaaguuuugcaguuauuaaauuuuuaaauuuucugcuaugaauaucugucuuaucaucaaguaagguuauuugaaaggcaccugauuauugcacuuguuucagauauguuaaaauaauagcagggguuuuuucccuaaccaauucaauauuucaugguuaauuauaugaaauuugugucucagcuauuggaaaagagguuuaaugacugagccacaaacaucagacugaugggacuuguauuaugaauuaccagcuuugugaagaugacaagguauacuaaccucauaaacuuauguuacuuaaacuguugacaucugagagcauuuacuaaauauggguuauaagaaacuggccuuucagcacauccucugucuggauuuguguagaaaaauauuuuaauuuguuucuacucuugaguuuuucaccauuguuuuaaguaugaauauugaauacguacauuuuagcuaaauaauaguuaauacaaaauguuuuuuucugaaaggacaaugaugagcguuaaaauuucuuucuuuagucuuaaaugauagaucauuucuguuuuauuuaacaguauacacaaaucacgaaaggaugaauuagcaagagcaaguucauguuaucaguacaguuugggggcauauucuacaagauaaugaacagaauuuucacaagggagcaacuuagggaaaacauuauuuucuugaaaguacuugucauucuuauuuuuaauaaauccacuguuggucaaggacagucacaauuaauugaugcugcuugugaaugaaauauuaauguaaaaauguagacucaagagucagugggguaaauaguucauuucaauccaaagguggugugguccauaaccauaccaucccuuucaugcugggucuucuuugaucucagaaggagaaaagugugaagcuuaaacuugauugucaacuugacuggguaggaauuaaugaaguacuccuaccuccuccuuucaugcuccaccucgguguguacuugcagguccuugcagguaggauugggaaaaaggaggccugcuaacacaggcauucuuuuucucugcuccugggccaccaugugugauagauacuccacucugcccuuccuuccaugauggacuagaaccucugaauccaugaagcaaaauaaacccucuuucaggacaguaccaccugcuguuuuuuaaaucugggcauuccuauuaguuuucgccuggccucauaaaacugguucuucacugggaaucucuacuaccuuuaucuuggacuuuucaguccauacacuauaucuaucuaacuacugcaaacuacuuucuguuccucaaacauaguaauuuuccccuuauucucgaccuuuacauuuuguugcaauauucuuuuucuuuaaggcaaaucacagauauuaacaccuccauauguguaagaauucuacuguuucacuagaccauuaauucuuuagucuuguggcuuuauugucucagaaucucuguuuuagaauuggucacauucucauuguucaugucaccccauuggcaagugcaguacucuguaaaugaugacugugcuggguauuuuagguuuccuguuaccuuuaucuucaaauguuaauggugguguugguuuuauguggcuauauauggcaauuaguaaaaauagaagguaauuuagugaugcaaauucuauaauguauuaccaagugauucuuuuuuuuuuuuuuuuuuauuaaagauuuauuuauuuauuauauguaaauacacuguagcuuucuucagacacaccagaagagggugucagagcucauuacggaugguugugagccaccaugugguugcugggauuugaacuccggaccuucggaagagcagucagugcucuuacccgcugagccaucucaccagccccuuaccaagugauucuacauuaaaccacaugacacagugucuguagcucuucauuugaaaacuuucuauauuaggauguuucguaauagaguuuuuggaaagauaccaccaagucagguguucagaaguugacaaguauauguaagguuauuaguuuguuuguuuguuuuuggucuugauuuuaaagauccacauuugcaguguagaagcauacacauaccuuauuuuuucuuaaauagacaaccuuaauuuuuuaagauuuauuuucauauaugcauauauauguacacacacacagucacuaucuucagacacaccagaaaaggauaucagaucucauuauagaugguuuuaagccaccaugugguugcugggaauugaaccaggaccucuggaagaguagucagugcucuuaaccacugagcuaucucuccaaccaaaucuugaaagaaaauguaagaauaauguuaagacuaggaacuuaguacagugguuuauaguauugcauuugagagauuauguguuugauucccuggcauugcucaaaaauaaauaauaugcaaaacacuugcuauuuauuggggaaguaugacuacuuaguuuaaaauacuuacaaaguucaauuauauuacagugaauucugccagguaggguauguaugcauguguguguuguguguggguaauggguauguaugagggugguuguguugaacaguggcaucucagacauaauaucucauagucauuucccauuuuuguuccuguccuuaauuuuuuaaaggaugaaaaugugucucaguguauuuauguugauagugcuuguaauuaaguguaugaauuugaaguguuugucauuugauauacuaaagauaugauuaaauguuauuagacaaaaauguuucuuuuccccucuuuuguccauguccaagcuuaugcaggaaaggaaaugcaccguagaagagcuagcaaacaacguauuaucaguuuauuucucacaaaggauccucuagaauaugcauuuuuaaugcaaaacuagauuggcauguaguuuguugcauuuaaaccccuguuuacaaucagugccuggggcuuugguauaguuguuuuaaaguuaaaugaggauaaaaauuaaaauuuauuaccaagauauauggugcacucaggaacauaaucucaucagccuuuaucugcuggcauuugaacuagaacaacugguguccuuuguaaaaacuuuucagugcacuaaagcuaaaugguaacuuuagucaauuuuucuuuuuuuuuuuuagugaaagaauuuuuaguaauguuuagaaaucuuuauugcauuaguugguauucauaaaagaauguucuuagacuugaguaacaaaauacaauugauauucuaagcuaucaucauagauucuuauaaguaaaaaguuuacuucauaaaaguaaaccuacguucuuacuacuuaaguaagcaaucaaguuuaaucuucuuaauggucuguuucucuguuggaucaauuuaauaguacauugaggaaaugguucauuaaaaaggaccacuuuauguuucugguacauuccuaaauugauucaugucuugauguguuuuguugauuuucauuuuguuucuucuguucuuuuggaaaagacaaaaaucauaaauccaucggaaaaacccacuccuugcacaugcguacucuuuguccucagcagggccacugauuauaugcaacuuacauagguucacaggucuacauacacauucaauauucuauucuuacuagugugaaguauuaggcaggguccuaacaaauucuguagggcauacuaauccccaaagacuaguuguccuaagcguugugauacaaacugcauagugcuuguucuguguuagccaagucugugacccagugaauuuccucacccauagaagucuuuacacauauauuuuauuuuaauauauuuaggggaggguugagaauuuuauuucaugguaagcauuguaaauauuauuuuaggcuuagagagugcugauuaaauaaaauucugauauauuugaucacauagagcuuaauuuaaaauacagaaguauacuauuauuuacaauaaacacaaaacaagguuuaacucauuuugccauugcagguuaucaaguuaugcccaaccagcagcaaaacuaccaaggaauaguuggaguucagucaccgcagagucagagccucaugggaggccagccaaacagcacuggaccucauauccaaggaguggucauccccuaccccucagugccaucauaucagguauguuuucucucaccugcuuuagggauagaugguuucagagcaacugaaucauagcugugguacagccacucaccuagcauuugagaagcugaggcaaagagauuacagguuaaagccagucugggcucacacaauaagcucuaugacugccugacugcauuguguuauuucuguucuuuugugucuuugcuuuaaauguuugauuuugauuugaguuuuugaaaccaggucuuacuuuguagcuggccuuggccagcuuagcguugacugugcagccugcucugucuucaaggccaugguccuccacgugcauuuaccaucacacucagcuacucugucccuuuaauguccacaaaaugcuuuuguaagaggacaucauccuacaauuuuuguuaguuauuugaauauuugaaucacauugauacuggccuguacguuuugccugguacuguguuuccaacuauacaacuguaucagcaaguauuuuauuauauuguucacuuuucuaaaaacuccuuuggggagagagaggaauagaaagguaaauagaagugaggaauaaguauuugauauaagaugugguuauucuuaccaucaguucauauuugucggauuuguauauaagugccauuucccaaacaaaacuaccauuuacuucagucuccaaaaugauuuaucauauauuuaaagugccauguuaguggccaugguagugcauaccuuuacucuuaguauucaggaagcagagucaagcagaucucugugaguucaaggccagccuggucuacauagaggguuucaggacugcuagagcuauacugugaaacgcugacucaaaccaaaaccaaagaaagccauggaaggccaggcauggugguacacacauuuaaacccagcacuggauuguaagaauaaacacagaucucugugaauugaaagccagccuagucuacauacugaguuccaagucagucagggcuaauacagugagacuuugucucaaauaaaugaauaaaauacaaaugucguagaaucugauuuauagaucuagaagguucauuguuccccagauaaacagaucucuuuacuaugacaugacaguuuucaggaauuugcuuuuccuuuuuucuucuuuagggaguguucuaguuggcuuucuguugcagugauagacaccaugaccaaaagcaacuugggaaaagaggguuugcaucaucuuacaguguacaagcuauuuaucagagaaagagcuccaacaagguagacuugcuccuaggcuuaaaugccuaucuguuuuacauagaccaggcccaccuguccacaguguuuggguccucauacaucaauuaguuauugauaaaauuccauacagccgugcccacaagcaaguauaauguaugcaaauugagguuccuucuucucacaugccaaguugacaauaaaaacuaaccaguauaggaaguaauuuauaagugguuuugguuuauuagccuccugguuuuucauaucuaaggaaugguaaguuuggaaauaaguugaaaggucauuuucauucaaauagagaaaaaaauuaacuuauugugaagagaacuguacauagauucuguguaaacauagguaaacauauuggugaucuuguacagacuaguaacaaagagaucaugaaugaagcagugagcaugguggcucacaggcagaagugaauaucugugaguuccaggccagccugaucuacauaguucaaggcuagacaugguuacacagagagauacuauuuuaaaauagccuucaccuauguuuuuaauagcucaggcauaaauuaaucguaaagcuauucagaggaugggaaggauauaagcaguuauauauccaaugugaaauugucaaggaacugugauaaagaaaucaggagugucuggcuuugaagccuguugauaauacacaggaauuacaaaaaggagacaugcgaaaauguuuccuuucuuuucuucuccgugcugucugcugugccuuuuacaguaccauccauucaugaccuagucacauaccacauaagcuucccauuaccuacacagucaggguuggcaacaagccagaccaccccucuaacaucuagaggacucuggucuucuuaucuaacccagaguaccaagcagcucgcugcugcugcugcugcugcugcugcugcugcugcugcugcugcugcugcagauucucguaaaagaaauuugcccuuggauuuuaagaacucgcagauuauugagagaaaugucauuuuaaauaauguauagcuuuguuaguauauuuuguuauuauuguuguugcugccuuucuuguuguuguuucuuuuaagacaaaguuucuggguagccguguccuggaacucacucuguagaccaggcuggcuucuaucucauagagauccgccugccucugccucccuaagugcugggauuaaaggugagugccaccaccacccagucaauuuagcaauuuucaaauggagcuggauauucagaauaguuccuguuuuuuacaaggacauguuauuuuugaaguucuggggauugaagcauuacgcuugcacuauaacaugcaucucuugcaaagucucaugguauaucaagcaguccucacacuggauaagugguuagaggaaguguuauccaucugugaguaggacuuuccuuugucauguuccuacuguuuuagguagaugaguucaauaguaauaaacugucaucugaaaaacaagcuaggccaaauaauacauccuuaucaguguguuccaaagcaacacauucuuuuuuuuuuuuuuuuuuuuuuuuuuuuuugguuuuucgagacagcguuucucuguauagcucuggcuguccuggaacucacucuguagaccaggcuggccucgaacucagaaauccgccuaccucugccuccugagugcugggauuaaagacgugugucaccacguccugauaagcaacacauucuuaagcagcauuucuucucucucucucucucucucucucucucucucucucucucucucucucggaauucagauuuuguuguuguuguuuauuuuguuuuuugaaaccaucuaacuguguaggucuggcuaccaggcuggccuugaacuacuugagugcuggagaaaugacuuaguauauaucgcuuccuuugcaguuaucaggacccgagguccaucuucacccacaaaaugagcuguacacugauuuuagugcuggggugauguaaacaggggagucccugggcuugcuggucagccagcuuagugaaacugguuaacuuugaguucagugagaaauugugucuaaaaauauaagauggagaaggauugagauagacccagugucagccucuguucucaguguaucaguacauacaucuacacacaaguauguacagacacagaaacuuacuuaaauugcuuuaguuggcccaauaaagcugugucauuuuuuucucuguaacuuauauaauuggaaauaaucucagaaaaguauauaccuucuaaguaaucaaaaagacuaaaauguguuauauuuuacaaagauggauaaaucaguuuguuuuuaauuugaaauaaaugcuccagagaaaaaguaguuaagaguuuacucugaacuuugagaugacugguuggcugcggguugcauuucagaaauauguuauguuacauaaauaagaauuaaagguuaauuaaccauuuuuaaaagcugaguuuugcuguguaguacucacuaaucuggaaugcaauacaccuuuagagaaauuacuuaacuccaauaaacuuaucuauaaaacaggaauguugccagucacaguugcacacaccuguaauaccaguauuuuagaggcagagccaggaggacuacagcaaguuucaggccagccugguuugcaacacacuuuuguuuuguuuuguuuuucgagacagcguuucucuguguagcccuggcuguccuggaacucacuuuguagaccaggcuagccucaaacucagaaauuugccugccucugccucccaagugcugggaucaaaggcgugugucaccauuaucugguugcaacacacuuuuaaggccaguuagaaaagcaagucccugccucaaauaauaccuauacagcaacagaaaacagaaacagaacaaaaauccccaaagauuuaugaaaguacuuucuugggcagaugguauguuuuaaugagauaaugcacaaagcaucuggaaccuggcaguaagugcgcaauaguguucuccuugucuguggccaucucuugugccauuguuaccucauacauuauguguuagagguauucaauaaaaacacaguagcccacuguaauuucaugugcauuuauaaucaggaaacuucauugugccuugggguuucugauuuagagaccaaagaacugaaguagauagagaguuaagaucuaccaagaccauccaguuucucauggagaauugaaaauucaguucagaugcuugcugagcuaaauccuuuaaauguucuaucucaaaucaggucagucuguccuugccuauguuggagacacauuuccagcuuuucugauauggaacugagguaccucagagcaguaaaguuauuugcccaguguuuccuagcuaguuaaaugaggagauggugccucaucuggacaacugaagcuccacagcucuugguaugaccuaagcccuugucagcuuugucugagguaaaguagauggcucuuccuugucacaagaucaucauuuugccugggcuucuuuuuuaaaauaacuuuuuuaaggauaaagcauaucuuucaaaauugaaugcacuuaaccuauuuuaugauucauaagucagucaaaaugaguaccugccccaagggcacguagaccauuguggugauguugugguaagcuuauuuuaacuaguaaugcuuuacacauauauaggaucuugacaugaacaucuccaggacuuagaaauuaauuuuuuucuauuuaaauugucuuucaaauuuuagguuucacugccucaagguucucaaggaauugcccaucagacuuaucaacagccuguuguguucccuaaucagucuaaucaaggaucucugcccacaacaggaaugccagucuauuacagugucauuccaccuggccaacaaaguaauuuaaggugagcaugacuacaaagccuacucuuccuggcuucccacuguucgccagguauauggugugcuacuccauugaaaguugaccaaagggcuacguuuaacugaauuacuaaaaaucauuuugucuuuaaaaagaaaagguaucaugcugacuauuuaauaauuguuuuuaaauuuuuuuaugucugugauuuuuuugcauguauauaagugcacuacauguaugcaguacccaggggugguuagaagaggccauuagauccccuggaacugaaguuacagauggcagugacccuccauauaggugcuagaaacuggauguggaugcucugccaugcucuuaccugcugagccaucaucaagccccuuuuuauugauuuuuaaauauuggcauaagcuaaucauuccauucccuguaaaguaaagcuguuacagaaugaaaauggagauuuaugugaauuuaaaaucuuugaaaauacagauccagggauccaucccauaaucagccuccaaacgcugacaccauuacauucacuagcaagauuuugcugaaaggacccugauauagcugucucuugugagacuaugcuggggccuagcaaacacagaaguggaugcucacagucagcuauuggauggaucacagggcccccaauggaggagcuagagaaauuacccaaggagcuaaagggaacugcaacccuauagguggaacaacaauaugaacuaaccaguaccccagagcucuugucucuagcugcauauguaucaaaagauggccuagucggccaucacuggaaagagaggcccauuggucauggaaacuuuauaugccccaguacaggccaaaaagugggaguggggagguagggggugggggggggaggguaugggggacuuuugggauagcauuggaaauguaaaaauuauuaaaaaagaaaaaaaaaauacaguguggaaagauggcuuaacaguuaagaguacuugguggcucagaguagucuguaacuccaacuugaugggauuugaugccucuggccccacaggcaauugaacucauguacuuaacguauacaaauaccuacacacuggaacuuguguguucaagcuugccucaaaaucagagcuccaucugccuuugugucccaagugcugggaauaaaggccuggccuggcauaauuauuucuugguguuugcucugauacuauuuugggguugcucucacugagcuucucucacuuuuugggaccuucugaacccuuccugacaugacuaauacuaauuugcuuguccuugaaaguauuguucaaagcacuuguuuuaagggauuuuucuacuauuuuacccuucauuuuuccauuuuuaacuugaaauucaaaagcauaauauuuaucucuuuugaucuauaaucucagagggcaaccuaauguacauagaaaccuuuauuuuagaacucuuugaaaauguuuguaucacagaaucuuuaugaaaggaugaugaagaaagccaacucuaagccuuuuucuguaagugugcccuaguaaccccuauauuuguccuagugacaucccaagugugcccuaguuacccucaagugugccuuucuaaucccaagagugcccuaguaucuccgaaauaugccuuauuaacccccauguguauccuaguaacucccaagugugcccuuuggcccuacuccuuauaccuuccuugaacuuuuaguuauugcuccuaagcuucuaguuuuguuuuguuuucuauuugguuuuuucucaagcauccuuaauauaguuguuaguaauaaagucggucaaucuaauuuguauuguuugaugcaauuuuacuuuugcugcuauuaaagaguaaguuuccaacauuuagccuaaaaaaugaguaaaaaauaguaaggcauaaauccucagauaugccagaugaauauaguuuggagaucugugcaccauuguugggaguugcagcuggagaaagggcucaauugcucuugcggaggaccuagauugaguuuccaucacccauaacaugguucacaaccuuuugaaacucuaguuccagggaauaugaagcccucuucugacuuccccaggcaccaggcacacauacaaugcauauagauacauuuaggcaaacaauauuuuuuuaaagauuuauuuguuauauauaaauauacugucuucaggcacaccagaagagggcaucagaucucauuacagauagcuucgagccaccaugugguugcugggauuugaacucaggaccuuuggaagagcugucaguacucuuaaccacugagccaucucuccagcccaggcaaacaguuaauacacaaaaaaacuaaauaaauccuaaaacaaacaaauaaacaaaaaaaacuuuuuaagcucaguggcaaaugacuuugcagugcccugaguuugaucacugcaaaaagaaaaguguguagacauaccccuuuuaucuagguacucugaaggcaagaggcagagucuggcagauuucucuuaguuccagaccagccagggcuguauauugagauugaaaagaugccagacaugguggcucaugucuuuggguuuuuuuuggggggcggggggggcuugguuuuuugagacaggcuuucucuguguagcccuggcuguccugggcagaaaucucagaaauccgccugccucuaccucccaacugcugggauuaaaggcaugcaccaccaccgcccggcuguuaaauguuuuuugccauaaguuuuuuuuuuuguuuuuuguuuuuguuuuuuuuuaugagcaaacuagugcguucucaccuacaguggcaaccacaauauggcuucuguagaaauaacagaguaaguaacaaaagauuacaaauucauuaaauaaauaaaauaaaaaguauucuucuuacugcuaaguugucuucucagaacaucucauuuguucuuuaguagauagaaccuuuuuuguuuguuuguuuguuuacaugagagagggcauaaggugggcacaccuguguugagaucaaggggaccucaugaugaguagaccaugggcauaugaacaagagcaggugaugggcucucucugugggccagggaaaccuggaaaauucuccagacaguugcuuaagcuauauuauuucuauagcucagacucauguaauauguucugggcauaacuaacagcaaaguaaggggggagggagagaagaguggagaggagagaagaggaaaggaaaagaaaagggagagagaaagaauacaacauuuuuuaucaugugagccaauuuuucagccccucaaagaacuuuaacgcuccuuuuaauuccuuucucuuuccauuuaauugaacuauuggcuuacuaccacuuaagcagcaaagauaauuguuauuauuaagcaaucaucagcaugaauuucauauaaaucuauguguauguugccaauaauuaaucacaaagcuuuaaaaaugcuauuauugggcauucuuaaaacauguaaauauaaacaaauacaugcagaauccucauauauucacacuuaacacuuaacaauaacuauuguauuuucaucuaaaccucugcuucugccucgucaucuagaguuuuauuguuuuuuuuagacuuauuuauuauuuuauggguaugcaugcuugccugaauguauaugcaagcaccacuugcaugccuguuacccuuggaggucaaaagagggcaguggaucccaagggacuggaguuuuuuuacuguugugagcuaccacucuaggaaucaaacguguucuuugcaagagcaguaagugcuuuguaccacugagccagcucuccagaucauccuccuguagauaccagguaucauuuuauucaugaacauuuuaguauauuuauccguaaagaauucuuuagaugcauaugcccauuaugccagucauaccuuuauuauuauuauuauuuguaaucccuuaaguaaaacgaguguaccccauaaauacuuugcaauuucugaauauguacuaagaauugccugucgauagauuugacugaucauaucuauuguguuuucugacaucuuuguaauuucuacuucauuggcaguuacauuuaaacugguguuuuuaaugcaguuauaugagauaguuccaagaaauggaugaaguuauuaaguaauacuuauuuaaacuuuucaauaggaagaugacaaaacagagacugaucaggcuaauauaaauuaagaucccugacugucugugaguucauuauucuauaacuucauaucauuagccugaaagaacuugcuaaaagagaaaacuuugaagauuuacaauaaagccauauaguuugacuauaaaugccauucaaaggaucucaacaacuugggguugguuuuuuuuuuuuaauuguuuauuuguucguuuuuuuuuuuaaccuaauuaucuucuauuuuguuagaauaugucagauucguugucuuuauucuuacuacuuuuuuggugguuugguuugguuugguuuuuggugggguugggggaauuacuuuuuuuaagacagguuucucuguaaagccugguuauccuggaacucacucuguagaccaggcuguccuugaucugccugcugcugccucccaaguuuugugguuaaaggcaugugccaccauugccuggcuuauuauauuuuucaagaaauaacauuuucuucugagucuaauuauugucaaaauugccauccuguccuuuuuuuuuuuuuuuuugagauuauaauuaaauuucuucccuuuccugacaaagauauguuagaauaauuuguaaaauuuucaaugguaggauuagaggauauauuuucagaguuucagucaguauugugaauauaaaguaguuuuuacugagugaucacaauucagagauuacuuaauucagagauugucagccaaucugaaaaaauauauccauuuaaauaaauuuagagaaauguuuauuucaaagacuguuuggucaucuguuucucauugugcuguuuucuguguuuuguuuuuucacccuauagcucugcaguugguuacuuacaacauccagggucagaacaaguacaguuuccucgaaccacgucaccaugcagcucucaacagcuccaaggccaccagugugcagguaugccuagaugacugaugcagaggucagcugacugguucccagcugccuggguggugaugugcacucuagugucucacucauguccuguguguugagucagguugucacaugcagcucucuccuuccuuuucuaauacuagguucauccuucuaccuucauucuccccuaucuaugggguuaguaaucuuggagaaccauccccaagcccuguugauucucuagauuuuucuggguaaucuaauaggcguaaggccucaacuacugccuuuuugauaacaccuaguguaucuuccuucuaauguaacaaaaucauguagcuaaaaguuuaaaggcaugucagacucaauauuuuccuucccauuuuacuuaucuuaccacagccuuaaucuaguaaccaaugcagagaucucagacucaugacucuucuguggcuuccugcaguacucagaaagucccuauuuccuuacucacugugcugauuuuaguguucuuuucaugucuuugcaguaaucucuuaaguauuuuguuuauguuuuccuccguuucaucuauuuccccaacacaaaaaauuaguacagaauuauuauccugaaacagaaauuucuucauuuuauucucugacuaaaaaacucuucaguuaggccggcgugguggcucauaccuuuaaucccaguacucgggagggcagaggcagguggaucugugaguucgaggccagccuggacuacaaagugaguuccaggacagccagggcuaaacagagaaacccugucucgaaaaaacaaacaaacaaacaaacaaaaaaaacaaaaacaaaaaaacccacucuucaauuaagaggacuggcuaucuuuccagaugacccugauucuguuccucgcaccuacagaguagcuaacaucuggcucuaacuccauucuuaggguuuuguuugccucuucugucauccucaggcacugcauguacgugguccauacacacauacauucacacagauagcacuauacacacagcauaaaaaucaauuaaaaaaagaaaagaaacggacaacucagaaugugcuacguuuucuccucccccacuagaaaggaugugugugcucaguguaaccguggcuauccuggacucuccauguagacuaugcuggccucaagcucacagagaucuguauuaaagggaucauagggauguaccacuaugacccaaccuuccccuuauuuugguaaaauacuuucacaaaauuugucuuuauuuggaaaacauuauuuuaaaaguugggagcauacauacauacacacacacuuuuuucucuacuagguccuucaagacauuuaggucuaaaggauuccugcuuuuuauuuuguuuuggcuuuuuaggguuuguuguuguuugcuugguuuguuugguuuuuugguuuguuuguuuucuugaaucuuugggcuuuuguuuguuugaaguaaguucauacuacaaagauacauagauuaggcuagcccaaacaugauccuucugaauuuguguccucagugcugggauuccagauuuguaacaccgugaccuucuccaaagguuuuguuuuaaugccuuuuuaaacacacaauuguaugcagcagguuucacuagagcuuaaaucugauuuguauacauaguuguaaaaacuuauucagaaauguggaauuaauguuguuuuccuaguauuucauauaacaauucauuguuaaaauauacuggucucaguguucuaauuauccugauuucagcugugccacagcagccaccugguggaggaaugguaaugaugcagcucaaccuaccaaauaacccacagucucggacccacucacccccacaguggaaacagaacaagcacuacugugaccaccagagaggacagaaguguauggacuuuagcaacauggauaauauuguucagguaagguaguuuguguguuaccucuuuguuuuugaguaggggucuagcuguguagucuuagcuagccuggaaaucauguugaucugcuuccucccuaagauuaaaagcauaaaccacuacuuguagcuugguuuguuauuuagaaacagcauuuucucacauaccgugacuuaacauuaaacuugaaauccuaagacuaguagggacauuugaacauucuuuacauccagacauuuauaucaaaauucagauguuauuuuucaacuuuuaaaauaaggucuuuuguaacaucgguuggccucaacucuuuauccuccugccucagccuccuauauacugggauuacauacauacaaaucugugccucauuuuuauucaucaucuuguuuguuuguuuaaauauuucuuuauuuaauguaugcaaguacaccauugcuguuuucauacacaccaaaagaggccaucugaucccauuacagaugauugugagccaccaugugguuucugggaauugaacucaggaccucuggaaaagcagucagugcuuuuaaccacugagccaucucuccagcccuugucuacuuacuuauauccaaaaauaaacuugaccuaaaaaauaccagaagagagcuaggcaugcuaguucauaacuuuaaaugugcaacauucagaaaguuaaagcagaagaauuuaagauuggcaaagaaaaagaaucaaacaccagaugucuuuguuacuguucuguugcucugaagaaagaccaaggaaacuuaaaaaauaaaucauuuauugggacucauaguugcagauaauuagaggccaugaucauuauggcaggaaacaugaugguagacaggcuuggcacuggagcaguagcuuggagcuuacauugacaaagacaaggcauacagaaagcuagaugggaauggcaugaacuuuuuggaacuucaaagccugccuccagugacagaccuccucuagcaaagccacaccuucuaaucuuuuccaaauaguuccaccaacuagguaucaagcauuacagugugagcuucugggagcauuguuauugaaaccaccacaccaggccugguguuaguugccuauaaccacagcacuuaggaguuggcagcaggaagacaaggaguacaaaguuauccuuaguucuacauagugagcuugcccugauugugucuacuuguucuuguugagauccugucaacaaaaaacaagugaaaauuaucagcagaugcuaaauacauuagguaaaaguauuaaugggcguuugaaguagacagauuaggugucugacuuuaaaccuagaugagcuguacucaucaauugucaauauccagaaagauagauuaaccaaacauuuaccuuuuaaugugguaugucgggaaggguaggcucacaucuuuuaucagagagaaacagaaauaaauggugguggcgcacgccuuuuaucccagcacuugggaggcagaggcagguggauuucugaguucgaggccagccugggcuacagagugaguuccaggacagccagggcuacacagagaaacccugucucaaaaaacuaaaaauaaaaauaaagaaauugaaccuagccaagcuguuuuccacaccuuuaauccuagcacucugcuggcagaggcaggcaggcaggcaucugaauucaaggucaacccagucuaccuagggaguuccaggccagcucagggguagguauauaaugagaccucgucacuaaaaaaauaaaacuuuaaaaaaaaaaaaaaaaaaaggucuggugagaugguucaguggguaagagcaccaacugcucuuccaaagguccagaguucaaaucccagcaaccacaugguggcucacaaccauccguaacgagaucugacucccucuucuggaaugucugacuuacauauaauaauaaauaaaucuuuaaaaaaaauuaaaaaauaaaaaauaaaaaauaaauaaaacuucuuuuuaaaccuaaauuuaaucaauaguguaggccuggaggcuuauagcuguauuaaaaaaaaaccaaauuguaugcuauuaguaggaugcuaaagagaaauuauccuuuuuguaaaacaucuuuaucuuuuaacuguuuauuuuauguguauuuaugucccugcaccugcaugccugaugcccuuggaaacuagaagagggugucagauagccuaaaacuaaagauucagguccucuagaaaugcugacagugcucuuaauuguugagcuagcuuuccagccuauuucagguuugguggguuuuuuguuuuuguuuuuuaagauuuauuuauuauagccaggcagugguggugcacaccuuuaaucccagcacuugggaggcagaggcaggcggauuucugaguucgaggccagccuggucuacaaagugagcuccaggacagccagggcuacacagagaaacccugucucgaaaacaaacaaacaaaaagauuuguuuuuauauguguguguguguauacaaacacacacacacacacacacacacacacacacacacuguagcuguacuggugguugugagccaucaugugguugccgggaaugaagauuacucacucugguugccccacuuguucuaauuggccccugcuugcuccagucacucaggucuaaagauuuauuuauuauuauauguaaguacacuguagcugucuucagaaacaacagaagagggcguuagaucucauuacagaugguuguuagccaccaugugguugcugggauuugaacucgggaccuuuggaagagcagucagugcucuuaaccacugagccaucucuccagccccggguuugguggggguguuuuguuuuguuuuuuguuucuuguuuuuugguuuuugguuuuugguuuuucgagacaggguuucuuuguguagccccgggcuguccuggaacucacucuguagaccaggcuggccucaaacucagaaauccgccugccucugccugccaagugcugggauuaaaggcaugcaccaccacgccugacuuugauguuuuguuuauuuguuuagcuuuucauugcuucgcugugaauuucauaucaugcaccccaauuccacuuauuuccucaucccuuccugccugccgucugcccuuguaagcuccccuccaaaaggaaaaaaaaaaucucacuauagaagcuguaguguauggcagugugucccacaguauacccuuuuuuccccacccuucuuuacuugcaaauguucacugcagugagucugguuccaggccucugccuucugccaggccaucauuacuggaucuucaccaggagcccucuggaaucuucugugguugcccuguguugccugaccacugguuuugguguugcugguuuucucuccuuuuugucaguuaccucccuccaacccugcuuccauaucccugucacuccccucuucacaucucaucacauacuacaauuaugauuguuggguauauuccaggcccagauccuauguaggagcaguaguguucuuaccugcugagccagcucuuuaacccacuacuguuuuugccuguguuuuuaauuuuuucaagccuucuuguuaaagguacuuuaaauuuuucucuuagaacuguuuuuauuaugcccugcaaauuuugauguguugauuuuauuuucauucaauucuugaaaguuuuagucgccuucuugauuucuucucuaacccaguuuucauucacuaguggguuuagguucuguggguuuguguauguucuggaauuccuguugcuuuugauacccagcuuuauuccuuuguagucugguagagccaucagauguuauuuuaacuuuucuaaauuugcugagacuuucugccaacauguggccauucugagagaaaguugcaguggcugcuaaaaagaaaguauguuucuuuaguguaugggugggagguuuuguagaugcaugugaucugugauaccauuugacuacaggguuuuauuuagcuuuugccuggaugaccuggcgauuggguacuaacucacuaucacuguguuggaaucaaaagucugugguuuggaucuaaucucucuuaugaaaucaaguucuccucuguuuggugcauaaauguuuagaauugucaucgucuguuggguuuuucuuuuaaugacuaugaaaguccuaaccuacuagauaugauuugaagauauuagaauagcuauaccuucuuguugcuuauuuccauccuucacucuaaguugguaucuauuguuuuuguagacagcaaaaaguaaaaaguggguccuguuuucuaauccaguguguuagacugugucuuuuuauuggggaauugauacugagaguuggggagguggugauacacaccuuuaaucccaguacucuggagggcagggucccugugaguuugaggguagccuggucucuagagcaaauuccauguuagccaggacuacacagagaaauccuaucucgaaaaaacuaaaauuaauaaauaauugaguaaauaaagacagauacugagagcuacuaaugaacaguguuuauuaauuccugucauuuuuugguggcgguauuucuuuuuuuauuauuuauucauuuacaucccaaaugcugccccucccuagucucccuugaagaguuccuucuccuauccucccuccccuuugcuccugagagggugcccuucccauauucucuccaccuuggugcaucaagucacuucaggauuaggcauccucucccacuuccagacaaggcagcccucuauaacauaugugucauguaugauuuuugguuggugguuaugucucugggagcucuuaggguuccagauucguugacacuguuggucuugugauggguuugcuguccuugagggccuucuuagacuuacuugauuaauaacucuuguggaauuauuuauuacuugugccaucucagguauauuaaucuucucuuuagaaugaaauauuccucuaguauccucuguagaucaugggccugcuguuauauguaacuugaucuuucugucuuauaauauccuuuauuuguuuugaaagaggguccuuauuacuauguauuugcugauauggaacuuacaauguaugccaggcuagccuugaauuuuuuucuaucucugccucuaaagugcuaguauuuauuauaagcaccacaccuagguaggguuuuuucuuuuaauuuuuuaaagauuucuuuauuuacuugauuguauaguaugaguaguauuaugaguacuuugccuacguguguguguguguguguguguguguguguguguguguguguguguauguauguauguauaccacacagaucagaggaggauguuguauucccuagaacuggaauuacagaugguuguaaaccaccaugugaauaggaaccaaaccuggcucuucugcaagaauaccaaauacucuuaacuacugagccauuugucaggcccauccuaggacuggaggggugguagagagcugugaaggggugguucagcagcuaagagcacugacugcucuuucagagguccugaguucaauucccagcaaccccauggugucucacaacuauuuguaauaggauccagugcccucuucuggugaauuugaagaaagugacucuauacucaaauauuuuaaguauaugucauuaaaauagcuaaauaaaacagacaguuuguuuagguuugcuaacaaacuauaaauggccauuaaacucugaaacuauauuuauuugauuugaugucuuacaguuguguguggggugugugugugugugugucuuugugugugucuuugugugucuuugugugucuguacggauuggguccagagccuugugcauuuugggcauguacuuuggcacugagcuaauccaugaucuuaaaguacuuccuauuuuaaauugggaaaguucugugagacauaacuuaaaauguuuacagauauaucuaguucuuuuaagagcuucuggguuauagaauaaauugguacaacuccuucuggaaugcuaguuggugacauuuucccguuuuccgaaacacacagguacaaaaccugaaucacaaauccacuuuuggaauuuuguccaguaaaaaaugguacaacaagcauucacagugguaauacaugccuauaauuucagaucuuaggaugcuaagggaggauaaucaugaguucaaagccaaccuggguuugacccucuaucugggggggcuguggggcaaaagucaaaauaauuguucuucaaaaugauguuuagaaucaggucuucuaagacaucagaguugugaaaagaaguuguaccagauaagcuagagcugaagcaccacaacagcucugacucagggcgguucugauuauagucugaauuccagaaguaaugggaauauuacugccuuuccuccauuacaaaggauguuguugagacauuugucaaaauugaaggaacucuguuguuugggugauaguauuauacuauugaugucuuaaguuuugaugauucaucaguuaagagcacuagcucuuaaccagaggaccuggguuggauucuuaacaccuacauggcagcucacaucugucuauaacuccaguuccgagggguuugaagcccucuccugaccuccauaggcacuuggcauggacauaauacuauacauacauguaggccaaacaccagauacaugaaauaaugaaauagaaaaagucauuauuuuuagggaauagacacuaauuaauuucuacuaaaagaguaacaugggcugcucacucaaauuauuuucagaaaaaaaaaugguaacauacauauguuauguaccacagcaugauuucagucaacaguguccaacacuggccaagaguauaauggucagcuguggcugugguuccauaguagauaccuagguuagcaugauugggguccuagauucaguccauuguuguccuccaaagaaacagauuuauggagcugaaaaauuccuauuaccuagcaccauuauagugaucucaaguacaauggagugcugacauaauaccccaaauuguauaauggcauuuucaccaagagagucucauaucaugaagucauguaacuguauauacaggaagagagaaaguaaaugaauauaaggaagauguaaccugaauguggugguacaugccuggaaacagcacaaaagacgcaaaguugggagcaucggcaaugaguuugaggccagccuggucuacauauugaauuugagguuagccagggcuacacaguaagacugccaaaaagaaaagaaaagaaaacauuagcaccauuuaggaaauauagucacuauugugacuauuuucaaaggaugaaauuauuuugaaugaaauuuuagaaacauuugguuuagaaaagaauaagauagguauauagucuucuugcaaaugcagcaacauuauugccaaguuacaaagaagguuucaaaaauauagucuguucucauuuuuauaguaaugaugugugaguucauauucauuauucauaaugacuuaaacuuuuuaacaaguauuaauuuauaauucagugaauaauaaguuuuuuuccaaaaggaaauuuuccaauagccugcccuaagugugaccuaauuucuccucuccugugauugcagcccagcccucagcucagcagccccauccuuucuccagugcagucgccagcaccagcucagcuguccacucugaagaccauccgucccucaggaccaccgcuuuccaucaugucccaguuugcuagaccuuuuguuccuggacaggguaaguguucaugaaacuggucauaacuucagagaacuguagaccauccugauggcaccagucacucuucucuguguaccugcauccauuuauuuacuuugugugugugugcgcgcgcguacaugugaaagugggaggacagcuuucaggaguugguuuucuccuucuacuguguuaguucauguuggcaggcuuggugcuagugcuuaauuaggaauuaaucaggacaucuggaguuaaauucacagcaaguacauggcagcucacaaccaucuguaaugggauuugauuccuccuccugguaugucugaagacaguguaugauagcgaaaugacucuuucaagagaaaaaagaagaacaagaaugaguugcuauuuuaugcucacuggaauaacuaugaccaaaaagauugucaacaccaaacguugaagauucagggaagcaaguaaauacacauuugugguaagaauauaaaagaauaaaggcauuuuggagaaaguagaagaauuuucuuguuaaucucuugccacauaaccuagccauuccacuccuaguuggaaggaaaaugaauuguauucacagaccuaaucaagaacauuuacagaaccuuuagcucaaacuggacuugauuuaaucauauaucacccugaauauauuauacauauaaaaauccaugcgucuuguggaguucauaguaguaaguaacaaagcaagcuauauauauaaauuugauuuguuuuaaacagaaauccaggcaccuagaaaggugugcuauaugauuuuaauuauauugaaauuugccuacagcaagaucaugcacucuguaaauuagaacucagaaguguuagaaaugagaugagggagucaguggcuaggaaaccgaggguaacucugaagaaugcagauacccuuagcugucuguagucacuguuacauagauauacugcugucugaauucaucaacacaacccuucaaggauccauuuuuauuguauaauaagucuaucucacuuuuuaaaagagcaauaccguauacacacagcaaaaaugagcacauuuguauaacauaacaaagacuuaacguauacacaccaaaacaucacaagugauaaauuaccaggaugacuugcauuuccucccuuuauaaaaccaaaauauuuuauuauuuuaugaguaugggugugaacuuaauauauaucuacugugaaauuuucuauauguuuuuaauacuuauaaauuuauuuauauauuuaguucuauuucauuuauaugucuuuugccuacauguauaucuguguacaggucugugguggcugugaaggccagaagugggagucagaucccuuagaacuggaauuacagauugguguacaucaccaugaggugcugggaauugaacccaggcccucuggaaaagcaaguucuguuaacugcugaguucucucuccagccccuguuucuuguuuguuuguuuguuuuauugguuuuuuuuguuuaguuuuauuuuuuauuuaaugcacauugguguuuugccugcauaugagggugucauccccuggauugaauugacagacaauuaugaccugcaauaugggugcugggaauugaaucuagguccgcuggaauaaaaagccagggcuuguuaccucuaaaccaucucucuugcccugucagccccuaguuuuguuuucuuucuuucuuauuuauuuauuuguuuguuuguuuguuuguuuauuuuucauuuauuuauugauauguuuguuuugucuuuuaagacagaguuucuuuguguagcucuggcuguccuaaaacucauucucuagaugagacugaccuugaacucauugaucugccugccuuugcuucaaaagugcugggauuaaagguauaugccacuacuacccagcuaaaaaaaaacaaauaguacauggauaugggugaaaaauggguggaaagauggcuaaauggguaagacacagacugcucuuacagaguaucugagcaugguuccaaacacccaaaucaaacaccucagaacugccuaucauuugacuugcauggaaauccaggaccucugguuucuugacacuugcucuccuguguacaugccuacacacauauacacauguacauaauuaaauuuauuuuuuuuaaacucuuaagugaagggcugucaaaauggcuucauuuauaaggauacuugacuugcugccaagccuaacaaccugaguuugauuccuaggacagacucucauaguggaaggaaagaacugacuccugaagauugcccucugaucuccacagauguuuuaugaaaagugcaugcacacaaaugcaguaaauacuaaaaauagauggacuuuguuuuuaaguaaacgauggggcuagagagauggcuacuuaguuaagaggagcucugauugaggaccugaauuugguucccagcacccauaaugggcaguuccucaucuccuguaacuccagcuuagggaauauaacacccucuuccagccuucucaggcaccuccacuucuguguagaagagacacacacagaacugaaaaauaacuuggccauuugugguguauaccugucuuagucaggguuucuauuccugcacaaacaucaugaccaagaagcaaguuggggaggaaaggguuuauucagcuuacacuuccauacugcuguucaccaccaaggaagucaggacuggaacucaagcaggucaggaagcaggagcugaugcagaggccacggagggauguucuuuacuggcuugccuccccuggcuugcucagccugcucucuuauagacccaagacuaccagcccagagaugguaccacccacgaauugagucacuaauugagaaaaugccuuacaauuggaucucaugaaugcauuuccucaacugaagcuccuuucucugugauaacuccagcugugucaaguugacacaaaacuagccaguacaauaccuuuaaucccaauucuuggaagacaaaggcagucagauuucuaugaacuuggucuacauaagaauacaauauagguucucuaucccuuaccccuauucuaucccuaccacucaacccuuuuucacuaucuuguuggcaguauucaccuuucggacguuuauacugacccuuugaagaauuuaaggaacuuuuuccauuuaugaaugaaugaaugaaugaaugaaugccagguggugguagugcacaccuuuaauucuagcacuagaaagacugaggcaggcagaucacugugaguuugaguccagccaggucuuuggcugagauggcucagaaguuaaaggaacuugcuaccaaucuaaugacccuaaauucaauccccagaacccacaugguagaaggagaaauaaaauguccacagguuguccucugcuuccacacacccacaauugauuuugcaugcacacacaaauaacaguuuuaaaaacaucuauuaccuuuguuuguuucccaccaaacauguuuucuauguuuaucuucuuucugaacaguuuagcaaacucugguaaguacauuacagccaagaagagggaaccaugaaaaguguuuuuaaugacuuucaggagaugccagguauccgcugcuuggccagccccugcaguacaacccuccuacucuucugcauggacacauuccacaucaacagguaugacaggcaguuccuacuccacaggcuuuguugcugaacacccuaauucuuucugaagauaucagaggugcuggagccaacuguuaaugcuugcucgcacuggcuuggcacagagcagagcaagagacaagguggcagccaguugucugaguaguacuuugcuacugauaccaaaaaauguggguagccacaggcacagcaccuuugcuuaugaaagacaaucugcagggaaaguccugaugagugccacaguuacaaaguccaguauuacaaagcagaauccagccuggcacgaguuuaauaucuguucaaguacaaaacccaaaguuuguuuaggugcuauauuuucaaauauuacaacuuaguuugcaacuauuccugcuuuucuagggucagucuggcagcaggcauggaaaccgaggacguagacaagcuaagaaagcugcauccacagaccuuggagcaggagaagcagguauguccauagauauaggucugaauacucagaguaccacaccacaaaaaugagcuccauucuucuagcguucuuaaaaaacaaaagucccuagaaauuacucuagcuucagggucuuggauaugaugugaagguguauauaguaaggccuuggccauuagcuuuuggagcaauaaagagggucacaagguaaaaaugugccugacagcagguagagaaaggucucauacuuaccaguggaagauagacagcaagaacauugucuuucugugguaugggguuuugccuuuauacuucaauucugcuaaaagccuugggucauaagggugcuguuaucuuuaggucacuuuggaaaguagaaaaguuuugcccaagaugaccuggucuagcgaaagcccuugcuuuguccccacagaaagacugagauuagggcuggagagaaggcucagcggcuacgaacacugacugcucuuccgaagguccuaaguucaguuuccagcaaccacaugguggcucacaaccaucuguaaugggauuugaugcccucuucuggugugucuaaaaauagcuacaguguagucauauacauaaaaauaaauacaucuuaaagaaaaagaaaaaagacugagauuaguagcucaacacuuaaugcugaauuggaaugauuuuaaggaguaauugugcugugaguuugugucagaaugcuguuuccugugucaucuggggcagcaguaguugguccauuaacucuuucaccuuuuucaugcuaguugucggcaaggucuuggaaaucacagaacuaccagacggaauaacucgaguggaagccgagaagcuuuuuggggaacucuuuaaaauuggcgccaagauccgauggcuccgggacccccagucucagccucagcugcgucgucacgcucucugcugugguaguggggauaacacugucaacccugagcacucuaaacccagugaccuggccucuacguacacuguccuagcuacguuccccuccauuucagcugcacagagugcacugaagaagcagauccauucagugaacaaguuuaagcugagaaugagcaagaagcacuacgauuuccacauuuuggaaagggcaaguucucaguaaaccagccgcuaccuuuggaccccucacucuauaauucccugcccucucccaucugauuggcuuguuaaguggagcguauguaauauagagacuccugggauguuuggccauauguuaccgcuuuuggaagaaaguccagggacccagaaaagggagggggaagauacccauuucaccccagcgucuauaggaauccacacgggaaugguucagaguuagcagcuguuucuaaggaaaugcuguucagaugccuccuaacuuuuauaguuauuuuguuuuauauuucugaauucuuguaucagauccaaagcucuauuguacagcaaauuauucuucaaagugauuauaaccaguuacaaccuguauuucuuuuugcagccagcacagugugaaccaacucagacuuugagagaaaaagaaugcaggaguggaauaaccaagucaaaaaccaugucaaaacuauccucuggggggugcugagggugcuauggagacccacaaauaaacaauuacuccuccacugaauugcuaaacacagaaaaauuuccaggaaauccagaacuccccaacaggguccuucuucuucauuuagguaguguggccguuaaguguaagguaaauuauguucucgaugccuccuaaucaaaccacuuagguuagaaagaaacaggaaucauccuaggcaggaaaauuacuccacuuuuuuuuaaguguccuuccaauaacuaaugccacucaucagcauuguccucuuuggaaauuuuguccuccugaggaaaugcacuugacgagugcugaaaacuucuuaagugguuuaaauuuuguuuucauuguuugcagcggauuacuggacaucaaagauucauugcacuuaugaacaaggaaccuuauuuucaauuucuguguaauuuugcaaggcuguacaaugugcugaugcaagccuuuuucaguucaagagaauaaauguuuacaaauguagac

SEQ ID NO: 349 - RNA, 611 nt, Mus musculus
ugugaagacacaggcuuuauaaagggauacaguaaaugugcacagggagaauacgccaccuacgaugauuggaaaugggcugcauuuggugacuggugagaugacguggcugcugucucuugaguuacugaaggcaggcuggguagggaagaccugguucuggaaugaggaugguucuuaguuuucuuauauuccucucucuuauuuauuauaaaaggugaggaauaggaaggggugacaggugagguagaaaugggggcgccguguuccuuagauugcuuccugcugucuggggauggcgacaucuuuggagcacuguugauccucaccagcaggacauauucagcagucauaagucucuggccccguggcuagggguuggugguccuguaagaacugauuaaauguuugauuggagaguuuuuuaauuugucgucggagaaagguagagaagagacugauaaaguuaguaaaaacaggaaauggagaagggagagggucaugaagggaaguauucacuuccauacggggcccucagaggcccagggacuggaggcauugaguuuuuccuuaccuuuuuggaggucuguuuggagcugguggauuuuugu

SEQ ID NO: 350 - RNA, 1087 nt, Mus musculus
acaauacaagaggaaacugauggaguucucccacaggaccuuacagguccuaaucaaacaggaaauccagaggaagaguggcuaugcgauccaggcugaugaagagcaguugcagguucagcuagauauuauucaaggggaacugaaugcacccacucaguucaaaggucggcugaaugagcugaugucccagaucaggaugcagaaucauuuuggagccgugaaaucugaagaaaaguacuacauagaugcagaccuauuacaagaaaucaagcagcauuugaaacaacaggaaggccuuagccacuugauuagcaucauaaaagaugaccuagaagacauaaaacugguagaacauggauugaaugagaccauccauagcagaggcggugucuuuagcugaucguuuacagacuuguuggagagauugauaaaaugcgucuccuugcuacaucgagccuucuuucugaugaccacauggccggggaaaaggaugcuucuccucacugggaugucugcgauccucagagguuacuguacguuaaaucugaaauggucaccacaaagcccuucaaagagaaucuuugaaaaguuuauaucuaaaagcuguauuuacuuuuaaagaaguguuacccaaagcauacacuguuguucauuuuauaacagcguuaagcguagucacagagccugaugguuacucuccguucuccucuccauagcacagagcgccacagagcuacuuccuacauaacacaacaaacugugauuccaugccuguuggaggcugugcuucaggguauaaaugcguuucagcuuuuauaucugugaaaucagcuguggagaguaaagaaaaucccaaaguauuuaaugauuugugugguuuuccuuuuguucuagaaagacuugaaaauauauuuuuauauuauuuuacuuauuuagaacuuacagaaaauaccuaaccgguuaggauaugacaaaaucaccacuuuugcaagcuguuuuguuuuguuuuguuuuuuuauuucuaaaaaugaaauccuuaaaauaaaauuuuaauuuguaauuuaaaaaaaaaagaaaaaaagac

SEQ ID NO: 351 - RNA, 5977 nt, Mus musculus
caucuugcgugggagugacuggugaaaagugaggcuuaacgccuucguuccugaaucuccagcuagacuagguucugggagguugaggucggcuuguaaagaugccuugcuggcuaccagaaggcaagagcuaacuaacuacaacuucuggucagcauccuuggagccuauggauccgggagccucccauucaccagacaggugacuccaaagcauguuccuugauuucccccuccaucccuggacccaggcuacauuaucuguggucaucuggaagagccaaggaggaggagaagugcacccgcuccuggugugaggguacagagggacagauucgcuguaacugauucacaguagaggcuguugcagugggguuuauaucucccagaacuacuuuucaaagucacucccccugcacaccauugguaccugacaaugcuugacaguccagaguggggagggggacuuguuugcugcuuuggcuaaacggugggggagggacccuagaacuguuuucacuccuuccuucuugacccgagagucaagucaucuuccacacaauccaaauaugcguuucacacccccgcggcgaguuccagcgugcuacgaacugucauuauucggcguuuacugcacaccuuuagaacuauggucaaggcagucucgggcucccgggcuacagaguuggaaacuggcuagcuaucuggucaggucuccucucugcccgucugucuucugucucucggccaccgcgaggacugcguugccaugaugaagugucuuccuacugggauacgaggaaucggacuggaauccugaugaccaagagugaguccucuugagcccugccaccaaccgcgggagugaggcgaucgccccaggcacggcugcugaccucauacagucuuucugagguggcagauggacgcuuucaaguucgucucacgggacuccccgcucgucccguccacuuggccucaaugaaucaguucggcgcagccacgaaccccgccagcggcgugacuguuugguggguccuucugaccucucuuggcauuuguuuaccuucccgacgaugagucggcucugccugguguuugggaggcugcuuucaucauuggcgaccucccugcaaggugacauucugcucugcuagacucgggaacuccuuccccgcccuccucccuggagcauaaaugcugccgacgcgaagcucgccucaccggagcgcucgggagagccggccgacccccaacccucacccgcggccgcccuugccacuuuaagagcccgcgccguuuuuggaaggaccgaggccgagucccccccaccccccaccgaggugucgcgagaagcgccccagcggccaccucucgcgauguuuggaggcgccaaaggcggccauuuuggggucccccccgcugguuacuccggcgcugucccccagucugaggcugggaccaaggcuggccccgcaggaggccggccggccgacacuauguggcggguccgcugcaaggccaaggguggcacccaccuuuugcagggucuuuccagccggacccgcuuacgggagcugcagggccaaaucgccgcuaucaccggcaucgcucccggcagucagcgaauccucguuggcuacccgcccgagugccuggaucucagcgaccgggacaucacucuuggggaccugcccauccagucagguacgggcaccggccggggccggggaagucuuggaggacguggaggggagaagagugaagcuaguaaggcagagugccgaugugacagcuaggggcuucgaggaccagaacuccgggaaggccggggcaggugucaaguccuuuacuugugauuuagagacaaggcuggagucuugaaguccccuguuccccaagccugcuuccaggucauuuguuuccucugcuuucccaaaggacagcaggacccuuguucccugacgggaugguucuuuuucccuaucccgaucagcaggucagcgguugagauaccaauuuuucguuuucccuguguguuaauuucuuuuuaucuugugucucauauauauauauauauauauauauauauauauauauauauauauauauauauauauacauacauacauacauacauacacacacacacacacacacacacacacuuggacguuguguuuauugcuguagaauuaaccaacagcaguuacuuguucccagguuuagaacuugaacgucaguguugaccauucaaagcuuuuuccauuuuguggcaaggccccucgaaucgagcugucagaugguauaggcaugcgaagugcaaagaacaccccagugaccuaccuagucuguggagaacaucugaaagauuugguuuuuaaguugaaaugcagcgcggagcauuuuguucuguuugccucuuucugaagacacugaacuaaacacaaacaaacuuagagaguuacuggccucuuguuuacaaaguuguguucuccuugguaacccgcuuuauacuuuuaacuccuuugcuuucuaauuuucugaguuggcuaauaaacacccaaucuauaauuucucugcaguucuggauuuguuuuauuuuugacaggugacaugcugauuguugaagaagaccaaaccagaccaaaagcuucaccugcguuuucaaaauauggugcuccuaguuaugucagggaagcucugccugugcuuaccagaaccgcagucccagcagacaacucuugccucuuuaccaguguguacuaugucguggaaggaggagucuugaauccagcuugugccccugagaugagacgccucauagcacaaauuguagcaagugauccagucuuguauagugaggcgauacugggaaagacaaacgaagacuacugugauuggaucagaagggaugauacgugggggggggcaaucgagaucucaauccugucuaaguuuuaccaaugugaaauauguguaguagauacacagacagucagaauugaucguuuuggggaagaugcaggauauaccaaaagaguucugcuuaucuacgauggcauucacuacgauccgcuucagcguaacuucccugauccagauaccccuccucugaccauuuucuccucaaaugaugauauuguucuuguacaagcacuggaauuagcugaugaagcuagaagaaagagacaguucacugauguaaaccgcuucacccugagaugcaugaucugucagaagggccuaaccggacaagcagaagcaagggaccaugccagggagacaggccauaccaacuuuggagaggugugaucuauucauaagagugggagccuacuaccucacagauccagaaggcucuggguuuuccaauaagcuauucauaacccuacagaauagaacacaaugcuuggaccauccuuuuauccuaaacuaguaugacugacacugaaauuccuuguuaagauuaaaaucagugugcaaguuuacagaugugugucuacacuaguggcaugcccucuuucuacugggggucggaauaaggugguuuuggccacuugggaugcuaacccgaagacuggauuauauuauaaaccagcaccuaguggcuuuagcuuauagaagaaaacaucauauuuuagguaauguggaaagccuuguggagggccacuggacauauaccacaaugucuccaguaguugauuccuuuuaauaacuuugaaugaguuaguaguuucuaaauucugaauugauccaucaaaugaagauacucagaauugucaaaacuuuuuauauugcaauuugguagacuuuauaaguguaucuaacuacuuacaaguauauugaaagcaauuuuacggggagaaguaugucccuugagaauguuaucuaaaacagggauuaauauggcccuguugcgauuucuaguguauaaaaguagaauguauaaggggaaaaggugccugaagcagcuuccugaagcuuuaaaagacuguuggccucuuguuuuaaugcaauucauguauuguuauuugucacauuagguaauuuuuuuuuucagugaagcaggguaugccuuuuuaauugcuaauuuaguuuaaaauucaagaaguaucuugaaaauuugaguguuuaguucuuuuguuuuuuuuuuuuuuacauacauauaaauuuuucugaagggauuugauuuccucagcucuucagcucaaagcacuucuuacuaacaagucuuccucuaaagugucaauggaaugcuuugguuuccugaaacucuuuuccguagagaacaguauucauagauccacuaugaucuuuuggauauuucacaguucugcaaguuaguacuuuguucaucugugaucuuugacuuucaguuuuuaaauaauugauuugguuuguuucacuuagaaaauauacaaaguuuuaaaauccuugccuuauacagcucucucagaauauugcuaccuaguguuagguauguagccauuugcuugauggauugauccucaaggcacuugcucucaaaacuuagcuucacuauagaaucuuccagguaaaguuuucuaccucuuaauucuucuaaagaucagggaugcuaaguuauaauuuguuguauaucugucauacaguguauagaggcauaauguugugaaguuuuguuaucuugaucucauuuauuaaauaucucagagaaccauuuacaccaaugugcuuuaaagcacuuaacaucuuuccaugauucuucuuagcaaauguuuuaaaaucaaagucaacccuuagccuuuuacaugguaauggugaccaugucaaauuaaggaauauuaaagugaacaauuuagaaaguuccuuuaaggacaauugaacaauucacaaaguaugcuucaaucauccaaugagauucucuuuuguguugagacaaagucucccuguguguuucuugucggccuggaauuuguuauauagaccaggcuccuccaacucaaagugauccuucugccucugccuucugaguguugagauuacaaguaggggccaccguaccuggccagaugacuuuucuugaaugcccuuugugcacauagccagucaggcaauggcauuauuauagucauauaaguugaaaauguuuuucuuuuuugaacugagccuuaaagauaguucuagugagcuuaggaugccggacacuuggaggucaugacauguaaugacugucacaaaagucucuucagaccuguccucuggguuagauuuuuuaaaucucuuuuguuuucucuguaaaauauuuaauuuaaagcuguacauuaaaacuguaaaauuggguuaugcaccguauuuauagagcuuaccuuuaccacuugagcauccaaauucaauauuucuaaaaauuuggauccaaguuuguucaugcaacaaguauuuauugaauaacuuauaaugugucaggcauguucuauuuuuugaaaauaaauuccugucacuuuaaaauugagucuauauaauguacagaggauuuguuuaguaaacguaaagaaauagaaugagcacugguaucuuaaaaaucaagucuuuguucuaaguguuauuuguaugucuuguuuaguauuuauuuaggggauuguuucuuauucuauuuuuaucuuuugcuugguuugucagguagacacuugauaguaaaauggcuuucaaaaagacauuuuaaucauuugcugauaugagaacugguuugagaguaguguuuuuguugugaaacauuccaggugaagcauuauaugcaaauuauuuaauuauuaauuucuguucauuccaaauacaagcuguuaagccucauagaauuuaaaagauuuguuucauauuuuuuccuguauuuauuaagcucuugaaauugugaggaaacucauuuuuagaauuuugaaaaaaaaaucugugaauuuaguugcagcaacgcuaaaaaaaaaaaaaaaaacaccaaaaac

SEQ ID NO: 352 - RNA, 1168 nt, Mus musculus
gagauuggggacacagagacgucauccuguuucugacuggaagacaucaguaagaguagucaugcuccauugggucaucuguaaaggagagaugcagagggcaguguugaagaucuuuuaauggcaagagcugucugggggacucucccuugagcaggcaucuggcagaugacuuauggggcaggcccgacuggaaggguuguuccacaaccucuucuccucaggagaguuuagucugguaaccgucaccagcaaucucagggaggcugcaacagucacagaucugaagcaucacagacagugugaccagcaauggaaaugccaagcaaaagcucgggccacaugccaaguauccccauggcuccuuuuggcguguacauagcugcuguugcacuggccugccugccagguaguaguugagaagaggcagaagugcuuugaaaaguuaaaggagcuaccagauaccagucaaguuuuagcugugcuguuggccuuuacaauucaggguuagauagaagacauacuucuugaaauaauaaggucucauaggacuggaaugaaaaccuggggcugcuucugaccugugccccuaaauagucuaccuacucaggacuaaacaacagaaaagugcccuugccaccugccugccugccuagccuuccgaacugaguccuggugggcuucagccugccaguucuccuugguacccacuguugcaggaagcagcuucagaaguuggcagagcagagccagggaaagcuugccagcuucuucccccacagcagggcgagucucggcacucccauccccagcaccaaccucauagcugcuucucccaacagagugacagcagcuacgacuuccugucugcugaagaaaaggagugucugcucuuccuggagaaaaccauuggcucccuggaggcugaggcugacagugggcucuccacagacgagucagagccagccaccaguccucggaguuuccgagcccuacccaccgccacccaacaggcuccccaggguaagagucugucagggaagcagcacucggaagaccagagucuccuaaacauuucccaggcagaaaagggagcccugugcucuccuagccagacucaagaagaggcuuccugagaagccagcguucugugguuuuauaccaagua

SEQ ID NO: 353 - RNA, 808 nt, Mus musculus
cauacacaagccauaagggcaucaugauuuucagaugagaagagauguuucucaagagugccuagugagauagacuagcgucaaaccagauguggcaacuccuggcucuuggccuacgaucugucuucaagaccucugcucuuauuagagggagaacuuuagcaugggggaaaguaagagaaaaugaguuaaaggagcaugguggugugcuccugcaaucccaauauuaagagguaaaaauaggaucagaaguucaagguaauccuuggcuaccuagggaguuuaaggccagccugggauacauugagacuuggauucaaagaagcaggaggagggagcaggaagaggaggaguagaaagggggaagaaggagaaggaaaaaagaagaagaggaggaagaggaggaggaggaggaggaggagaagaaggagaagaagaagaagaagaagaagaagaagaagaagaagaagaagaagaagaagaagaagaagaagaagaagaagaagaagaagaagaagaagaagaagaaagacagacagacaaaaagacaaauggaucuuuccuggucucaccuuuccccuuccugucacucauguggaccucauauaagggaaagauacucucaaccucuuguauuuggagaguuuugagcagacagguagaagauggagccugggagcagcuguuuuuccaauagucaaauuaggacuguuucucucugagcucuguucuucaaccagcaccuauagaccgaaaccaacaaaucagaaauguccauuaauaauuaaagucuaugauugccaccaag

SEQ ID NO: 354 - RNA, 4469 nt, Mus musculus
uggaauuuaacaggcuuguuuauuauaugaaaauacaucaccugcucuugacagguuauaaauauaaucuucuaagucuuguguucaaguaaaaaaauaaauagaaguuaaauagaaaauaaauacacauaucaaugaauaaauauagauagcauuagaaaguacauuacagaauauuuuacaaaauugcaguguaagggaauacagagacacaugaaggcauucacauaagggagccaauaauguagaaauaauauacacauagcuagcacuaaguuauaucacaaagggguggugguuugaggccaucuucguggugcugaggacuggaacucuugaguagaaaugccagcaccuggggccaugucuucauggugcugaggucugagauucuuggacaggaguguucucagcagccucuccacuuucaucuauagcaucuccuccauccaucucagaagaaugccuaguucucccaaagccuuuaccaccgcugccugaaguuccaacugaaggaagagcagaugcauccugucagagaugcaaaagagacauuugcccagaaauaauccuccuuccucuaucccuagucagcugggauaccuguguguguccgugugcgugcgcgugucugugucugugugugugugugugugugugugucugugugucugugugugucugugucugugugugucugugucugugugugucugugugugucuguguuaucuauguguguucccuacugugcauacuuugaucuaauaaauauugacuauaucaagcacuggaccaguucagaaacgaacaacacaguccuugcuuauaaggaauucucagcugaggaauggagacaggcgagaacaguaacuguaaugaaguaugaugaccaaaugauggaaguuucuacaguauggcaagagguagccaacucugggagcagcauccacuuccuuccuggaggugaugaccuaggcugauucagggaggagaaugucagugagcacucucuugggaggcaugcaggaguauccuugugagaaacaacauagcuggauucguaugauguugcaagugagugcuuuugaacauauguacguauguguguauuggaaaacaaccguuucucaucuaugccccauuggaagaucaggugucucuguauugguuagaggagucauagacauucuuucuucgcugguggggaaucauguagagaaugcauccuucuaggaccugggauugucccuagggccauagugaacuauuaaucugguuuguaccaacaugaauaucacacccacauaucuauaaucucaguucuaaagacaaaccucccacaauccauacgaacauaguauauaccucuaugaagugacucagaauuugguuguauuucuccauugcuucuuccccacaaugacaugccaugugagaaugcugggaaaaagacccaaagaauaguaaguuuuauuuuuaccuuuuaguguaaaggugauuuguauguaccccugugcaccacauucacguagugccagggaaggccaggagagggugcugggucccugagacuggaauuaacgaaggguugugagacaccuugugggugcugggaaucaaaccuggguucucugcaagggcagcagccagugcucuuaacuguuaagccaucucucuccacuuccaauuuuauuucaaauuuuggucuuucugcuccugcuauugggauaagcagagaguucuguuucuauaacccuauaauccuacaaucacuucuauaggaaagucuuuuccugcuuuaucauuugggauuauuuaacuaaccaucagguuaaugaggcagcuuuucaguuuuaaauauggagcacagagucuuuuuuagaaagagacagugcucuccaguuccugugccccacuggcuuccuacucuagcuccugccuagaagacuccagagcaaauccaggccuuuauggaaagaaugcaauucuauaguccuguucauaaccuaagaucaaucccaauagcccacucaccuaccauuugaguacaaggugcccuaguaaggauguagaacucauuaccuauagaaaagaaucuaggacuggugagauggcucagugguuaagagcacugacugcugaguucaauucccagcaaccacaugguggcucacaaccaucuguaauggaaucugaugcccucuucuggugugucuaaagauagcaacaauguacucauauacuaaaauaaauaaauaaaucuuuuuuaaaaagaaaaaaaucuaguuucacagauaugagcuaauaaucacaaauaccaaaaagccagcauuuuguauuucuucaaacuuuuuaggaugcuuuuuugaauucagcauauauucauuauuucuaaaaaguuacucuugggggggugguuagcguugguugguugguugguugguugguugguugguugguugguugguuuguuuggcuucuuguuuucuuuaguaauuuuggauucaauuucucuacccauccauaggaaagaaaaaugagccugguugcuaaggccuuccaacuauguaaccaacaccuuuacucacacagacugagagguccuucuugaugauaagaaaggaguuggcgaggcugcugaucuuucucaggguaugguggucaggggucugguagacuuugaauacccuguccagauagaaucucacuagaugacgaaggaagcagcaccuauccaaagacugugaaggagacaagugugucaguggggagagcaggagacaagaccaagcugugaaggagacaagugugucaguggggagagcaggagaccagaccaggcugugaaggagacaagugugucagugggaagagcaggagacaagaccaagcugugaaggagacaagugugucaguggggagagcaggagacaagaccaagcugugaaggagacaagugugucagugggaagagcaggagacaagaccagguugugaaggagacaagugugucaguggggagagcaggagaccagaccaggcugugaaggagacaagugugucaguggggagagcaggagacuagaccaggcugugaaggagacaagugugucagugggaagagcaggagaccagaccaggcugugaaggagacaagugugucaguggggagagcaggagacaagaccaagcugugaaggagacaagugugucagugggaagagcaggagaccagaccaggcugugaaggagacaagugugucagugggaagagcaggagacaagaccaggcugugaaggagacaagugugucaguggggagagcaggagacuagaccaggcugugaaggagacaagugugucagugggaagagcaggagaccagaccaggcugugaaggagacaagugugucaguggggagagcaggagacaagaccaagcugugaaggagacaagugugucaguggggagagcaggagaccagaccaggcugugaaggagacaagugugucagugggaagagcaggagacaagaccagguugugaaggagacaagugugucagugggaagagcaggagaccagaccaggcugugaaggagacaagugugucaguggggagagcaggagaccagaccaggcugugaaggagacaagugugucaguggggagagcaggagacaagaccaggcugaugagaaagcucuggauucacccucccugagcucccccggaucaaauccagaccuuuaugucuuucaaagacucagucguccuuaaaauucugaugucaauauuuguaucuucagcuugcuaaacaggagaaaggacaagaagagacaggucacugauuucugccaaggucuuagauagcaaaacuuuugaucucuuuccugccggggucuagugagaggcauuuuggaacuaccaaguacaggcaucucuuggaaaugcacuguccaggacuggagucucuccauccucuggauuuucauuagcauacuacuaaggauacccugagaagacagacagacagacagacaagacaagacaggaaagauggaucccuuccuuuacauaccacacuaucccgaaucucagaaaauuccuuuuguauugccuguagguuugcaguaaucacacagcuucccaaauggagggucuugagcccaguuaaaggaguccagagaagaaaacccacagcggagaacaguccaaaggcaagaccaaagccuuucaucuuacaccuagauccuggagaccagaagcgaaaauucaaagagaucaaucagggcuaucgaugucucccaucuagccaccaggaauaugccagcaccagcugcccacugggugggaacugaacagcuuuccccagcugcaagcagugcuauguguucacacaacuuccuaagaaaagcugcuucagacagaaaccucccagucccuuccggaucuagguacugggu

SEQ ID NO: 355 - RNA, 58539 nt, Mus musculus
uuuguucucuaagguaugauuugacuuguucuucccacacaugcaugccuauuuucucauuaggaaguagaacugaugagguucagagaaccuggagcaguaaaguuccugcccaaaaugagguuggggcaguccuuuucuuuucggccucuggcucccuaggaagauacgaagggcaugguuauucuuaggguauacuggucuccccaccucuucugcuucaacaaaugcauguugcccuucucuuuccacaggucagcggacagacuguagucuugccagguaagugacccugagaagggauaaggagaggccccugggauagagccaccugggaaagagccguagcugugcuuguaaaagauacuggauggcuuugcaaaggaguggccugaggcacaguugcuuccuucucuuugccuuacuaaucccaucuccuuucaaguggcuguggaguugcugccauuuaggguagucugagcaaaauaaugucaugggaguugucccuugauuaaaaaucuuccagaaacuccccaaagcuacaguacuucaaagaaaauaaacacuagacucuggaucuugauaaccuccuaguuagaagacuucaacauguaaccuuagagaagucucugauacaaagaagacuaggugauaguguuuaaccugagauuuuuuuuaaguguauggagaagaugauaggcacuaauuagugacuguuguggauaaggaaauauuacauugcuuugacuugacaaauagcacugggagaaaucuuugcuguucaaguaugcaguccuuccagucuuccuccaccuucucucccucuccaccucagcuaaauauuuucccucacagucauaauggugcuaugagcuggcagagaacaagacauucauucagccagcacccugaggugccugaaaaugugcugcuuuaaugacgcagauugccuucucucagcucauacagucgugaggccacuuacaguuacaggcucacuauuuacugaugacuuaaucugauuuucaucauuuugucauaguggguuagagcugaaguccuguuacuaugccauucuugaggacuggagggagcuaagaagauaaaauucuguaggaccugucuccugaugguauagucuuagcuucuucgucagagguaccacaucucuggaaaggcuaagaagagcugcacugauuucccaugcuguuuaucccuuuccccaugugugaccuuggacuaucaucucuccucucagaauaucagccuccucuuguugaagacaagcauuuuguuagcucagaaaagcgcuaugauuucagcaaggagccuuaagagcaggcuggcggcagagugagaacaaggcccagccucccaauccaucuccuaccuucccaaagcagggggugccguccaccucguugaguagugugcuucugugucugauacccuuagagaaaaaggcuccuacagcuaagcacggcuugaaaagcaccgacagaggcccugaguuccuuucagucugaauguccugccaucuaaaucaaaaacaaaacuuaauuaauuaauuuaagugguccuuuucuuuuucccaagagacucaagagaagauauaucacucuuugguguuuaguuuuuguuuccuuucauacagaaagaucuuuagauugucuaacaugacucuacuacagaguaaacuauuugcugccuguuuaaguuuugaacagugauaggcauuaaaccagggaccucuaugcuuuuauggaagaauaaaguuuauuaggcuuuuguugggaaauaacuuggcaagucucuuagcuuuuucuggaacugaucucaaaauuaugauauguuucauuaccugcuguuacaauuguuuuacaugauuuaaagcuuuaguucuggauuuaggagugauugucucauucuguccccuuuuucucucuuuccuuccuguugcuggacugguccuuucugauuugguggggcaaccacaggcgaagcucaacugugaggaaacagguaagagcccagcagagccagauuguccagcccggcucaugaaaauuguguaccucccucagccaugaugaauuccaugccaugccucugaccucaugcucauacguggcugcaccuuuaguuacaguauaguuaagauuguggcaaccaccaauuccaaguuuuugggaauuaucauaggcuuuguaauccagucuucuccuugucagaucuccaggaaauccaacaccauugaacuuacagauuaaguuugauuuaaacuuggacaaauuguuccguaacagccaaugauguccuucucugugagaacauaaagaggccucacacuuccuuacauacacauuaauaacaccagcagcucaagcuagcugauccucaaucuaaaacguccuacuuacuaaaauuuguaggucaucuuagauguauuccugacauacccuaauaauauagauaugaaccuguuuugggagugaaacaaaagaagugcucagcucgacagguuugcacugacuuucaccaauauauuuaaauucaccgcugagccaguucuuacccauguuaggagggaucuuagcaguggccuugaguaauccacaccaggggaaaucucaguacaauuuuuacuuacuuuaaaaggaaaaaaauuuaaaugaaguauauuuuugcaguagcaaaauuccauucacuaauuauagucugugguaaguagugaagugacuucauguucccuaagcuucucacaccagcuuugcaggagggaaaguuagcaaguacaggguggaaggcagggcucagaaauauccuucugucuacccaggaaaaagcugauccaggccuuuuuaaaaagucauuugcaggggcuggagaaauggcuuggugguuaagagcaccgacugcucuuccaaagguccugaguucaauucccagcaaccacaugguggcucacaaccaucuguaaugccauccaauuuccucuucuggugugucugaagacagcaacaguguacucauauuaauaaaauaaaauaaaauauucuuuaaaaaaguugaaguugauaaaaauuauaucuaaaaaaaauuauuugcagggauggaaagauggcucagcaguuaagagcacucgcucuuaauuuaauuuaaauuuaauuccagcaccuaugucaagcuacuuacaguugccuguaacucuagcuccaggagauccaacaccauugaagauuuacuuauuuuaucucauguguaugaguguuuggccugcauguauguguauacauuauaugcaugccuggugccugugugaaagggacggggggugucagaucuccugaaacugggguuacagauaguuguaagucacuguguggauucgaauccacugagcggauccuaaucuagaccugggucuucugcuaaggcagcagguacucuuaguugcuuagccuucucucuagccuucaucuuccucuugaccauagaugucauuuucauaagaaaaauuaaucuuuucuuucuuuuauuuuguuccuuuuuuauuauuauuuuuuuaaguacagcaucuuacuuacuauacaguccaauuugacuuugaacuuaugauccugauaccucugccucacaaauucuggagcuacaagcaugugcuagcaggccuggcuauacauuuuuuaaaugauaaaaauuuuacuguaacuuucuaccaucuuauuccuauaauucuuuuuuuucuccuuucucuugggguuucucuuaaaacucgagaggaauggaaugucucucagagauaauuuauugcauuuaauagacauaauaaauuaauaggcauauaucuuauagccuaagcaaccauuuuuccuuuauuaccaagaauaggcuugaacuugaaauuuauuucuuuucauuucugaucuaacucuagacuuccugcuuaguccuagggcuugcaugugggagcuuugcagccucugcuguagcugcaggagugcuggaguuugguagguaguaucugccccugacuagggucaccaucaguagugaguggcaccuaccugcuuugcauggcuauugcuacacuaaagcauuugcaggcaagguaccagauuugcaucagaguccaggauuuaccacauccaauaaaccccuuuaauuggcuuuucuuauaguuucucucugucaagaaguuuuucuuaaaugguaagaauaguaaaaucaggcuggagagauggcucagagguuaagagcacugacugcucuuccagagguccugaguucaauucucagcaaccauaugaugauucauaaccaucuauaauugagaucugguacccucuucuggugugcaggcagacaugcauguagaguacuguauacuaaacagauaaaucuuaaaauaaauaaauaaaauaguaaaagcauaauuuagaagaucuuguucauauaaauaaccagaauaucaauguuuguuucuuauaaaucaguuaaauaagagaaauaaucuggagauuuguuuuccuguagagacuaaguucaaaccagcccagaccuuuccuaagcaggaggggaccccugagccauuagucucaggccuccuugcuccacuccagcccuuccuuuccucuccugcgcauuacuucccucacuuucuuccuaauccugcuuccucugauccuugacauuuaaguguucccuuaagugugcucuacuuuguguuugucucuuuuaaaaaaaaaaaaaaaaaaagauucauuuauuuuauuuuauguauaugggugucuugccaacauguacaucugugggccauguguaugcaguacccauggaagccagaagagggcaucagauccuguggggcuguaguuagaaugguuguuaguugccaugugaggguugaaaacugaaccugaguuucauguguuuaggaaauuguaucuuauaucguggguauccuagguuuugggcuaguauccacuuaucagugaguacauauugugugaguuccuuugugauuguguuaccucacucaggaugaugcucuccagguccauccauuuggcuaggaauuucauaaauucauucuuuuuaauagcugaguaguacuccauuguguagauguaccacucuugacucuagcugcauauguaucaaaagauggccuagucggccaucacuggaaagagaggcccauuggacacgcagacuuugugugccccgguacaggggaacgccagggccaaagggggggaguggguggguaggggaguggggguggguggguaagagggacuuuugguauagcauuggaaauguaaaugagcuaaauaccuaauaaaaaauggaaaaaaaaaaaaagaaaaagaaaacugaaccuggacccucuguaagaacaagugcucuuaaccacugagccaccucuccagacucaagcaucaugcaguaucuacauguauuaaaauacauaguaucccauuaauacauacagauuuuauguaccaguuuaaaaaaaaaguuuuaagacaaaaaauuuuaaaaccaauuaauacuaaaagaaagaaacuuugccaaacuaugaauauuugucuucuggauaguuuucuccuguaaguuacugacugcugcucuacucucuuuccaaauuauaccaacugucaauuccauccagcuuccuuaaucugauagaauaggaauuuggccugacuauccuuacuagcccuuuccaacuaagguuauaugaucaaaacauugugagccaaauaaugaaauugaugauugacauuaauuuuaacauugagaaaagaagggaagaagaaaaaagcaauggaugaaaaauuuauaggaagugcugggaaaguuguauguaguucuuguaggucuucguggguacauugggaacacauaggcacagcuggggaagugaauucacuuguggcuuagaaacaucacagguugcagcaaagacgaucugaagccucuaugcucuuauuccucauuagacucugccuuagacaccauucuagccuucugugguaguagagauagcucugcucuauccuugucuacuacagaguauucccccggguuacuucugcugggcuuuuggugacaacaggcguacagguuggcuuucgugccuuguucucugaggacucuauggaagucagcugacuguugguguuagauguccugcacauucagacagagcccugcauuccauaguuuacuaaugcuaggauccuggaaguuuccaguguccuccuccuugaguguuagauaaaaaucugggaccagaaaaacucugcaaauaguucugcuaccgucauuaucucuccuacuacaugauuuccuaagaauggaggccuuuucuccuuguaauaguugauccuuguguuuacauuagaauaagggauaaaggacaacaauucuccuaagguuacuuguccugacaagguuacuugaucuaaaaaaugucagaugcuggccacuguaccugaaaggcuagaggaagcagucagguuacaaagaugagcauuuggaacuagaugugagcaugacacaucaucaaucccagggaaacagaggcgggcagauuucugugugaguuugaggccaacuugauguacauagugaguuucaggccaaccaaggcuacuuacugagucccugucuccaaagaaaauaacaauaaaaugagcauuuuaugacacugagaccuuucuggcuccaguuccacuuuggcagcauccugauuccuggcaagcuuggaaccuacauaggccaagccaucucuuuucucagccugacucuuucaugagacccagcugcuucccuuauaguggccaaacucauggcuauaucugaaaauucaaagccagauauguauaauccaaccugugaaaugggcagaagauacaaggcucuaccacauuguagucuagucuugccaaaauaucugaaacuagguuuuagggcaucucuuauguacuucuuucaugcagaugaauuguuacucauguggcuacauuacaaaaccuuucugauuuucaguaauaauuagcaagcacuguuuacuacccuuacagucuguaguaugagugacagcaaaguaugcaguaacaaaguaaguccuggcuuuuccacuugcuagcuaugugauacaauuagccauuuaaccuuacuaaaccccauuucuacauuaucuaaaacacuuuguauguggccuaacaccucugugaauguagacauuaauauucauguacuuggggcuagggagauggcuaaguggucaugaguacucuugcagaggacccucauucaauucacgggagacuuacaaccaccuguaucucuaaucccaguagauccaguguacucuucuggccucuuuggauaucagacauacaaguggcacauagacaugcauguaggcaaaacacucagcacacaaaacaauagaauaaaugcagcuuaaaacuucaaaaacaaacacguauauucauguaccaauaagacauguggcuagccucuccacuggccccuuaguuuguagacagcaaguugaaacccauauaaacugccaggauuguaaagcaaaagacaaaguggacaucugagaauccugcuauacauguucccaggucauccuuacuauucaagagucacuuuuucuuuucuuuuuuaccuuuauugugccaacuaaaccauuuuucuuuuagauuuuuaaguuuuauuuuuuaugaacaguggguuggguguuuuacaccccccucuucucucucucucucucucucucucucucucucucucucucucucucucucucucugucucucuuucuucugcuaaaaauuauaccucuuuuuggucaucuuuaaaaccuucugcuacauuuuuacaaacaaguccauagucaccaccauaaggccugccugcacuucccucacaaauacuaccacccuucaugggcccacaauuuguucacuguuauccacuguaauuucuaaaaucauuauaguucccuccaacaaaauuccauccuucauuguaacaauaauccuccuccaccaccacaucucccaccuugguuucaaaauccugguucaucaccagcauugugccuuaacuacuguaaucaggacugcuaccauaguugccaccaucaccuccaaauucauuauauuggucaucaccaccuccaccaccaugcccuccucuacuacuauauauacaggaccaccacuuccacuaaaauuuucaccaugaccaaaauuaccuccaauaccuccgaaguuuccuucuugaccuguaaaguugccaaauucaccuccaccaccucucuaugacccggaagauggcaugucuuguuuggaaaagaccuaauucccucacauuugugaccauuaacuguguuguuucuacaaagcaaauccucuuuuuuccacucuuguuuauccuccauaacuuguaugguuuugaccuugacauacuuuucaaaguagucucucgaguuauauucuucuguaucuucuugacuaucaacagaauuuuucuucacuauuaaugggcaccaggcuuuaaagaauccuuucuagaaacaguuaguucugguucuuccacacccaucaaucuguguguucuagcacacauugcuacaucuacuucuucaacacaagaguaaguucagaaaaacaaagccccuggaauauuuuguuugggggagucucucauuacuauacuguuuguaaggguuccucauuucucaaaauguucucuuaaacugccaucuguauuuucaaacagcuuccuccagugcucugguuccaucagaucauggccuuccuuccccucccuucccccaccagcaucaaugaacagucaggcugggggcgaccagacagcaggguuaucuccauuuugaggccagacucacuucuucuauuuuugauuuuugauuucuacauuucuuucuuguuuuucaggauuccagccaagcaauuccucuggugguagaaagcugcauccgguuuauuagcagacaugguaagcagaaauacagcuuugcucauauuugugcaaaaaguuagaacuucaaagaguccuuuacagaaaaagaacagagguggagccagagaggugguucagugguuaagaucacucacugcacagccuugaggaccuuaguucagauuccgaaacuuacauagcaaggagagcaggaucuuauacacaacuguaacucuaguucaguggaaggcaaaaagacaggagggucucugggggcuugauggcugccacccuagcccuaaaaagaguccuguaagauccaguucaaggaaaagacaauaccacaaaggagugucucagagacagaguguuagaauagaaaacaaccaacacuguccucuggccuccauagcuacacacaggcacauguacacauguaugugcauauacaccagagagagaagagagauugccuucccauccucacauucuuagaaaaggaauaaagucuuaacucauucauguacuguuugcuccuucagaaaggcucuaucuacaucucgugaauagacauguuuugaccuagccacuuaccauguucuuuuguagcuccagaguuuuaaauggcagcuucuuuaugaagaagaggagcuagacaguguggugguggugguggugguggugguagugguggugguggugguggugguaaugaaaccaguaguuauaggcuugguguauguagguagguaccuucuauggcauagccuaaccauuuugucccauuagcuguacuggaauggucugaaacaauuccaucucugauguugcacugauugugucuauaauauuuguguuuugucuuaauuugguuucauuggauauaguguuccuaugagcucaguaacuauuguaaaguuguaucuaccuuuugagagucuucagggacuggcucucucucaacauuaaucaaguuauauuuaccuuucugcuugggcaaagcuaagcgauuuagcucuguucuuuaucagcuaaugaccucauuagacauacuuuaauaauuaccagcaaguuuauuccccaaggcugagaauauuuagaauaucuauacuggccuuuaacuguuuagaaauuacaucagaaauaguuuuuaaauacuaaaauauccauccuggagcuaaggaagccagguauugcuugucuaaauuccaaggcaccuuuuuauucuccauccucuugccugccuccucuucucccuauaaacuggaguguuucuuagauucauuauugaagcaguaauuauuuuagcauucuuguaucauauccuaaucuccaucaacuauaaauuucuguuauuucuguucucuugaaguaugagcacuauucaucacuauugaacaaucaacaaguauuuuauaagcuccuaaccaaugcuaagcaucauguauugccaagaaagaaaacauaaagagaaguaauauacuaaucuuguuuuuaagugguuuuaugaugcauuuagaagaaaauaagugagcagauaauaaguuaaugaaaagaaauaaagcaauaguaauugacaguaacagaauaagaaauuuuacaagauagcaguaguuaauuccaaggagcuggcaaagacaaauucaagcugaguucaguugaaaaauaaguguugguuccuaaagaacaaugggaagaaguuguggauucauucguucacccaugcauucauuuguuccuucaacacaaagucuauauugauugacuauuauagaccaguaaaaagguucuuccagaaacuuuuguuccacugaagaacaaacauaaucagccaguaaacaaauugacuugcaauauuuccaauguuaguguacguuaugaagaaaagaaaucaggaugcaagaugggaaauggagagaggcacuguuguggugggucaugaaaagcccacauuuuggguggaguuguggggaagagguaagcaaugugucccucugaggaagaguauuuguggcaagagaacaagaagugcaggaacuguugacauauguaagaaagcgcacaggcugaaagagugaagggagguugacuggagaggaagccacaggcagugcuuuuauggcucuguuagcuacaguagguauauguacauuuaauggauucauaaccuuuguuagccucagaguagucuauggcacagcaaauguuaggaauuguuacauccuaacuaucauuguauccucuggaagauuauauuauauuauuauauuauuauagugcccauuauagagaugaggaaauuaacauucuucguaguacagugucagggugguccauaaggacccacaagaggaggggucugaggaaccacuaaaauuaaccaggaagggauuuuuuuuuuuaaucuuccauuuucaaaaaagaaaugugaggugguuuuaacagucaguugaagaauuaucuaggagaacaacucuuagcaacagcuauguccagcagguuuuaugucauuuucaaauaguuuacccuaauccaagagcacuuuaugcuuucauguuagugugugcuaagaaaaacaaagacuaaagauuauagauauauuauuuugguuaugcacuauaccaaaaugccaaauggauuuuccuuucuagaaaacuuguuucuccucucaaaauuaucacaucacauacucgaacgauucugucuggugugccagugagaugguucaguggguaaaagugcuuguuucacaagccugacaaugugaguuccucaaaacauggauauccacacaugugccauagcauacacacacacauacacauauaaaaugaugaugaugaugaugaugauaauaauaauaacaacaacaauaauuggcccuaagaguaagugguccuaaucuagagaauccauucucuaggagaacuggaaaccagacugaaguagaacucaguauuuuagaccaguugucugauuuccagcgagcucaucucucauuuguucuucccuugguccacaggccaucaaaccuacccagaagcacugagcugacccucucaaaaaguuguguaguacuuucccagcuaaaacacaccgaacagucugguuugagaugacauuuccuuauacucuauguuuccaauaaggccugggguauguuucuguuucugucagagucuugguauuuaugauacauuuuguuuuaagcaacaauuucuggcucucacaccccauuugguaacuaauguagugccaccacaauagcauugaugggauuuuaauguugcuugccauucuccgaggaauuucuuagggauuaccucagagaaacaaaccgcuuacaccuuacuaaaagccagguaaugccauuccuucacuuacuuucagucagauucaacaauuucagccuugguauuccuccaggaucuaacuaauugaauacagccccccucacuuaaaggacaauuaugaaauauccagcaaaauauagccuguauucuguuuuguuuguuuuucuagaaucaaucugagguuucuaucaagguuuuuggaggaucacagagaaauguugacaaaggagaucuagguuuggagaaaggcugaaaguccugauacagcuggagauaguaguuaagccaaucaguagugauuguuuccugauuuuuuuuuaguggguuacaguugcauguguggugcuuucuguaaacuaaguacaaucaggccaagauggcuuccucccauccucugugcacacagcaguagccucguguaugacaaugaaaacugagccucugguugcagcaacaagacugccuuugagcucugguccugguucuuccugucaucguucaccuguccccucaucuagaagauggauuacugcuaacccugaccuuguaggguucuaugaggaccaaauacuuucuaggaaagcauuacuggcagucauuauauaagcauuguuuuucaugacuaucucuacuccagaaaaaucaugagaagauaauuuuuuguauaccucauaaugaucuauaaacauguuuucuuuaaaaaaaaaaaaaaagacagcaguucagggaccagugccuaggacaaagacugacaaagcuaucuacugauuggucacuuuuguuuuuauguccucuauuuuucaucaguucagaaauguuuucuagaauaauguggauaguguuaaaaugcuaacgaacucauaacaacccaucuuucucuaaccucucuaaugcuaccuacuguuuuaccugccaauacccaccuccauucuugacugugggcaauaagaaagcaccaacaaguguuccccacuccacggguaggaccagaaaacuaaaggcggagaggcugcagccuaguagucacucucccuuagaagcagagaggcugugagcaucccuuuggccugaugcuucccuugcaacuaacgccucauaauccucccagagacguguccagcaucagugcccucccuguuuuuucuccuuuguccuaaaaaccaacacaugguaccaguggagaagggaauccuaaucguggccuuuaugauugugaacuugcuguuuuucacuugaccacuuuauuuucuguuucuaggccuacaacaugagggaauuuuccggguuucuggaucacaaguagaagugaacgacauaaaaaacgccuuugagagaggugagguggaaauaaacagcuauaagauaaauguuugcuaacccugagagcugccuccaccuuuuccaguagaguucucugugcuuauaaaaccaagaaauugccuguuuucucuguacuuugaguagauacacagagagauacuggaccaugccccagcuuccuucuuucuuagucccacccauccugcucauuccuauggugaucugccagaaacccaaguccucacuauauauccaggcaguuuauagccuuauccagaacccuugguagcaguuaauaucaaggcuaaugugccucuucauuguaucccauuuaucaucuuguggucuauuaagguaaugggcaagcuuuggcaauuccugucguuguaauugauauauauaguuucaauuuaggguugguguuaucauuaaauuuaauuacacuugauaugaaauuuuccauggggauucugggauggcuguucugucaguggguguccacugcuaugauagucagagaaacuggccucuuggccuuguuuucccuccaccaggggcucagucuccuuuaaguuucaugauucuugugagagaaacaguuccugguuucuccucucaacccacagggaauguucauuagccugaacagugccacauuguggccauagugcuggguagagauaaugagaugaggauguaaauaggucaccccuccaccaucucugccucauccucugugauuugccuaacucgcuuucuuuccuuucggacugggggcuaccuaucuuuaggagaggauccccuggcuggggaccagaaugaccaugacauggacucuauagcugguguccucaagcuuuacuuccggggccuggaacacccgcucuucccuaaagacaucuuccaugacuugauugccugugucaguaaguaucaguaugccccaugaauggcagcaagacacuuggaaauucucaucaauuuguuuccucagaagcuuuucaauaaaguuuuuuuguuuuuuacauauuucuuccugugaguuucuccucuuuaucuccacuguuuuaucccuaguaggggaagagcaagaaugauuuaacaguaauagcauagaauuuaagucaagacuccuugcuuuuuuuuuuucuaauuuaucucagucauuaauuccuuucuaucucugaguuuuaucuuuuuuagcaaaaugcuuuuauauucauccguaagauccagucuugucagauaccugaagcuuauauacaaugucagagcuauuaauagaaccagaggaaagugagagcaccaaccaugcucccugcuugcuguuuuauaugugccauggcuuaccugauguguguguguguguguguguguguguguguguguguguguguguguauucacaugugucuggaaacaagaaaagcuccucuaugcacuuaaaaguaccauuuaauauuuccccagagaaagaucucuguuuucauuaaaguucucuguuagggcacaagaagccauuccuaggcauuuagcucaguuggugauacugaagcauccuaccacuugauuccaugggaaauccauggaaauuuaaaauaauaucaaguuauucaggaagcagauuauauuauuuaggguuuuauugcugugauaaaacacaguaaccaaaagcaacuggaggaggaaagggcuuauuuaaucucacgcucccaucgcuaaggaaaccagagcaggaacucaauagggcuggagggaggaacugauacagaggccauggaggagugcugcuuacugguuugaucccugugguuugcuuaaccugcuuucuuaaacaacugagucuaccagccacccacagagugcugggcccucccauaucaaucaagaaaacauaccacaaguuugcccacaggguaaucuggugggaguauuuucucaguugagguuccugcuucccaaaugacucuggcuggugucaaguugacauaaagauagccaauacauaggccuuaucugaaugauggccucagaaggggaagggaguaaaugcaggagagaucuuuucccagguugaacaaggccuuuguggccuccugaauuuucaguuuggcucaguauuuggauuggguacuuaccuguuccucuuucaguuguucugagaaaagccugggcaucuaggaugcuaguucucuuugcagucuguguguuugugagaguccaaugggaaggaguuaugagacaguuacaaacauacauuacuaaggucauaucucaucucuuuuccaggaauugacccaagugaagucucuuaccaagacacaccagauuccucaucugcccaauucuuucuuauucuugcuccuaguccaauauuugcuaugucuuauucacauaaaggcuaccagaucauguuuguauugucacacuguggaagucggaggcuguucaugacagagaucacaggcauauggccaaaucuguaacuaaccugaccauagcacaaaaaccaggaaucuucucuagucuucuucacagauuuuacuacuuuuccaggguccuacugucaucucccucuacgcaggcucugcucacaucuacuuuagauaagggagggggaagccagacuuaucuagaggaggaauagauaacuguguacagaggagucaacgaaggacuuccucagcugcugucccuucuccugugcggggcucuucaagacugauuauccagcagucaugacagguuuauccugagauaccucuuugccuuccucaaucagugaguagccgccacuuggcuuugacuaugcagagcucucacaaacacacagacaacaaagagaacaagcauccuagauguccccaguuuuucucagaacaaccaaaagaggaacaauuuaaguauucagucccaaugcugagccagacugaaaauccaggaggcauaaaggcuuugucuaugucuauuguuuaaauuagaggggagacauguccaacuccuucugugcccauggaacauacaccuugaguuuguauuagucagaguguggguccaguguguggucuuuugaaacagucucaucccacagaacauccaggaggaagcuccugucacuaucccagggcuguauaugggccagcuuugcucccucugugaguugugcugcuggugacugcagucaugccagaggauaacaugccuuucuucuuucagcaauggacaaccugcaagagagagcugugcauauccggaaaguccuucugguccugcccaagcccacucugauuaucaugagauaucucuuugccuuccucaaucagugaguagccuucacaaugaaagacuuggcuuugacuacacagagcuuucacauggaucuaugucuaaucauccauccuaacagacacuuacugagcaucugccauucaccaacuacggugcuaggcuacuaaaaauacacugucagauggaaagaaaaaagccuuuuaucauuagcucaugauccaaugaaggaaacagauacuucagguauaauagcugcuaagggaaaaagaagacuaaagauggggacagaguucaggggucauaauggacaaaagauaaaggaagaagagccaauuuagagaugugcuugccacaaaggccuuucugggaagacgagguacaagcaguaaccugaaggguaaagaaagggagcuauaaagacauugaagauuugagagguagguuugaaaaaugguaugaucuggcuuucagguauuuauuuucaaaccugccaguuauuuuguggagaaguuacugcagagggucaaaaagagaagagcgacguauuccaagguugugacauggucuagcugaggugaugguagaccagaagaugacagaaagagucaggcuugggauauacguugaacacagcauugacacagaggaucugcuuauaggcugggugaggcaagaaaaauccuaaacuccuucuagagcauaagcacaguugugaaauuagggaaaaauggaauaaagauacugagacaggugcuaguguugaccagauaguuccacgcaucuuuuacacguccaagagaagguuuuucugcagcuaaccaugggaaccuaaucugagaagauccugaaguggaggcuuuucuccagccacauuuacuauaggugacuagugcacugauaucuccacuucagggcuuaaaugggacauuucuuauucaagcuugccugggacaagcaggaguccccauguugcagacaaggcaggaagcagaaacaugaccuucugucuucuaaaacaaagauuauaaccugaaggccugagagacccuccaguauauuuucuuuggauccguugugucuuaaaaacguuaaaacaauguuuaacuguuuagaaauccgucuuaaaaauuuagauuuagcuuuugaaaagcuguuagaucuaccauuaguagauguggcagcaauucccuguggcaacagggcuguccacugggaguacauggucagcccugguccccagccuucuccauguucucaucuaucaucaugcuggcucuagguuuccauauugccaagaaguaauucuguggauuccugaauccaucaaaacagggaaacaaaagauaaaccaaaggguuuguuuuaguuuuagcacauacuuugugaauaugaagucuuuauaguuagucuucauuuaaaaugacuacaacuuuacuguuuaugccuucaugaucagccuggccuuauaggcaucuugauuaguggccccugccuaagaccuuauuggaaagcccacacugucaccuaugccacugcagaacuccagaaaucuuggcucuacagucugcauccucccuaagcugugccugacugaguccuaacucagaugagcuccucauaacucauccaugugcuuaugcauagccuggaaacgcugcucugccuagucagcccccagggccacaagucacugcuuguucacaucaccauacccacacuuaaccugagccuuguuuguccuccaugaccuaggagcaugacaagagcagacaccuagaguagguagggacagagaagacauagauuaacuguuaucuuucccuggcuuugcaggggagaaaaacaguagagucagcgugauaaaguauaagauaguggccauuauugaaaaacaucauaggaauguuacuaauuccaauuauuaauuuguuuguguauauauaauuuuuuuaaaacauuguuuacugaucaacaauaaguuguuauauugggggcuggugagauggcucagggguuaagagcaccgacuguucuuccaaagguccugaguucaaaucccagcaaccacaugauggcucacaaccaucuguaacgaaaucagaugccucuucuggagugucugaggacagcuacaguguacuuacauauaauaaauaaauaaauauuaaaaaaaaaaaaaaaaaaaaaaauaaguuguuauauugaaaaggcaaaagcugccaacaguuguaucaggaguuggcagcugcuuccucauggagccuuuaccuggacccacacuuugggaauacauucuuuaaugcuagcugauguuuauucuuggauuauacacauauuacaucucagagaaccaaacuagcaguaucuaucaauugccucuuuagcugcagcuuagcuguugacuuuagcccuaggucucauguugugaaacagugcuggguuagaacuaugaaucucaucugaaugcucaccuuggggaaguugugucucuaagcuugcaaaauguuccuuaucuauacaguaggauauuguuuagacauaaaaagggaugaagaauuggugcacgguaccauacaggugaaccuugaaaauacuguguugaaucaauaaaccagacacacacaaaacacucaacauuauaagauuccauuucaacuaaauuuccagaacagccaaauccauagaaauagaaaguagauuccuaguagccagggacugagaggaagguugaaaaguaacaauuuagugaauaccagauuauuuucagggaugaugaaaauguugugcaaauuagagguaauaguuauacaacauugugaguaugcuaaaugccaccuaauuguauacuuuuauuuguuauuauuauuucuauuuagaauauaaaguuauguguuucuuuauggucuuuucauacauauguaucauuuuauuuuguucuuauuugcgccuguugccccccccaaccuuguugccagucuucuuccucuuccaaaagccccuacaucugucuucauguuacauauccacuacuacccuucauuuugucccuuccccucccauuagaccuucucuucucucuuugucccuuuucuuuggcauggccuauacacacacacacacacacacacacacacacacacacacguacacaugaguagaaaagaaaguuauauugagaaucuguugcauaucguuccagaaggcugucaucaagaaaacaaccaacugugaaacuucauguucuuguaggauuccuaacauugggagcaggggcugucucugauucuuuugcuugcuuuuggggcccuuuuccuccuucugaguuaaugugagcauauaugccuggucauauugcagauuguuaaugcuguguuugguugauaucccuggaaggccugcuccuuucuugggggaagugggcaguugggguggcuugugaggagaaaggagguuggagggagaaacuggagagaggggaaacuauaguuaggauguaauauaugacagaagaaagaaaggaaaggaaaggggaaagaagaaaagaaagaaaacaauggacaauaaauguugacgaauaugucaggaaagaggaacgcuuauaagagauuggaagaaguguaaacugauacagcuacuguggaaaucagaaugcaggugccacaaaguacuaaaaauagaauuaccacaugacuaagcuaaaacauucuuggguaauuuccugacggauuuuuagucaacauauacuuguauauguauauacacauauauacaugcauuuccauguuugcugaugcacuauucaaaguagccaagauaugcaacuagcccagcuguaagucugucaacagaugaaggauaaacauggcauuuuauuaagguauaaaaaagaauggaauuauaacacuggcaagaagguagauagaaccuaagaucauugcaugaagugaaauaaggcugacuuaccaacauaaauaugcaggaguuugaagcagaaaccacagaggaauggugggcacuagcuuccucccaucuacagcuauauuucuuuaaacagucuaggccuaaagauaguacuacccacaguugucugagcccccugaaucaauuaacaaucgagaaaauuccccagauacaugcucacaggccaaccugauggaaacaauucuucaguugagguuccuucuucccagggacuucaaguugacaaccaagaucagcuaucacaagguucuuggucuuuuuuugguucuuguuugguuugguuugaugucuaaugggaaucagaaaauggacauagauucacaaagcuauggauucacaaacgauauguccucuuccagauccuuuucacuauagccuccuaugaauaggacaacccucucagugguggggauaggguacuucaugcauccuucauuguguuguagaauucacucagguuucuuagaaauaguguuucucucugccuaucacacauuccaauaacucugguuucuuauuguuacuaaaacacccucaaaucacauuaaagaaacaaggcuuuucuaagcuuucugucuuggagaagguccagagaaggauuuuaaaauuaaaugucuaauaaugaaugucuaaaugucuaugagcuggaugcagugguguaggacugugaacagcauuugaaggccaaggcaggaagacaaugagucuggggaacguaacaaaucucugucuuaagcaaagacaaaccaacuccuauguagccaggcagcagccacugagaugauacccuugccugcuggccucucugucuuuaguuuugguauuguggagaauaccucucagccacugcuguccauggcaauuguucauaccucaugccaucucuaauguccuacagugauuauagaaggaucacaggugcacaucauauucuucagcaaagaagaacgccauuuguuagaggaaaaccagcuuuguagcauaagucuggauguaggacacacuagaaauaaacuucacccaauccagaagaauggcaguggaauccaaaggcucuaguuccuuuucagggucugucagaauuggacacugagaaccuacugcugauaaccauaggaaggccaaacuccucagcaaugcccaucaagcuuuguagaggaugcucccaaagacagcccaggcuucugugucaggacaggcacuuaauuagggcuuacuuacaguuuuagaggauuaguucauugucaucaugguggcagaaaaaaaugguagcacacaggcauacagaccugauacagguagcugacaguucuacaucuggaucugcaggcagcagcagaaagagaaagccaggcccuggcuugggcuuuugaagccucaaagcccacccccacugacauacuuccuucaacaagaccauagcuacuccaacaaggccacaccuacuagucccucuuaaguagugcuacuccccacccgaccccuccaccccugagacaggguuucucuguguagcccaggcuggccuugaacucagaaauccgccugccucugccuaccaagugcugggauuaaaggcgugugccaccacuguagugcuacucccugcugacuaaauauucauauauaagagcuuaggggagccauucuuauucaaaucaccacagauaaggacccguggggacccccucaggcauggugauaguugaguauuuggguccuuggccaagguuggggugugacuagagcagcugcuggcugagagugggggaaaaaaucucuaaauaaauaagcaauaauaaaauuagccuauguccaagggaaccccaaacagaauauaaucagaaugcaugauuaauuccuagauguaauaauaauacaaggggauauuaugaaaauguuaaacaauugcauuagcuauuuuagaaagaauuugcuguccugauggaaugaaaaaauuaaucagcugacuauauuuguaauaaguacagaauuuggaauugaaaaugcccaguaacuugauucuuuuguaugcaugcaugaaagcacaugauacacaguuccuguguccuauguggguuucucaaaguaagccuagggccccaucugcucugauaguuuagugaauuggucugcaggagccguauccaguucugcagaguguuauaugaucuguuucuaaagaaggguaacucugauguguaagguaagggugaaaaugagacucaaggauucaaagggggaacuggagaaaagggucaggccugcaagcaggucuugcaccuuuccuuucccuggcucccaaauaaccaugggcgguggcucuuuccucagcugacuuuccagaaggccucagaugcccagaaaggcagguggcaguuuguggacuuaugacuuuccuucuggcaaugccucuuguguuuguguuuucugggcauucaugugagagcuuuccaauuuccccccucucucuucucuuccagcuuaucacaguucagugaagagaacaugauggaccccuacaaccuugccaucugcuucgggcccucacugaugucagugccagagggccacgaccagguguccugucaagcccacgugaaugagcugaucaaaaccaucaucauccaacaugagaacauuuucccaaaccccagggagcuggagggucccaucuacagcagaggaggaagcauggaggauuacugguaagggcccaagaaggggaggagggaaaagagugccugauaaucacugcuguagaggccagauggucaagcaaaacccaaaggaaagcagccaggucuccccaccuccacauacaggcucuguaggucgcuagggucuggcuguucuccuaucuuagacucacccacagaauaagugccucuucgcccaccucccuuuuugaaaugaguauugugugacuagggaccaucuuggaaaauagugaccuuaauagcaguuugcaaggaaaggagaguuuacaaaguaguguguagcaggcaguggugcccaagcuguguauugugaggaaaacagagcugggucucagggaauccuguucuuaggaggcagaaucuguauaugaggcacacugaguuuauaagguggcauguuagaaugauuucagaaauuugugaagagaaaaaguguaaacuuauuuggaguagguuacacuuaguuccacccccuguaaaaaauaugacguuauauagacaagguuuuuuaugaccuagccugagcacauacuucuaaaaggaaccucccuaaguauauuuguauuagaccaccucuuuuagacaaaggaaucauuucuaaaaauuagaauacuaguucccuuuuucagaugaacuccuuacaauccaggaaggucagugcaaugugucagcccaccccagugauuggggauucaacccugaucucaugcuuucuaggaucaggcuccauccaguaccucacacagaugcccugauaccacuuuacagugccauucuucacugaauacaaaggccuuuuaaccccuaccaucuuguuccugcucccuucucuaaaugguuuuuaauagaagcugaaugcacaagccaacccaaaucagauuccgucuaaauuaacaucuggaaccaauccuuccagcccuauugcuaucaaccacaguaagagagggcaaggcauauauuuaccuaauuagcagucaguugguccaugguuuuccaugacccucucagaacccagggagugaagaaaauaacauuugugccucuguaaacuuuuuaugucauccuuggaucuacucuuuccuggacuucagaucuuuggccugcaucugagcuggggacaccucagguagcugcuuagagacaaaacuuucuguggcugacaagugguccacagugacugggccuguugaucaguugaccuccuagccugugagcuccaagauauauuuccuauaucuuugugugaguaguuaaaaagcuguggaauggucccucaguucuuaccuuuaccuguaaaguuaaauaucaaaucacugcagguucuggaccaauaaaagggggauguaguggucccagcucccugaucuccagucucuacccagggagcagaagccaagaagugugguuccuuagaacacauacauggaaacucuuucuucuaguuuucucccaaguguuuuccucaaccuuuaccuuguguguugugugugugauauuuauuaguggucuuugaaaacaccacacaaggcacaggcgccggcgggagccuucuuggcuccgggacuccgcggagggcaggcugcacgggugaccguguggaauacagagugccagcuguuucugggacgggcgagagagucgcagagcuucugggcggcgccaccuucagcuccagacagccggccaccuuccuggugagagcacgggggucugccuggccugagagguuuguggcacaggcgccggcgggagccuucuuggcuccgggacuccgcggagggcaggcugcacgggugaccguguggaauacagagugccagcuguuucugggacgggcgagagagucgcagagcuucugggcggcgccaucuuuagcuccagacagccggccaccuuccuggugagagcacggggucugccuggccugagagguuuguggcacaggcgccggcgggagccuucuuggcuccgggacuccgcggagggcaggcugcacgggugaccguguggaauacagagugccagcuguuucugggacgggcgagagagucgcagagcuucugggcggcgccaccuucagcuccagacagccggccaccuuccuggugagagcacgggggucugccuggccugagagguuuguggcacaggcgccggcgggagccuucuuggcuccgggacuccgcggagggcaggcugcacgggugaccguguggaauacagagugccagccguuucugggacgggcgagagagucgcagagauucuggggcggcaccauccucagcuccagacaaccagccaccuucccggcaagagccacagagcuucugaggcugcgacaucuucgacuccagacaacuggccaccuuccuggccaaagcaacacagcuucugggaaagauucuguuuugggccuucaccuucagccaggaggagguccaaacaccagauaacuguacaccuucccugagagaggagagcuugccuacagagacugcucugaccacugaaacucagagaagagagcuugucucccacgccugcugauagaggguaacaaaaucaacagaggaacaaucuuuuaacaaagacaacuauaacaacuaacuccagagauugccagauggcgaaagguaaacguaagaauccuacuaacagaagccaggaccacucaccaucaucagaacccagaacgcccacuucgcccaauccaggacacccuaacacaccugaaaagguagaccuggauuuaaaagcauaucucaugaugaugguagaggacauaaagaaggaauucaacaacucacuuaaagaaauacaggagaacacugcuaaagaguuacaaguccuuaaagaaaaacaggaaaacacugcuaaagaguuacaaguccuuaaagaaaaacaggaaaacacaaccaaacagguagaaguccuuauagaaaaacaggaaaacacauccaaacaggugauggaaaugaacaaaaccauacuagaccuaaaaagggaaguagacacaauaaagaaaacccaaagugaggcgacgcuggagauagaaacccuaggaaagaaaucuggaaccauagaugccagcaucagcaacagaauacaagagauggaagagagaaucucaggugcagaagacuccauagagaacaucggcacaacaaucaaagaaaauggaaaaugcaaaaagauccuaacucaaaacauccaggaaauccaggacacaaugagaagaccaaaccuacggauaauaggaguggaugagaaugaagauuuucaacucaaaggaccagcaaacaucuucaacaaaauuauugaagaaaacuucccaaaucuaaagaaagagaugcccaugaacauacaagaagccuacagaacuccaaauagacuggaccagaaaagaaauuccucccgacacauaauaaucagaacaccaaaugcacuaaauaaagauagaauacuaaaagcaguaagggaaaaaggucaaguaacauauaaaggcaagccuaucagaauuacaccagauuuuucaccagagacuaugaaagccagaagagccuggucagauguuauacagacacuaagagaacauaaaugccagcccaggcuacuauacccagccaaacucucaauuaccauagauggagaaaccaaaguauuccacgacaaaacuaaauucacccauuaucucuccacgaauccagcccuucaaaggauaauaacagaaaaaaaacaauacaaggacgggaaccacgcccuagaaaaaacaagaagauaauccaucaacaaaccuaaaagaagacaaccacaagaacagaaugccaacuuuaacaacaaaaauaacaggaagcaacaauuaccuuuccuuaauaucucuuaauaucaauggacucaauuccccaauaaaaagacauagacuaacagacuggcuacacaaacaggacccaacauucugcugcuuacaagaaacccaucucagggaaaaagacagacacuaccucagagugaaaggcuggaaaacaauuuuccaagcaaauggucugaagaaacaggcuggaguagccauucuaauaucggauaaaaucgacuuccaacccaaaguuaucaaaaaagacaaggagggacacuucauacucaucaaagguaaaauccuccaagaggaacucucaauucugaauaucuacgcuccaaaugcaagggcagccacauucauuaaagacacuuuaguaaagcucaaagcacacauugcaccucacacaauaauagugggagaccucaacacaccacuuucaucaauggacagaucguggaaacagaaacuaaacagggacacagugaaacuaacagaaguuaugaaacaaauggaccugacagauaucuacagaauauuuaauccuaaaacaaaaggauauaccuucuucucagcaccucacgggaccugcuccaaaauugaccauauaauuggucacaaaauaagccucaacagauacaaaaauauugaaauugucccauguauccuaucagaccaccauggccuaagacugaucuucaauaacaacauuaagaauggaaagccaacauucacguggaaacugaacaacacucuucucaaugauaccuuggucaaggaaggaauaaagaaagaaauuaaagacuuuuuagaguuuaaugaaaaugaagccacaacguacccaaaccuuugggacacaaugaaagcauuucuaagagggaaacucauagcucugaguaccuccaagaagaaacgggagagagcacauacuagcagcuugacaacacaucuaaaagcucuagaaaaaaaggaagcaaauucacccaagaggaguagacggcaggaaauaaucaaacucaggggugaaauuaaccaaguggaaacaagaagaacuauucaaagaauuaaccaaacgaggaguugguucuuugagaaaaucaacaagauagauaaacccuuagcuagacucacuagagggcaaagggacaaaauccuaaucaacaaaaucagaaaugaaaagggagacauaacaacagauccugaagaaauccaaaacaccaucagauccuucuacaaaagcuuauacucaacaaaacuggaaaaccuggaugaaauggacaaauuucuggacagauaccagguaccaaaguugaaucaggaucaaguugaccuucuaaacagucccauauccccuaaagaaauagaagcaguuauuaauagucucccaaccaaaaaaagcccaggaccagauggguuuagugcagaguucuaucagaccuucaaagaagaucuaauuccaguucugcacaaacuauuucacaagauagaaguagaagguacucuacccaacucauuuuaugaagccacuauuacucugauaccuaaaccacagaaagauccaacaaagauagagaacuucagaccaauuucucuuaugaauaucgaugcaaaaauccuuaauaaaauucucgcuaaccgaauccaagaacacauuaaagaaaucauccauccugaccaaguagguuuuauuccagggaugcagggaugguuuaauauacgaaaauccaucaauguaauccauuauauaaacaaacucaaagacaaaaaccacaugaucaucucguuagaugcagaaaaagcauuugacaagauccaacacccauucaugauaaaaguuuuggaaagaucaggaauucaaggcccauaccuaaacauaauaaaagcaaucuacagcaaaccaguagccaacaucaaaguaaauggagagaagcuggaagcaaucccacuaaaaucagggacuagacaaggcugcccacuuucucccuaccuuuucaacauaguacuugaaguauuagccagagcaauucgacaacaaaaggagaucaaggggauacaaauuggaaaagaggaagucaaaauaucacuuuuugcagaugauaugauaguauauauaagugacccuaaaaauuccaccagagaacuccuaaaccugauaaacagcuuuggugaaguagcuggauauaaaauuaacucaaacaagucaauggccuuucucuacacaaagaauaaacaggcugagaaagaaauuagggaaacaacaccguucucaauagucacaaauaauauaaaauaucucggcgugacucuaacuaaggaagugaaagaucuguaugauaaaaacuucaagucccugaagaaagaaauuaaagaagaucucagaagauggaaagaucucccaugcucauggauuggcaggaucaacauuguaaaaauggcuaucuugccaaaagcaaucuacagauucaaugcaauccccaucaaaauuccaacucaauucuucaacgaauuagaaggagcaauuugcaaauucaucuggaauaacaaaaaaccuaggauagcaaaaacucuucucaaggauaaaagaaccucugguggaaucaccaugccugaccuaaagcuuuacuacagggcaauugugauaaaaacugcaugguacugguauagagacagacaaguagaccaauggaauagaauugaagacccagaaaugaacccacacaccuauggucacuugaucuucgacaagggagcuaaaaccauccaguggaagaaagacagcauuuucaacaauuggugcuggcacaacugguuguuaucauguagaagaaugcgaaucgauccauacuuaucuccuuguacuaaggucaaaucuaaguggaucaaggaacuucacauaaaaccagagacacugaaacuuauagaggagaaaguggggaaaagccuugaagauauggguacaggggaaagauuccugaacagaacagcaauggcuugcucuguaagaucgagaauugacaaaugggaccuaaugaaacuccaaaguuucugcaaggcaaaagacaccgucaauaggacaaaaagaccaccaacagauugggaaaggaucuuuaccuauccuaaaucagauaggggacuaauauccaacauauauaaagaacucaagaagguggacuucagaaaaucaaaucaccccauuaaaaaauggggcucagaacugaacaaagaauucucaccugaggaauaccgaauggcagagaagcaccugaaaaaaugcucaacauccuuaaucaucagggaaaugcaaaucaaaacaacccugagauuccaccucacaccagucagaauggcuaagaucaaaaauucaggugacagcagaugcuggcguggauguggagaaagaggaacacuccuccauuguuggugggauugcaggcuuguacaaccacucuggagaucagucuggcgguuccucagaaaacuggauauaguacuaccggaggauccagcaauaccucuccugggcauauauccagaagaugccccaacugguaagaaggacacaugcuccacuauguucauagcagccuuauuuauaauagccagaagcuggaaggaacccagaugccccucaacagaggaauggauacagaagaugugguacaucuacacaauggaguacuacucagcuauuaaaaaguaugaauuuaugaaauuccuggccaaauggauggaccuggagggcaucauccugagugagguaacacauucacaaaggaacucacacaauauguacucacugauaaguggauauuagcccaaaaccuaagauacccaagauauaagauacaauuuccuaaacacaugaaacucaagaaaaaugaagacugaagugugaacacuaugccccuccuuagaagugggagcaaaacacccuuggaaggaguuacagagacaaaguuuggaguugagauaaaaggauggaccauguagacacuaccauauccggggauccaucccauaaucagcuuccaaaugcugacaccauugcauacacuagcaagauuaugcugaaaggacccugauauagcugucucuugucagaguaugccugggccuagcaaacauagaaguggaugcucacagucggcuauuggauggaucacauggcccccaaugaaggagcuagagaaaguaccaaagaagcuaaagggaucugcaacccuauagguggaacaacauuaugaacuaaccaguaccccggagcucuugacucuagcugcauaugcaucaaaagauggccuagucggccaucacuggaaagagaggcccauuggacacgcaaacuuuauaugccccaguacaggggaacgccagggccauaaaaggggaguggguggguaggggagaggggguggguggcuaugggggacuuuugguauagcauugcaaauguaaaugagcgaaauaccuaauaaaaaauggaaaaaaaaaaaaaaaaaaaaaaaagaaaacaccacacagguaaucggggaacauuugugccacuguccuuggccuugggccaguggcaucaaggaacaauugucauugaccuagcuccugacuucccuucuuuaggaagaaagauacuaucacaaugagcgaaggcagugaaaaaguaagcccuccccaaauuuaggagaguggccaagaaaccgagaccaccagacugcuuagccaucccacagaugugaaaaaguacauuucagaccaccuaccugucccagacuggauucugguugccuaggaauacugcuaggaccuugggccucagauguuagugucggccauauugccagggcacaggagaggagaagcaugagaucuuaggacuacacagaaccucagaaaguaucauuccuuuaccauggcgcagauuugaaaguggaaaguccagacuaacagcaccagauccugugggaccagaaugaaaugcagauucucuaacuccagacugauuuugugacucagaaaagcuuuuuagcaagcccuccagggcucccugcaguuuaagaacugaugcucugaugccuuaauggaugcacagaaaugaaacccugcgauagucuguaggcccagaaaacaguaaggaauuauuucaacuuaaaaaaaaaaaacaaaggaaaacgaaaacgaaaacgaagaaucccuacugauguucuaccaguauucucuggaacuuaagaucccuccuuagaaccggcuuguugccuagucuuuaacaggugucuuagaugggagggggguguguacugggcagggagaggcaggcuccauggcaggaggcagaggagugugguguuuauaggcucgccugccgggaaaggugugcuugaugguuccuacugccagaagggaaagcuucagacauggucagaggguuuucugcucuucaagaauguccaccuccucccugagccagaagagaagagaagaaacacugccauaguaacuucuagccacuccaaguucuuagccuugaaugauuuaagagaagauaaauguuuuaaggacuaggcugagcuuucauccauuggccuccagugaaauccacucuccagcagaccuuuaccuuugcucugguuccagucauccuccacucacuuccuacuuucccaucagugccugggccagugagucacgcggugccccagagucagcaaggaaaggaaggagguuacacuuacugagcaccccucuugccaagccuucacuaaauuacaccagugauaccucacacaccucuguauuuauuuuaaaaauaacaacagauguagcuaucaaauaucagagcugguuuucauguccaguugucccugcuucaaaaaccagggcuuuccuucucugaguagucaaguuguguuuuauaaagaguuuauuuguaacuccacagccuucccuuucucucaaggcagccuaagucccaaguaguggcauguggcuuggggaacagaagcuaaacuagagaaucacagagaucuuuuauuagcaguugauggcuguggaguuuagcaagcaauugauuugauauaacaaaggggaggaaaauuuuaggagcaaacagugaugucccguuauugcucuucuguuucagugacagcacucauggagagacuaccucugcugaagacuccacccaggacguuacagcggagcaccacacaagcgaugaugguaugcuauaggcugcuggucaguaaagcaggcaugauaguauauauugugcauucaaccaacuaugcuguccaguggacccuaagugggagaaaggaguuucuugucucuucuuaccuuggaggagcagucucaaguaaugaauacuugaggugaauaauacaccuuuuguaguccugcagcuuccuggacccaccucuuagcucccuaucuaaccugaauucaguagguaucagcccuaauucugccagguuacuggaaaccaaagcaaagcucauuugaaaaacaucaagccuggggaauagagacacugggugccaagaacucaacagaagccaagugaggggggugggaaugaggacacagaaaccacacacuugcaugccugccaacuggaaaaugugaccccuuccaaaguacagauuugugugugccgcacagcccgugagugugcauccagggguggaaugcucagcugucauccucaaaccccucuagaguacaugugauuuauuagagucuguccagccagcacauuuucccggcguccaaccgcuccacaccuccguuucuggaucacuuggucucuggaagucucagcaguugacaagggcccucagaauuuuaugggcagaagaagaaaauggcacagucuacaaguuuugcuugcaccccugccuugcuagaaauccugcaaucuggagcuagcuuuugaaggagggagagauaggacuuacuguuuaaaucauggugugagaagaaucagaaugaucuuuaagagagaaguagguguaacaagagaauucaguauucauuauagcugccuuguucucacacuguuagagguuuaucucuagcgagauugguagggcagcugagaaaaacgaggccacagagccaagugcuguacuugagguuguagagaacggauacuggccuacugagacagggguucugcaguggaaucuucagccagcccauuuagcagcagacuugccacccagggcuuuaugggcaugggcuucuuuuuaaucagccuuccucccugcuguggcauuuacaaacuaauuguucuguguuugggagagccuucuacuuacuauccaaucucuacugcagcuuagauggaugaaugaugccagcaauggcuguaucacaugucacaugaaugugcacauaccacagugcugggcacuauucuaagguuuuucaguugaaauuaacuccucagaacaacuucaugagaagggaaacuuccugucauccucauuuuauacauaagaaaaucccacagagaauaguaauacuuuguacuuauaagcccuuuuuaaccucucaaguuauuuucauaugcauuuuccauauauugguuuuaaaucacuuuauauauuuuacauucuacugggaggacuaaauaacacaaauaaauuaccuaaaauaugguacaauuugaguauuagguugcugaugaauuuacuauguaaucagaaaaaugcuuaaaagcauaguaugucaggcuggguauagaggucagugguggaguguacguccuugaaugcccacagacgaagcccugaguucaaucugcaguacugccuaaaagaaauaaaaaaucaagaauggauaguagacagucagcauaaaacauugugggaucacaaaggaauuaucagggaaagcagugucccuguguguuacugcaggcagaggagagaaguugggcagggcagauaauaccagucugcuagagcuuuauggauccugugcagcuuauuuuuauacugaguuauccucccaccacuguuaguagacuuuucacccaguuuccugagucuguagaucccagaaacacaugcuucauucuuuccugcccuuccuagaaugugagcccauagaagccauugccaaguuugacuacguaggccggacagcccgagaacugucuuucaagaagggagcaucccugcugcucuaccagcgagcuucugaugacuggugggagggccggcacaacgguauagauggacucaucccccaucaguacaucguaguccaagacacguaagugaaacccuggcaccuuugggggaggggggucccugcugcacuguggaagggacacuuaauucccaaagggguucuaagacuuaauguuccauggagaacaccccgccucugcaacucaguggagaauuguuuugaucucccacuuucucuucucccuuuaaauugccacuugauccauuuguuuuagaagcgugccagguuuauauacauuuauauguaugcugaaugagugacagcauggacuuuuucauuugaccaugcauuauuugcuuucucggaagguuaggcugagaaaacauuugcuucucugucuuaguuaggguuacuauuucuguaaugaaacacuaagaccaaugcaaguuggacaggaaaggguuaaguuggcuugugaccuccaucacugaaggaagucaaggcaggagccuggaggcaggagcugauacagacaccgccagggauugcugaguaccugcucucuuauagaacccaggaccaccagcacggggauggcgccacccacagugggcugggcccucccccgucagucaguaauuaagaaaaugucauagagguggaucuuuuggaagcauugccucaguugugguuccauccuuccagauaacucuagugucugucaaguugacuuaagacaggccagcaagccuuucucuguaacuuaggcugcuugagcucacucugucuaacucccagcaguccuccugccuuagccucccagugcuaagauuauaggcaugcgccaucagacuuggcuuaccccagccugcugagccacugauaggacuuugccaccugcaggugaagacugacaggcggcuuuuuaggagaaagauuuuuagaaagaaagggaagccuuguaaaagaagcaaaguaggacaaguaggaaaaggaugucgaagaacaagggaaaccagaguuggcucuagagguuuugcuggguagccugucuguugguucgcacccuuugaaggaauguauccuaggcagaaaguagcaaccuuguggccugcacacaccugccccccuucgcccugccucagccccacaccucccuaagauacagcauugucacuguuuuaguccuccccuuacuauuaucuuuuuaaagguugauauccugagucugcaccuucccagccucucucgggcuuguucugcggggaaacccucccuguguugauaacaucgcaaaccugguggcggucugugcacggacaggacucucccaaauuuagcauuaugacuucaccaugggauccagagaagaugagcugugggagaaaaggggcuuucuuuuucaucaguagccagaggggccaggagagcaauggagagaccugagaccaucuugaaugcucagagcgaggcuacauaugcuacgacaguguggccauguguccacaccaugccucaucgcuggcaucucccuccagagccacuucagagcugccugucauuaccagcagcacucagaacuucagcagauaaacugcaaccugaaccucaccuccuucuccaggagguggucccaucguggccaccccacaaaagcagcaugggcccaaaggcagaugcuuugaauccagguguccccuagccaagcuuuucugaggagcugagaaucaaauagaacucagcgaacuauuuauuuauuuaagugacccuucaaaggcccucagguucccuugccucugcucacagagcuagccccagacaggggucgcugcugccucugcgcugugugggguuauguguauguccaggggggccaucuugcugauuuaacacugcuuuuuguguuguuuucccuucucccugccugccugucccuucuaccccagcgaggacggugucguggagagguccagccccaagucugagauugaggucaugucugagccaccugaagaaaaggugacagccagaacgggggccagcugucccagugggggucauguagcugauauuuaucuugcaaacaucaacaaguaagcgcugcuuuucauuuucugcuccccucaaugacucacucagccucaccccuagccuaacccuuccccgcucugcuggaagcagggcuccagcuccccagccuaacagucuucauguguuguuugcugcugcaaggcguguggccaggcugaggagaggaggccggugugggucugagggcaggccccagccuccgacugucuguugucauccugugguacucuguguguuccacagugucugucugcccagacuuccuagcagucuuagccaaaccuucaucaaagcuuuggucaccuuugcaacuugguuuugugcuguuucuucuauuucuuaucagugccuucacuuuuccaacucuuauucaaaccguauuugauaucuucuuugacccuugucugucugcagauucagagucucauaugucucucaccaagcuaaugucccaccaugugggcuuguuuagauggcacgugucuguuucuccccauccugcauucauagccauggaaaagagaagagcacugagccaagggaagcuuuguccugaacuccuaaaucauccugugauuucccuucgcucccuuucacacuagcagaaaucacuuuucaucuucuccuguugcuuuagcacuguguauuauacuucccuggcagucccucugcagagucccccccacccccuguccggcaggcuuacacucaccccagcuuucauuguggccauuagcaguauucugagguucuaacuccauccacaccugcuggcuaucuagagggauuccucguucgccugcccaugagcugccgccuucccaagaggcacucaggcuauuggagaacuaaucucaucucaaggggccagacaccaaguccuacagaccucuuuccgccagacccugaacuguggcccagugccaggaggaugacaagccccggggcacucguggugaccguggauuggagaugacgcacaguuuguauuccuccugacuuuggaggggugaaaugauuugcacuuugauacccuguuaaccauagccucuggacacugagacuggaaggagaauaaaagaugcuuauuguuguuaaacugcaugagguugccagaucucuuggcuuuuuuccaaccagacaauagagggguugggggacaugguucuuuccuaucucuuuccccucaaguucaucucguuuauucagcucacuuacuagaauagucauaauuuaauucaaaccacuaagcaaguugagaauuuuauacuucccuccaucuacuaggagggcaaguuaauaaaaaguagcugccagcuaaucacauuuuuuucaauauuuacaagucuguguuaauuaugcgucuacaaucacaaggucauaagccuauugagccagaaaccaagacuggauguugaagggaaaguuagguguuuauuuacacacauuuauuuuuguuuuuaugguguugagggacagaacugaacaagucacauauucagauggagaaccccacugccaagcuacagcuucaucccuggguauuaaguuuuaagucagcauauauuugaugccacuuauuacaaaggaaugauagagaacaaaggcugaaaauagucaaaagauaaacaacugcuagaacguugagauggcucccuugaacugcuugcuuggugguaucaagauucuucugaugaauuuccuggggcagacuauaaccaacccaugucaaccuuuccuaggcaccagccaaucagugcgugagugacagacagcccccauaugccuggcccuuaggagcgaguaugccguucugucuuccugacuaucuccacaacaguccucccaugcaacuucaauuuccugauugucuaaagaacucucuccuccuggacccucucauuugguuaacuccuccucacccuccaagacucacucuaagcauuacuuauuuggggaagccuuccugacacccuaaguuccuugaggcugaaaaaaaaagugcucucauccugcguucuagaauggcuugaguuguuggugcucagugcuauccaugccugguuccuccuucaggcugaacuuguaaccagcaucucugucuucauggcccaaauagagccugggaugacacacugccacagccuccuaaaucugcccucucagcaguucugauuugugagucagccauccuugaaugggaaaaggaaaucagcagaguucuuaggguguggcauuucacuuuaauuccacauccuauauuaaccaucugcguugugccaagcaccgaugcuagugauucagagcucacagacuggcaaggcaaaagaccauauggaaggcaacugaaacacagucccauguaaucacugaggggauaugggaggggaaaaccucuccagucuguaguuggaggcacuagugucuggaaaacuugacagaggagggcuuauuucagcagagcccuccuagacuaaaaagcauccuuuuucuuguugaaaauggcugccuuccaaggcuaguccuaccuagccauacaugcuuagaguggcugcugggcacacccugcuggacccagaaagauaaagcagaucucagcuguaagcagcauaagaacuuacuucagauuuggcccccagucuucagaguccuacccuuaccauccagagaccccacccagcucagcucaucuuccucaguagauacaagaucagagcuacccagcugcuaucugaacuagcagcuagauggcaucuuagaugagguccuuuaaaaucugguuugaaaaaugaaauuauucagcaucggacaauacccauaugacuaggauccuaccacaccauaucguuugagagccuuuugugguaugaaauaaauuggcccagugcugggugacauaggaguugcauaaauguccuuuccacccuaggagcaggcacacagugagcccucugucugugccaaaaagcaguuccuugaaaaaucuuuuccaugucuaugaauacgaaacagccucuuacuagagcccaaaugaugacaggcucauuauacauaguugagcaaacuggaaacguuaacuccuguuaccagcaguucuccccuccuuggugaugaugagacuuucuuaccuggggccuugggcugcuguucaggcaggcaguggagugggucuuuucaugacucuuuucucccacuagaaacuuucucuuaaacaggcauuuuuuucugacagcaucuuacauguuuagaacucaaagcucacagccaccaaguaaguaugcauuucacuccgcccagguuggggguuggaagggaaccgauccagagagaaaacaagagaaagaaaagcuggagaguuaguguaaucuauuugacucucuuuaaaagucccaggugccagccucuacccccugucacaauccuagcucccuuggagccagggcucccugaucagaugccauuuuuguuuguugaaggcaaaggaagcguccagaaucugggagcaucagaaaagcauuucggagugacagccaugggcugggcaguucucugacugacuccuccucccugggggugggggcuagcugccguccauccucccagcccaucaugagccagaaucuccccaaggaagggccagauaaguguuccaucagcggccauggcagccucaacucuaucagccgccacucauccuugaagaaccggauggacaguccgcagauccggaagaccgcuacggcaggaaggucaaaaaguuucaauaaccaucggcccauggacccugaagucauugcacagguaacagggcucugaacaguuacgugauaagcuuacacugguuacuuccccucagcagccccggagaacccacagaacuuaaagcagaccaaugcucuguacauucuauagagaguacugcaaguaucauacagugaaccugccagaacagcuuaaugagcaaucugccuaguccuaucucuccagcaagaaccuggaaguagaauuagucguacuaagguaaagucuggggugauagcucaguggauaagaauacuugcuauggaagcaagaugaacugaauucaaauucacagcacucacauaaaagccuagcauggccauauaugccuguaaccucagugcuggggauuaggagcaggcagccagaccagccaaaaagcagcaagcuucaaauucagugagagacucugucucaaauaagauaagguagagaguaauagaggaggguaccugacaucuuccucuggccucuguccauaggacacauugaauagguagguaaguagguagauaguagacagaugauaaaaacccaauaguaggcuuuagugaagcugagacaaauauagucugucgcguuuauauauuucucuacccauccccaucaccccacuuccugaagcugaucuaggugcuuguggguagauaauuaguccacaucugauucuaucauaaagaccccaaaguauccauguugcuugaagcucagguacuagaagggccuccagcccagggcuccugguaacagugcaggugagcucccgauugcaggacuuuccuucucaucuacacuacacugcugacucuguguuuuccgugaaauauuagaagcccaacccgacaucuaaacauccagcuacuggggccacuccaagcaguucucucagacgucucucccagcuauauaauuuucacuagaacagguaggaacuaagggcuugguuuuguccuuuuccucaccucaucuucuggggugacagggaagggcaguggaggcucuguauggucucuguuggcugcauugcugcucagcuuaaggagguguaccuggugaggccagaguuaagcccugggccugugaugucuugcuuugcuagccuucuauccuguuuaagcuccugacagcagucugccuugcaccaugggaauccuccuugaucuucuuuuggccagucauuaaucaaaguguuagaaaccgcaaacauacuagcugcauuaacaggacggggccaggagauaagaauucuuccagagcauucuaaaagauuugggaagucuaguguauagcucagugaugcaagcucagaaugcuugccuggcaugcauaggcuccuggguuccaucccuaagguugcaggaaggaaaaaaaggggggcuaauuaaugccaccgugauuagugaaaaugagucccugucauucguagcaacauagaucaugccauaggaccaaaagcccugagugggaaaucugaggcugacuuggaacuuaaaauguuugaaaguauucuugaucccaaagaggaguccugugguggcaauauuaaacacgagugugcagcaggguauggaggcugggugcuuacacacagugguucucugguucugccuugagccccugggcuaggacugcuuuuuuccuaaaagcugcaguguccucugauuuguagaugcuaacuuaccugugugggcuuuggcucccccuucuggccacucuuuggguucucuuucauggugcuggguagaaggaaccaguuucaaggaguuuggaaauugaagcauuguucuaaccagucuucaaggacuuggcucuugaacggcccuuagcucauguggaggauggaaggaauaacccccuuaaccauuggccuugaagucaagaaaauagagaucauacuugaucuccaccacuuuguaaaauguguucacuauguacacuuucaaacagacacagacauagagagaauuauauaaugaauccccguguacucaugaccuucccuuucuccaucuaacuguguguaauuucauccagaaaugucucagcaccugucacagaaaacaaggacuugaguugaaaagacucagcuacucuuuccuuguuaauauuuucucuccguuguuaaacuuaguacaucuaugcaauguguuugaucaugucuuccacugcucccugcccccagcuccucccagagccucccacuuggcuuccagcccaaucuccuguuguuguuguuguuguuguuguuguuguuguuguuguuguuaacaacccacccccaguccaauacauacugggcuaagguuucccauauguauuggaagucuaauauucccauauaugcauaggucuagggcuaccuucugggguaugaucuagcuaccaggagccccaauucccaaaacugagugacucuuccucagcaacugucaacugccaguagcuccucugauggggguggggccuaaggggccccaccccaguuucugcuggcauuuuggcuggcuugauauuguacaggugaccccaacggguauaaguugauguguacaacagccuugucauauccaaaagucaccaguuacucuuucuaaauuccugacgaugacaaucucuguccccuuuuuccacgaucuggacacucauaugucccaggacuuuggccaaugaaauaaggcauuuuauugcugguuucauggcuuagccuauuugagugaaauuggauccuuggguauaucugucuugguuugucuuacuuuuuccuuuuuccuguuuugcaggauauugaagcaacaaugaacucugcccugaaugagcuucaagagcuagagcggcagagcagugcuaagcacacaccugaugugguucuggacaccuuggaaccacucaagaccuccccggugguagcccccacaucugagcccuccagcccucugcacacccagcuccucaaggacccugagccugccuuccagcgcagcgcuaguacugcuggggacauugccugcgccuuccggccuguaaagucugucaagauggcugcuccagucaaaccaccagccacacggcccaagccaacugucuuccccaaaacaaacgccacuagcccuggugucaauucaucugcuuccccacaggccacugacaagucuuguacugucuaagggguauaacauaauuauucuagacaaggagacuggccguuucuaaaaucuuccuauuuaaguagcuuggggacucaguugaaaauuagguucuaaguuguucuuacaggaauuagccuucccauuacccagaccucgagaaugaagcccuuguuacugcuuuccccguucugguccuuccuccacucuuugcuucccucuguuguuggaauccagccagcuccaguacauacuguucuuagguuagccagugacagguuguccaugaucggguugcugcgauaucugccaaggcaagacauagggacauaagccuacgucugucccuucagaccauagaggacaccuugaccagauguuuggcugcagcucucagugacaucuuguuuuucaguacugauuuaaaaaaucauauauagcccaguuuucauuuuauauaaauauauauauauauauuuguguguaugugcaugcacaugcacacccauauacaacacagguuuuucuagccucuccuggucauagaccacucuuuguugugguggcaguucacacagaagccaccuggagucucuguucucaucacaaacuuuguucuguuuggaacagagaaaccuggccuuugagaucucugucauaaacauuuagcagaaugggacaguccugugaccugccgugcgggugggauucugucuucuuccucuugcugugagggagccaccgguuguuugcauuugcucugcuccaugcuguagaagugcauccuagucuuaucucggagcuuuggaaguuuuucugaacauagagacuuuucuuccguuccugucuuugucucugacacaccauuuuccauguaagauguuuuccaauauaagacaguucuauagcuagcuccuuuuagaguaaaaagucuuaaaguuuuauuguguuuauggcagauuuaaaaaggguaggaaaugaguccuucuuucucccacuauuuuuggcaucugauacuuuuaaaauuugccauuccauuaaaaaaaauuaaguugcucucugcuaauccaaaaauugggcccagauuaaaacuauuucaaguucaccucuuggcuuaguuuuguuauaaagcucucgggaugaacaggggcuugaaaaucccucgauaaauucuagaagugcugccucuugaaacuguuuuuuguuuauccaaacaagggugacuaagggaacuuugaccuccaccaacucaaaacuguuuucccaaaaccagaaucuuaaaaaagggaaaaacugaaugugucacauuggguccugccuuugaccuuuuucuaccguuagaugcucucccaaccuacaagccuggugcuugaaacacuggcucuuuuacaucgugcuuccccaggagcaccagagcuaggaaaucacaccaugggaucauguguuucaacagcucccugccgcucaggcucauucucuguuuccuggcuugaaugcuaugcuuuuauuuuaacuguauuguuuucuauaguucaagagagauggguuugucauuuggguuggaaucucugaguguucuuagcuuugggcuagaaaugauccuuuuggaccaacuugugaagcuggcaguugaaucuguagaaagugguggaugccucucucugagugaagggaauggggagcuugaaggagucacuaacgagaagaguaacuugcagcaccaggaagacugcccccugagcuagagcagagagagcuugaguggugugagucugacugcauggggcaccccuugguccuuuggaugucugauccuugcugugcuuuuuacugaccugggcuuguacugcuccugagccaauaggggcuuccagacccaaggauccguuuccuugaugacuaagaagccccacccuucccuuuuuacauuccuccuaaccuaagugagcagaguuuccacccugcccuacauccucucuccaggcacuacccucuaagaagguaaaagcaaagguucuugaagaccaugcuuugggccuguacuuuccuucuugccuucucucuuaauccuguacauuauuuguguuuuuucaucccuuugguccgauguccaucugcugauuugcauaaugaacuggacaguguacaagugguucccuacuaaccccagcucugggagccuagcugucuuccuuaucucuggugcuucugacgccugugagacgguccuguuagaaggaguaggaaccagaaggaggagaguccuccgcagcagagcucacuucaacuggaauugagguugcacacugugauuucacaaccaaaagccaaaaggagccggccaccccaggccuuaggcaaccagccuuccucaaauaggcuugccugaaaccagcaugauguuuccaagagcccugcucugccccucguggcauggauccuuucccugguguggacuuaagucucuggggaagaaaaguggguggggcuaccagcaucccaguuuggaaaguagaggaguuugccaccagcagcuuagaaacuggaaaugcuggucucugccagccuccucaggccacccucauuuauccccaaggagaugagaaauccuuccaguaccaggaugaacagaccacuggaagggcuggugugcauggacuucaguucagaagagaacuuagaucuuccagggaacugcaguguuguggcgucugauuuguaugucacauuuguguaaaaugguauguucuuuaaaaugguguugauaacuggaauauuguauguaugcuugaagaugcuuugugcgaaccuaagacucacucagccaaugcuggauugggaaaaauccaaagcacaacuucaaaauaaaauacauuuuuagguuuugccgcuguacgucaccucccuuccccucucccugaaagcagugaaguaacaaagucugagccuugcaacaguaggaacuaggugacuuugagugccaccuccuuuccccucuacagcauuacucccauuuagcccauguguggagccucagagaguuugaaggaagucuccagcauacuauucaccaguccgugguuguaagaacuucccucaacagaacccaccuuuuguuuucaaugcggacggcuuucauuuccagcuuuaugaucagcguuccccacuugaaagccuagccaggccauggugaugcaugccuguaaucccaguauggagacauguggaucuaugcgagauggaggccagccugaucuacagagugagugccaggacaucuggggcuacacagagaagccagcccugucuugggggagggggggaagaaagaaaagaaaagaaaaagaaagaaagaaaggaaggaagaaaggaagaaagaaagacagacagaccuaugaaacugguuggaaacuuaccaacuauaacuaaggguugccagacagcucuguaguuuaaguuugccugcaugcaugucugcauaguaaauguaugcagugacauggaggucagaaguaggcaucagguccucuggaacugaacagacacagcagacaguuuugagccaccauguagggcuggaaacugaacucuggucaucugcaagaacaaucagugcucugaacugcugagccaucucuccagucugccaauggaauggcuauugucuuucacagcuagauccccaagucugccuuuggcuaucccuguauauggaaaaaggucugacugacaggucugucuugcugccgguggagguggagaguacagggagacuuccacucgcuuagagauagaugccuuguguuuuaauagaaaaugaacaugaugguggaguucauaaaaaguaacagcugguuucucuaccacauauccugccaagagauguuccagaagcccaaagcaauggagccagccagucauggacugaaaccuccaaacuuguccccuggaggcuuccagauaaggaaaaacugagucugcaguguguguguguguaaauguacauauacauugucagauucauagagauuacuugccucugccuccugagugcugaaauuaaaagcaugcaccaccaugcccuucacaauuauuuuuuucuaagauguugcugaauucuuaaaacagcaccuuuguccuuguccugucuacuugaugaauuuauggacagaccagcuuagcacucuuuccuauccugcacacagauucugccuuguauggggcuauuugacuccuuacaccaugaguugcuuuccugucccagguaagagcaagugugcacacaugccugugcacacacauauuuaacauuugagaaauucagaaagugugugugaucauguucauccugccccaguucuucccagacucguccccucuuccuaaucuucccuaccuaaccuugcccacccccaucaaggaugguuggugcugccccauguucuuggcuguguggccuuccacuggagcauggucugcuugucagggacugcacucuuagaacugacccucucuuucccagaugcuagcaauaaccucucacuccucugcuaggggugggacguaauguccaacucccucugcgugcugagaucuggucugguuuguguuugugcaggucuugugcaaugcauacauuucuaauaaacagaugccagauuuaaaaaagcagcaaaaugccgugagagauaacaaauuagaaugaauuccacaaaaccuggagucaacauugauuuuuagagcacuuauuauaauaggagacaucccuaaggauaagucaaacaagccugacauguuuauuagcauuaucuguguucaguggugacccagggaauucuacuccagcuggggcauggacaccuuccucuuagauuugucauuucugucucuuauguaucugguauucagcuccuugccuuaccagucugucucaucucccuuuguuaaugaugcucuugcagcauuguugcccugggcugagucaaaauugaggcuguucugccacccugugaugcaugugggcucucacacccaccucccauuccagcagcaguauaugaagggggggaucccugaagccgaugaggugcugggauggagccagcucuugggcuauagacaaagcaccaaagaggcuuagagaauccuacagacaagagucaugcuucuggggucccucuucauauguauucuauuggaacuuagaugggagcagguggcagugaacagucaauacacaaacccauuucaacuggaugggaaccaaaacaggagaccagguuaguauggacugucucauuuaaauguucagagagcccauuguucuaggacauuagguaagaaauaauuucacaguuuacucacagcccuccugcuucagccucuugggugcuggaauuucuaagcaugagccagcacagcuggcaggaaguuuccuuugacucggaugcuaacccugauauuacauauggcaaggaaucauuuagucaagccaccgacuucaucuauucaagcauuguauugagcaggaaagacagacuguagagcuuguuuccacacacagcaaaguaagugaauguaaaaaugaaacaagauacuggguuugacgagaaaccaucauggagcugggugugauaacaugugccaguagucccagauauucauuagcugaggcaagaggaucacagcuugaggccagcuuuagcaauuacuccauuuuuuaaaaagagggaggaggccauuuugugaaaucaagcacagaaaauuuuaauuucugcuuagggaagcucugcuaauuuagaugaccaaaugacacucacaugggaauagcagacaguagaugugugagucuggaguuugggggcaugaaauggauaccugaaauccacuaagauauacucaaauggagauuccugaaauggugugucgaugggaaaggagacucucauaaaggagggaccagcagaaaaagaugucgagaacccagcaccuaggugucagaagagcaugucuuuaggauuuagcagcagagugccugguagguaggggccgggguaagccacagagaugacaccaugcaucuuacgcagggccaucucagagcagggacgugaaagagggacaggcagacagccagagagagguuugugcuaaggggaaccuagggugaugauggaagaagcugcugcagcugggucgcugaaagcaggcugggggagagccugauuucuaauacacaugccacagaguccaggaaaaggaaguauuugacaaaagugaggaucaacuguugaaugugccaaggaauaagaugaagcuggugucaaaaguaagcauuugcugggcaaugcuuuaauagcaggccuuuaaucuaaacuugggaggcaaagacaggaggaucucugcguucagcgccauccccaucuacauugcaaguuccaggacagccaggacuauauagagauaccugucucaaauacuaaaaauggagaggggaaugggacuucuugguacauagacccugucgagagagagagagagagagagagagagagagagagagagagagagagagagagagagagaaugagugaaucuaaccgggugggauaggcagcaaagaagaaaagacccagcauccagacuggacaaagaccaggguuuguucugaagauagacagacuugagagacacauuuuucucuguguacagacucagaagaaagacagaggaauauggggacagaugaguugcauagccccagugaaggcaguggugccagcagaagggacacaugguccugucucucgggagcaacagcagauauuaggguaguuacggaccggccguggcugcugaggaaugaguucacuuucacgugcagggucuuaagcugagugugggaaggaagaaccacguuuccagauuaggaaugaugacguaauugcacagggaccaggcccuuggggccuggguaguacacccacagaccccuacccaccacuugggaagaaccagaguugacuuaugaaggugucggggaacuauagguucuaagguuuuggcacuuagccccugugacuaaguacagucaguauacacagcccuguaaacaaggcccacacauaccacccugcucuguccuuucuuucuuuuguuuguuugagaccuuucuuauuuuuaaaguacuggaaagcaguguguggggguggggagggcgccauagcuacuauuggguauggaauucagccucaugcauaccgagcagaacuacugaguuacaccccagcugccggauuuuuuuuuuuuuuuuugaaacaggcucuagcucugaugcccuguucaguguugcaagauauuugaucacacaaugaaccccaaguauguuauuuacuggggaaaaacaaacuguuucuaguugugguguggcacagcacuuagcacucaccuuuaaucccucuagcuggaauacagacacgcccuuaguaccuuucaccccaaacaaugaagguaacguuaguuuauagaaggaagcacccacauuugaaagugauaucacacacauacacuuauacauucauacacaugcacccauacacagacacacauauacacacauaaacucaaacaacacaugcagagucacacauguauacauuuacacacacacauacacucauagacacauauauacuuuacacacagaaaucucacacacacaaacuugccucugguucuugugcugccuuuggauuaccgcuauuucuaugauuccuuggaccugggaaaaugcggcaaugucuguuaugaacauccucuucccuccaggcuucuaagccacacacacacacacacacacacacacacacacacacacaccccucacacacacacacuucacacacacacacacacaccacacacacacaccacacacacacacacacacacaccacacacacacacuucacacacacacacacacacacaccacacacacacacacacacacaccacacacacacacacacacacaccacacacacacacacacacacacacacacacaccacacacacacacacacacacacacaccucacacacacacacacacacacacacacacagcugggacacaggcaugcaguccuauaucuugaccacaccaaggauguuuccucccagagucuccaggcaaaguaccaucuauuacaguuucaccuugcuggcuaucccuagugucccagguacaaagccccgaacaauucaugcucuuugcaccucuggcccugcuuccuaugcuugcacuaguccuccuuugcugccuaacucagagcacccagcaaggcuggcaagcccuuccugcucccccuacaagguccacaaaaccacuguuugcucaguaugcauugccaugccuucauaucacauccagcaucccgcaucucugggauuagaugcccaugucucccuuuucuguccugagcacagugccugcuucacaggagauacuaggcuuggcucuuguguuaaaaggugugaaaaucccuggguggaaaaggagaauaggcuugccagugaaaggagaguaagagugcagguucauggaagaacaugaguauagccugcagcauggucaaagugacacugcaaauaccucgugggccugagggguacccuuaccauaaaaguaacccagacuuucuagacugauggaguagccacauugaacagguccaccuugcuagaaaagggggucuuacagcaccuguuaaauaaugugcuagagaaaaugcaugcuucuguccucuccaaguccaugaucgacaagugcaaucccccauguucuugccagguggaaaccuguaacacacaggcuggaguguggaacccucaggucugccccuccuggccucacugugaaaagccacuguaagggcucuagcugucacauuaucauuggguggaucugucagcgacaagcuccgggccuguucuugccucuccucccuguggugggguggggcuggcagaggaaaucaccagguguggccaggggaaagucccaccaacauucuagagaaacauggaauuuccuggguuuuaaccccuuguccaacugcccacucagagcugaccagagcagcacagccccccuucccggcuucccaggauaucuggaguacuggcuuauggcugggaaggugggcaaauuacuaaagguguacagaacuugauaccaucaaacauggucugaaaaaaaaaaaccacuucccagauucuccaucccccugccauccauacuaccuaaagcacacagugcauuugaguggcuguggucagaaaacggcaccaggugggagcagguuuugcuguguguaaggucagaguaggggcuaugaucuggguguguacuuguucuugaaagcucuaaaggaagauaaguccuguccagcuucuaggaggggcaagcacagguccuggcucuuucuaggcaguuuucaacuugguuaacuuguuggacuucuuuaguuaacuuuaagcagagcuuugaauuucccuccagagaugccagcauaguacucaguggccugucacagagcccccagccuccguucuuggcuuccuuguggcucaggcgauggcccuauggcuuccacuugacaacucacagaauccucuuucccuuuacugaagggggaguggagguguguguggcagccguugagaugccugucccuuuaagagcgagaggaagggagggaaagaggaggggagaaagagagaaagagagagagagagagaagugaaucaggaaguaugauaguuaagagccugggacuggguaccccacugcucucagagaggcaggaaagagaccuucaggcucaagaccaucaccugcuuugccuguggauccuggggggccccauagcuaccaggaucuucuaggcacugcccaggauugacuucaaggccugaaucccugggggugccacccaguuccacaagucugcauugcccugcaacugagauaggagauggggugaguguguagugucuguggaggagggugguguggggaagccaguggggcagcuucaagucaauacucagcugaaugcccgaguccuguguuuuucuugugguugcugggagccugguaguguucugcacucccucugugggaaaacacucucagaacggacugcuuggaggccagugaggggcagggaccaugauggcccugagaagaaccaugauuggccaaaaaaagcuccccuccugggcucugcuucucaacaugcugaugcaaagcugggguucagcuuugggggccucuacuggccucugcuugggaucuuuccccuggggcccaaauaaccaggagagguuuccagaacagcuggaaagaagcuggacaccgcccccccccccccucugcucgcuucaagaacuguagggaaggugacaacaggaacaaguuaaagggcugggacugguggccuuugauggggcugagaaucaaacagcacagcaacagcacgaaggggccucucauccacccacccuucucuuuccgguguagcucagcuccuggacuugccccagacagaaagcaaaacacacacuugccagggagagucuuugccugauucugagccacuuggagugcagguauguguaucugccacagaggagcccccgaggaggauaggagucugugggcaggcuggcguugacucacagaaggcugcugugcugcaccuucuaugcacagagggucuuggggaugggaggguggaugggaggaugauccagagauaauccagaugugccacaaucagagcuucuagguacagaacccagggccaugcugcccaucugggaugcuguucugugcaccucacugcccgccuuccugacugcagcuaugcuuugccccaguagcagggcuugguugaggaccagccuagguagagucaugaaggugacacaaucugcugcccccagcugaaggugacacaaucugcugcacccagcucccaagacugcagccuuggccuccacuucagugcccugucugagccuugcauugggcugacuccucagccauacagagaagcauggacaacucguucauguugccuucagaaggucucaucagcauccuuaccuuugccuaaagcaaacauguguguguugucugaaacuggggugugacuacugaucucuuuaaauggcuucuggcucaaaagcuuacauucuccaaaguuugcauuuucuuuuguuuuuauuuauuuacauuccaaaugcugcccccacuucccagucccuuuacuccaucccccuuccccuuugccucugagagggugcuccuccacccauccccuuacacccacuucacauaccccaaccucccgcaucuccaugcauuuuuaaaucagacuacaagcugggcuauagcucacuugguuuguaaagggcaugcuuagcuaccaugcaugaagccaaggauucagcccccagcaccaaggugauaggggaaagugguacacacucauaacccaugcauuuaggagguagacacacaaguucaagaccauccucaauaccagugcaggugucuaggcuacucugucuuuaaaaaaaaaaaaaaaaaaacaggcagaaagaauggagcugggcauggugcaugccuuuaaucccagcacucgggaggcagaggcaggcagauuucuaaguucgaggccagccuggucuacaaagugaguuccaggacagccagaacuauacagagaaacccugucucgaaaaacaaaacaaagaucucagaauggaaccacuuuugguuugagcaccagugcgguccuagagcucugucugaugggcgcagcuuuauuucaaagcauuuuagggcuggggguccuucuuaugcuccugccucaggcauccccaaagaccggcucugggccuauuuuucagacaggcagucaguguaacuuuugagacuucacuuucuggaaccguuugcuuuagaggaaccagauuuugaagagaacgggaugagcacaaagauggggagcagaguuguggaggguuucagaucuucccuggagcucuagagcccuuggauuugaugguuuuagaucuuuacacucccccacaucaucuacuccucccuuucuuccccucccauccuuccuccuuggcugucucccucuaguaaagcaaugagcaaggccugguggccugauguuaguucucagcaguaggaagucaggggccacaaaagcagagaaggggugagggcuccaggcucauguugcaauccuggagauuugugguagugugacuggaucugccugaccuuugcugacccagggcccuuccucccacacugugucagcuuccugggacaaccccaggccuggaugcaaaaacucugaguccccagugccugaaagaggagacagagaaaggucuguuccuguaaacuggccuaccucugaaggguucugggagggaccuggggcacaggacaaagagaagucaguccccaaggguagaacagaugcaagcuuggggcccagcagaccccccacccugcugcucuuuugcuucuuuggggggaaguuacuuaaccuuccugagccaccgcuuccccagcucccuugccugugcaguggcugcguggagcccuuuaugggauggucuuggcuggcuaucagugucuacugcagguaagacaugggacucuaggaccccccacaugguuguuuguuuuguuuucucaggaagaagauagccaagcccaggagaugcagaguaccacuaacuaccuguggcauacugaugaccugcuagggcagggggccacugccaguguguacaaggcccgaaacaaggugacagcaacucuggccccagacccuuucaugcccuggagcuaggcucuccauuugggcauuaagauucuauggagcuggacagaguccugggacccuuauuucugucaacucugaugagaaaaagacuccauagauuugggcugaggugugggaugcuggaaaaauuccuuggaauggugccucugucagaggcauguugggacuagagaacaaggcaagagaggaggugacagcaagugccaucuaggaacagcagggcugggaguuugggccuguugggguuugucccuauaguggcuguagagcugugucagaaugcacacacggugcucaggaacuggaggcaggggagacugccggggcaguucuuaucuaugacaaaaugagcaagaacacaagucgacccuugagggacaucaggugugucacuuccaagcugcucgagcucccuggguaggggagggggcugcugaugugagcccacccaaccccugcuucccucuggggcuggguugggggagaggcuaacgagaagaaaagauugcagcuccucaauagggguagguucccggcagaggugguccccauugcuuacucucgcccugugcccacgcuagaaauccggggaggugguugcuguaaaggucuucaacucagccagcuaucggcgaccuccugagguucaggugagggaguuugagguccugcggaggcugaaucaccagaacaucgugaagcuauucgcaguggaggaaacggugggucgucugccuggucagagaugaaugaauguucuuaccuugaccuucgaaguccagggagaggcaagccaugcucaucagcaguccagaggcauugauugggg

SEQ ID NO: 356 - RNA, 1589 nt, Mus musculus
gauugugggaaguagccauggucugaggcuagcgccucaccugucagccgcccaggcugcuacagucucuucuggcccucgcaucccgggcgaucgcugcuguggggacccgggaccaugauacauuucaucuugcucuucagucgacaagggaagcugcagcugcagaaaugguacaccacacuuccugacaaggagaggaagaaaucacccgagacaucauccagacgguccucucucgugggcgcaggaccagcagcuucauugacuggaaggagcugaaacuuguuuauaaaagguacgcuaguuuauauuuuugcugugcaauagaaaaucaagacaaugagcuauugacacuagagauuguucaucguuauguggaguugcuggauaaauacuuuggaaaugucugugagcuggauauuaucuuuaauuuugaaaaggcauauuuuauccuugaugaguuuauaauagguggagaaauucaggaaacauccaagaaaacagcagucaaggccauugaagacucugauauguuacaagagacaauggaagaauacaugaacaagcccgcguuuuaaguguacagucuacuugaagauucugagcgcuccaugcugugaaccuacaaacaagcaacuccuugcauccagucuccgcacggccucuggcaccacgccaaaagacuacuuaaagggauucuguguuagcuagcaaaacuuaaaaguuguuagcauauguccuuaugguugcuacaugucuguauuauacuguguaucaauacucacuggggcucuaaguguuucacauaauugcugcagauugaauagcuccuugcuguguuuuaagcccuugugguauuuuuaagguaauuucaaauauugguugcaauaugaucauuuuuguugccauuugaucuucuaccuguagacugacaacugcuuugugauaaaacacaauuuugaauguaaaguauauuuuauauaaugaaugccuuuccuaaauguuuaaaaguauacacaaauuaaguuuauguuaauagcucagauuucauacacgaugcuuagauauuuuuaacauguucaaugcuacuauaauuucaggucagauacaauguauauggcuuuaaugucuugaauucaacuuuuuuuuaaauugggauaaaacuucauaagagauuuugaugucuuagaaggugcuagaucaaguuuuuuacuuucaauuaaauauaagggacauuucaguaauguugugguuucuacaaacuauauauuuauuaagguuuccagagaucuggcgaugaaauguuacagcaccuccuauuuuuaccauaauccugagaggaagagcuauggaaacacuuauauagcaauaauugugaucucuacuacucuuuuguaucucauguuccaauuacuccuugugauaguuuagauauuuuauuuucauauaucuuauuccuugugagccuuuaaaacauauuuuaauguaagaugaaucuuuaaggcuuccuuagguuguguguauuucauuguacucuucaugggaggcgacucuuucuuucuucucucucucucucucucucucuc

SEQ ID NO: 357 - RNA, 21375 nt, Mus musculus
ccauugaaauaaacuuccauuuuauuuuaccaaauauaauuuaucaguuaagucgacauuugucaauucaguuauaguaacuauaaauaauucucuuaagacacaguucuguaacuuuugaaggauaugaaaguaaaccaauuuuguuucuuccagucaggccaaaaguacaugcaauaggugcaacccggugggaagaaaugaaucuccugaagucacucuccugucacuccaggccccuccacucacaugcgcugagccugggcgccccuaccuuucuguuuucuaggcaaaggaagaaggaugcuucagucuccagacagccugauccaacuccagaugucaggauagagcaaguggcuggggacccuggggucacagucuuaggguaugaugccugugcaagagucuuguguuuugagauggaguuaggccagagggaagagcagaaauaaacucagauccacacugaucugccugacacaaccccaacuagacaaucucuaugaaucuguccaauucgacaguucugauuucaggugaugacagaggaaaugaggccgagaagagucucuaggucuaagcacaguguugguagacacggagcacugcuuaauccuuuucuuggaggcugacccuuuaggcuacacagggggaagaauuuauggauuccagacagacaggccagaaguacagccugcaccccauuuguugaacaguuuggggcauguguagggaagggacuuugguuuucuuugaaucauggacgaggcagauacugaagcagccuauugauauccagcuugcuaauuccaagcccucuucugaguggguagcaagauguggagaggagagaggcugcgggaggaggguauuggaggacaugcugcugcuugagcaacgggguuggcagucacugcagaguuaggggcgaacgagggaacauuuacugucagguugaagaggcacaauggccucuguagccuaggggaugaggugagguuagagcagcgauucccuuagcacugguggguugaugccaggcacugaacuuagcacaguaugcgccccguaacgacugcucagugaagaauuauugcaggccggugcuguggaagggcucaucucggggaggcugagauuugcugaaugagugaaugguugaugcaugucugugggcagaagccgagagaaaggccaacggagcccucgugugauagaaugaguguguuuaggaagugacagaggccaagacugaccacgugauuaugucaugagagacggcagugagacaccccccaccccuccccguugccucaaucuccaggucauuuggcacauucccuuguccuauccccaaucuuagaagcccaucuggcaagcugcgcggagacggaguguguggagagaauuaaagagaggaggcuugaacucgguucucuagacucagggggcacauggaccuuuggaaaccuguggaugacauggauccgugaagagcccgggucacuaccacucauuucagcugggaagcaaucaggcaguugggcaaggcacaugugcgcagauggaaucuccagugcacgugacucugcgggcaggcuggccuggagcaggccugugauuacgaggaguugaagcaacguuccccugcccagugcugugaaguugguccacaucuauaaaagugcgugcaugugugggaguguuaauuaucccuccucccucuguucagccaaacccuaaacaacccagagcccacuugagaguuucucauuagggccgaggcugaggucgcuaaagcuaaugcaaagguccccgaugcuggacaggaugccaaggucccgaucuaaccuccucuggaggcacccaccguggaauugcacuuggugauugucucaaaagucuacuuuuacugcuuaugucagcccaucugucugucccgaauucuuccuauccaaacuuggcucaauguauaaaaaauucccauugaaaauaaugagaauuugguaucaaagugaaaucccagaaaggcaugggaguguaguguagggugggguagggaaacaaaaggaaaauaaaaauccaaauagaaagugcagaggggugggggaaagacugaauggcuaagcuaguccccaacaucugugucucuguccccaaugagccagagcacauggaagcugagugccaggaguccggugccaagcaggucccccaaagcagucaaguaugggauggagaaguugucgggguccaggccccggccccacauccagugcaccauccagucugcgauguacaggagaaucagcaccuggggagacagggguucugcuuguagccacccgcuuucugcagggggagccagaggccacaaaauuggauguguucaguggaucacaaggcuuggccggucacaaccuuuuugccaggacagcucacagcaagccaggggcuuucuaaacuaaauccugcccuuacaggaaggcugcccuugucucaauucugggucagaucauucuucaguuacugcaauuccugccauguuggccucuccaggagccugguaggggcuggcagguagagccaguuucucuuacaaggcccuggguaacagcugauuacacaagcugcuuucucuucacccuucccacccugcuguuuauucuaauauucaucuguaaaguagguuuaugagccagucagcgaaauacgucaguuauaaugcauaacaguucaaaaauacaucuuggauuaucuacaucgauuuauuugcucccuugcuuauguucuauaacuauagaugagaauagauaauagauauagagaauaaaugagauuggaauauagguacuggguccaggaccagugguaccuaucgcuugcaguggacagugggucacaaacauacaaccucaggccuaacgcugggccuugugaaugggaaucggcauguuaguaagaauuacaugugcucugcacugggagcagcacuucaucuaggacguuaacaccugauuuuaggggucccuacaugaucacgucuauaugagaaugagaugcauucuaaccauuagacugacauacgguuaucuggugggguuuauuuuauuuauuuauuuuuucgagacaggguuucucugugugucccuggcuguccuggaacucacucuguagaccaggcuggccucgaacucagaaauccgccugccucugccucucgagugcugggauuaaaggcugguggaguuuauucuugacuguacuuuguaaagacugagguaugaaaauucugccuuaagggacucagggguaggagccaguaauguucccuguuuuuaggcaaauuugguuguuuuggccucucuguaaggaagucaggggugacuauucuggaaccuuucacacccucugcucugcacacagcuaccuuguacucccauggcccuggcccugggugccauccagucucccuagaacuucacagccuuucugauagcugcagaagaugcagccagaggcuuuuaguauaugugcuaggguggaaacgucaacagcugucuucacauuuuagccucccgaguagcacaaggacacauacagggacagguggcaaagggaccuggcagaacuuuacagggagcaauugcuaccacguugccucuccacagacucagagaaggaagcacagcuaaaauugaccacagggucaugaccccuaggauggggcaauggaauggggguguggcuuucaacccaggggaaggggucaacugaggcggccacaaaagaccuuuggcuugcucacgcuccuuucccaucaggggugcaccugacuacaucggcaagggagcguggugaacuggguaaugacugcugggaacagcauaugguugguucucagccuggcucucgccaagauuccuaacagacaacuuuucuaagcacucgguucgggguuuggaaggaaaauugcuuaugacuaaauuaauaauaccaugggaaugccauagcauaccgaaaggaaaggcuuggaugagucuugaagauggauuugucuugcacaaugguuuugaugcuuuuucuagcuguggaaaagcccuuauuuuaaaggaagcccagcagaggacaggguaugggugguucaagcccaccuccuaggcacccugcggcuggucuacuacucucacuuucaaagugugccacugaagcugagaagggacacgaccaagcugaagucacagaauggcaguaauucuuccaggccagugucuauccuccugagucccggccagagaaaagguggcaagggaccagguccaaaccugggguucuuauuccauguggcccccgggcugugcccugcuucugccauaccuggagcagugcagcagucauguagaagaugaugaagaugagggugaggguggugugcccgcccugcauacagcugaugguguagaggaacacuagguguccugggaccacaaggaggaagaggacacgggccgagcgugaauucacaucuacaagaggagagaggaagaugggaagagaagcauuggccccaggaggucccaggauggucaacgccguauucuaggucagcacacagcuaucucucuaggguguuucaggaaaagacaaugaugucuuaccugggcgcuccacucuucagaaaugcaggcacagcccagcagaggagacccuugaacuugggccccagcugguucucuagugagguuccuggcugcccccccccaaccccuaaggcaggaauggaucugggagggugagaugcuaugguuaccagggcugaagaagguggugcauggacuggggcagcggcgaggaguuggcucagaguucuccccuggcaugccguucauguggaggaagguggagaugcggcuggccugcacagccaccagauugcccccgacaccugcagagagacacacaggacucagacuuggaggaggaaggaccgggaggaaaacaccuuguucuuugucccguaucuguagaggcccugucuucuaccuuuccucggggcugagccgacaucacucuucccucuggugccaacagaauacgauggaagaagacaaauauuccacagcuucugagggaugcucuaucuaggcucuuggaguguuggcagggauguggccugucugcugcacccgugugugcagcauggaccccccacucacuacacagcaggcuccaaagcucuccuugccuucccuuucucuggagcugaccccggcaggcacucagcacucaaacacucacccgauaaccagcuuccaguauccagugugagcucuaaacuggcacugcccugguaaaccgcugguuaccauuucccuuuaccaucacccccuaaccuagccucuguaccucucagcuuuacccugagcccugagaggugaacugcuuaggccccacaccagucucuccugcuggaugcuucuacuuagacuugugcaguggaaggcccccgcagguaaacaaggagagggguuuaguguuuucuauuuuccuucuggauccuuuuaugcuuuuuuggcaggagcuuacucuuguagggagcggggugaaauucuaacugggcucccacaagacaauuucuggguucccuggcccuucagggcuagaagcuuucauguugcugauuucuggguuucucacgguccccuguugguccugucacgccaucucuaucuuuauuaggucuuguucucucugagcuagauucucuggccugcuggagcccugagugacacagaagccuuuucguucccccagcagcugaugcuaaggucucaccauuaaucacaggugugaagacagccauuccugcaaaguugggguccgagacggucuuguccaggaugagaccucccacacuauacagacaugaagacaaaugacauaaaaaccauggaagguucugcuccagucucugggacaaagagacauaggccuagcuaaccuuggggacaaggacagcaaaguggcuuccaggagucucuccuuucagucuuuaguucucgugcaugcaacaguugucgcucauaaucuccugacuuggcacagugacuccaguuaagaagggaaggcacagccaccuucccgugaggagugaggcucgcuguggccugccugcucagcacugauuuccucaaggguaacugcacuggcuccucccugagggagcuggcuuucucgaacccagccacugugcuucaacuguggcuaagcccaggcaguccaaccagacaguugcauuuccaagagcaagugacugauacaaggacagaacugugaccgauugaagaggaagcagugacacucuauacugggucucugugcccuguugggggaaagccucucuguccccuugcuggaauggggaggagucagaagagugaaaaccuggacugcugacccccuacugagaaggcagagugacagagagucacucugggcccugacgacacugcgugugucccagaaugcggcugcuuuuuaguucccaaggucaguauguucugcuuuggaaugaaaccuaguagagaucauuccugucacuugcaguaggacacauggcugacacuacuaaugcauuuccaguaugugcuccguuucugccccucuagggguucagauggggucuauggugagguugguacaggggaugagaacccagggccccagcauaccugcugauagccauagcaaugaugacaggcucccagccugaauacaacaccucccuuguggccgggcuucuucgggccagcaccacccagacaggcagcagggccacaaagaaggcacacaccaggggauagauguaucgccagugcucugugggggcagagaucagagggaaauaagcaccuuuaguucccagcuuuccccagcuuaagcugcagaugucccaagagaccagcucauccacagucagucauucuacccuaagugccuggaugcacagcaccucaccucaucaaugaggccagcuuugcccauuuugcagaggaagaaaugaaguauuagagcuacccaggcacuguauggcuucucagacagugccauacuauggagcccaaguuggccucauacggucuuccugcuuuuuccucuugaguagcugggaucauaggugugcgugcgcaccaccaugcccaguugaggcaagaaaguuaacaggcagagagcagacuguaugucuccuggucugaucccagcaaucucugccucccauccauccuccucuccaguuugcuagcagauucuagucuuccauucuuuccuuucccuuccccacaucucaccucuccaggagaaacaaaaccccuagggucaggcagggaugagugcugauacgguccuuccucuggugccugccuacaggaucugacaucagugucuaucuagccuugcuacccugcgcccagaaguugugacaaacuguucguacaguuaacaguacaggaaaaaucuucacacgcuugcaaaauggucccuaucucucccagucccacccaagccauucucaguggccuuagccuuacucaguuccagguagaguccccagcugaugccugagaggagugccaaggugaugaggucgcccaggcuagcggcgaugggcguggcuacguugucuggguugaucccaaucuuucgagacccaaugaugacuccgaucaugaucauaccuggugaggaaggagaggcaggccggguagggugagaaggggaaaaagauauuaauaaacaaaagggaacgucgacgugcaagacagagugagcagcacccccacacccugagccuucccuuccuuacccaggaccaaggaggcaaugaaggcuguagccacacugcuggcgcauagcaggaaggcgugugggaugcuaaaguggccaucagggauccagccaaagacgacggcugcgauggaugccaggaagccuaccaccguggcuuguaccuggggagaggcaugguaauguggagucuggagcagagcuccuuagcugaggucacuaaacacccaauggguaauuccugguccuuagcaagcacgcaggacugggcccuacaguucuugcaggcuagaaggaugacuuuauuuaguuuuugugcuaccuuagaauaggguaauguacccuacaaaaauccagacauguuacuggcugguuggaugcuucucuggagauggggugagaaucaacagcccagagaucagucagagucaaggcccaggauucaagggggaagaaauuugaucuguguggccuccugggaagaugggacagcaguggcagaggacacucuaacauucacacaucugauucuacugcaaagauuagugaaggcucaaaaucccccaaaccaccuagugccuggacaugugauauggaagcugcuggggcacucccugucuuggccauuuuccugaguaacuagucaccuccuagccuacuuugcagaugccggagaaucacauaggauccagcugggcugaccuaagccuuucagggauuccugacuaaggagaugcuuagccuauugucucuggucuauguuuucuuaccuggauaagggccauauuccccgugaucauccgccagagcuccuuagguguguccauuuguccaauguuggccugaaagagggagggugaggggcuggagcaggcugcacaggguuuggggcucuaucuguuugacuggaucaaaaaagcaaugcauauagauagccuaaggcucuagggccagagcaagagagcacccagggcagguguacucugggcugugagggggcuuguggcagaucccacucuguccuguuuauccaggcagcacguuccugcaugggucuguauaacuguccuggcccagaagcagccuguucucuuagggaaggcaaggucaguugcuggcccaagggcugaggcugccaguauuuggaaaggaaagaguggguugcaccagccaggagaaaggaagaacaaguugggguggguuaggcuagcugcccucaacaccaucuucuccagacuuggccacggagagacaugccugguccugaguuuuaacaccucuugccucucagccauggcuuucuauugggcucaguccacgaaaugucuaucuguggcugaucuaaaggauuuugggagguggaaaggccaauucucuugaagaauaagcugccacagggaaagggggugguuugaagggguguggggaaggccuggcucugcuccugcccagcugcagaguagggcuggagaucagaggaggcccccaccuguguggcuggagggaccagcaugaugccugccugucaaagcugcacaaacagucacgaggcagguugcaaagcaggagguggggcaggcauccagggauggcugggacauccaaagccugagccugggaaccauucugggcagggagccccugcccagggacaggacacccagucugggaucucccuccacggcuucccuuuccucccccagcccaggcaguuguguggagacuuaccagucuccauguugccugcuaccuucucccugacccucuccccuacuucccacagcuaggacacucacugcaguggacagccucgacgccagggucauuuccaaguucccuuugagccccagcagugcaggcaccaggaugaagaccucugucaccuucuggaagaccucccagugcuauaagaugaacacagaguccaagaauuucaguaccucaaaggacuggcauuggagcugaacagaguggggucaggggacagcagagggaaacagggccagcuggagcaagcacgagaggcaccuuaccuccccgcaagaagccuaaaaguagaauaagucuaugaauuccaaaaagcacagccuagccaccaucucagaacaggagggaucccuagccugacuucuaauaugcuuucauggggaccuugcagaggagccaccccacgcuggcuuauguucuagaacccuuagugauauacucucucagagagcacucugcagcccccucgccugccuuuauccaguugcucuguggccucggccuugggagguguugucucagcuguggagagcucagcuccacagggcuggggccggggugacuagagcguuuguuugguuucuauuuccaagggcuuugggucucagccacagugacuuuccccuagcagguucugaauuuagacauugcuucuccuaugcugaucugcaauagauuucugauuccuuucuaugcacccaaucucuuagcuaacagaagcaaauacaccccuguugggagaggcugggccuggagucaggagauauggguucuaguccugggucaaucaguccuggcucucccaccaacuuccuuggccaaccuauguuaaugcauuuuuuuuucacuuagucaccucaacaagccaauaaagagguuuuuuuuuuuuuuuuuuuuuguucccauuuugcgcaugagaaaacugaggcucaggaaguacugucuuaguuacuguuggaaccuagguuggccacucaaaguccccuuaguuguaaccaaaacugaggauuucccuaaagaagcugggauuauccccaccacccucccgcccuaaagggcauggaguucuaagaauggaaagccugcacguuugugaggggaggaggggcaggcagcagguggagguauacagguucuuuugggugucuggagacaaggagcuguaacguaagugugcugagcugagagccuuaugagccucuaagagauacagcgagggcucucacgcugcuuccucagcaagcuuucucacgauggauggcaggcuggggccuucagacaugcuacaaggcaccaagcuccugcuuaagcggucaggggcuagacuagagagcuagcucauaaggcaauuccagccccucgacccuacugcuaaagaacaaggcugccaauccaaaccacagugagaggucaccucaugccuguuaagacaguuaagaggacaaacagaaaauaccaaguauuagcacagacauggagaugggaacaugucugcacuauuggugggacuauaaaauggggcuacuuugaagaacaauaagacaguuccucacacuaaaaaucaacugcauguguaugcccagcacuugggagguauagguauuucugaaagcucagggccagcuaucuacguggcaagacugucuuaaaaaugaauaagccaggugguagugguggcgcacaccuuaauuaagcccagcacuugggagacagagguagguggaucucugaguuugaggccagucugguuuacagagaguucuaggacagccagggcuacacaaagaaacccugucuugaaaccaaaaccaaaaccaaaaaaaaaccccaaacuaaucaaccaaauaaauaaauacccaaauaugcuggggagauggcucggucuguaaaaugcuugcuacacaagucucuguacuagagucuggauucccuaaccugcgcgugaaaagccaggcucagcagugucccuaaccccagcacuaaggcuugcugggccuugaagauuaaugagucaccagcuuagccaaucagggagcugcagguucagugagagacucuaucucaaaaagcuaagguaagaggugggucuggggagauggcacagugguuuagagcacucauuccucuagcagaggacugggguucuauucccaacacccacauaguggcucacaacugucuaaauucccaagagauuugacacccuuuuuuggccuccccagaagcauuaggcaugcacaugaugcacagaugugcaugugcagggaaaacaugcauacacaaaaaagagugcuuguguguguacacacacauaugguggagagcaacagaaaaaaaauguccuauguugaccucuggucuccauguaugugcacauacccauacaacauguauacaauucauguaacacacacacacacacacacacacacacacacacacacacacacaaaugaacaauuaaacaaguacaauggccauauggucuagcaauccuauuucuucuccugacuacuuagcccugaguccuaaguauuuauccaaaauaacugagugaaagcaggaucuugaagaaauaucuguccacuccuguucauagcuucauguauucaugacagccaagagguagaauugauccaacuguccaccaauagcugaguggaccaguacaauaugguauacaaauauugaaguaugacugucuugaaaaggaaauccugucccaugccacaacuuaaggacauucuuaaggacauucuaccacaacagucagccaugacaaggcaaauauugcaugauuccacuuacauaaggucugcaguagucaucauauucauagaagugugcacaugugcgcacacacacacacacacacacacacagagagagagagagagagagagagagagagagagagagagagagagagagagagagaaugaauugugguugcuaagggcaaagggccuggagagaacaggaucagcauuccguggaugcagaguggagcugagaauguaguuuacauacuucaagaugguuacgguauaguuuuguguuaugugauuuucugcaacauuaaaaguaaacauacaaacaacccagauggugugucuguaauucuagcauucagagacugaggcaggaggauugggagucugaagauagcuagagguacaaagagaaacuuuaucacaaauaaacaaacaaacaacaagaugcacaagguugggccagggagcagagaugaagacacuggugguccuauaaggcgaagaacuugccuucuuguuaguguucuuagagugugugaagugaacaggauccagagaacagcucauuuguugcagggcugcagcauagccuugucugagcuccuaggccuaggauuuuguagugacuccuaaaggaccuggacucucugaagacucccaggaaagaagaggcacucccgaccccauggcaguucugaccuuucagccacugcuuuucaaacaccggggaaggugaagaucuuccccgcucuuaggcagccccugugaggugccucaugagccccgggaccguuacuguuggacaaggcugggagagacagccuuggggauccagcucccuuuagcugaggccuaagcagccuuguuccgucugcucacaaugggcaagcagcuucagagagggaaggauucuuucccucccuuaaugagugugggcccggggagcucucuuagaacacagucccucaucccacccucaucucaaaugccugccuuccuguaucucagcugcuagcucucugaaggugauggguguaugccgauaaagaggaaagaguagagggaagcucucaaaguguauggacuguuuguaaggaguauagcauauaguaucaucaaggaaaaaaauauauagcgggguuggugggacaagccuguaagucuaucuucaggaugcugagacaugugagugagucuagccugggcuacacagcaauaaaauccuggagaaaagaacguauaaaguucaguuaacuccccuagcugccacccuaagcaccccuaauuuucuccuuucaauacauacgcacccucugcuuugaacuacaggggaaccuagaaguugugggauuuugggcaggaugagauaggguguaucggcaaaggaaaggaucagggccaguagcagcccccugcagaagaagucuucccgacucacagaauacagccuggaaaucacacuaucuggacuuuuggcccagcaaagcccuaagcuggcaccugggacuaaagagccaaucuccauauccaauuuuucuacucacaaaacucucucagagaugcagcucagacagguagucugugacuguacgcuugcacaggacucugggaagcagagccauccagaaagcagugugguccugagguuagggggugaggauggaucgguauagauuagagugguuucucuuacuccuuuggccuaauuccggcccauccaguucacccuggcugggagugucugcccaugaagucaaaccagucagcuaagccauuaggcaagcuaccacccacaccuuccugaaccaaugggcauggaacaggguccaggaaacucugcuuggcuugcggggguggggguuaggaccaccuauggaucuuuacugcuucucagaaucuuagccucucucccuuuguucucucgccucaguuccuguaagguauaugaucagauaacugcucccacauuuaaaacuaacccugacccagagcaaucacuccaagccccagagcuccgagaucucgcugugacuccuuccuuggccaucuaaccugcucuucugccuguaaccucaucuggcccagccuccuguuccggaagcagauuaguaagaagucaagccagggugaggagaagauggaaucaagacauuaaaaugacaacccacacccacacccauucuaaggcaccacgaugcucaagaacuuuucagguaaucuugggucaggcuagaucacaguuucuaucugauagaggcuuaucccacagggccuccuggagguguucgagcagaggggccucagggcaaugccugcauguccagagcuguaugaagcaggagaaaaggaaauggcucugauagcacacgcaaggcagaggugggcagugcggaagguagucaaggaagacaggaacugaguggccugcucaggggcuccagcagccuccaggaaaacagcucccaucucugcuucucucccauacccuuccccaaggcucugcugggggagcguggggagggggggugucuuaaucucucuggauacucagcaaguaagagugcauuaaaacaaggaguguagagcuucccuacuuuaaucuaguugagagguccuaugaagaccacauaccaccaccuucuaacccucccauuucucacaaaggcugauagaaaaugguuguaaugcccuccugcaggagcccaggaaagaaugggggguaggggggcaauaaagcaugggcagcuugaggcuccuaugcagucucuuucuaaagccaacacugggcucgcuccuacuucccucaaaacuauuggcugcagugggcaagucagaacagacugcagucugcuucucuucuaaccuggaggaucccucugcuccucauuucacuguggaggcgacuacacgcaggaagugaagcaaggggucugacuggacagaagcaggucucuaggaaaagcccaguauuagcugcagugggaaccuuggcucaagguggcaucucuguacugagugcagacuccugaugcucuggaaccacgggggccuugagcaaccagcaaccagcccuaucugggcacuuugggauugucucacugcagguaaucuuauccugaaaggagaacacaggugugacuccuguaucucagagcaucaaccauccccaucacuccccaggauguagaguaagaaccuucuuggggcucccugccccugucccccacccccacccccccauacucgcccacuccaguucuacugcuguagccaucuaugggcccugcuuuagcccagcuguggugggaccaugggggaagggggcacaaggacaagccagucauugucaucuacaccaacggaacccuagcucugguaugagccaagaugccacacugagggagaugccaacccucugugggcacacuaggcagcuccggguccccuacaaccuaggacauaaagcaaggcaucagaggucuguuccuacucuuggaccuugccaugucagagguggagagugagggguaggggagcuggacccuacucucccuuuggcuuuuguucacuuuaaaagccaaugccaaucguucugguucccaguuugcccuguucuucaagacaagacaaaagcagcaggcuccucagucuuaagccagucugcaaaucccggccauaaugaaggucacagggguuacugacacaagcucugggggagauaaccacugguauuucuaugccacaguuucucauccacaaaauggagaugccuuuuuccuacuuuuuaggcuuacaggaaagacccccauuaaccuaugcuagcaucaucauuaucagaaacuaagcuaaaugucuccuggcucaccacaggaugcucguucuguaggccccuuguuuucauucuguggugcugggaauggaaacuggggauuugugcgugcuaggcaagcaccguaccacugagcuacacccacagcccugaagcucuuugcaggcauucaucgagaacccccaaaugguaagaaugagaaccaaggccucagaaaggagaggugagggagacuacaaagccagucucaugucuucuccccuucuuccuucccccugcucugagcaaucagcggggugggguggggugggguggacggagagccccaagcucuggauuggcuuccuaaguccggguaggaacaguccucacaauaacagguuugaagagagggaaggcagcaccagacacuuucaccagcuauaaauauucucauuaagcuuccuaaguugcaagguucaagccucauggucuacauggauguuacauacagcaccuacagcccacuaccuucagucaccugagaaggaccuggagacccccauggcagucucugugagcccggcuugaguguuagcugggcacaaagggaggcgaggcugaaccuccuauccuuucgggagaugucacagugagggagcccuggggcaggguggggggagugguccccaaggaccaaucuccuucugccccuguccuuuggaguaccuaggauaaagccagcauuuagcaagcacuagacauauucugauuagcacugguagaaagcugugugugugugugucacugagcuucaaaagcuuuaacuucaaaacaagacuuuuucucuuuccaaccuggaggcucuugguaaguccugacucacaaugcacuaaauacagcuugccccugcucuggcucuuaguucccagguguccuaccaacucguacuguuuugucuauccaguauccucacaaaguuuccuguuugcccagagcauguuugugacagacgaggagcagagagggacgcuccugcuaaggucugguuacauucuguucccauccacgacacuuagagcuucuucagaucuuauaccaccuucccaaaccauccucgcucaccaaggagaccgugccaaggaugcacaaagaucagcaauacaaaaugccuuaagagcuuucucacugggucugagacccuuccugacagcugaguaaauuccugcccagcgggggaauggaggagaggcuugaaaaggaguguucuaucauugguauccuugaaaccucuggagaaaggaaagcaggcguaaagaggagaccuaucuagaugucuccuacugagcuggaaucaacagcacugaggaggcauagcaagcaacaggccugcuccucucuucccaccccgaggcugagcucuggaguuacaucuguuacuguuaggcaauacugcucugaccaccucccuggggcuacuuggccucucugaagguucugcaguaaguaacagagacaucgaugaaaccaaggauguaauccaaagggaaagaguauucuaggaagcagcagcugcuucugacacagaaguggagaggaacuucuaagagucaguuuccccaaaggccaagguauugagcaagggcuugugagcagaggacacccuccucaggucuuaccugcacaauguccagcaccaugccagcugccacagucccaaagccugccaguaggaaggggaacagcacuugcaguccaauggaaaaggaggucuccuugagcggagaggguggcgcggggccccggucugugcugacaucgucacucucguuacucuggcucccguucuccaguagggcguccuccucccgaauucccuuggcguuagcucgggacucaaucacuaccaccuccaccccaucaggccccaggaacucugaggucccagccaagggcucucgcccagggccauccgaagaacagggagaaggaguagggccaguaccauucggcugguggauguccuuuggcucuggcuuagaggacaugacaggcagggaggagaggaggggagaauuuauuuauuuuucuuucucucuucgacucugacuugggaaagaacuuagucuuggggugaacccaggcuugauugccgcaagaccucuucccacggcucuccacuccuaccgggcacuguaaaaacugaucuaccaaaagacagccccaucaagcaaugcagccuggagcuggaaggaaacaaaguccucaccagaugcagcagcugccucuauggguagugggugccugcucccagcagcucuguguugugccaggggcaaucuuugguucucaguggccagcuccucagagcaggagcagaagagcucaaccugagucuggagugccugaugcugcagcccucucuugggaaaagcugaaugaguucagaucguugagaacgaagccucaaucugaggccaggguuucuucucacuccugcuggguggcuucagcuucucacagcaccguggcugggcucagcuggucccagugucugcuaucuuuccucucucucccagagaugucuucccuucuugagaggaucuuguacuuucucaguugccugguccuuaaagucacaagaauugguguggaacaccuuacguugggaggaaggacaaaaagaagaggggggggggggagaaugaauguugguacauagcaaaaaccaguuccuacuaggaugaucugcagagcaugugguguuacagggguggcuauuagcuguucuuuuccugcuagaauuacacuguccugccccacuucaugucgagaugcagugaguucuauucccagcagauucccagccagcaaaccaccacccaaaaggaggaugcuucauaggagaccuuggcauugccuccugagcaaccuggggugggcagggaugugauuaguuguuuucucggaucuugauaagaacucaguauuacuuaaguauagucccuuaucaguaaaguuacagauucagaugcaaacucccuacgcauucacucuucuugagugacuuauuacaagacagcaacagcaagacagggcaaacagagaggcuggucauugaggggagcaucccuagaccucuaauuguccuagcccccugcugggaugggagaggaagccaggagaacuccccaggcaaccggggcagggcaagccggccaagaccaaggccaagaaccagaggccuccuucuuacucuugcccuugaaagucgaguguuacagaaaccacaggcuaaacccugguccaggcugcauuuacacuucucucuaugcuagauccugugagccugucagauaggacccggcaguuaacuagauugaagagacagagggugaagcuacuguuuauuccuacauuuuugguugccuggccuucccccuuuccucucggguuacugacagccagacaugguguaacucuuaaaaacaaaaauaucaucgguaaaagguguagaaagaggaaagaaaaacaaagucaggcaaauccaagugucacaagcuaauaugcauuuacucccaaaucaugucugucuuugccugcccugcuuuucuuagcuuaaaggaauccccacgaauugccaccaacuuguugcauuucaccagcauggcucucaauaguaaaaaaaaaaaaaaaaaaaaauccagaggguuuugcagguaugaugaacaggcuguuaguauuccaaacacucacaauuagucaacuccaguuugguuaaggcagaaucaaacucuagggcccaaguuaugagucuuccacuaacucggucaccagccaagccaccuuaacacagcaccguuguuuucaaagauccucacuagucagccaagaggaaacacucagucugaguccaccgcccccgagccagcaaaguuucugaguuccuucgcuaaaaccugacugcccccucccucccgucuuucuggcaggccacuuugaccuggaagggggcuagcaaggggagcaggccagucucucaacuacaucagcaguaaagccacuaccgaugggccucaggcucuaggaagccgcgucuccuuuccaagcggggauggacaaaaaagcccgguuuagguauccccaacuacagggguggggaggaggagugccuaguugauuuccgccgacucccggcaacucaagacugcaaaagcacugcguccuggagucccccgcccucgucucccucccucccagacccaacaacacugaccugcgccuugcuggggagaaagggcgccuggagagugguagcaggggcccgcggaauugggggauguaggguacccccucuucucaucacuccucccccucagccguccuccucgagcccccgcguguuccccgcuacacccccaggcaaggcgagcguccaaccgcgacacccggcucgcuacauuucgcuucugccuuccugugaggccgccgcuccgauuccacgaggggagguggccugguggggggcgaucaggauauuccgccucgggcugguguggaccggacugggccugagaugccgagcucgcucguccccaaucgccucuugcccgcggacuuggacaagaguguuuggcuguggguggcaaacgugaucuggggcagagcgggugguaaccccccuccaucaagaauagagucaggauggacaacugcaucagccaaucagagcaggaaaaggggcgggccccgcccaggccccgcccauuuccccggcguuucuugagcugggggcggggugagggggaaaacgcagcagagugacgggaacucagaauuggaggguguugugggcucgcggugcucaagcgcgggcgggugcugcgcuccugaguucccacggccucucaaggcgagcguucugcuacgcauguacuccugaaucuugacuaucucuagugagccucugggccuuccagaagacccgaaaccaccccuuugagccggccagcuggcgaucgcccgggccgcagcagccaucgcguguuccuucuccacgcccagucccuaccuucuuccugggcacaguuccuauucaucaggcuccucaucucuccuuccagguuccuuguuccucugggcgacugaccgaaccuuaaucugccuuaauaaaguucc

SEQ ID NO: 358 - RNA, 1747 nt, Mus musculus
ccccuagcccagccccccagucucuugucacuagacacacugggaagggaguaggggucaggcuaggucggaggaggggcggcguggccagacgacugguguucucuggugucuggaguccagccccgggcucucagcccccgcgaagagaggcgagccggagcugugcagugaaugcaaagagcugggcgagcucccagcccggcgccgccgacggcguccucaaccacggcccaaugagaagacagcagauaauuuauucucuaaucccgguucgggugccgagcgcgggcgaguggcgugggcugggggguggggugguccccucguccucucucucguucccgcggccaccccucccccgcccgcgggcucgggccgcgcacacacacauuuccugacaauuagcgagcacaccuuggccgcgcggccuccggcagcgcugccgcuuuugucucccgcccgccgggcgcaaaguugccgccgcgccgcgccgcuccggcugccggccgcccgccgccgucggggggcguggagggcgggugggccgggcgccgggccggggcuggggggcugcaaaagagaagcggaagaaaaguaaggcagcgcuggccccuuccuuuguuacagccugagugugagcgggcgugagcgcgcgcgggagugccgaugcgcgccgggcggugcgugugagugugcgugugugcgcgcgcguguguaagggcgcgugugugcaugcgggucgggacccgaaggcgcgagguggcagcgcggggcagagagcgggaccggcuucgcggucuuucucgcccgcgcagaacucgggcagguagccggccgccuccggcuccuccccagacgcagcuagcggcugcucuuagauggaaacccgacccgggccgggaucaggcgggcugcgggacgagggcuggagggaggcggcccgcgggggucugccccaccgcagggggcgccggaggugcggggaguucccggaggagccggcgauggccccugcgagccccggagggcgcgaggcuuuggaggugguuugugcggccagggagcaagcgggagaggggcgggggcgaggcgaagucugucuaaaugccaguucccugaaguucagcgcgucgguugucauuucaucccuuaaugcauauuuaugccaugccgaaauaggcuucauaauuaacuccuggagucauccgcagagguuaaagggaccccgaagauuugugcauugauuggguacccaggcagugugugugugcauguguguguguguguguguguguguguacgcgcgcgcgccccgugcgaacccauugagaagaauaauuauuuuucuccgcuggaagcuacagccgagaaucagaccgggagggaagagagagguuggagagggagagggaaagagggagacaaaggaagugagugcaagagaggagccggcucagcauccgaacugugaguacagagcggaaacaggcagaaagugcugggagucggcgaccccucugcgggccggguuggggggccgggaaccgccaaggacuggcgucucugcuuugggcugggcagggcuccuccagcuccggcaagcucaccugaaagccagaucugccccgcugcugccugcgccaaccacuguccuggcuaggcaaaaacgaagccccccauccaggcuccacugccuuuguuccuucuaaaggguuucacagccagugcgcuucaggagggaaug

SEQ ID NO: 359 - RNA, 2737 nt, Mus musculus
ggaaggugaauucauauuuuaauuaccgaggcuuggguguggagggcacaggggagggguagaggguucugccauuguuugcccagggccgaggacaccccuccuaacugacucacuucggcugguuaccuggggugggucuuguuggaaguacuucagcuccugcccuuggagguguguguguguguguguggggggggggggucagggugggagaaacaauuguuaaagauuccuggcuugucccaacaucugaauaucauaauccccuaucccucacuucggugggggacauuaccaaaauucuacagacauuggggaauuuuacaucugccagccugcagccccugccucuucuucacuggagaagugcuuucuuguccuugaguuccuccacucagccucuccggacuccucacuuuuccuggaguuggaaggaaagaauaguuaagagauauguggggugaaggccaagagcaggccggggugaguagugaggcuggggaccuauagguagcucgggagggugaugcucugggacuuggcagagggacauccuggccgauagaccccagaccauccugaagugagccagcggggggagggguacuaggagcauuggcuagcaucagccccccuccuucacuuugcagcuuuccagagcucuuugucuguucccuacccacucuuggacaguggcuugggugagaagaguugggggugagugggcucccacuggagcacagaugagaaggacuuuucuaggcucuaucugacccaguggaggggucaugagaucuuacuucuccaggaggcccuccagccugugauggaaguaaagauuacugccaaauguggagaaugugauaggguagggcagacauuugguagcagggcccucaggucccugcugugggggccucuggagagaagaaaugaggccacaguacuuauguacacugacauggaguuauuugcccuugcuuuuuccccacuucggggacugagucuagugaccuuugugcccagacaucuagggcugggaguuguaccccccaauaugagaccccuagcagggugacaaggagaagccacaggacuuaagagccaagaaagagcaauucuugcugccuuugggagcaaagggcucaggaaucccacuaagcagccacacagcaacccagcuccggagagauuucuucuaaagcacccuuccugugccagauaaacccuugcucuucuuccaccugcucuaaccuacuccaaggggggaaaugggcaaacacuuaguguuuucauuacccucuaaggacucugggcaggagcaggcaucaaaggggaaggagugugaagagaaucuuggugcccugugucuaagagccugggagacuagaccugcuuuggggccagaauggcggaaaauguugcaagagcaggucucuuccuuaggcagccucguguccuuuguuguauguguccguugcugguuuugauuucugacgauuugagagcacuuucuggaucauacccuucacauacaccccagcauggaguaugugcauuacagauacugaugacaagggaccccugccagcucucccucuccuccagaucuagcuaaggcucccagugcccaaguauucccuuacguuuggucucuaaaugucaagccuucacuagccuucugguauacagaaaauaagaacugaagguccagagagauauagcuacuucccaggaugacagugugcccaccucagagucaagaauaggccuuggcauggacaccauccuaccucggguuugucaugagagggauucagagauugccgcgguagauagaucuagaaauauaguaguugugucucgguucuaucuauauauauccuagagacuucucucuguucacuauauauacuccaccagaguggguguguaaguggugcuggaaagcagguuauuaaauagcagccugccuuccuacccaugcugacucaagcugggccuccugcccauccagcuggucacuagaaaugcagucucccuauuaauuacagugauuggauguauuacccagggacuagggguagaucccagcgggaccagcucuauagcagacauucagcuguguaggaaaagcacauuggucguguaucccgaaggaguuccucaggacagauacucaccacauggaucgugccggguuccucaagaaauggaguagccacuucacaggugugccuugacugaggcguggcacuaacugugcccuuucugcuggagauggcggugccuuguucuucacuauuccaaacccucugcccuagcucacccacuuuccccccauguuuuuccuagacagaggaaucauucacaccauugcugggguguuggucugaccucuggguagggugccugccuuccuguuccaagcugcccugccugagaugaccagaaggcaucucuguuuuucuuacaguaggauugcuuagggacagcaaggacagagacgugcaagcgguggccauguaagaugaaaaccacaaggagaauggggacgagugucuaagaggcauacuucccagacucccauguuccaccucaggcugaccucagccuccaccuucuccccagggugaaaagguguuccauucucccugccuuuuaugcaguacagaggcuaaauacaaagcccguuggcugaagacccucucuuuacuaccugguuuuuuacaua

SEQ ID NO: 360 - RNA, 2737 nt, Mus musculus
uauguaaaaaaccagguaguaaagagagggucuucagccaacgggcuuuguauuuagccucuguacugcauaaaaggcagggagaauggaacaccuuuucacccuggggagaagguggaggcugaggucagccugagguggaacaugggagucugggaaguaugccucuuagacacucguccccauucuccuugugguuuucaucuuacauggccaccgcuugcacgucucuguccuugcugucccuaagcaauccuacuguaagaaaaacagagaugccuucuggucaucucaggcagggcagcuuggaacaggaaggcaggcacccuacccagaggucagaccaacaccccagcaauggugugaaugauuccucugucuaggaaaaacauggggggaaagugggugagcuagggcagaggguuuggaauagugaagaacaaggcaccgccaucuccagcagaaagggcacaguuagugccacgccucagucaaggcacaccugugaaguggcuacuccauuucuugaggaacccggcacgauccauguggugaguaucuguccugaggaacuccuucgggauacacgaccaaugugcuuuuccuacacagcugaaugucugcuauagagcuggucccgcugggaucuaccccuagucccuggguaauacauccaaucacuguaauuaauagggagacugcauuucuagugaccagcuggaugggcaggaggcccagcuugagucagcauggguaggaaggcaggcugcuauuuaauaaccugcuuuccagcaccacuuacacacccacucugguggaguauauauagugaacagagagaagucucuaggauauauauagauagaaccgagacacaacuacuauauuucuagaucuaucuaccgcggcaaucucugaaucccucucaugacaaacccgagguaggaugguguccaugccaaggccuauucuugacucugaggugggcacacugucauccugggaaguagcuauaucucucuggaccuucaguucuuauuuucuguauaccagaaggcuagugaaggcuugacauuuagagaccaaacguaagggaauacuugggcacugggagccuuagcuagaucuggaggagagggagagcuggcaggggucccuugucaucaguaucuguaaugcacauacuccaugcugggguguaugugaaggguaugauccagaaagugcucucaaaucgucagaaaucaaaaccagcaacggacacauacaacaaaggacacgaggcugccuaaggaagagaccugcucuugcaacauuuuccgccauucuggccccaaagcaggucuagucucccaggcucuuagacacagggcaccaagauucucuucacacuccuuccccuuugaugccugcuccugcccagaguccuuagaggguaaugaaaacacuaaguguuugcccauuuccccccuuggaguagguuagagcagguggaagaagagcaaggguuuaucuggcacaggaagggugcuuuagaagaaaucucuccggagcuggguugcuguguggcugcuuagugggauuccugagcccuuugcucccaaaggcagcaagaauugcucuuucuuggcucuuaaguccuguggcuucuccuugucacccugcuaggggucucauauugggggguacaacucccagcccuagaugucugggcacaaaggucacuagacucaguccccgaaguggggaaaaagcaagggcaaauaacuccaugucaguguacauaaguacuguggccucauuucuucucuccagaggcccccacagcagggaccugagggcccugcuaccaaaugucugcccuacccuaucacauucuccacauuuggcaguaaucuuuacuuccaucacaggcuggagggccuccuggagaaguaagaucucaugaccccuccacugggucagauagagccuagaaaaguccuucucaucugugcuccagugggagcccacucacccccaacucuucucacccaagccacuguccaagaguggguagggaacagacaaagagcucuggaaagcugcaaagugaaggaggggggcugaugcuagccaaugcuccuaguaccccuccccccgcuggcucacuucaggauggucuggggucuaucggccaggaugucccucugccaagucccagagcaucacccucccgagcuaccuauagguccccagccucacuacucaccccggccugcucuuggccuucaccccacauaucucuuaacuauucuuuccuuccaacuccaggaaaagugaggaguccggagaggcugaguggaggaacucaaggacaagaaagcacuucuccagugaagaagaggcaggggcugcaggcuggcagauguaaaauuccccaaugucuguagaauuuugguaaugucccccaccgaagugagggauaggggauuaugauauucagauguugggacaagccaggaaucuuuaacaauuguuucucccacccugaccccccccccccacacacacacacacacaccuccaagggcaggagcugaaguacuuccaacaagacccaccccagguaaccagccgaagugagucaguuaggagggguguccucggcccugggcaaacaauggcagaacccucuaccccuccccugugcccuccacacccaagccucgguaauuaaaauaugaauucaccuucc

SEQ ID NO: 361 - RNA, 1383 nt, Mus musculus
caggugcuucaggccguggccaaacauggagcccucugagagcugcuggauuuucuuaagggggaagagaugaaaagcccugguuaauggaaagcuccuggaugccuugucaaucgggguugaagguggguuuauuccuaagagaccagagcagcuaguuuagacaucugaacgcugggaucccuauggguggccugccaggccuacaaggucaucuacccuuuaguuccuaaaguaaguucagcuuuuagaaaucugaacaggauguucucaggccguagccuguggcuuaguagcacacaaguagugaacaggcauuccuggggcuacauccuucucaauuggucugcccaaucucaucaccuccuuucuuccaugucaagacuguccuucgggcugcacuggggcauugagaccaccaaaccucccuucccacagaggucucauugacaguccuuggaaaaaacagauccauauaaucagguucuaucuccgacgcaggcucugcugauucugcauccagcaccuuucagccuuccucaccaaucaaacugcaagguguuacugcacuugcuagaacuuccugcuucacuuucuccauaaagggacugguccuuucuaacucccccaucugggaugugaaagcagugucuggggaauugguagccauauuguaaccaugagaugacauagccgauaacagaggacaacacaugccaguagaguuuacaaaauaagaguccacaagucucuacuaugacuuucgguuacuuacagccagcuaaguugugauauagcugacaaugaaauaaacauuguuuuucugagccuaggauaccuacugcuguccagacaggaggcuuucauuuccccccagacuagagccaagcugaauccuugaagccugcugcugccucucugcggcgcugccccgagacgccaccugcuuccuccaagccccagcgcuaccaggauaaauggcugguggcaacugccauguaacgguaggcggcuuucccgugaggagauggcuuaucuguguaggccacgucuucucaagagcuccagagcggugggaggcugggugggacucaagaccaggggaaacauuauacuguguccucuaagagggaaacagagccaaguuaccuggggcucaggagccacagcaggcuuuucucugugccaacauccuauagccucacaaaguaaccuccaccauuaaaauaauuguuuuaauaauccaaaaaaaauuagacacacuaguuuuucuuucuuucuuuuuuuuuuucuuuuagaaacaaacagagcaaaaguuugagcaugaagaaagcagggaagaaaagucuccagcuuuugaguggcuguccacucagugcugcc

SEQ ID NO: 362 - RNA, 1383 nt, Mus musculus
ggcagcacugaguggacagccacucaaaagcuggagacuuuucuucccugcuuucuucaugcucaaacuuuugcucuguuuguuucuaaaagaaaaaaaaaaagaaagaaagaaaaacuagugugucuaauuuuuuuuggauuauuaaaacaauuauuuuaaugguggagguuacuuugugaggcuauaggauguuggcacagagaaaagccugcuguggcuccugagccccagguaacuuggcucuguuucccucuuagaggacacaguauaauguuuccccuggucuugagucccacccagccucccaccgcucuggagcucuugagaagacguggccuacacagauaagccaucuccucacgggaaagccgccuaccguuacauggcaguugccaccagccauuuauccugguagcgcuggggcuuggaggaagcagguggcgucucggggcagcgccgcagagaggcagcagcaggcuucaaggauucagcuuggcucuagucuggggggaaaugaaagccuccugucuggacagcaguagguauccuaggcucagaaaaacaauguuuauuucauugucagcuauaucacaacuuagcuggcuguaaguaaccgaaagucauaguagagacuuguggacucuuauuuuguaaacucuacuggcauguguuguccucuguuaucggcuaugucaucucaugguuacaauauggcuaccaauuccccagacacugcuuucacaucccagaugggggaguuagaaaggaccagucccuuuauggagaaagugaagcaggaaguucuagcaagugcaguaacaccuugcaguuugauuggugaggaaggcugaaaggugcuggaugcagaaucagcagagccugcgucggagauagaaccugauuauauggaucuguuuuuuccaaggacugucaaugagaccucugugggaagggagguuugguggucucaaugccccagugcagcccgaaggacagucuugacauggaagaaaggaggugaugagauugggcagaccaauugagaaggauguagccccaggaaugccuguucacuacuugugugcuacuaagccacaggcuacggccugagaacauccuguucagauuucuaaaagcugaacuuacuuuaggaacuaaaggguagaugaccuuguaggccuggcaggccacccauagggaucccagcguucagaugucuaaacuagcugcucuggucucuuaggaauaaacccaccuucaaccccgauugacaaggcauccaggagcuuuccauuaaccagggcuuuucaucucuucccccuuaagaaaauccagcagcucucagagggcuccauguuuggccacggccugaagcaccug

SEQ ID NO: 363 - RNA, 2629 nt, Mus musculus
uaauuuuaacaucaauacagaauaguuguuaucucauaaagaauaagauaucucagagacucaaguaguaugguuucaaagauuaccaaaucugucugcuugcuacucuguucugucgcuaagaacccaucuuuagcaucauagcugcuucauagcaaccuucauugaugcgaacaaugagcucuucugugcugcggggguaaauagagcagaccagagucaggcagcaccaguccgccucacacuaggcagguccugauucacuuagaacaggacgagcugccucugccauagcguacucacuugcuccuuuggaaggguguguuggacuaagucucuaaccugggcuggucucacauggguguauagcugaagcugaccuggaacuugugaucuucgugagugcugggagaagggcugugcaaacucccaguuuauguggugauggggaucaaaaccgagcuucaugcaggugcagaacgcgugcugccacacuccacuaaagcuuuuucuuuucaggagacaggucuuagaguuagcccguuuagcccaggcuagccuugaauuugccagcaguccugccucuuugaggcugcugucaccauaccuugcuuuccauuucuuugaaagucuauacagugaagguaguuaaaccugggaauggggcuuucaggugcaguguucaaagggaccuaccugaaauggacaaggggggagucacguggcuccagcccagaguugucuguuuuuuucaagacgguuucuugguguaacagcgcugguuauccuggaacucgaucuguggaccaggcuggccuugaauucacagagauccaccugccucugucuccugaguucugggaucaaagguaugcgccaccaggcccagccaaaguuaucuuucuaauagaggugguuuaggaauauucacaguaaauuauucaagauauucgaauuaacauccuagcccaaccuugccucaccccuuuuguaagacugguuuuguaucugaucagauuuaguacgggacuuugaaacucucccacaguuugggagggagggaaagaguuagcuuauacaccuggguaacauggaaauucacuucagcuucucaggucuuuuccuuuuuuccuucuaaagccuguggguuuaaguucauuaggaagcgaccagaauugugcccuggaagacgccccuggcaggcuuaagcaagcaagcuuagagagucaagcgacaauacuguaaaaagucuuccugccuguggccuuaccuaagacuauggaccccgcuucugugcacaucugugcaugugucuguuuugcugacaacuguacauuauaaucucucaaugcucagggcuauuccaagcuggaggcucuguugugguacaauagaacauucaucuggaaugccugcuaguaaaauacugagucaugaagacuggggccaucguuuuuauccuuaggagucuguuaucaauaaccuaccugccuuugguguugaugacacuggacaucccugaggagcuacaaaaagccguggggagagucauugucaaugccacaggaugcaguguuacauguggccuuggcuacaaggaagagacggagugcgaggugggucccgacggagugaggagaaacugcacguuccagcguuuggagugugugaccaacuggaucugugggaugcuccauuucaccaucguccaugggaagacguuugagcugaacugucucagcucagacauccuggagaaagggcaggaagccuuccgcuucaccuggaggcuugcccggggcaucaucucuacuaacgacgagcuuuucagacccuuccgagccaauucccccuuuauaggauuuaaaccagccuaugaguauaacgcugggacguaucgaugugacgugcagcugcuaaaaaacuugaaauuugucaagaggcucuauuuuggacugaggguccuuccuccaaaguugguaaaccuaaauuuccaacagucccuuacugaggaucagaaguugauagauaagggcugggaaguuaaucuggacaaugggucuaagccucaccucccuguguggcaaaggaaagugacaucggccuugggcauaggaauuguggcuggagugguuggcggcguguuggugagcguugcugucuucaaggcccugggagggacugauggcagugggggccgcacccgcuuaugaugcaagucuuccucccaggaggcuggcuaccuaggaagcuaagcuagauuguaugugugccucugauggugaagugucaaaagagggcucucagccagaguuggcuaggaggcugggaagauguaaccucaguaguucagggcagcauccaccauuguauucagguuucccugauccuagaugcucaggagauccacugcaggcuuagguucugucccuagagagaguucugucuugcaagcuuguuuuugugccacacuucccagugugugugccccgcucaccuccacuccaccucucugaacaguguauugaccagaauguacuaaucgcagccuuuuauguugggaguuuuuuuuuaauuuuuuuuuuguuuuguucaauaaaaauaauucacaggaacuuuauggcagucu

SEQ ID NO: 364 - RNA, 1811 nt, Mus musculus
caccuuaauucugauuuuuauuuuugagacaggaucucaugaagcccaagcuggccucaaacucauucuguagccgaggaugaucuugggcccuccaaggccaccugcccauggcuggaauuauagguauguaucaccaugcccgacuucaaauucacguauuuuaaaaguaugucaaaaguuuuuugagcacaugaacccuucucaaagcucugugcauuagagaggucccuaugcagccacuuuauuuuuagauacugcccucauuagaaaaaaaaaaucaggauaacuugcgauuuuauuaucaggacuuuaguuuuucaaccccuugaacgguggugucuugagaacccaaaguugaugacuccccugaaguucagaacugugcuuuugacaggucuuaaccacacccccucaccuucucaucugaucaaucucuaaggcuccuccagagggggucucgcuuccccauuggucaauuuagaugagcuuuguuguauguguaugugugucuguguauguguguguguugggggggggguguccuugugucugaguucagggcucagcuagguagguucugauuuuauuagaggcuggagacuaagcaugguuauacaccaagugugcauccagauuggggacgguccuuaucgcuguuuccucugccccugggacucugagcguaugcauuagaaaacaguuuuccauguagcuaaccauuccaaagcuccugaagccauucccuuucauccccacccaaaggcugcuucuuggccuuggccuuucauugugcuguuaguucaugaguaaggacgccaucucugccuguaccacccugcaccacccugcaccacccugcaccacccugcaagccucaaugcuccuccaggguccccuuucugcaucuuccaucggagaacccccuaccuuguuaguagaagcauccaagcaucaaaacacacacacacacacacacacacacacacacacacacacacacaaaugcacccuucagccccagugcacacagaaggagcacuguuugucaaccacaguuuguccuucuucuggauaucuuagacuucaacaacgauagcuuccuuggccacagaacacugguagguugggauccagcaggaccagggugucaaccuguaagaagcugagaauaagcccaggcucagccuauccucggguccaagaguaaugcgaggucaugucagugaugacucagacauguaggaucaucucgaacuucgauucccauuugcugaguaaaugucagugaaucagcagcacagauauuauuaucuccccuuuacaggugaggaagggugaggcuuaagaacauuuaagcaacuuaaccaaggucacgcgcuaccaaaaagagucaaacuggaaccaaacccaagucuucugaauucacgcucuccugcucuugcuccugcuccauggagauccaggaagcagacuggggaguggggcacugcagcacuaggcacaaaaagaaucaggugguggcuauggaggagaaagagacuaguucucagcuggauacaaggaaaauguguccacggugugaucacaggacacaggcauggggcuggccagugcagagacagcaccagggagguaucugagagguacccucccagaaugaauucccaauggcaacagcugaagcugccuccucagagagccuucuagggcaggucuaugcuguauaaccuggauaccucugucucuugucaccuaacagugaugagacucgaggcagggcaggguuggagacagggggaagcuggaag

SEQ ID NO: 365 - RNA, 657 nt, Mus musculus
ggggguuaagcgaaaacccugccacaagaagcgaaaguaugagcugggacggcccgcugccaacacgaagauuggcccucgccgcauacacacaguccaaauucgaggaggcaauaagaaguaccgugcccugagauuggauguggggaacuuuuccuggggcgcugaguguuguacucgcaaaacaaggaucauugauguugucuacaaugcauccaacaacgagcuuguccgcaccaagacccuagugaagaacugcaucgugcuuauugacagcacgcuguaccgacagugguacgagucccacuaugcacugccccugggccgcaagaagggggccaagcugacuccugaggaggaagagauuuuaaacaaaaaacgaucaaagaaaauucaaaagaaauaugaggaaaggaaaaagaaugccaaaaucagcagccuccuggaggagcagcuccagcagggcaagcuucucgccuguauugccucacgaccaggccaguguggcagagcagacggcuaugugcucgaaggcaaggagcuggaguucuaucugcggaagaucaaagcccggaaaggcaaaugagccucaugcguaguguaauaaaggugucugcuguucuauuaaaaaaaaaaaaaaaaaaaaagacaacuucc

SEQ ID NO: 366 - RNA, 8660 nt, Mus musculus
cgaguaaggaagccgacagggaccacagacgcggccaaucagaggccacgcacgagggugaggcaaguccgccucucgggaggcaaggguggggguucggcgaaugacgugaggcgccgcugggcgguagggaguagacgcccucgguccuccgucucgcccugcagcuuccgggugugcggcugcggccauuuugagcuucgcuucuuugcgcccucgccugccacccagccacccuuuccgccuuggcguuucgcgccuccgugcgggccaccggaaacgccgccgucgucuccgucgccgccgcgcgagggagggucuucucuaugguggagcgaucucacacggccuaggacgucuccuucccuagccgggauggaccuaaccgcggucgccaccgcuugcgcgggccucugggccguccggugcagcacucguugcggaagccgccgcucucugggccuccucugccggcgcgggaaucggacugcaguacccacuccguggcugggcaaggcggagacuguguagaccucggauccagccugcgcugacgccgcugagcucuguccuccuccugucugagaagccgccaaggaaaggagauggagacaggaacgcacagggcccggaagcggccuggcccucggcugggcuccugguuccggcugcccuuccuucggcgaucgcacgccugcucuucggaguucccgccgccuuccucucgacaaaaucccgggaacuccgcucugcccgagcgucggaccagguacuggaccaaauugcuuucucagcuccuugcccugcucccuagccuauuccagaagcugcugcuuuggagccagcuuuucgggggccugauuccuaccagauggcuagauuuugccgcaaguuacagcgcccugagagcuuugagaggacgggaggaaucugccgcucccacggugcagaagucucugaguucacugcggcuggacucuucggaagacuugguugucaguucucuugauuggcuagaggagggacuccaguggcagugcucguccucagaccuggaguuaaaacucaaggcccaggaaagagcuuuagacucugcagcgcccacuuuccuccuggagcagcagcuguggggaguggaguugcugcccaguagccuucaagcuggucuagucucccaccgagaacuugacucuucauccucugggccucugagcguucagagcuuagguaauuucaagguaguuuccuaucuccugaacccuuccuaccuggacuaccuuccccaguuagggcugcgcugucagagcagcgcuggagguggccaguuuguggguuuccgaacacuaaccccagagagcugcuaucuuucugaagaugguugucacccucagccguugcgggcagagaugucggcaaccgccuggagaagguguccgccucucucuacagaaggccugccggaaauccaccaccuucguaugaaacggcuagaauuccuccaggcuaacaaagggcaagaguuacccaccccugaccaagauaauggcuaucauagccuggaggaggaacauaaccuucuccggauggacccacaacauugcacagauaacccagcacaggcgguguccccugcugcagacaggccggagcccacugagaaaaaaccagaauuggugauucaagaaguuucacagagcccccagggaagcagucuguuuugugaauuacccguggaaaaagaaugugaagaggaccacacuaaugcaacugaccucucagauagaggagagagccuuccuguuucuaccagaccaguuuguagcaacaaacugauagauuauauuuugggaggcgcccccagugacuuggaagccagcucugauucugaaagugaggauuggggcgaggaaccugaggacgauggcuuugauagcgauggcucccugucugaaucagacguggaacaggacucggaaggccuucaccuuuggaacucuuuccacaguguagauccuuacaacccccaaaacuuuacagccacgauucagacggcugccagaauugcccccagagacccaucagauucagggacauccuggucuggcagcugugguguagggagcugucaggagggaccccuuccggagacccccgaccauaguuccggggaggaagaugacugggaaccgagugcagaugaagcagagaaucuuaaauuguggaacucuuucugucauucugaggaccccuacaaccuuuuaaauuuuaaggcuccuuuucaaccgucagggaagaauuggaaaggccgucaggacucaaaggccucuucugaggcuacaguggccuucucuggccaucauaccuuacuuucuuguaaggcccagcuguuagagagccaagaagauaauuguccaggcugugggcugggugaggcucuugcuggagaaagauacacccauaucaagagaaaaaagguuuguucccuuuuacaugacuaauaacuugcucuauuuugauaugguuacuauagcagcaugacuuugccucuggaggcacaguugugcacauuuuugaggaaggcaucugagcugguguucuugaauugagaaauacuccagugugauccuucuucccaauauagagaaauguucuucuccaaaugaaaggugccaguauuagauguuagcaggggugucauuuugguugguggaaccugaaaguuagaaaugguuuugcauguguuuuauuugaaaguauauaauguuuuauuuucauggcuacaguguccuuauuccuauccauuggaauccagaggaauaacacuagcaagcagcaaauuagguuuguucaguuguuugcccugaaagugguacuguggugugugccuguaauuccaguacuuuagaagcagguggguguucuggaguuuuggagucuagccuggucuaccuagugaguuccagacuagcuaaagauacaugagcaggaccuuaucucaaaaaggggguggggguggggcauacaccuggcuuuccugcagucaguuguguucccagcuguccggaaccuccagcccaguuuguuuuuuaggucucuuauguaacacaagaccucacugugaaguccaagcuggccuuugagccuggugucucaagcuucccgagugcagggaugauugugagccucccggcuuguuuaaaacuucaccgggcaguccuuugguugagcuugcuuggaguucagaguccuuugagcugccuagcuucucacugcuuacucagcuggguuacuauuugauacaaagaugucuucuauuguugagggaguuucuuaggcuuucauuuggaaagagaaagcagugagugagugaguuaucauugaacuauucugcagcuccagugccugucagggacagugugugagcgagcgagcuccugggucugaagggccuagcuuuuuuuuuuuuuuuuuggguuuuggagacaggguuucucuguauggccauggcuguccuggaacucacuuuguagaccaggcuggccucgaacucagaaauccaccugccucugccucccaagugcugggauuaaaggcgugugccaccaccgcccagccaggccuagcuuuuuaaaaacuauucuuggacauauccaaaugguaguaaccuuacgucuugucuauagaggcauaaggcaugcuaaaaaauaaauuuuagagugguauagaaagccucuauauuugcuuguuuauaauuauaaauauuuauaaugaaguuugaucagcacuccuuauacucuucaggauagacagcuauugagggcacaagcaggaaacaguggaguagugcugugaguucuuggcucuggagagcucucugcucuacuccacucugcccugcccgaaguuagcgaugcgauggagcugggcgggauagggcuaccagacuagacuucagugagcucucacagcccugaucucacagcccugaucugcuuccuucccuagugggaguauaagaucugcuguagaagaguugcaagauuguuuugucuugugauacugggcauugaaauugugaaccaguugcauauuaaacauucacauugccacuaagcuagcuacaccuccagcccaaguuaccaaaacacaaaugagaauaaaacucauaauuugccgggcaguggugggcgcacgccuuugaucccagcacucgggagguagaggcagguggauuucugaguuugaggccagccuggucuacaaugugaguuccaggacagccagggcuauacagagaaacccugucuuggugggggggggggggggacgggacgggacacgaccucauaauucguuuucaugccuuugaauaacugaggccaaccucaugucucaguuuaguuuagaacgguagacuaugaacuagaaucaaaacuuggaagagguugugucuagcuaugguaguuaguuuacagcccuuggcuaccugacauuaauuaaaauucuuuuuuuuuaaaucuuuuuuuuuucuuucaagauuuauuuauuauauguaaguacacuguagcugucuucaggcacaccagaagagggugucagaugucauuacgggugguugugagccaccaugugguugcugggauuugaacucgggaccuucguaagagcagucagugcucuuacccgcugaaccaucuugccagcccucuuuaauucugucuuagggggaggcuugggaucguggagugugaaauacuuuguguucugacaaaacagcagauuguagacuuuggaauccugguuauagcacuuagaugcugugggacuccagcugcucacuggcaucugguuccuugccuguacaguggggcuaauaccgaccgguucauagcucaugggguccccauggggcuuaaaugaggaagucuguaaaguucuuugaaaaaaguuuggcauuugguccacaguauaaaagugcuuauuuuuauguaucuuagugacugacuggguaaccacuagacugcaauaucugguaagguguuacauacuacuaauuauccucgggggcauugcuuggccugauguaaagggaaggaaagcuguaggcucggugggauuagcugauguaacuauuaaacaugcuuuagagcaacuauuuacuuuuggaguugauuuuuuuuuuuuuuuaagacagaaucucauguaaagcauuuggcuucagacuccugauuguccuauuucagugugggguugugggaggggggccuuggcuuauuauaagguugucuccacugugguuacccucugaguacuuugucauuucaggaaaagaauucuaacaaauagaauuucuguauuucucuaagaauuaaaggcuaacagggauaacaaacaaacagagaaacacagaguucccaucuaacuucuucuguagugggcacagcgauccaucccgucuaguguugaugugguguuaauucuaagaucccagaauuacuaacauugguuuuugucuuucuagguaaccuuccuggaagaaguuacugaguauuauauaaguggugaugaggaucgcaaaggaccaugggaagaauuugcaagggauggaugcagguuccagaaacgaauucaagaaacagaaguugccauuggcuacugcuuggccuuugagcacagagaaaaaauguuuaauagacugaggaucgagucaaaggacuuacuguuguacagcaauguuaagaagugaacagccugcaacccgugcccacucugucucuuacuugagaguuucccuuaaaaacaaacacuggcagcuguccuuggacauguuuuuaaagaaacaacuuguaucuagagaugcaguuugauuauuuuuggguaaugugucucauuagaaacaccaacuccgauaaugaagaaucucuuaucuguaauccucucuuuuccuauuuaguuggauguggguuuugucuuuuugagagggucucacugcauaauucuguuuggccuaggucuauguauguagaccagguuggccuugaaguugguauuuccuugccucuguuuccugugccaccaugcccagcuggaaguguuuuuaaauauccucugcuuaccuggggugagaguuuaauuuugcacuuucaaaacguuucuucuggaggcaggggcuggucugguuuacauacaggcuucaggccagcuagggcuauguggugagaccuagucuuagaggacaaacagaacaaaacagucagguuacuguggaaacugaggcaggaggauaggaagguccagguaugccuggaacucagugaacucugaacucaaggccagcauggggaguuuagcaagaccuuuuuacacucagaauggaaaaggaagcuggggauauagcucgguagcagaggccccugccuacaugugcaagguccuggguucaguccccaguacugcaaauagaaagaaaaaacauugucuuggauaacuauaagguuuaagccucauagucaguucuaacucaaauuaugcaugcauugaguucuugugugcuuuuucuguucuaaaauuaaugggcuuuauggguuuuguuuuuguauguuuuuaugucuguuauauuuugagguaggggauugaggcagggucucacuguggccuugagcucauggcaguuuuccugcuucaacugaguguuuugguuuguuuguguuuguguuuuuuuacuuucauagauuugacuuaaugaaggcaaaaaccuguuaucaaccuaaaagacauugaugugucacuucagugguggauuuucucccucuuuuuuuuuuucccccagagcugaggaccaaacccagggcuuugcacuugcuaggcaagcgcucuaccacugagcuaaauccccaaaccaccccccccccuuuucuuuuuuuaaagacauggucuuauauagucuaggcuggccuuaaacucauuacuuagccaaggauggcuuugaaagauccuccuguccucuuguuuggcuugcacauggcaugugccauacauccagauuuuucucuguaucuaggucuuuuuaagauauuuccaaggacugcccacaaauccacagugcaguacuuucuugacugggaaagcgggguuggugugcuuuucaaaggcacacaccauuaugcccagcuggucugccaaacuuaacauauuugguuucugugcaaacuguccauuuggaagguuucuguguguuguaguuucaguugaauguggcucucuguagcuuucaagaauggguagaaaucauaaagcacucuuaaguaaucauugcauuguagacauuuuuuuuuuuaacuaggggguauuugggagacaugucagauauucacuuuuguuuuaugugucuuaaaaccaguguuacuuacacccugccucagcacuggcacuuuucaaaccugucuuggagacacuguaaacuuggauggugcaguucuggguuuucauguguaaaaugucaacuacaaaggucaauauccagguuuguuguguucuaccuuauguagagagaagcaaagcagaaagggcagauagagcagccagaaagugcuaguguccccccccaaagcgugcuucuagauaguguguggaucaggugugcuugguuuguucaguuagcgucaccuguugugcaugguugagguaauguguuaccaguucuuuagugguuacaugcacaaaagagaggaccucugagucgggugugggaugagcuuuccagaccuggcaggguaaacuaccucaguuuauaaucucccugguuauuuccguuugaugugaucuaaggucugccucaguggugaugauguucauccacacacaagguuaguaagagugcacgaccagaaacguuggucuuauuuuugagaacccccauuucuguguauuuuaugcaccugccuuuagugaacuccagagugcauuaaagagucugguuuagugccgugggaaugggcuaguuuagaagcuauguuuggaaagcaggcaaguugacuuuaggaagaaaagcugugacaguguguagacauuucuuuuaaaccggacugcagcuuaacaacacuugauuucagaugauuagguuuuuguuucugagacccagcaccuguauauuuaaaaauuguuccagauuacaccuucacuaucaaaugaguaaaugacucaugccugcagacauguccugaugguggcaagaacagaaggaucuuugacugaaggagaaaaacugucauugucaucccagcccccaggaaagaacaccuccaaggcaggcaggcaggcaggcaggcauggugguucuaguugaauacacauucaagucuugcaguggugcuuuagaucuguguagcaugugaggcucuguacaggugggggccacacuucugagggcugaaauguggcaacccuuuaucuaacuugaaaucaaaaccgucaaauuuuauuuuuuauaauuuaagaaagaguuggggaaugacauuuuuugaguuggccuuuucagcucagucauuuuacguguaacguggagauuugauagcucagauuauauuuguauauaauuauuaacuaaucuguaaauuguaauaaauauauuugcaauuauuaaaugcuaugugacuuuaugu

SEQ ID NO: 367 - RNA, 8660 nt, Mus musculus
acauaaagucacauagcauuuaauaauugcaaauauauuuauuacaauuuacagauuaguuaauaauuauauacaaauauaaucugagcuaucaaaucuccacguuacacguaaaaugacugagcugaaaaggccaacucaaaaaaugucauuccccaacucuuucuuaaauuauaaaaaauaaaauuugacgguuuugauuucaaguuagauaaaggguugccacauuucagcccucagaaguguggcccccaccuguacagagccucacaugcuacacagaucuaaagcaccacugcaagacuugaauguguauucaacuagaaccaccaugccugccugccugccugccugccuuggagguguucuuuccugggggcugggaugacaaugacaguuuuucuccuucagucaaagauccuucuguucuugccaccaucaggacaugucugcaggcaugagucauuuacucauuugauagugaagguguaaucuggaacaauuuuuaaauauacaggugcugggucucagaaacaaaaaccuaaucaucugaaaucaaguguuguuaagcugcaguccgguuuaaaagaaaugucuacacacugucacagcuuuucuuccuaaagucaacuugccugcuuuccaaacauagcuucuaaacuagcccauucccacggcacuaaaccagacucuuuaaugcacucuggaguucacuaaaggcaggugcauaaaauacacagaaauggggguucucaaaaauaagaccaacguuucuggucgugcacucuuacuaaccuuguguguggaugaacaucaucaccacugaggcagaccuuagaucacaucaaacggaaauaaccagggagauuauaaacugagguaguuuacccugccaggucuggaaagcucaucccacacccgacucagagguccucucuuuugugcauguaaccacuaaagaacugguaacacauuaccucaaccaugcacaacaggugacgcuaacugaacaaaccaagcacaccugauccacacacuaucuagaagcacgcuuuggggggggacacuagcacuuucuggcugcucuaucugcccuuucugcuuugcuucucucuacauaagguagaacacaacaaaccuggauauugaccuuuguaguugacauuuuacacaugaaaacccagaacugcaccauccaaguuuacagugucuccaagacagguuugaaaagugccagugcugaggcaggguguaaguaacacugguuuuaagacacauaaaacaaaagugaauaucugacaugucucccaaauacccccuaguuaaaaaaaaaaaugucuacaaugcaaugauuacuuaagagugcuuuaugauuucuacccauucuugaaagcuacagagagccacauucaacugaaacuacaacacacagaaaccuuccaaauggacaguuugcacagaaaccaaauauguuaaguuuggcagaccagcugggcauaauggugugugccuuugaaaagcacaccaaccccgcuuucccagucaagaaaguacugcacuguggauuugugggcaguccuuggaaauaucuuaaaaagaccuagauacagagaaaaaucuggauguauggcacaugccaugugcaagccaaacaagaggacaggaggaucuuucaaagccauccuuggcuaaguaaugaguuuaaggccagccuagacuauauaagaccaugucuuuaaaaaaagaaaaggggggggggugguuuggggauuuagcucagugguagagcgcuugccuagcaagugcaaagcccuggguuugguccucagcucugggggaaaaaaaaaaagagggagaaaauccaccacugaagugacacaucaaugucuuuuagguugauaacagguuuuugccuucauuaagucaaaucuaugaaaguaaaaaaacacaaacacaaacaaaccaaaacacucaguugaagcaggaaaacugccaugagcucaaggccacagugagacccugccucaauccccuaccucaaaauauaacagacauaaaaacauacaaaaacaaaacccauaaagcccauuaauuuuagaacagaaaaagcacacaagaacucaaugcaugcauaauuugaguuagaacugacuaugaggcuuaaaccuuauaguuauccaagacaauguuuuuucuuucuauuugcaguacuggggacugaacccaggaccuugcacauguaggcaggggccucugcuaccgagcuauauccccagcuuccuuuuccauucugaguguaaaaaggucuugcuaaacuccccaugcuggccuugaguucagaguucacugaguuccaggcauaccuggaccuuccuauccuccugccucaguuuccacaguaaccugacuguuuuguucuguuuguccucuaagacuaggucucaccacauagcccuagcuggccugaagccuguauguaaaccagaccagccccugccuccagaagaaacguuuugaaagugcaaaauuaaacucucaccccagguaagcagaggauauuuaaaaacacuuccagcugggcaugguggcacaggaaacagaggcaaggaaauaccaacuucaaggccaaccuggucuacauacauagaccuaggccaaacagaauuaugcagugagacccucucaaaaagacaaaacccacauccaacuaaauaggaaaagagaggauuacagauaagagauucuucauuaucggaguugguguuucuaaugagacacauuacccaaaaauaaucaaacugcaucucuagauacaaguuguuucuuuaaaaacauguccaaggacagcugccaguguuuguuuuuaagggaaacucucaaguaagagacagagugggcacggguugcaggcuguucacuucuuaacauugcuguacaacaguaaguccuuugacucgauccucagucuauuaaacauuuuuucucugugcucaaaggccaagcaguagccaauggcaacuucuguuucuugaauucguuucuggaaccugcauccaucccuugcaaauucuucccaugguccuuugcgauccucaucaccacuuauauaauacucaguaacuucuuccaggaagguuaccuagaaagacaaaaaccaauguuaguaauucugggaucuuagaauuaacaccacaucaacacuagacgggauggaucgcugugcccacuacagaagaaguuagaugggaacucuguguuucucuguuuguuuguuaucccuguuagccuuuaauucuuagagaaauacagaaauucuauuuguuagaauucuuuuccugaaaugacaaaguacucagaggguaaccacaguggagacaaccuuauaauaagccaaggccccccucccacaaccccacacugaaauaggacaaucaggagucugaagccaaaugcuuuacaugagauucugucuuaaaaaaaaaaaaaaaucaacuccaaaaguaaauaguugcucuaaagcauguuuaauaguuacaucagcuaaucccaccgagccuacagcuuuccuucccuuuacaucaggccaagcaaugcccccgaggauaauuaguaguauguaacaccuuaccagauauugcagucuagugguuacccagucagucacuaagauacauaaaaauaagcacuuuuauacuguggaccaaaugccaaacuuuuuucaaagaacuuuacagacuuccucauuuaagccccauggggaccccaugagcuaugaaccggucgguauuagccccacuguacaggcaaggaaccagaugccagugagcagcuggagucccacagcaucuaagugcuauaaccaggauuccaaagucuacaaucugcuguuuugucagaacacaaaguauuucacacuccacgaucccaagccucccccuaagacagaauuaaagagggcuggcaagaugguucagcggguaagagcacugacugcucuuacgaaggucccgaguucaaaucccagcaaccacaugguggcucacaaccacccguaaugacaucugacacccucuucuggugugccugaagacagcuacaguguacuuacauauaauaaauaaaucuugaaagaaaaaaaaaagauuuaaaaaaaaagaauuuuaauuaaugucagguagccaagggcuguaaacuaacuaccauagcuagacacaaccucuuccaaguuuugauucuaguucauagucuaccguucuaaacuaaacugagacaugagguuggccucaguuauucaaaggcaugaaaacgaauuaugaggucgugucccgucccgucccccccccccccccaccaagacaggguuucucuguauagcccuggcuguccuggaacucacauuguagaccaggcuggccucaaacucagaaauccaccugccucuaccucccgagugcugggaucaaaggcgugcgcccaccacugcccggcaaauuaugaguuuuauucucauuuguguuuugguaacuugggcuggagguguagcuagcuuaguggcaaugugaauguuuaauaugcaacugguucacaauuucaaugcccaguaucacaagacaaaacaaucuugcaacucuucuacagcagaucuuauacucccacuagggaaggaagcagaucagggcugugagaucagggcugugagagcucacugaagucuagucugguagcccuaucccgcccagcuccaucgcaucgcuaacuucgggcagggcagaguggaguagagcagagagcucuccagagccaagaacucacagcacuacuccacuguuuccugcuugugcccucaauagcugucuauccugaagaguauaaggagugcugaucaaacuucauuauaaauauuuauaauuauaaacaagcaaauauagaggcuuucuauaccacucuaaaauuuauuuuuuagcaugccuuaugccucuauagacaagacguaagguuacuaccauuuggauauguccaagaauaguuuuuaaaaagcuaggccuggcugggcggugguggcacacgccuuuaaucccagcacuugggaggcagaggcagguggauuucugaguucgaggccagccuggucuacaaagugaguuccaggacagccauggccauacagagaaacccugucuccaaaacccaaaaaaaaaaaaaaaaagcuaggcccuucagacccaggagcucgcucgcucacacacugucccugacaggcacuggagcugcagaauaguucaaugauaacucacucacucacugcuuucucuuuccaaaugaaagccuaagaaacucccucaacaauagaagacaucuuuguaucaaauaguaacccagcugaguaagcagugagaagcuaggcagcucaaaggacucugaacuccaagcaagcucaaccaaaggacugcccggugaaguuuuaaacaagccgggaggcucacaaucaucccugcacucgggaagcuugagacaccaggcucaaaggccagcuuggacuucacagugaggucuuguguuacauaagagaccuaaaaaacaaacugggcuggagguuccggacagcugggaacacaacugacugcaggaaagccagguguaugccccacccccacccccuuuuugagauaagguccugcucauguaucuuuagcuagucuggaacucacuagguagaccaggcuagacuccaaaacuccagaacacccaccugcuucuaaaguacuggaauuacaggcacacaccacaguaccacuuucagggcaaacaacugaacaaaccuaauuugcugcuugcuaguguuauuccucuggauuccaauggauaggaauaaggacacuguagccaugaaaauaaaacauuauauacuuucaaauaaaacacaugcaaaaccauuucuaacuuucagguuccaccaaccaaaaugacaccccugcuaacaucuaauacuggcaccuuucauuuggagaagaacauuucucuauauugggaagaaggaucacacuggaguauuucucaauucaagaacaccagcucagaugccuuccucaaaaaugugcacaacugugccuccagaggcaaagucaugcugcuauaguaaccauaucaaaauagagcaaguuauuagucauguaaaagggaacaaaccuuuuuucucuugauauggguguaucuuucuccagcaagagccucacccagcccacagccuggacaauuaucuucuuggcucucuaacagcugggccuuacaagaaaguaagguaugauggccagagaaggccacuguagccucagaagaggccuuugaguccugacggccuuuccaauucuucccugacgguugaaaaggagccuuaaaauuuaaaagguuguagggguccucagaaugacagaaagaguuccacaauuuaagauucucugcuucaucugcacucgguucccagucaucuuccuccccggaacuauggucgggggucuccggaaggggucccuccugacagcucccuacaccacagcugccagaccaggaugucccugaaucugaugggucucugggggcaauucuggcagccgucugaaucguggcuguaaaguuuuggggguuguaaggaucuacacuguggaaagaguuccaaaggugaaggccuuccgaguccuguuccacgucugauucagacagggagccaucgcuaucaaagccaucguccucagguuccucgccccaauccucacuuucagaaucagagcuggcuuccaagucacugggggcgccucccaaaauauaaucuaucaguuuguugcuacaaacuggucugguagaaacaggaaggcucucuccucuaucugagaggucaguugcauuagugugguccucuucacauucuuuuuccacggguaauucacaaaacagacugcuucccugggggcucugugaaacuucuugaaucaccaauucugguuuuuucucagugggcuccggccugucugcagcaggggacaccgccugugcuggguuaucugugcaauguuguggguccauccggagaagguuauguuccuccuccaggcuaugauagccauuaucuuggucagggguggguaacucuugcccuuuguuagccuggaggaauucuagccguuucauacgaaggugguggauuuccggcaggccuucuguagagagaggcggacaccuucuccaggcgguugccgacaucucugcccgcaacggcugagggugacaaccaucuucagaaagauagcagcucucugggguuaguguucggaaacccacaaacuggccaccuccagcgcugcucugacagcgcagcccuaacuggggaagguaguccagguaggaaggguucaggagauaggaaacuaccuugaaauuaccuaagcucugaacgcucagaggcccagaggaugaagagucaaguucucggugggagacuagaccagcuugaaggcuacugggcagcaacuccacuccccacagcugcugcuccaggaggaaagugggcgcugcagagucuaaagcucuuuccugggccuugaguuuuaacuccaggucugaggacgagcacugccacuggagucccuccucuagccaaucaagagaacugacaaccaagucuuccgaagaguccagccgcagugaacucagagacuucugcaccgugggagcggcagauuccucccguccucucaaagcucucagggcgcuguaacuugcggcaaaaucuagccaucugguaggaaucaggcccccgaaaagcuggcuccaaagcagcagcuucuggaauaggcuagggagcagggcaaggagcugagaaagcaauuugguccaguaccugguccgacgcucgggcagagcggaguucccgggauuuugucgagaggaaggcggcgggaacuccgaagagcaggcgugcgaucgccgaaggaagggcagccggaaccaggagcccagccgagggccaggccgcuuccgggcccugugcguuccugucuccaucuccuuuccuuggcggcuucucagacaggaggaggacagagcucagcggcgucagcgcaggcuggauccgaggucuacacagucuccgccuugcccagccacggaguggguacugcaguccgauucccgcgccggcagaggaggcccagagagcggcggcuuccgcaacgagugcugcaccggacggcccagaggcccgcgcaagcgguggcgaccgcgguuagguccaucccggcuagggaaggagacguccuaggccgugugagaucgcuccaccauagagaagacccucccucgcgcggcggcgacggagacgacggcggcguuuccgguggcccgcacggaggcgcgaaacgccaaggcggaaaggguggcuggguggcaggcgagggcgcaaagaagcgaagcucaaaauggccgcagccgcacacccggaagcugcagggcgagacggaggaccgagggcgucuacucccuaccgcccagcggcgccucacgucauucgccgaacccccacccuugccucccgagaggcggacuugccucacccucgugcguggccucugauuggccgcgucuguggucccugucggcuuccuuacucg

SEQ ID NO: 368 - RNA, 42204 nt, Mus musculus
ccucggaggcugucggaguggcuuucgcagaagcgagcggcgagcgcccugcuccagucccgccugggaacugaaguguacgagcgcggcuccuggaagccgagcuccggagcggccggcggaggucgaaggccgaggcggcgcgcucagcuucggaggcccuggcuuuggacccagcgggcucggagcugcgcggaggagcagagcgcacugcccgccggccuggcgggcgcagcggccgcgaguccgggagccggacugcggaagggaacacggcggcggccagccgggggcagagggcagagugccgagcggccuggcucggaggagggcgccgcccgacccguccucagcucggcgaccguggccagcggagcccggcgggccgcggguccugagcgcuuccagcccacggcggggggcgugccuccgcccggccgcgccgccccggcccgcugcccgccgcguugccggggcaugugagcgggaaggccaggcugcuggcugccgggacgcacugagcagaagccggagcgcggaguugcgaccccgggcccgcgcccgaccgauuaguaagugcgccccuucgcgccgcgcgccccaucaccccagccucgcgaaguuugacacgcgcgcccccgcguuccuagggacacgcuggcucucugccgcgcgacuuuccaucuugggcaaaguuuuugccaggcggagccgauccuaccagaccccucacaacgccggccgguggcgccgcgcugaucccgcguccuuuuggagggcaguggcuacaggccguuggggguggcgugcgcgcgccacgcgagccgggcuucggggguccucuacccgcccgcccuuugcgacccgccggccuuaggucuuucgccccagccugaccaacgcucccaguuuaagcacucccagccugagcuuagauguccccgugcgagccccacguggggcucggguacccgcaacgcggagcuccggucccggggugcauugggcagccgggguucagcgcgcgcccuucccacggcuccgguucauuccccgcggaccagccgggcgccgccucccauuuuuucagcccuugcugcucuucacuccagccugccccuugccaccccugcgucccacgguggagugucggagaagcgccuuucagccccuuucacuguagaaauaaauugaucacaggacugaugggaugggggugggggguggucgcguagucccagcgguucgccauuguuuucccaucccacguucgguacguaaacacacacucacgcgagugugugugugugugcgugcguguguuugcacgcgccagcugcggcugcucagauuccccaggagcucuagggucgcccgcgggaucuccccgcaaccaaccuacauguccuggcaggaggugccucauuacuugaagcuggggggggaaaggcacggagagugggagcugucccagaguccuuggcgaggccggggguccggcuugggcuggacgugaauuuugaacuucagccuuggaucauuccgggaggaccccgggcgcuugagcgguggcucuagccugggaggguccccagcagcuggcgcucuuggcagcaucuccgugacaagagcuuagaggaaacugaggaguuuuccugggaaguuugcuuuagcucugugggaauuuccgggcccggcgccuuagcgcuggcgcuggcagaggggucugaccuaaggcagucagucagugaugcugccacuccgagcaagguucccagagacccuguuuccaacuucuugaugcgguaggaagucccucacugugugcuagauucaacacacuugggucuuguucuugaccgagaugggucgcuugauccuggcgauguccaaacaucgccuguacuuucucaguuuaaaaaaagggcggaucugugcuucuaucuuugaagcugguguauguugaugguuugaaggaugcugguuuggaaggccuguaccacggaacgccagauagccuuguaguuagaaccaggaagcuaagcuggaguuguacaguagugcagccgcugguggugccaccgaaggcaauuugacccaccucccuugcucagguuacuuaucuguauagugagguuaaauucugacaguggccaccucguggggguggucuuaaggaugaaaagucuaaaggcaaucucagcgccaugcggcacaaaguaaauaaaugcucggcaacuguuagcuuuuguugucgggauguaacuuaguggaagagcucuagcucaacaugcaggaaaucuuggguacuguauucagugugugcauuugggaaguuagcuguuguuucuuauuacuaaucauauuuacgucuauuauuguuguuacuauuaguuuguuuuccaauacagggucucugcguagcucuggccgcucugggacuuguuuuguagaccaggcuggccucgaacucagauucuucugccucugucuccugagugcugggauuaaaggcacagacaccaugcccagcuagcuauuguccuuacuguaauaacaguauuaucaagcccagggccuaguucauacuggggaagugacuaccacggagcaguaucuccaaccugggccauuauaauuuaaaggaccguguauagagcccacaaucuuugugauuguguccguuugaucgauuuuaguaauuaucacuuauggggaggaagugaccucacucuccuuccuaccucuucuggauucugaucuacccaaacuuaccuucuuguuacuuaccugcuucaaccuuuuugaguacuuuuuuccuuccuucuucccuuccuucuuuccucuuaaaaauuaaucuucacaccauguagcauucucccuggaaacagccccaggaaggaaaugucuuugaaaggguauucccuggacacccuggucugugcugcagacccaggauuggaugugcauuugugucucagagaacuggguggauuuucacuaagaggaucccaggugucuggggcucaggggaagucaggugggccaggcagacugccugcccuagaggguucuguucccaggguaggaucuguuuccuguugcuggggcucacuugagaaccuagccuagcuagccuggcugccaagcauacugcaucugagacuuagauaaaugagagcugucaccuccaacuuuacagugacaguuggagaggcuacucggaauguaggggagacacagguucuugucuuuauugcggcauagcacagggaggggagauccaggggcaccccuuucuuccuucccugaccuucugacccuuaccaggcaugggggcuggggguggguggccagugugggaaaacuugguguugggaagguccugcaaguaggcgguuugcagaugcaaaguuuaaaacaucugcuucauuccuuaacagaaacuuguggaaggaauaugccaaucuccugccgggccugggcuagacagugugauaguagguggacaaguggauugccuaccuguuguagagcggcugcuuucuaaugggggucccgaccauuagaguaccagaccaugagaaaaaauacccaauguggggagguagagcacagggcagaggacuuguugggaggccagugaagacugcccugggaagaacucaggauagcauaggccugaagacagaaggauccagcugcacacagcugggaagaggagcauuccaggcugaggcaccagcagaugcucuccuccucccaggucagaaccaaguaugcggcuuggugguuggaaaagagccuguaggaucaggagggucagagccuggcugguggcaccugguagagugacuggggguuggggugggcugcauuuuacugucagcuccacaggaagccguuggagaguagagugauuuaugauuuuuuuaagaugauuugauaccaaagaaagugaucccgauugccccagggcaggaaaugauggcugagggaggagagauuguguuuuuuuguuguuuauuuuguucuuuguaaauuuaguacaugugcacacauaucaacaaugccccaacccccaaaauacuuuuaacagaacaccuuaaaaccuggagaaaguacaggaaaagcugauauguguccacacacugauacauguaugauacaaucuggugcaguuagauguguacauguagaagguuuuuuauguuuguuuaaaaauuuuuaauuacacuuauuuauuuaguguuuguguguuagugguagggacuuguggcacuguauuuguguggaggucaaagaaagagauggccuccacuuuacauauguccacauggagacauacuuguagggaggggagcauggaacauguggaguucaggagaaaccagaggggagggguguguguguguguauaauucagaagcaccaggaccaggaaucaugaagagauguugccaaccucagguccacccugcagccuuauuugcacaugggaaguagcccaacagggucuuuuugcuuuauaaacaaagaaacaaagaaacaaacaaauaaaaacagauuugggaacugugugucguaugagaaggacuuagguagagcagauguccuguuucugguccaugaggugagacaacggcccagagaagaucugucucuuagagcugcugaggccccugggcuguaaggcugcuagguagcuguugguagcugcaugugcuccuccuggacacccaugggucuugcccuugagggcucacacacuaagguuuucucuggagguuugggguggccuuucuugagcuaccuuaggugugcuuucaggaagcuaaugccgugguaaggggaauccacaccccuguccugcaccccucuccucaguacauugaugggugaagcugaguguuugcaaaggccucugugcagggagggcugccaccuugaaugggaguuauuuuccuuuugcuuaggagggccuguuucugccugcacuugcugccauuccuacccuuugcuaguccccuuccuaaaaugcccuggguugcugucagaacuccugucaccagaugaagaacuagcaccuacagucucccugaugcaggcagcaggcaugaucugaaugcugcuccuucucuguugaccuucgugcucccaaagaccuaucuuagagauucauuauuugccauuugggcaaggccaccuccacccucugccacugucccugaaggggauguguaucaccaugcuuucuuacaauacagaugcauccuacaugacccuguucuaugccaacgagacccuguuccucuggacuucuggcccucaugacccaggcuugguacgaggcuuucccaguuuuaagaagaccucucugcuuugguggcuuuggguuggcuuggggaccccuaggacugucgggcugugauacugucaaggaccccaagucccagagaaagugcuagguuguaaucagaccuauaggcugcgagggcaggagggcaggaggggaggaaguggcuccuuucccugcuuccauucaaaagccagccacagcuaaagcuauguaguguguggccugguaccagaccaguuagaagaguuccagauacugaaggggcagaagcuuaugggauacaagacuagggagaaguggggacaaugucugcugccuuuuuccuaagucauauuauccagcuaggcccuucuggucucugagaagcugcaaaccuggcauugggaaccacagagagaaacccacaucccacucccacuggccuuagcaguaagccugguaaacugcccguggggauggggcagggauuggaaaggagcauugggcucucccucuacguugccccucucccgugcuuuguaaggacagguccuagguaagguuucaguguucuggcuugaaagaagaaagggaaggggcaguccagggcucuccgcuggcgccuggccccugguguuugggucuggaguccccgccaggccuggcucccuggggacccgccccaaggcggccggccuguccuccuagcaccccgccuccugccugcggaaccggccgggcggagaaccgguuccugugggccgccccgccccucgagaggacaaggggucggcgccugcgcggaguugggucgaggcaggugccuugggguccaggugugaccagugaagggggcagcugaugugggggcucccuuugucccgauaggcccggggcaccgcagggagagcgggaagccccaguaucccgguggcccuucugaggcccgcggccauugcugacuucuuccuuuuuuuuaaaguugugguucauuuuaucuuuuuuucugugcuggggaaggaccccagugccuugcuugaccaugcuaggcauagcacugagccacagugucuaaaaguagcauuagaaguguaguuacuuuuuuaaaaaucagaaugaaaggauuuaagauauauugcaauuugccggugagacagaaaggaauggaccauuccaugagagaccuggaggaguugggugcugaaaggggcuuccugccaggcgggugaccaucacaggacaaggggccuuugaggcugggccagaccacuuuguaacagcccaggggccccugaaacacucaacaguacugacugagguguagucagggacuugccagccuuauagcuuuggccuuggugcaguuugauuagaccagagggaucuggcucucccugcaaguuuucugugggccaaaccaccccucccuccucagagcucuacugaagaagucugaagucauucuaccaacccagggaggccuggguucucagccugugucuugagggguggggugggguggggaaggaagguuaagaggcuggcaggaagccuugugugaagguacaguggggcucugggagcaggcuggguguugggugggacaaggcuaggacguuuugaagucaaggggcucauuugucuggguggaguaaguggggaguuuuaugucuauucacagggccugggccagguggggcaucugagagcuccagggagacccugaggauaucagagcaauauccucaagggaagggaagagugacuggaagggaaagaacagaucagagaagagcccuuuggggaggugagguggaggagaguccaauugggguuucaccugucuacuggggagggccaggcagcaggcacccucuugcucucugcuccugucuucugcaauucagcaagauagcguuguggagcccagcaggccccccaguagggguaacgggagagaggucuuuucuguagguucaauauguucccuagccaauaguacucuccccuacugcucaucccauggggugcaggagacaggagacagagggaagggcucuauguuguaucuuaguguguaguaggaaacagcagcaguuucucuucccuucucuuugguaugugagaaacaaggcauggauugacugcugucugccugaggacuguugaaaugaguguccaacucaaggugaguggugcuuggugcuugggaguuuugcaguguguaguccgcacgacuguacacuugacccuguugcaaucggcugcuuccgggcccuaucuaaacuaggcguuagacucucugguaggcagaugagaagaggggccuuggcuagauagucaagauagugaacuuccaguauggccagcuucuucgcccaaagccugacagcuugaaacaaaggccuuguauguaggcuuuugucucccaccagcagguccccugcugcuggacuggcucagcuaguugaggcuggaucaguuugugucacacaacaguuuucaaacuggcugcacguugacuuucauaucguuccuucccuuuucuugagugcacacacgugaggacaacuuccaagagucaguucuuucugccaugacccucuuugauggauccagggauuggacucagguucucaggcuuggcgggaagcagccuuccuccucagccacagcuugcccuuaccuuugccuaguuuuagaucaguguucuucagugugacaccucaaauugugagagugauuugggcuauuuggcuuuuuguuucuuuuuuuguuuuauuuuguuugagacgggguuuuucuguguaguccuggaacucacccuguagaccaggcuggccucgaacucacagagaucugccugccucugccuccugagugcugggauuaaaggcugcaccaccaugccuggccugacuagcuauauggauucuucuuuccucggcacugaugugaaauugugggagagcagagccgaggggagggcuuguguucaagugugguaccuuuggcgguuuaaagagggacccuggacuucuggcccuccuggaguggucgcaggaguagacuccugguguccaagucaaggcugauuggcuaggaaugcuucgauggggccccagcacaacggaaggagaaugggagcugagggguuuugcuugccugcguggucucagcacacggaucuuggcaccagauccuuccugccuucacccaucauugaaaguuacccauccguguccuucauggggagcgagccacugugucauggcaucuaaggaggugacugucuggucagauagaaccugucuaggcacaugggguggugguagcuuuaaagguuacacccuaauaaggucuuaaccuggaagucagcuggggccucaugaaugcaaagaaugauguuaaagggaaucacggccaggguggggcugccuuuuacugugugugauacgcauaggaacuaggggggagcugccuuccuuucuagcagagcuugggcaccaggugacuggaugccugguccacucucucccaggcagcccagggauaggauugucauagucaagcuggcguaaaaugcuugcguuacuugcccacccuuugcugcccuccccaaaccuagcaguggugucagugcggguaauccguguucgacuggagccucuuuggacugccaggaccaggcaggcaggugcuggccggggcugcggagccccauugcaggagucaagcugccagugccaacacugcaggauaaacaaggcugcucagagguugggggagggaggcuaccaaaagcaggagggaacaggugucucaggagcugcugacacaaagggcuucuuguuccaucuucccaucucaaggggcacccugcucccucccuucugccugcccagaguccaaugaccaggucaacugagguguugucuuucggccuguguuuaugcuugcuuagaacagaucgugcagguacaccccaggaggaagggaaccugccucucauaaucccauagcucagcggucuccaugggucugagguuugccuuguuggggcagcgagcccaagaggcauaggagaggagagagccuggagcuuggcagaggacaggguauagugaguacgggagugggggaucacaaggaauccgugggccuggaguagccaagugugacaacacccucuccuccuucauaaucauucgugagagaccugugguaaccuuuguuguagggacuggggacagugccagccgucaggaagccucugcagccagacuaagccuuauuuccucaucuguaaaauggggugauaacaggacugucugccucacgcucuugauggcucaccuguggagagguuugaaauccacacaggauuugugugaggacagggagggagcaugggcagguauauaguacccgacaggugagggugcucccuaagauacacuugcagcacagaccugucauguccaucaaaggaaacaauggucucugucuuuucuuuggcuuucuagaguugauggcuaggcuguccguggccugcguggaugggugaggcugggagauccaggaccucuggcuuuguugaggauucugccauugugcaggacugaacgggggaagccuguacucaugagugggcaucaccaggugugcgucucugcucgggcugccuagaguugcuccugugccuuucuuaugagggaggagcccccuccccaccccccuccccagcaucuccucugauagcucuauguguugcggguggagugugggacuguggacacucugggguuugugggcaugugaguuuaggacuguugccuggucucuuggagguuuacuuuggaaggcauaggaguauauagaaccuucugggcuccagggggcuccaccccaauggcaaagacccagaccagcccccagcagacccaggcagggucuaagaccuaaaguugcccacccaugggggcaggucauucaucauccauccugucugggugacagggcccuuugggucauggcuguguccuaacagccacagacagcucuucccagacaucuggaaggccgugcuuggcacgggcuguuguucucuccuggccuuugucacuugccaccauggucauguccagugugaauauauggcucuuucucuuccuccccugagucauguuuccuagguguccccaagguagacagagaccaacgagacgaguugcucugagggcaaauacuggggcauagggugggaacacggcucuggguucacacagccagguggucaagauggcuuuguaggaacucuggacaagcaagagaaaggaaggagcagcaggccccuggucuuuccacaggacuuuguccauauuuaauguaguuaagaguacagacaguacauagaacucgaauuuacagccuucguccagucacuugggugugauucucacuguuuuucucaaggugggugcuucugguccugccugugacuuucacucuugcucuccuccccucuacccccccccccccggccccauuacagaacauaggugcuccaccccuccccauuacauuacagaacauaggugcccagccucucccccuacuaauaauggccaucucuuugcuggggucagggcaccuucaggcuguacucagcagguacucaguacauguggcauaaagcagggugacaaggaccaaacuuacaggguuccuuggccugccucgcacccaugaaggaaggcuucguggugagggguagccacuagaagggagagucggaggcagaggugagccagcaggaaccgguuucucuggaagugacuggccuaagggagccuuucucucccuggccucucagagacucauguugaggagcagaaaggaagaggcccgugguuuuguuuuucagacugagucuguuaauagcaauuuauugcauccgggucuccagccaagcacauucuguuccccacuuggacauggcagggcuagacaggaaggaggaagggaucaacaguugugauugacgacggugucuugggcuaugaaggaggcgccaguuucaccacaggcuagcuugagccuggccuggcccaugucgggagauagaugcacggggaggcugggaagcagagugggcagcuccugcccugcaccaugccggaggggccucgcacguuccacuuucuguuugucaaauggaguuugggcuaugugauguugaccagaccugaaguguuuucuugagcacccuggaaagaccccuauaaggaaaaggagggcaaucaugcaagagaccuccagaagagggggagcgggcaagauggccgcccccguggaaagaauggcgcacgagcaaaacacccccccuuuuugcaaugugcugagcugguggaauuucacucagugggugcaagaucgggcagcagauagagaucugugggcuccugggcuguguguguguguaugugugugcagacugucauguggggguccaggauggagaaagcagggcuggcacccgggguaccccaucuucccagcugcucuccaugguuccugggaugcauaacugauccccacuccuggaggcaagccccccaccucucucucagguaagcgaacgucccccuuccuuucuccaucguucucccagauguucggcacugacaacaggccaucuccucacuuauucaagcccacuccuagaaaccauacucgggugaggaaccucagcucaggaaagaaagguggagccugaccccaaggguugggacaguggugcccucuugcgcgccagcuucaucccaagcaugguaccacucagugguuguugaagaucagguucacuuuuugguaaacacgguguguguuaggcaccaggcgccuggacaugcuuucuacuugugagguuuggcccauuguuguuccuagggacagcuaguggccucuuagaccuguuguuugaucucucuucucuggacugagaaucaucuuucucagagcucaaggcuccugccugaggcucaccaaaaggcagacucagcucaccacacccaggcuucauagcuucccuagugcccuucacaucagcguaugugggacacuguugggccagggacugugagggccaguccagaggcuccggagggagccggggacaaggagcagugggcagaaacauagccugcacuuagacagaguccaccugguucagccaaacguuggacccaggucacaaugcugggacuucguuaacaauggggaaacagaggcuguuucagagaacuuugagaauggguggcugguucauucaggcugaagugucucucauugucccaggaaaauucccagcagucucuguucuuuuccuuuccauuugaagccauuguugcugccuucccauugugugaauggcuggugacugaaggagggccuugccuuuacuugccaaggcucaagggugugggcucaggcuagcagcuucggagccauguugcgcucccauccgcccaacccauggugcccaaggguuuuagggugucaccaccuugacuaagaucccugcauguguaggcuuucugacucuggccuuuuuagaagguaaugauuugguggcuagcauuuuugagacagggucuuggguaucccagacugauuuugagcugugauugaggguggcagcgaacuccugacucugccuccaccucuugagugcuuucaggacaggugugugcuaccaugcccugcuugguuugauguauauuuuuuaaaugaaugacauugcuagaaacuuuaaucauuaauuaaacauaaucaagaccucauuguguaggaaugauugaauguggugggagacgaggcagccaugcucaacucucuggagacuguguucugugggaccugacagaagggggcuacagccaggucucaugccaguguuccuggacagugagauggagugggaugccugaacuaugauuucuggccaguauuggaauggaucucgcugucucugucucuguuucuuucucucucagacagauuuauuagauuuuaaaagugaaagcucuggacagguaagcugugacucucagcagcugcucaggggaggagaauggaggagcgaagggaaaugcugugcgacaugaguuaagccaucauggaugucagcuaggcccauggcggacaagcaaacuugcggcagggaggguggcuuuugaggaaaaaaauaaaggaccccaaagaauccgagaaaucuugcuuacaacggagacagaagaaaaggaaauuguuaacacuuuuuugcgugauucaagcaggcacacuuagaagcugaagccgugcggccgccagccuggaaacuguuuccuuagaguagaguuuucucacaguagaagagggaaucacaaaagauaaaaggauucagcgaagggauaccuauguucucacucuucaucuguggcgaguguggagcuggcugaccacuggccucguccugagcagggauagaacuacccugggcccugacaggaugccgcccgguacccugaucaugcucucuggaagaucuagugagagaggugugccucugcagggauggugggcacagacauugcaucuccagugucgucuucagcuucccacggccuucuuccuuuggaugcagugcuggccaccagggcaggcauggggaggguucuucaacaggcgaaugugaaaagugcccacguagagccuggccuggaggggucucaucaagguuugcugcuguuacccauuugcugcugugcccauuguguuauugaugaucauuucacccagagccaccaaggugaggccugcuauccugggcaucuccagcagggcugggguguggacccugaaagaauaaacuugcaggguaggcauaacaaaaaaugacagauugacucagaggacauugccuuguccgucuccuuuaguucucgccagguagaaaccaguggaggcucauaggcacgcuggaagcugggccgugcauuuuaagaaguuucaauggucaacagccuauagcuaaccuuuggacccugaugcuggaugcugcaagagacggcuuccucuucagaccauggcugcagggaggagucuugcugggucacugucccugauacaugcagguuccaccgauggcaacuggggccuggagagucaauaagaagugaccucuuccaagaggguccuggucugugguuugggauuuggaguuagucucgucgauuuccuugucugugaaaugggucuggcucgaaaaccagcccuguucaagauuccagggauguccaagggcugcaugccacugaggacggcugugauggggacagacacaaagucauaagcuuacugaaaacgacguggauguuuuguuuccucuuguaaguugguugugugguuccuuagcugacaugacagugagcggagcccuuuucgaucacccaggagacugccgugccugcuaugccugcugaguccuuuccccacguggccugcuucugguagaaguuagggccuuagcacacuaucuucacccaccccuucccugccuuugcaucaaaggcuggagcccccucaccuauaauuuaaucaucuggagaaguaauaacugacucguugugcaaaugucugggugaugugcgccaugccucugagcugaagguauccagaugacugggggugcauagggccguguaaaucauuugauguaucaaguacuuggacagaaaauaagugggcugagccccucccccaccccugccucaggcagggaagggucuuuugacuacuuuuguguggaagggggaaagccaggacuugaagaccuuaagagguaaggccagaauuguauccauccggagggggcucacaucugggcaggcucucucuaaacuagaaugcucaccagucagggcugucaggguggauagucccgagccgggaagaagaggguuaaauucuuccuaagugcagagccuggcuuuuccagugaccccaccaaugacccccugcccuccccugggucaggucugcagacuguugggggaggggagccacaggaggagcuucagcacucugauggauaagaaaugccccaggguugccuacucucucuuucaucaaacagggauggaugaaggugcugguggcuuuccagucagcauaggaagucccuagggucguuggggugggcugccaucggaagggccugcacuuuaaucaagcuacagaaugcaggcuguggacauggcagacucuuagauguguucuuagcaaggugggaaugaacauuguauuuugucaguaaaauacuagauaaaaaaaauuagaaaaugaaacuucagauggcccucagggcuagcgggacuugagggccagcuugugauuuguugaggaggaaaagaguucagggguagccgacggaagcuaguguacaugaccucaaguggacuauucccugaaaauugggacaguagcggucuguccuccccgguggcucuuccacacagggcagcuguggugucacuucacugucccguguccucuguagacaguggggcacccggagguaauguuauuucacagcccagcgugugcagcaaaguccacaacggagcugucuggaaaucagggguccagcuuccaaaaggcugcccuguuucagaagggguuuccaggaaaggcagcuuccugccccccagcuggaggaccuaaguacaccugugucuguguugcaggucgaagccuuuaaucuuucuuagagacagcagggagagaccuggauggcagagcugggcgcacucugucuggcucugaccauuucuagacucuucaauuaguggcuuuaauuauggccuucugagcagccugcugcccuucugaugcugugucagaggcuagucaccagucuguggagcucuugccucggccuauauguggauuaaaggugugugaaauacaguuaauagaguguguuaacugugagcacacgugugcauauggaaagggguacaagguauggaacccagggccucaacacauacuauaaggggguaaggggcgggacauaaucccagugcuugagaaacugaggcaggaggauuacuaugacuuuaacgccauuuaaucuggacuacagauuaaagccuugucucuacaaagcauaaaaaguauguuaaaauacacauagcaucaacguuaccgcuacacauuauaaaauuguaguucucugccuuuacauuguuauacaacagucacuaacucccucaucccuccccugaauagauacccagaaacggcuguucauggaauucuccauuaugcuccucccugucccuuugaccccugcauuccuagucccucacaagugacagcauacggugauuuguccuuuacauguguagcuuuuuucacuuagcguguuccaugguucauucaagcugcagugugucauuuccuuccuuucuaaggccaagaauccguuguaucuauaaacugcguauuguugguuugcuuccgccuuuugguugucacaguguugcucuagaggaagagcuuucuuucaguucuuggggcuguauauaccugggagggauugcuggaucagaugggaauucuguguccauguauuuguugugcauuucuguaaccccagcucuggguggucuccccacugucuacccgugugaaaacagccuucccaaugccugcugccugccagucuauuucaagaugggggccagggcagucccaugcccuucauuggccaggaagauauuguggauacaauuggggcuuguugcuugacccugcaagagcugugaacaggucacagaacuccucaccuguacugaucugggcuccauggucugggaaccuuuucugccaggcuugcugugagcaucccuaagcuggggagcaguacuggucacacaggaguggggcugguuccggcucucuaaagcagcucuccucggccccuuuagagaggggcuccaucagccagucugugggcucagccucugaguugccauuggcugugauuuuugccuccuaucuugugucucaucagucgggugauugauaggaacuguuucacagggcugaugagugacaugacagggcugaagcugacacuccacauuguuagucaguuccuguuuccggguugagaggcugccuggccucagaucuccugagugucugcuucuuucuccuuaacagaggugcccaccucaaacaauuccucugaagaauaaggaaguuaauaggaguaaaaacaauuuaaguaaugcugggcaugaaguaaacacucaaggaaaguuagcuaugguuggagguccucagccgcacaugccagggugacucaaccucucacuggagcugcaaacuugcccgauagcccaauacucgcgguucuagaaaacguuuuggaugucaacacuacaggugucuuucuucuuggugcugccucagggucccucccgugcucacuagucaucccaccccuuugccucgguuuccaaagagugucaguggucgaagcagagccuggggcuaaagcucugggccagcagaguacacacuucauccaguucguucuuagguucauucguucauuuguucguuuguucaaccaaccaacacuaaaguacgaaguuuuacucugucuucugcagacuugugcugagcgcuuuauauacagcaacuugaaagcucuccagccugccuucaagaagguggugugagcuccaccacagguggagacucgaacuguaaagacuggcagucucaguguucagcaggcaaggugggcaguuccccacuccugcccucaagccuccuaaucuauccaguugcugugguaacagucaugacagcaaccaccuacacagcccaagaaccuugggugcaguaguggcacacguaccuuggugguuaccaacagcucuuuaaugagauuuaagaaggcucaguaagagagaaaaucaugccugguacuagaaaucuagaugacuaagcuagugaagucauggauuuggaauauucauucauucuuucuuucuuucuuucuuucuuucuuucuuucuuucuuucuuucuuucuaucuaucuaucuaucuaucuaucuaucuaucuaucuaucuaucuaccuaucuaucuaguguaugugaguauacuguugcugucuucagauauagcagaagaaggcaucagaccccaucacagaugauugugagcuacuguguaguugcugggaauugaacugaggaccucuggaagagcagucaguacucuaaccacugagccaucucugcagcuuuuuuuuuucugucauggauuuugaaaggagaaccuccaacuaccagucuacuaaaccaguauaaucccugacuacauucuaaauaccuauccuuacacucacagauagguguuccuuuaucaaggaaacuucucuuugcaacagaugggaaccgguaaagaaaacuacaacugaucaaaauguggaguuguggagcccagcccuaguggauagauacauuuacaacuccugcaccuaagguuuggggaucauuuccagaagagggguuggaaagauuguaaaagccagaagaauaggaaauguacuguaagauuuugucuccuagaaauguuagaaaccacagccaugacgucucagcaacauggcugccucaugugaacugaauagagaugacacugacagacaugccaguguggaaaggagaaagcucacaaggccucagccagcccacacaugguagaaggucuguguagcaaagaugaaauucuucuuggaugauggguaaacacagcuuauugcagauugucucgaucauuccccucuguggccauccuuuugucuccauguuccccuuguucuugggcuuggcaugccgcugccuggguuaauagaauggcgauucacgcugaugggaggcaaaugaggcucuucugaggagcuggugaguucugacaugaugugucaucccaggcagggaagaugcaguaguucaugcucggugcagugauuggucuggauaagcaggccuucugcuuacuugggcuuccuucacaaaucuguauccugccuguccccacuguggguaucugaggccucaaaguacuugucagagagauauuacauuguuggggauaccaaaaggacauuuagggcaccaguucuggggguacuccuguuacaucagucacuaaagaggcaggaguaucaaggccagccugaggucuuaccuuaaaacuauaaagggcuagggggugcuuugaccagaacaggauuaaacagagagaggaaguauaagaaggaauagcuaaaauuaagggcccuuugagggguacuguggaaaccuacuauaguagaaguguuuguuugucuguugagucaggguuucucuguguagcccuggcuguccuggaacucuguagaccaggcugaccucaaacucaaaucugccugccucugccucccaagugcugggauuaaaggcaugugcuaccacugccuggcuagaagugucuuaaaaagacacacacacacacacacacacacacacacacacacacacacacacacggaaucaccaaauaauagagagacaaagccccaauuagacaucuccuugccaccaaaugaaaccuccagagucuaguugcauuguuggccaaagaggcaccauggaaaccccagacaaccuaggccuuuagcuguuguccagagugguaaagcacuguugcugaagacagcaccuacagaacucacugaccacagggaaguagggcuggugccucccuagagcccucacccuacugacucacguucacaguacugaacacuacucugcacucuaucaggggagaaagguaaacaccaacguagauacaaacccuucaucuaaaauggugaccugcccacaagauacaccgugcagucaugacccaguuugugugacuagccagcuaucucaugagaauccacgcuccacacugcuugggguggcagaggaccugaggcuuguaggccaugagccugagggaagccaaacaccacguucugcuuaagcaauaaaaagacuccuaaggacaugguuuucuuagccaucgucagagaaguuuccuccugcaguagauacaaaauacagagacccagaacuggacaaugugcagagagcgagaccuuggaaccuucaguccucaaugacuccaucagaucgcucccccucaggguucaggggacucugaagaagaggaggcagagaguguaagagccaguggggauggaagacaucaagggagcaaggccuucuagacacagcuggacugaugcacguaugaacucagagacuguggcagcgugcacaggucugugccaggagggaucccagcgcugagagggaagugggcgcaagaccccaucccuaauccggaagcuaucuguaguugauaaacugcuugcaagggaaacgcuaguucucuucagcugcgucccacuggaugugcaaaccggccuuaaggguaggcccuguguccaguaguagauggcccacacuaagugaacuaacugguauuuuuuggagugguuuuugguuuuguuuuguuuuuccuuacagguccuuuacuuacauauacuuuucaauuuugcguuuucacgagauuucuguauaugcagagugguuuuucucuguguauauguuucuugugccuuuuuuagcucuuuguuuucugcuaaacagguuuuguccuauuauaguuuguuuuuauuuuauuauuuauuuuagaugccuguuuucuaaugagaacgagagagaggauguggguuugggugggugggaagauggggagguaaacuuaggaggaggacaaauugauuagaauauaugcuacaaaaaaagucucuucaguuuaaaaaaagaaaaaaauuacaaaaauaauacaaaccuaaacucaaaaaccaaaacaaaacaaaagggcaacaaaaaaaacccaaaaacccaagggcugggaugcuacagcuuacuaacggagcucuugcaagcaugcauuaaacccuggguuccauccuuggcauugccucugugugugugugugugugugugugugugugugugagagagagagagagagagagagagaacagggaugggggaauggauacguugacagaagucaucuugaguaagggugugagauagaaccaaaggaugagaacccacguggugaagccagacuuguaucuuugcuuaucugaucaucuaaggauagccuuuauucccuuuuaucuuuucauuuucuugcagugucaagucuggaaccucauaccucgagggccagugcucuaccagugagguccagagguuggggauggagagucuaaaacuguuccauucuugcugcuuaggggccagaagcccccacccagaucucuagcauauaaauggggggaggggggacgucuuggagagugcaaggaucuuaggagucaugugccuggagacugaaaagaccaaauauucaucucaauuccagggaaggucuagggagcccuucucacuucucuuacucucggguccccaaccaugcauguugccagauucuugaaggauauaucacucuuguaaccacaaagcagguauuagauacucuguguacaggaagaagcagagggguuuuuguuguuuuaaaaagggauuucggguagcccaggguagccuggaacuucuaauccuucagcuccgccuccaaaguguucuguuaauacugucugauugaaacugggguuuugagaaauagucuucccuccaaguuccuuuccccuccccccuccuccucuuccuccuccuccuugaagagaguuuaagcagccuuggcuguccaggaacuugcucuguugaccagguuauccuugaacucauggagaucccccugccucugcuuccugagugcugggauuaaagguacaugucacuaaccauccaagugucuuggcuucuuucuuucucucucucucucucucucucucucucucucuuucuuuccuuuguucuuuuguucuuucaugacuuauuucauuuuaugugcauugguguuagcgugucagauccuuuggaacuggaguuacagacaguugugagcugccauaugggugcugggaauuggaccuagguccuuuggaagagcagcagugcucuuaaccacuaagccaucuuuccagccccagccuugguuucuuuugaucaccuuuuccuuacccagaacuuaucaagaccgaccuugugaaccuggaacauaguggucaguuugucuuuauuggguuaaaacauagggguagugggagaaugagugggcaccaaccagaggauguaagauguaggcuugguguuaaugagugacuucagacaucccuccuuugccagauaggaugucccagacucuggcuucuguaguguucuuuuaagaaagagauugcagcauccuguagugcuuguggccaaguaaagguauacugugacugcucacauuuuaaaaaaaagauuuuauauuuauaugaauauacuguugcugucuucagacacaccagagagggcauuagaacccauuacagaugguugugagugaccaugugguugcugggaauugaacucaggacguugggaagaauagucagugcucuuagccucugagccaucucuccagcuugacugcucacauuuuguuucuccuuccuuuggcuaauacccaggccuguuccuggugaacuugugauaagguugaccagucccugcugcaacagccuagaauucuucccuuccugggagacaagaauggcccagucaaauucuugguucuguuggaaugacgcacaccugaagauacauaccgucagcucuucagagaagaucucuuggggacggaugcaucacaguaucagccccagcagcaccucucucuugggucuaacuuuguauugauugacaaugcuuuggcgccuuucuguugcuggaagaccauguggcgguugggggaaccaccucaaguacugacucuuccaggccacugcucuccacucuaugggacuuguaucccucagaaagcccagugcugaguuggguucugagcuagaggcacuugcuggguggccaccaccuuucucaggcucugggcaggggcuagaguuucacugagccuccaucugccgauguggauagauaccacuuggccagccagugggauccaucaguccuggggcuggaguauugucuguucauagccagcugagagacuuaaaacagccacagcuggaccucauccaccauaggucugcugcaaggggcacggggaccaucaggaaaggguugcccucagccugcagccugcccagcucccagcccugaguaaacacagagauaggaucggguggagucaggaaggguggcagggugcggccugugggaagaauggcaggauguggcacggggcaccauucugggcacccacgccuugggaccauuguucagggcagcccgaggcucucaacucucugggguuucagaggaagugacauucccuuugggaccagggccugccccacccauguuacauggaucucuuucccugacgaugcccuuggcaccagccacucuugacaagcagggggcggggagggcagccauggagguuugcugugcccaaguggcccucucucugagggucugccugccuguugcauaugucuuccugugcccugggucugagucacagucagucgacgauaacuugaaccucucucugcaucuugugcggagggaacgggaacugugcaucuggagggaggaagggcugagagugaagacuuuucuuugauccccauucaccugggucuguggcugggugauuagaaaaggaaguggcugguggcuuguuuggggcagaaggggguuggcagagagugggaguuggaguggggaaaccggcuuguggggagaaugggggggcaaaaagguggcacucugccccuccucauccuuggaggggcuucuccaccccuuuauccagacacuggauucaaagucccaggcagcaguucagaaacucaagggagaagauggcugaagcccccuccugugaagggauggcacccuuugaggaugcuuagugagauaaaguuaaagaggaaggagugggagaccugcgaggugggcuuccuaggagagaaggaagguagaggaggcgcuuacuguucaaccuccuuguugguggaaggccucugacuguaguucugaaguagggcuaucccaaggagcacacacacuugacuucucuaggccucgcuaucuccauuuaucuaaaaacugggaugcuggacaggagggagggccacagauaacacaggagaacuuccacugagcugggugcugaugagcgguaucugauugauggcuccuggcuaggacuugggguuacagaauaggguagaacugggggaucccauaguugucuccugugcacugagggcuuuggguuuggggaaucuggaaagagggaaauccccugagaaggcauggcaugcguuuugcaaggaaggcguuauuaaggagauugauagggucuuuagccccuggagaagaaggggcuucagggaggcuccuaucaggucuauaagaaagcgcuugucccagcaggggagaaagaaggaggaaugagcucgcucugcuacugcugguguccuucacacagaggaaguacagggagcagcaucagucucccuugcuccaggcacugugcuaggaccuggggcuacagugauaaguguaaggugcaugggucagguucccaggcaaugggggagagccagaaacauccucaggcauucugaggcaucaccagcugugauugguccuuugaagaccaaguucaagguaccuugagaauguaaaacaggcacauuugauagguuaccucuucaucuuggguucucuuauccccauugugcagugcagggagucccaagaugccauuuccugauaucagauaacccuguguaugaccugaagguauugggugcguaugggaaaacuggaaaagggcauccacgggagaagauggccugagggacacgcuggaacucaaguacgugcugcugugucuauagauagauagauagauagauagauagauagauagauagauagauagagaugagauuggcugugcugcucagugguagaguacacacuaggcuggugagguccuggguacaauccccaucgaaaccccaaacaaacaaaaugauaaaacgaauuaggugacucuugggugcugaggcagguggaucugaaggucaguuugcucuacaccguuaggcccugucucagggaaagauauuuuaaaaaaaggugagcucaauguuuugucuagugcuaggaaaauggcucagagauugagagugguuaccgcucuugccaaggacaagugaccagguggcuuacaaccacucacaguuccagcuguagcuccagggggaucugaugccucugccuucagcaugcauuuaugagugcacacacacacacacacacacacacacacacacacacacacacaauuaaaaauaaaacagaucuuuaaaagauguaagagaggaacaaaaagagaggauguccuaucuaaccuaacccaucaguuuguacccacaacucguuagcuuugggacccuugguguguuugauacggcacauuccuaccggcacuagcugcauuacuggggcucaguagcuaaauguagccaguagggcugguucugggcagucaggacaggcaguggacucuucuguuucccccucagugggguggauggauggucaccacguccaguggggcagcacuuggccucggcguucaucugaccgugcucucuggcugcgguggcugugacugcuugcacugagguaggaguuggaagcccagaggcugggccuaaugaagaagaaaagcccuugggauccaaguguggccagaggaggcgaccugguggcagccagugggugugggacagagguggcugagagccgagggaucagaagcccacaggccuucauugugcgccugucacacuuccucuggcuuuauugcuuuuguccaacacccuauugucugguuuccuuuugucccggcuuucagcaccacugccuuuuauuuuccagccagccugguuguuuucauuucuuuugucugaaguuccugagaggaagguuuuauuuucagcgguuugauuaauucacagcuugagcccggguuuguuuguuauguaauuguugcccucagcuccgggguaauaccccgcccccacuccugcccccugcggggccuggcucccagccccuccccagccggaugggcugagcugccugcuuucugcagguucuccaggcacccccagaaccccugggccuaacugggcuggggucucuuuuuuucucuucauccaggugagaugggggaccucugaggguccacuagcccgcucucgcccugcucucucucuucuggguugcugaggcaccaggugcucagaaagugggugggggagucugcuguggucugaucugaagggugcaaucaaauacauacgugucaauuauaauauucuuguaacuggucuuaagacaccuuauguauguguucuguuguauacagaacuguaacauuauauaauugaguccacagugccagagggguugguguaagcuauagacuacaguauacccuguaccggguugaugugauggacagaugcacuugucccuuuauuuucgcuccacugugaucugaaaguauaagauggaaaauucuacacguaaauaauucauaauggguuuuucaguugucuugcuuuaaauguguuuguugugugugugacagggaggagguauuuggcguguauggcagucaggugacaauucuggagugguucuuaccuucgacauuuuuuguugcucgagcucagucagccaggcuugcacuguugggcagcaagcgccuuugccuaggaggcuucuugaucuuguuuuggaguuuuuaaaacagccucaugagcccaggcugccccuuaacuguuauguagccaaggaugaccucaaacuugugaccuuccugucucuaccuccugaggaucacagguguguaccaccaauuccagcuuuugugguuguuucuugagauacugugucuccguguauaaccuuggcuguucuggaacucacucuguagaccaggcuggccuugaacucagagauccgccugccucugccucccaagugcugggauuaaaggugugugccaccaccuggcuguuagguuuguuuuggcacacccaguuagguauagugcuggggaccgaguuuaaaacuuuguacauacuaggcaaacacucuaccccugaauuacauacacuccuuugucauacucaacagcggccccaaccugaagucacaggaaugcuggaaucccagugcuugauuggacagucucaucaauuuaagaacacuuaauuugccaugcagaaaauccggguuugguucccagcacccacacaguggcucauaugaccuguaauuccacuucaggggaucugacgccuucucuggcuuccgugggcacaugcaugugcacaaaaauucacucaggcauacauacauccacauaagaggugaaaguucuccauagagggaaaauuguuugcuaaaguugauaaaaccuagugagaagacaccgacugugggauggugaagaaaggaaaaggauuuuguuguuuuuuuuuuuuaaagauuuauuuauuauaaaauaaauaugugaguguacugucucucucuucagacacaccagaagagggcaucagaucccacuacagaugguugugagccaccauaugguuucugggaauugaacucaggaccucuggaagagcagucagugcucuuaaccgccgagccaucucuccagcccaugguuuugucauuuuugcugcaacucagacugcaagugaacagcuuuggugugggaccauggcugguuaagcuggggagugguacagcgacaggaaucugcuggggacauacaugucccauacguggcaaucgugugucgcacagccucuucuguuuaagggucuguuacagcaucuuaugguugcccuccgucugcucugaaaacugaaucccugugcaucuaaguccauuuucucccauuguagagagugggaugacaacaaguaccucugucuguguuacccacggcaggaggccacaggaauaccagucagcuaauaagccaaucaguucaauuguccaauaacaccacaugcacgccuaccucucagugacgacaucaauccauuugugaaggcagagggcuccugacccaaucaccuccaaagaggccccaccucccaauguuuuuccaagaggccagguccuugugugcuacuggagcgcagagcacaccucugagugcuugccccaggaacuggggagggugggcaacugcugcucuggccuuucgccugccgugaucuuggaaaugacauugcaaaguuccucugaugcucauccucuggugauguugagcggucaugugguaggagaggaggcagcuuugcacgagcguccaccaagcauauugcagguugggcaugguggcauaggcccgugaucccagcacuggcaugcaaggccauccucagcuacauaguucaguucuagccuggcuaaaugagacccugucuuggaauacaaacaaauguaaaaacccaagggauagggaugguaagauggcucagugguuaggaacacuugauggucuuccagaggaccuggauuccguuuccagcacccauugguggcucacagccaucuguaacucaagcucuagggaauccaauacccugcucugggcucugagguuaccaggcauaaaugugaaauacauauuuacauauaggcaaaaugcacauacagauaaaauaaauauuaaaaaacgauuuuuggaggaaaaauaaaaccacagagcugcacagauggcuuagcagucggagugcuugcugcucuguggaggacgguuuccagcacccacaucugcugguguagcaguucccaguuaacucuacucaaauccucccagcaguggcuccuugcugccugcgccaguguucuagguucugaaaugaaagacacacucaacacucacacacagucuuauauuuuaauaugccuuaaacagcucagugacugggcuauuuucaaaccuccacauggcuaacacaauccccucugauauuccggaguuauuacucacuaaaaccuaaaaccuguauuccaucuuggcugcuggaacccagaccugcagcccccaaccccaacccccccacggcgaguccccagcaccuacaugacagcuauguucucugucuugcaauaccucaggcguggcuucuauuccuuuccugggguggcagcuaucucccugacugcucuuccuuagucccuugucccggaauccuaaagucucgccuuugucuccaugcccagccauugacaacuuuauuuaccaaucaaaaccaauggggggggggggguugggcagggucuuccgugcugaugguggcucacuuccaccuugacuccuccaccuucaggagagcugaugcccuccucuagccucucggcaucccccugcacauauccacgcacauaacacguaauuaaaaauuaagaauaaaucuuaaaaaaacaaaaaaacaaaaaacuccucagcaaauccccaaguuuggcauuacaaguaucagugccagcaggggcagacuccacuagcgaugcugagcuagagagcagaacagaaugccauucaucuguauuuuacaaugaggcaugugauauacagacauguaaauauaagaaauauuucacuuugacuugucccugcagugagaagaaugacuggcuguagguucgucguagagcagaugcguaacuuguguggaguucuagguuugauccucaaguccauuaaaaaaauaaaugucuuguacuagggagaugguucuuggcuuucuuuuggucaaauugggaacuaaggcaucucuguaugcugugugugcaggcuccugccgauucuagccauguuggucauugaauuggaaguucuaauccaauuauuuugggggauagagucucacuggcuaacuguggcuauucuuugaacucacuuuguagaugaggcuggccuccaacucacagacaucugccugccucugcuucccaacugcugggauuaaaggugugggccacacguggccgucaaauucaggcucuuauaaugcugacucucggucugaaucuguagucgcuacauccagggcacacauacaguguucaguucucuuggguucagaagcagccaguuagccacgcuggcuuccucuggugagccccucagcucacuagacacaacguugcaaguaccgguggccugaggccgcagcucggcuggguucacucugccaugugcgaggcccuggcacugggaaagaaaaaggagaaagccaguccuaaagcaggcuuguguaggcguauggaucuuugagcagggcugggaggugcuuuguuggggaaacaaaggguggagguacuuccuggcgggcagaguggguuuauaacugggccaugggccucauucacucaguguccucugucccuccuucugcaggauguccaugcagagccccgucucugugcagcuggccccagacagcgcuagcaccauggugaacugcaccaucaagucugaggagaagaaggagccuugccacgaggcuccccaaggugcagccccugcaguggagacccagccuggagacccggcccuggccucucaggaugccaccaacgcuaaagcuccuccucaggugccuagcacucuccagggacccccggggucagugugcccacuccgccggcuuuguggcuucacaacugaggccaagucacucauuucuaacaggccugcauguucuugccuagcucuugugugcagcucuucucugcaagggcauuguggggccuaggugcgcagaggggaggagccacuguggucagggcuacaaacugagucaccugucagagcaggacaggggcuaaaugcguucaucccucccugugugacauucucagaggccagaguccuuguaccugaugacuaguuggggacgagauacacgugaccugggaaagauagucucauggaguuggaguaaaacugcugcuccaagaaugauuucccuaagaugaggggacucagguuggagagaugauucagggggugaagugcuugcugcacugugugagccuggaaguuuggguuccuagaacccuugugaaaaagccaggaaaguguggccgcuaccuggagccggagauugggagccccuggaacaagagaccgggagacccgacccaguaaauaaauaguagugcuugucaaaugugggccuacagacagacagacagacacacacacacacacacucucaaauauacuugccucaguaaauaaaugaguguugucaaaugugggccuccagacacacacacacacacacacacacacacacacacacacacaaaaaugcaucugcaucaguaaauaaaugacaggugcuugucaagugugggccgacagaugaggacacacacacacacacacacacacacacacacacacacgaaagggaauugaaguauaugguagggaccucugcaggucuacaggaaauuuauuuugauaacucuaaagaggagcccaguuuggaagagugagugggaaggucaguccuagaggacugagggccuuaggcacaggaggcguggggcuuccguuagaugugacacgggacacugcugcugcuucugcagcggcauggcuguggugccaccgccgccgccuccucuuguuuuuguuuuuuguuuuguuuuuuguuucuuuaugaucaggcuggcuaggaacucacagagauuccccugccucugccccuugagcucugggauuaaaggugugugccaccaugucuguuugaaugcuucuucuaauauaaugaggguuuuucuugccugaauguguguaaguguucuacgugcgugccuggugccacagaggucagaagagagugucagauccccuggaaccggagugguugugaaccaccaugugggcacagggaccugaaccuggguuuucugcaagagcaacaaauacucugaauugcugagccaucucaucaggcccaaauuuuuuguuuguuuguuuuuugggguuuuguuuuauuuuuauuuauuuuauuuuuugguauguaucugucuaggaguaugugcacguugagugcaguugcccucagugaccagaagaggguguuggaucuucuggagcugggugugggugcugggaacuaaacucugguucucuagggcuuuguuccagcuccagggaccacuuagggaagccacaguggguaccuuuaagcaaguaagcagccugcuggagcagcauguggguucauaguaacgacuagcugagggugagcucuguguuagcuccuucucuagugcugggacagaugucugaacaaccuacagaaggauuuacuacaguucgaggguaaauaucguggagaagacaugauggccaggaacuugaggccucuggccacggugcgucuguagucugguagggggcagguaaaacaguccagggucccacauucagaaugaaucuccccuuaucaguuaaaccacccucauagacaaaccuagcaguguguuuccaugguaauccagucccaugaucggccccuccugaaguacuggccucuuucagauacuuuaguaccaagauuuuagagacaggccugacuuucagaguugucaggggcuugugugagauccagcccagccuggagugaaacgcaggucucuugcuguccccaagucccuguucaugucacugugucauuuaucagguccuaugagcagggguugggaaugcuuuaggguuccucagaaaggacaccuuugugcugcuuagcccucuguaccacgugcuuucuaucuugggaguggcagugauaauucugugucucuuacaggacugugccucaccagagagcaguggguccccagaacccaagagaccagcagcuuccgaggcugcuucgggaagccaggagcgccuggacuucaaccgcaacuuacaggaggguaggcaggauaccugucgggucagaggugaggucuagacuagucucugcuggcccucacccugcccuucccugcccuuccaguugugccagccauugagaagcugcuguccagugacuggaaggagagguuucugggaagaagcaauguggaagcuaaggaugucaaaggugcguacaggccugcguacagagggcagggagggcaucuuagagccuuucccuucuggucuggucucgaacgcuagguaaacugagccguaccucaugcaccuguccugugucuuugaucccaccuggucccaccugaggguccucacuaugaaggguccucgccuagaagacucugagcaguagucugguccauucccagauggggaggccuagauggauccauuccugggauccaucccagcuuuccuucaggacccuuggggcuagaggcucagcagucaccuuccagcucucagccuaccuuguaagggagcugacaguuuguacucacuguuacuguuggaguugaggcugggcuuucgggaugguagggagagcugcugcuuaccucagugaucauuuugucaguguucucgaccacacccacagugggagcuuuacaucaaugcuucugcuccccuccccucucuccccccucccccauucacugacugggagucccagggaugagggccugagcugcaucuuccagaggcauccuggguauaaaugguccccaguucagcuguuaggaccaaacugccauaucagacagccagguugaaauggaagguggggacaugagcacacauugcuguccccaagccaaacaaauaucacacauuagcacauucauccucauacuaacccugucaagugacugucauugugccaaccaguagauuaaaaaagaaaaaucccagggcuggagagauggcucagcaguuaagagcacugacugcucuuccaaagguccugaguucaauucccagcagccacaauaguggcucacaaccaucuguaaagauauccgaugcccuuuucuggugugucuggaaacaacuacaguguacucauauaaauaaaauaaaucuuuuuuuaaaaaauccccuaaagcacagagagguugaagacugggcuggcaggacccugagacagagcacuugucagaugggugggugggcagauagacaggugaacuaacaagaacucccacagcagcauuucucuguggaacagggacccaagagagccuggcugagaaggaacuccagcuuuuggucaugauccaucagcucucugcccuucgggaccagcuccuuacggcccacucugagcagaagaacauggccgccaugcuguuugagaagcagcagcaacagauggaacuggccaggcagcagcaggagcaggugugccuggguuggggcuucagaguccuccauggggaagggugacugcugaagagaaaaccaggcucugagaacuggcgcccacucggcugugcccccuggcacuaggcucuguccccuggugcucugcucugucuccuggcacucgccuauguccccuggagcucagcucuguccccuggcucucugcucuguccccuggcucucugcucuguccccuugcucucuacuuggccuccugggggaagucagggguaagcugggacaggcgcccgaggagggccugggccguccgugauccccuugucaacuccaugccuccccagaucgccaagcagcagcagcagcugauucaacagcagcacaagaucaaccuccugcagcagcagauccaggugcugaugggaggggcgcaggccaaggguggcacuggcccggggaaccaucgggaaagggguguggagcaaucccuccuccaugcacugagccugaugaagagaccauacuuuugcuccaguucccuccgauucuauuguccuguuuuuagagggugacccaggaugucuuccccugguccccauugagauguaaggacaaggagauggguucacagaugugauaugguagacagaaccauuggaaaacuguucccacucuguacccuguguguacucacccccccccccagguccugggcugaccccccagcuggacagcucuuuggugcccagggacuuacaguggguuucuuugccuucagcagguuaacaugccuuacgucaugaucccagccuuccccccaagccaccagccuuugccugucacuccugacucccagcuggcuuuaccuauucagcccauucccugcaagccaggugaguggggcgggcgggaggccacagaggcagcuuccuugacuugagggaaggaguccggggccacaguuugggaucugcccaguggaagaacaaguccuuucugaacuuagucaggagaaugaaaaggaagagugugccgccaagcucucaggagacucagaaggcucucugaggagguggcgcuugaugguuggguccuggagaagggugauaggauccgugagggagaaacuggaacugaggugcgaggcucagcgggaagggcuugcgugugagcggugugagagcgacagggauccgggaggaggcuguggaggauuggaagggagugccuuggaacacuugagcagggaguguguucucucuggcggcgggggaugggaaugaaggugacagauggaaggaucgcagugaguucuggugacagugcccacagacagaguugggacagggcggacaugcugccuguaaaugccacacaggauaaguagcagugaaaacaacucguaaucuacccucccuguuccacgugaccgagacaguacaggcucccagccacagagccaaccaggcuugcuagccugaguucaucauccucaaauauccuccaucuuacuaccccaacuccacccuggcugaaacugaguguccuccucugagcccuuaucacuaccugcugugcugcuagugauugauacacagucuuaucucugcugcuuuccuucuugauucuaagcccagugagguaaaguagauaggagggagagaacugucuaggccaagggauggguuauggagucuagaccuggguucaaauccugccgccgccgccauuuaauuuguuuguggacagcccgcugaauuuacaaggucuguuuccuuaccuguuagguuguauagagagcccugacuaauacaccuguaagaugaggcuguugcuuugaguaacccuuacguaccauacauuuuaucuuagaggggaagcacacgcaguagcuuugcccccuacacacagcagggacaagacccgagggugccgucccuugugugugcauggggagcucuuuagaguggguuggaaagggcaggcaaggccaucagccugcaggggccauaugggaagagggauagaugguucccugcacuaccuuagccugacaacaacaggaaagguuggaccagcucuacacucugcccugugguccuggggccugucacuuggugccugcuauucugggcucaccugggacuuugucccuugccgcuuuucuuuccccaguggaauacccacugcagcugcugcacagcccgccugccccuguggugaagaggucggggguggccgcccaccacccccugcagguacuccuuugccuaccuuugcugccugggagccccucccuugcggagccaaugucccucuuugcucuuggcucacucgccuugaguccugucuguccugugauggggugguccuccuuggguguuucucauucucugucuuuuugggucggcaggagcccccacaaccacugaaccucacagccaagcccaagguaccugagcugcccaacaccuccagcucucccagccugaagaugaacaguugugggccucgccccgccagccauggggcucccacaagggaccugcaauccagcccccccagccugccucuggguaagccuuuucaucugcucucaccuuagacgacagugagucgucucaccuuagacaguugagccagacgccaccuugggcacgguccuucccuuucuccguucuaguuugggguuuuuaaacaguucuaagguacucccaucaccgagcuccaccccagccucugcuuucuuaaagccggggaugaggcuugcucugaggacgccuccuuccauggcgccuuuguucuccaggaucagauuagacagcauggggucaggccacugagcugcgcaucugagagaguugccucauucccgacccuuggcacccugcagcaggcaguccucagggagguguggggaugggcagggaguguacugccacaaggagacccuuaggugugacguggcaggaagcauaaauaugugggcugcuccugggacaaagcccucgggucccugcccuucacuuuguucccucuccaaacaggcuuccucggugaaggggacgccgucaccaaagccauccaggaugcccggcagcugcugcacagccacaguggggcuuuggaaaacucccccaauaccccauuccggaagguaugggccaaucuuccucugcccagaggacaggaagaugaagacaggaugacagaggaaguacucaugcccacauugucucugucaccugcaggaccucaucagccuggacuccuccccggccaaggagcggcuggaggagagcugugugcauccccuggaggaagccaugcugagcugugacauggauggugagagcucuggcgcugggcgccacuuaacuccacuagggcuguguccgucccugauuccuuccucccuccuuucuuggguccuuccuggcaugugucuccauuguucccuggugucucuauccgugggucgucuucugguaucuuguaacaacucuguggagcccugcuucucuggaucuuugcugugccuguucucuggccguggugggccucugcuuaccgcuggccuucgcuucccuccucauccucuacuuccugccuugcuaggccugagcugacuucucuaugagccucaucagugccuccugguggccaugcaagggauaucucugccagccccaaagcuguugccugccugacucuuaccuacccauccuccaggcucccgucauuuuuccgagucucggaacagcagccacaucaagagacccaugaaugccuucauggugugggccaaggaugaacggaggaaaauucuccaggccuucccagacaugcauaacuccagcaucagcaagauccuugguaagggccagggcguggguccucugcagcucaggguguugagcccaggggacauagcucaguaggacugggucuguuuggaguuuucaugccuuauugaauccugguagaaucuuaccagguguagcaguugagauguucuuggcagcuggauccuaggaccuuguaccagcgcagggcucuuuugguugucccuccccuugggauuuuguguauucuuuaccaccuccaaacacccggugccucuuauggccugugcuuuggcagaaaauagagacuagcauuguggaccauugguauagagacuuugugucagaggcugaggagcgggcagggccgacaagucugaauaagggugguguuuucauggcugaguccccuccaguaacugcgcggguuucuugucuggaacaccaggguuguuuucggcuuucccaugucuacccuggcccaugcucuaccacugagcuacaccccagauucacaucggauacuugauggcuuggaguggcugcucuuucgugaaugccuuuggggcggagaccucucaggggugccgaguuguuugacaugagaaugguacagacuccccgucauugccagccucaucucuuccuggcccagcauccagggagcauccacacuuggccaggcccuugaugagugcuuaugccuuaucauuuuugaucccaauugaagaccaggguccaaucaggacuucuagcuagggcuuggaaccuggugggguaccacgagagucuggcccuuaguuuuugccugguauuggaucagguucucgcuggaaguccaugaccaaccaggagaaacagccguacuacgaggagcaggcccgucugagccggcagcaccuggagaaauacccugacuauaaguacaagccaaggccuaagcguaccugugucguggagggccggcggcugcgagugggcgaguacaaggccuugaugaggacacggcgccagggugcucgccaaagcuacaccaucccgugagcaggcccucccugguggccagaggcggcuuguggcugcugugagagacugggguugugugugugucuggucuuugugugaggcaggcagagcagccagcaaggaucugggagcagaguugugugccaucugccugugugugaccccugauggauaaugacugugugcgagacuggugacugggaguuggguauaagaccuaaacuggggcaccugcagccugacaaacgcagggcaaauugagaacaccacagguauucaucccguaggaaggccccuuauuugaccaugacaggcacuaggguagaguucuguggucaaugacacuaaaacaaaauaauauucacgugccaccguccaacauacccucgacucugagcuuucgagcuauagcuggcagugaauuuggccaucaggaagcacacgcaagggccagaguaugccgguuacccagccugcagggagggcuggaagggcugggagggcacauggguacaucuguaauugcgaauuuucucugccucucagcccgcaggcuggccaggcacaggugagcucagauauccuguucccucgggcagcgggcuugccccuggcacguccacugguggagcacuaugacccccagggccuggaccccaacaugccugucaucaucaauaccugcagucuccgggaggaaggggagggcacagaugacaggcacucgguggccgauggagagauguaccgguacagcgaggacgaggacucagagggugacgagaagagugaugaggagcuggugguacucacagacugauccccagcucgcugggcccggcccgucaccgcugggggaaagaccuuguucccauccggacaggcacagccagccuuccugaacuaucuugguacuuggacuuggguguggccaggugaugggugaaacugcacuuguagauacauucccaagauggggguccuccucuucaucacaccucugggcccaucggaggagccaauggccuggcugggugggagucauguggccgugguggacaaagcuugcugaggguuuuagcccuuggggacaauggccagggaccacuggauguacuuccuccugucugcccacccacucaaggggaugacagggacacaccugccccccugaggucacaugcuuuguuuccauuucuucuugguccagaccagccauugugggacaacacaccugcccuacaagcucccaggucaccccucugccaccuggguuacuuugaacucugcagucuggcugugcugucuuuugucuuccaaguccaugugccucuggcuacugugugucugugcgcggcccacacauguucaucacgccacucuuggcagaaggcauuugcugagugucacugugagccaggcacgcccgugagcucugugaugugugucuugaugcuucucugggggcugcuucuguguuccuuuguccccacauugcuaccucuuugucagucuggugucucagguucugcguauuuucuccccauguacacuucucccucuuccuccuccgucugucccugucccaccacacccgcuguauccucuggguguuuguagggcccagccugccccugggacuggcaguuccugacccccaugaccccuucccucccuucagacucugccagucaguucccacggagccauuuuuagcucccagggccgugagagccagcccaggccuccaagggggcucugcccugauucccaacgugugugccgcagucaugaggaucuuuuucucagugacagcccugcagaggggaccccauggcagcuggucuccaucccuucuucaugagcuuaggguggcuucuucccuccccccccccuuuccuccuaaauuagcuuccugguuguaucccaaggaaaucauuagcaccuagucaaagaucuggagcugcccuggggcagggaaagaccccaaaccccacaaggccaggugcuucccuccccaccgcuguugacccuauuucucuccagacuguuucuuuuuaugacuguaaacauagauagugcuuuauuuuguuacuaagaagauaaugaugaauaacuuaaccagcauauuuguuuucugauggguguaauaaagaccgaccauuucaggacgugcccuuucucugcugggaggcuggccuggccgaauucucgagucuagcgccag

SEQ ID NO: 369 - RNA, 6642 nt, Mus musculus
uccguuuccgggucuugcuuccggaagucgcuuuccgaggcggccuuccuacucguguggucuuugugacuuccaccauggcguaccgcggccagggccaaaaggugcagaaggugauggugcagcccaucguauccuacgcugcgugaacucggggcuuugggggccguaggcgccgugagcgugggcggggagccgggcagcccgcugcgggccgcuucccgugaggcccuggggcgaacggggaggcaggaaagcgcgcggaguugaagggcggcgggaggcgggaggcggaaggcgggcuccggguggacccggccaggcuggcgauccgcgaugaaagcgggggauaccgaggaggagaggaggaugugggccaucgggaagguuggagaaacgagggcgguggggagggagcgcaugcucccggcggucguuugugcuugcggauguagcccggccggaccuuggggcgcuggagaguccggcgcgguugggagcggaggcuccgcuguuuguguaguucuuuuccuugaucgccgugcugcagaaccuuaucuucagauacuugcaaaauguacguaaguuguuuccuuacuguuacugaaaugaaaguugggccuguuugacucuuuguaacaaauucucuguuucuagugcuuagacuaaaaaauugggggggggggagaaccagaguugaggauaaggucacagggaaagcgcuaauuauuaauauguccgugcugacuuaaggaugcacacaguuaccauuauucuguaagaacaauguaauuauauuuacuauuaaaauuacucuguaagaacgauuugucaucggauuuagcagugacaguugcauagugcuuuuuccauaguuggacuuagaauggagaaaagacaccaaagcgggguuugggggagugggggcguuauauacagagaagcgaguggcaaaugcucuucuuugaggagauuuuagcgauguuuauuuuagaguguuacaacacagaugaaaaaucguuuuaagccauuguaauuuuuaaucgccagauucgcuuuguacuauccugugaacaguucuaacuguaaguguauucaugccagaagcaaaaauaaauuuucagaguaggaaaauuaguuuggacaggccugcccgagcacuuauuaaauguuucucagcagguuaaccaguguugcuagcucuuagaugaagacuaacuaguucuaguuuuuggcuuauauuuauuggaauuuuuaagauaagucguuuauuguggaaacaaaguaauggagugggauuuguuuacauuucuaaagucauuauuuuuauuucagagaucucgaauucagguguggcuguaugaacaagugaauaugcggauagaagguuguauuauugugaguacccaggcuauuuuuccucaaguuguuauuaaaaaagacaucucagaagauggccaguaagaacaauauacaaggcgucaaggacccaacccaaagaaagcucuucagagcuggaguuauuuauuuagccuuuucuccuugcucugguuaauaggguuagauaauacuucucuuaagaggaagggaagggagagguuaggcggugguggcgcacgccuuuagucccagcacucgggaggcagaggcaggcggauuucugaguuugaggccaggcuggucuacagagugaguuccaggacagccagagcuacacagagaaacccugucuugaaaaaccaaaaaaaaaaaaaaaaaggaagggagaguuaagacuuuuaagaagagcuucguuugugaggagagggaacaaaaacaaaaugagaggggggcggggagugauaaaggacuugcauucuggauuagaucaugccagaauagagcuggugggggugagacuuaugguuuguuaggcuucuaucgugaugguguuggggaucaaaguaccugcucuaccacacagcuaccauggcaauaaguuuuuguuguuauuuuagauuuauuugucugaguguuuugccuguguguguuuaaugcccaaacaggccagaaguuguuggcucaccugaagaugggugauugugagcuuccauguaggugcugggaaccaaaccuggguccuuugcaagagcagcaaggaaggauuuguaacuccaccaccucucccgucucuguuuuuccuuugugugaggcagagucuuuuaagagagacuuacacauggaaauccucuugucugagccucuucaauguuuagauuaauagccaugaaaauggaaaaaaaauuuuuuuaaagauuuauuuauuuuuaugugcaaugguguucugccuacuguuauuugugugagggcaccagauccccugggacuggaguuaucaacaguugugagaugccaugugggugcugggaauugaaucuggguccucuggaagaaaagccagucuucuuaacuacugaacuguccagcucuggcauuguuauuuugaggcaagaaauugcuauguagcccaguaaaggccuugaacuucccauccugccucagccuccugagauuuacagacgugcucagccucacuuuuuuuuuuucuuuuuugcaucaagggagugagugggguugcuuuguacauacucauauguguggauguaugugcuagagguaucuuuuauugcucucugcuuuuugagccuggaacucauggauuuaacaagacuaguuggccagcacuaggugcggcugcaggccacugugcacugcauuguuugaguagggauccaaacucaugacugcauguacuuuaccaauugacaugucucccuaguaccuacccuuccucccaaagcugcacaguauuuuguuauuuuauguagauaucaagagugucuaucaauacucucuuaggaguugguaaacaagcacaguaguuagugggagucguguuagugaggaacaugggugugcagugacagaaggcaauucaugugugcacaugccgaauuggguaguguccagcaggcauuccuggcgaauauuuaccucuaagggauugaaguacuuuggaucucauucuagcuuucuuugcuauuuaaaaagagguaggcuggggaugcagcucaguaguaaaccucuugccuaauggguagaagucggugcgcuaauccucaacaccaucucugcccccaaaaaggaaugaaaaugcccccacgcauugggcaugucacauaugaccaggcaugguggcacauaccuguagucucaacacuuggaauagagaggauaggagauuugugaguuuaaggcuuuccuuggcugugugggaaguuuagggcaaacauaggccacauaagacgcugucucagaaguaaggggcucaacagguaaaaguauuuacuauucuugcagaggaccaaguucaguucaaaguauauaccuuugauggaucacaacugccuguacuucuggcagguggaucuagugccucugcccuccuuaagcaccuguccuaaugugcacgcaucgauccaaaaauaaauacauacagguaacacuuuaaaagaauacaaaguaguuaauaaguaaguagaggcuguagguguuuguguugaaaaaucagugauagcauaaaauucuaaaauuuguugauauuucugaaucuaauuauucuuuuagaauggucggaugugauuugcuuaaaaaugauugucauuugccuucccagggcuuugaugaguacaugaaccucguauuagaugaugcagaagagauucauucuaaaacaaagucaagaaaacaacuggguaaggagauaguuggcuuuacagauuucuguuuauuucacuggcagacuugaauggccuauagcugaaaauucaugcuauaaaguuacauuugaagggagaagcacacuucugaauucaucuuccugccacuuacucuguuacccacuccuuuguuuuguucauugauagggucucagguagcccaggcuacucucagucuugcugagagugacagauugaacuccuggccuuccugccucccccucccaagugcugggaucauagacauucgcaaccaugccuugccaaggauguuaaaucugaugucguuuuuuguguucacuuauauuuaacauuaaguagaauuugacacaguucaauacuuccuugcaauacuuugauaucuuggguuugugacauaguaugucaguuuuuauucaacucuggcuguuuuuuuuuuuuuuuccagacuucuuuauauucauccuuuuuuacccggccauuaaguauuugaggcuggguuccagcucgcccuucacagucuuucccuaggccagcaguucucauucuguagguuaugacccuuuugagaguugaacgauauuucacaguggucuccuaagaccaucagaaaacacagacauuuacaauaugauucauaauaguagcagaauuacaguuauaaauuagcaauaaaaacaauuuuauuguugaggguccgcacaacuugaggaacuguuauuaaggggcugcagcgcuaggaagguugagaggcucuguucuaggcuucuaguguucagugagaucacagcuccagguacuaaucugggcauugacuuccuuauuuauguguauagcccaaaccucuucugaaccuguuuaacuuuccacauagaagguuuuuaaggcagccugucagaagccaacuucacugccugcuuacacuguucagcguggguuugcugaucacuuccuaacggaacaguaguuuccacuaacuuacuaacuuuuguagcucccucauccauuugaaguugcucuccagauguagccaucuuuuugaaacacugggucugaccuuaccagcuuuugcuugaaauuuuccauugucuguuuuuccugaggggacagugugauguuuuggcaagagccuucuuaucuggccugauguucgcucaucuugauucacacugucccauuuucugagcagucuccaugcuugucuccuuucaguuuguuuuuuguuuuggaggguuuugggcuggauuuuuguuuuuuggggggaggggggcugguugguugguuuggggguuucucuguagucuuggcuguccuggaacucucuguagaccaggcuggccucaaacucacagagcucacugcuuccuggagugcugggauuaaagcugugugcccccauugcccagcucuucuuucaauuccuuaagccugcacauuggccucacuuucuguuugagguaggaucuuccuguuuagcccaggcuggccuuaacucugagauccuugcuucauuuucuaaauggcaguguuaacacaauuaucacgccaugguuauuacacuugacuccaucaaauauugcuacguguauuguucacugaucaaacuuucucuaggaaacccaaauuuaauuuaguuuuucugggaugggagaacacaagaugugauauguugacucuguagugaaucauuuauuuuaucguugccucuuuguuagacugcaugcucccugagugcaugagucauguccucucugcuuccaaugaccaccguagugcuucacauaaacucagaaagcccagggaacaagaggacccauggucucauuaagagauacuuuacugagguuagguuaucuuuuguuagaauagucagugcucacgugcguuuauuagugauggaguucagguaucucuuucccaaacccuacugaccaaagcuagauagguggaagguagauucuaagaaaugacucuguuuuuauuugcuuuugaggugcucuaccucuauaacccaggcuguccgaucuuaccuuagccuuccaguacugggacugcaggugugcacugucucacgcagcaagaacucaggcuacugcagauggaauugaaauguauacuugacaaacacucauuucuaaacccucaugaacuuaguauugggagaugcuguauugggccuuuucacuugaccuagacuauaggaacuauguuucauuaaaacagcgcuguuucguucuguuacugaaagcccaguagaccugguggaagccuucaauauggacgauugaaaauguucacauagcguuaugagagagagaagugccucaguacuauucagagccaaacucugaggcugaaagauaaguaaaugucucucucugauuagucacagcuuuuguaacacuuuuuuuguuguuacaggucggaucaugcuaaaaggagauaauauuacucugcuccaaaguguuuccaacuagcagugaauggugaagucuguaggauguugagaagaccccuugagcguguuuaaagaugucugcugcaaccugcauuuacucaacuuguuuuacuugcacauuauuauuaggugacaauaaaugcuguaggaaguuuuuguuaaaauuuuacauuguuucauucugguggcaaaaugcuuuuaccuagggucgguauuuaagguuucugagggcuuccagucccccuugacauuugcuuuucucggagcauggaucuguacguucuugaggcagauuaagaauucugccugcacagguaagcugcuaagguugguggaaaaggcugggggggaggggguaauugaaaauaaacaaguuuuguuuuuuac

SEQ ID NO: 370 - RNA, 2423 nt, Mus musculus
gaggaggaggaggaggaggaggaggaggaagaagaagaagaagaagaagaagaagaagaagaagaagaagaagaagaaggaagaaaagaaggagaaagaggagaaggaggaggagaagaagaagaaaagaagaagaagaagaagaagaagaagaagaagaagaagaagaagaagaaagaauggaaaagaaaaagaagaagaaaaagaaaaggacccugucucuuaccuggguuuccuuaggaaaaguauuuuggugaagggcagccaguguuccccagugguuucuggaagugaucauucaaaaguagggaccagccuagaugggaaagacucaggcucaucuucuuuuuuuuuuuaauguuuuuggugggguagugguggcacacaccuuuagccccaacacuuggaaggcagaggcaggagaaucucugugagguggucuacagagugaguuccagaauagccagggcuacacagagaaaugcugucucaaaaaaaaacaaaacaaaacaaaaacaaaacaacaacaacaaaguuuuucuuguguuuggguuuuuuaaaauuuuuuuuaauguguauugguguuuugccugcauguauaucugugugaggaugucagauccuggcacuggaguaacagacaguugugagcugccauguuggggcugagcauugaacccggguccuuuagaagagcagccagugcuuuuaacugcugauccaucucucuagccccuguuuuuguuuguuuuuuaauaauuucuuuauuuguauuuuauauacauugguguuuugucugcauguacgucuggcguggggaugucagauccccuggaacaggagcuauagacaguugugagcugccauguugugcugggaauugagcccagauccucugaaagagcagccagugcucuaacugcugagcugucuccccagcaguuagauuuuugguugguugguugguugguugguuuucauaugcaugaguguuuugccuguaugugugucuguguaccuccugccuggugcccagggaguccagaagauguguuugacuccccugaaacugaacuuacagaugguuuugagccuccucaugggugcugggaguagcaggugcccuuaaccacugagccauaucuccagccuaagaauuaucuccugcuuucuugccugucccagauuguucuccauaggcauggaccuauggaacacugguuuccuuaaaauggagucuggaaaguaauuaaauaaauuuaaacuuuaaaggaguuggggccuuauuugauaacuaacugaugaagucauaaaacaguuacaacagaacuugcuuuuucccccauuguaagugccugccuaaauacccuugcuagaaaggaugugugcauaugugcgcucucucucucucucucucucucucucucucucucacacacacacacacacacacacacacacacacacacacagccuguaagauccuuucugaagcauggccgcauaccucuccuuuuacugucccaucuacucaucauugugccuauuccuaggccucucuguuaagccaucagauccuaaagauacaaccuccugauucagguaugugguaaggaauggugccuggcccagacuguuguaucuuaagacauugguuugucaauggggcauaaaaguuagcuugggggcuggugagauggcucagugguuuaagagcacugacugcucuuccgaagguccugaguucaaaucccagcaaccacauaguagcucacaaccacccguaaugagaucugaugcccucuucugggugcaucugaaaucagcuacaguguacuuacauaauaauaaauaaaucuuugggccuaagcaagcagggacugagcacguguaguugaccggagugagcagagguccuaaaaaaauucaauucccaacaaacacaugaaggcuuacaaccaucuguucagcuacaguguacucacauacauuagauagauagauagauagauagauagauagauagauagauagauagauaaaguuugguuccucagaugcaguugcacaugaaagagaguauucucuuacuugcaguuuuagaaaauaauugcuuugacucccaucugcauuuucucguagcucccucuuuuagaaacaaguccucuucauguggucacugagugauuuaaagcucuuaccguguuugccuguuuccuucccaagccuacacaaggccaggggacuguagcagguccuuauauaacccaucagguaccaacucaaugguuaccuguuccuggucucugucuguuaggacacgaucuugucgcuggaagcagaaagggggggaugaguggccuguuuucacagacagaugauuuuguagcucuacuguaaauaaaauccuuguuuguguguga

SEQ ID NO: 371 - RNA, 2759 nt, Mus musculus
agcacauuacaagugggcauggguuuuuauucucagugcauggcauugguuucuguucaucagcaaaaagcuuuauugguuccaaaaagucacccccuuuaaaacuccuuuucuucccgugucaguuguauaacacauuugcaguauagauuugucaguuucuagcauccccccucccaagaaccauauaaauacaugcaaaacauuauacauagagcuuaaauaauaucaaaugcaaauacagauugggugcacugcucagcugaacugcaaacuauggccacacacgcuaggguauacauugcuuugauaacaugucugucaugcagaccacaaaagucaauuuuuuuuucuuuuuguuuuguacaaaaauaccagugcucauuauacuaguuacugagaagaaacucaaaauuccuaucugcaugcugauuagaaaagauggcguagaacaauuuguuggcacauauauggcauauuuacauauggcauauauacauacagggagaaaauacgggccaaaggucgauuccguugcagggaaucucaccuuccuucaccucucccaaccaagaagaaaggaggcagcaggccgaacugcagacugggaagguaaaaguucuggcucugagcuaaaacggaagggaccgagaguaucuggucuauucugaggaggaggccggaauggcuuuagaacagcaggcauugcaagugcccaccccuaagugccaugggguggacccuagaugcagaaagugauuggaugugcagacuggaauggugccacugguagcuucaacuguaaggcgaggggaguggggagaaagagcggggucugggcgaggauucgggcacacucaaguucccuuguguuuuuggcagugagguaaucccucugauugaucuuugcaacucuccccuaaagcuugaaggcaaaaaagaaauccaaccccgaggaacuuccaaggguccggaggguuucuagcuggucucuccuacagcuuuugggaugggaaaaguacuggaaaggacauggaagaacuauugagaaggccuaguccugagacugucagccggagcuacaaguagccauuguuguugcauugaucuuuuccaguuuggagcucuggcuccucucugcuguaucagcagguuguuacaacucagagucauacacagaaccucacuaguggggucucuccggggggaggagaaagggaaggaagcauaaagaacuguagaccccacauuggaguacccuugcucacuagcagagaccauccaucauugauacuacucugcccacuaauuucuuaagaaacagaaacccaacugauccucacuccugaguaccaacaagccuggcucuccuccacggcagcaccugccguggccccacagcuaaggagccucuuugugggugcuuccuucacuaccagcagguucuuaccuaucuauccagguuuaucaaaagaaggcucuaggauauauucucucuccccaucugaccucuuucaaauccgaagcaccauuuaggggaaagugucauaacugauaucauauuuacacacugccaccuggauuacugaaacugaauagaaaaaaaaaacauauaaaaacauaugcacagaaacacuugaacuuauucaauucuguaucaacaaaauuuauauuaaaaaagucuagaacccaacaaauuuuuucccuaaauauaaagauggcuguuuggagaaaguaaguauaguauauugguuguuguuuuuaaccaauuacaaacauacugagucaccugucaugccaaacagcuggugaugcuccucuccacggugugacaugguggcacuuuauuugaaauucuuuaaacaauauauauauauagagagauauagauauagauauauggcugacuaauaaaugucaguuccugaccuaaagaaaacuauauuuuuuugcauaauauuucuauauuuucucucuuacuauggaaacuacagaacacgcauacacagaaaaaccuguugacuuugaaaaaguagacacaagcccucaggaguuaaccugucaggcaccacagaauuguuugggagcaaggaugguaaaauggccuucaaaacuuguuauuggcuuauuuuuuaaaaauaaucugagguaauaaaagaguugacagaauccaaucuucuaauguacuuaaauauauauaguugaacaacaacaccuugagugagauaccuuuccccccaaagaggaaagauugccgaaauguguaagcuuuacaaaaucccaaucaaagccuucucccuacuuccucuaaugauggauuaugcuggaaugggugugggaugguguuugucccuacacucacccuccccugggagcgugggggaaagguggggugggaggaagaacgcuagaagaagagugggcaagcucauuucacuuuccuuucccaagcggaaaccuggcuguucucaugagccucaggcacccucuuauucccauuacccuggaaagagggaggaaggcuucacugaccuaacaggaggugggacuuggggacauacauuccauccaccugcacaaaaaugcuuaaaucagcccagcggagauacacauggagcaccugggacugggccuccuccuugucccaguaaggcaaagucccuuuuggugaaguucccagcuccugagaggcgggcgggcagagggugcucugggcaguguuggggcagaaaggcacagacuucccugggcagcaguag

SEQ ID NO: 372 - RNA, 2759 nt, Mus musculus
cuacugcugcccagggaagucugugccuuucugccccaacacugcccagagcacccucugcccgcccgccucucaggagcugggaacuucaccaaaagggacuuugccuuacugggacaaggaggaggcccagucccaggugcuccauguguaucuccgcugggcugauuuaagcauuuuugugcagguggauggaauguauguccccaagucccaccuccuguuaggucagugaagccuuccucccucuuuccaggguaaugggaauaagagggugccugaggcucaugagaacagccagguuuccgcuugggaaaggaaagugaaaugagcuugcccacucuucuucuagcguucuuccucccaccccaccuuucccccacgcucccaggggagggugaguguagggacaaacaccaucccacacccauuccagcauaauccaucauuagaggaaguagggagaaggcuuugauugggauuuuguaaagcuuacacauuucggcaaucuuuccucuuuggggggaaagguaucucacucaagguguuguuguucaacuauauauauuuaaguacauuagaagauuggauucugucaacucuuuuauuaccucagauuauuuuuaaaaaauaagccaauaacaaguuuugaaggccauuuuaccauccuugcucccaaacaauucuguggugccugacagguuaacuccugagggcuugugucuacuuuuucaaagucaacagguuuuucuguguaugcguguucuguaguuuccauaguaagagagaaaauauagaaauauuaugcaaaaaaauauaguuuucuuuaggucaggaacugacauuuauuagucagccauauaucuauaucuauaucucucuauauauauauauuguuuaaagaauuucaaauaaagugccaccaugucacaccguggagaggagcaucaccagcuguuuggcaugacaggugacucaguauguuuguaauugguuaaaaacaacaaccaauauacuauacuuacuuucuccaaacagccaucuuuauauuuagggaaaaaauuuguuggguucuagacuuuuuuaauauaaauuuuguugauacagaauugaauaaguucaaguguuucugugcauauguuuuuauauguuuuuuuuuucuauucaguuucaguaauccagguggcaguguguaaauaugauaucaguuaugacacuuuccccuaaauggugcuucggauuugaaagaggucagauggggagagagaauauauccuagagccuucuuuugauaaaccuggauagauagguaagaaccugcugguagugaaggaagcacccacaaagaggcuccuuagcuguggggccacggcaggugcugccguggaggagagccaggcuuguugguacucaggagugaggaucaguuggguuucuguuucuuaagaaauuagugggcagaguaguaucaaugauggauggucucugcuagugagcaaggguacuccaauguggggucuacaguucuuuaugcuuccuucccuuucuccuccccccggagagaccccacuagugagguucuguguaugacucugaguuguaacaaccugcugauacagcagagaggagccagagcuccaaacuggaaaagaucaaugcaacaacaauggcuacuuguagcuccggcugacagucucaggacuaggccuucucaauaguucuuccauguccuuuccaguacuuuucccaucccaaaagcuguaggagagaccagcuagaaacccuccggacccuuggaaguuccucgggguuggauuucuuuuuugccuucaagcuuuaggggagaguugcaaagaucaaucagagggauuaccucacugccaaaaacacaagggaacuugagugugcccgaauccucgcccagaccccgcucuuucuccccacuccccucgccuuacaguugaagcuaccaguggcaccauuccagucugcacauccaaucacuuucugcaucuaggguccaccccauggcacuuaggggugggcacuugcaaugccugcuguucuaaagccauuccggccuccuccucagaauagaccagauacucucggucccuuccguuuuagcucagagccagaacuuuuaccuucccagucugcaguucggccugcugccuccuuucuucuugguugggagaggugaaggaaggugagauucccugcaacggaaucgaccuuuggcccguauuuucucccuguauguauauaugccauauguaaauaugccauauaugugccaacaaauuguucuacgccaucuuuucuaaucagcaugcagauaggaauuuugaguuucuucucaguaacuaguauaaugagcacugguauuuuuguacaaaacaaaaagaaaaaaaaauugacuuuuguggucugcaugacagacauguuaucaaagcaauguauacccuagcguguguggccauaguuugcaguucagcugagcagugcacccaaucuguauuugcauuugauauuauuuaagcucuauguauaauguuuugcauguauuuauaugguucuugggaggggggaugcuagaaacugacaaaucuauacugcaaauguguuauacaacugacacgggaagaaaaggaguuuuaaagggggugacuuuuuggaaccaauaaagcuuuuugcugaugaacagaaaccaaugccaugcacugagaauaaaaacccaugcccacuuguaaugugcu

SEQ ID NO: 373 - RNA, 8291 nt, Mus musculus
cuggaucugcagcacaaucggcugagcgacggcgucuucaaggccgacaccuuccagggccucaaaaaccucaugcagcucaaucuagcccacaacauccugagaaagaugccccccaaagucccccaagccauccaccagcucuaccuggauagcaacaagaucgagaccauccccaacggguacuucaaggacuuccccaaccuggccuucauccgcaugaacuacaacaaacugucagaucgcgggcuccccaagaacuccuucaacaucuccaacuugcuggugcuccaccugucucacaacaagaucagcaacgugccggccaucagcaacaagcuggaacaccuguaccucaacaacaauagcauagagagugaguuggggagguggggcaaaggggagagaagagguucggggcagccacacuuucucaggaacaccacugugagguaacaagaagcaacuacugggacagugguauagcagccgucaccaccuccuccuccuccuccucuuccucccccccuccuccucuuccuccuccuccucuuagauaggguuucuguaguccugacuguccuggaacucaaucuguaguccacagauccacuugcuccugcaggugcuggauuaaaggugugcaccaccacccaguucagaaaucuuucuaaugugcacauaagaccuuacauucugccgggcggugguggcgcacgccuuuaaucccagcacuugggaggcaggggcaagcagauuucugaguuugaggccagccuggucuacaaagugaguuccaggacagccccugucucgaaaaaaaaaaaacaaaaaaaaacaaaccaaacaaacaaacaaaagaccuuacauuguguccuuagcauugaagacaaggaaaaagaaaccccacuaguuuugacuguggccucacuauuuucugcgucugaguaaccuugaaaagauacuagacccauauggaaugucuccuuaccuguaaaaugaggguggcaguaucuucuaacacagaaucaguaggaugacuuaaucguguauggauggagugcgcugaacaucaugcuugaaaggcaugagguuuucuuucucuauccccucucaucagcaucagcuucucuggccacuggaccuguagaucagacagacacagaaauacugcuagcuguucuccuaacaguagaacagagauacaaagugcuacguccugggccuggccugcccgcugcaaaagaagccagcagcagucaugacaaaggccuucccagaucugagccuuggcuuuuagaaagucugugacggggaaucagaggcagcuacauagucaggguauaaaacagcuaaaaacuguuuucugauucuauuggaagauuguaauguucagcuaggacaguuuccacaaggaacacucacagagucccgaguuugaugugccaacuguagcccagagcaugaggcucaguccucuucaggcaagugucaggccagacauggcaguacacauguguaacccuggcgcuugaggaguggaggcaggagacucagaaguucaaagcaggcuuggacuccaugagacaaaacaaaacaaacaacaacaaaacucugucaacugggcauggugccuguaauuccgacucugggaagaaugaagcaagaagauugggaguucaaggucagccuaggaaguaaaaucgccucugagagcauugccagaaaggcucagagaaagacgcuauuguucaguuguuuaguccucgaauaaaccauuccuguaggaaaugaccccuccaugaucauccccaacugaaaucauuuuacaacugaauagauuggcucugaaaauuagaugauuacaaucauaccugcucuggaaaucaggugaccuacagucauacuuucccagagucacccuguccagagaauaggauagacaauggagcccacacacucuuggcucucauccccuuucuccucucccgugcugccaguuccucuguggcugacuucucucccuuuuuccuccacagaaaucaacgggacccagauuugccccaacaaccuaguggccuuccaugacuucuccucggaucuggaaaacgugccccaccugcgcuaccugcggcuggauggaaauuuucugaagccucccaucccacuggaccucaugaugugcuuccgccuccugcaguccguggucaucuaggcugugcccagagcuggaccuccucugacagcacuugaaggcugguggcccaagcucugggguccacuguuuuuaucugucucccucucucgcucccagcccugcccuuccucucgucccuucgugaggaugguaaauacuguauaaccugcuccggcucuaaagcaagauuccccacccagcccaaagacacccugccagccaagaccucugcucuucuuuggucucccuuugcuucagaaacacagguguacgccaacagacauauccccucucuucccccacaccacgagucucucauggguaaggcugggccauggacugacaucuuauuuuagucuuagccgagucagaagcagaagucauuccagaggugaacccuggaaaguuccuccauugagaacucccccauuuggguaacugucucaagaaggccgacaaauccaggucuccuaggccugagaucccuuccaaagcuguccucugccacuguuuccugacaccagacagaugucacccuguucccuacugucucgaguucuucagaaaggaagugugggggaugacuaaggugggguggagggucaggguuuccccacaacuuccagccuuuccuccgcuucccaucucccuccuuuggggcaaacacaguacacacccucuuggcugggccucagaaaggaacagccagggacaaaguggugcaaggaacuagacuuuggcuaauaggaggguagcuguggggucagagcccaaaacugggccuauguggaugucgccaagcccugcaaucucccuuacccaaacuugacaauggagggccaagaggcaucacaccacuucaucugcucucuauuaugugugagacucagucgagucaucccaccccaagggcaguucuugagaaacagaggaagagguggagcaccugggaaucucccagaagccucuuccauacuggggauuagccucuaccucuaaggccgacucaucagcgacaucugguggcugguggcaugauacugcaauucccugauucccuaggggaagagggccaugggcuuucuccuacugggucugaaggaaagggcagaggcuggggguucauuccuaucaggagugauugugaaugagaagucuuugagagucuaagggaagcuaguuugacagaggccuugccagggcucauuuugcucucggcuuccacaucuguaaacugagucccucccagagcuccuguuugugcacccucuucuagagcacaccuagcgcaggacaaguggcaucacccauucucccucugcaguuaauuuauucccugcauagagugucccucccccgcagacuugcuacccuccuuuccuagcccaggugagcagcuuggcggguuuccaagaaccugggcucccugccuuucucuucuucccuucuccucccucaccggaaggcugccuuugcccugccacacuugccuggguggagaaggauguggagaugaauguucuagaagugagugaggcacaggaccaauucuccuuaggcugggggagucucuggaggcuuuuuccucuccccaagauggugucacacaacuguuuuaaaacauuggauuaggcugggcccuauaguccagaaaccccauuuauauuccccaucaccuuucucgcauugaaaauagagcccacuucacacaaccucuuuucccugcugugcaacuuccucacccuaguugcagcugguuucuccaaggcuccugcuuaagucaauguaucauuacggcugaaagcaaccuggugcuacagccuggacaagccccuucugcaccuaugacaaccugcaacuuuugccccuuucaggaggcccacagggaucacagcuccuguggcugcuagggaugggggcaggcacugauccugcaaaccugaacuagcaucccaccaucagcaucccauuauccaaccguggaccuugccagcuuccuccacugcucucugcagccaucagcuagagggacaagaguuaaacuggcuuuacaggaaacacacacagugcugguuaccuugagguuuagaaagccccuccucacacaaguuuauucaaucagugccauuagcauuuauacaugcaggugcaugugugugcauaugugugugcauaugugugugcgcgugcaugcgccagcucucacccuguacaucuuaucuauucuccaaaagaccauguuaacucugauacagcguccgcauuccagcaagcuucacagcagaggaaauaaagucauauggaaaacacccagcacaaagcugacugugugaaugagucaaaggcagcaggacuacuuaaagccgucuuuucuccagcucccuacugcucgcugagaagauagggagagagaaaaaaaaauuugucuuaaaagguguguuuuaaauuuguguguaugagcacuuagccugcauguauguaugugcaccacaugugugcuuggugaccacagagguuagaaguuggcacuggauccccuagaacuggagugaugagugguugagagccucugugugugugcugagaaccaaaucccaguccucuaaaugaaugaguaaguaaugaaugcuccuagcuucugagucauggcuucaagccccccaaauaccuuauuaagaaacuccuagcagccaggggugguggcugccaucccagcacucagauggcaaagacaggcaaaccucuaggaguuugagaccagucaaggcuacauaguaagaucuuguuucagaaaggaaggaaggaaggaaggaaggaaggaaggaaggaagaaggaaagaaagaaagaaagaaagaaagaaagaaagaaagaaagaaagaaagaaagaaagaaagaagaaaaaagggaagggaaggaaaagaaagaagaaaaaaacuucuaaaagaaaugucgcaaagccucuucuuagacaauauccucaaaacucauaaccuucauguaaaaaauaaaaaaguaucccuaaagucaguccagaaaucuaauagcuccacuugaaaucaaagcagccauguucuuugaaaccaccaaugucaaacuguggaggguuucucagugcgcagcaccaaggcacugcaggaagagucaucuuuucuaacuaauuggagaaauacagggugcacaggaagugcccagggcaagcagccaaggacuaaaucaucuggaaagaucuacaggccacgcacaaguucaaaaggacaagaguaguugccagggcucucuuuagaggggauuuggcuaccgagggggauucucaacccgccuaaccuaggcugucuuguggaggaugaaaacuaacagaugcccucggccagcccuaccugccuggugugugccaggcaggccccaggaaggaauucaaagcuggaggaugcauaccccaugccauuggggaauuaauuucuugauaagagggugggguguaugcacgaauucuuuucucuuaguuguaaugauguuaacuguaugcaacucagccugggaagucucgcgugagccggcucugaagaaugaaagcguaugacuuggaaggagaggagauacgaaucgguagcuagcuaggcuggaguccacaucggaguggauggggguucccaguuuucagcugcgaauaccaaaaggcaggcgggucucugaacuuuucugcccuccucucucacugcccacaacagggcagcagcagggucaacuggccagacuucuguguccacauggccuguugccucuagcucaccaguaacaccucgugucucuguuaaagggcagcgcuuggcaggcucguggaucaggggcugugcccgcccgccugccgcuucccacacagguccacguucccauccaccaaugcccccgaaauccaugggaacgaccgaccgcaagcuugugaaggcgggaauagaagcugggagaaaguguaggaugagagccugccugcaucgcaggguuugccugggggggcgggggggcggggggcggggagugcgugggagcaggcgcaggcgcugugcagggcuggcugcgcagccugggauugcgggggcggacgcucaggcgagauggcgcgacuggggcgggguggggugggagaggagcggcgggagugugaaggggggugugucaccgagagcagggagaagugugagagcagguggcagggggaaaugaaugaacagucucaucuauauuccuuguagggauaaauugcguggaguugggagggggccacggucucggcugucuguggggcccgagggucucuggaagaacagaaugaagggguagggccagccaaaugugccaucugcuucgagggcguccucuuggcuugugacuuuuaucuccuuccacccagccgaguuucugaagcugucaguucccagaugggggaucuccgagacaaaacagccuuguucuggcaggcggccucuucuggcugccggaauccccuucccacagcagcugaggaguccucggggucuauuaggucugcccacucaccuggcaucgcaagcuggggguggguucugcuaaggccaucuguucugaggguagagucacuguguucucaggauuccugagaugaaguuguaagaaggugagccuugugaacucagaaucuaacacucaaaauguagugcucggcuaggccugggugaccuuggaccaaucguuucucuuuugcccucuguuucguccuguaucgguggucuucagagggccucccugcugggauucagggugugaccagaggaaaggaggaggggguggagagcaucugagaagagccugggcagcggaauccggaugacauucgccagccccuacccucuucuggggauaucugaggcacaucccaaagaaagauggggcccauggaaagucagaguugggagagaaguguuagguuccaggccagaggcuaugcacaaugacaaugucuuggguguuuguaagccaaugucccacuccuguccuuguccuuucuuccuacgggaguuagagaacuuccugucuuguuguuggugaccacugcuugugagcuugaaguuagucuuuacaucuuacccgacucccugucuccugcuguaccaccacagugcucuagggauagggcugaguggggugccccaguucaagcucuuuuuuucuuuggauuccaucuaugaaguccagugucguuauuucugagggaguggaggugggguggggugggggauggggauggggacagggacagcaagcuccauccauccaagaaaccucagcuuggaugagucuucuggaaucuaacugaccaacccucaaagaucagagaagaagguguagcggccaugaguguguguguguguguguguguguguguguguguguguucacccccacacaaagaauuccuguucauuaagugaagaaaugagauuagggaccccugaggaaaaaggaagggaaacagcagggcacuugaaagaauggggaaucuaauuagacacaugcaucccuggccaaccacucguccucucccuggccaauagaugagggggugucuagcuguccccugcucugacaggcagucaucaucuccaccagaagcucccuggaagcugcugagccagacggaaccaaaagcaucuaaaagguaagguccaagguuggaggccucaugcccacuggcacaaaagcaaagggauggagucggggcuguggcaggaacugggcagagaauggcaagaguacaaggcucugaucaaagaagcugcgaggggcuuccggguggucaguaaacugccuuggggguggucuugaagagcauagauuucaguuuggagugggaauagggaacagagagauacgaccucuuacuacugcuggggacuuaccauucagcccggcugagauuaggaagaaaccugcgcaggcggcuuugggagggcuguguaaucagcugcagauggauggcuacgaugcugcaggcacuuccguauccacagcacacucagcccuccaccugccugcacagaugugagugaccugcagacg

SEQ ID NO: 374 - RNA, 19719 nt, Mus musculus
caaaaggaaaugaucacccagcagaggguuucugucccuuacaaacaacuuuccaggaagggaucaaagaacugcugagcuagaccaaggccgggugaguaucacagcaggguuggccaggagcagacucaccauagccauccccgccugguccagcagaugagcccagagcggggacacaaagacaacauggaacuuuugccgcuaugcuaaaacaaguucucugucccaauacuguagaggaaggguaaguaacggggcaagguuauuugcuugaugagcugaugaacuauaauuaauaccuguacaugggcacacagacucagaagggaccugaauagcccaaggguaccuccucauccuggagaagcagcaggaaacaggacugguaccauacaugucagccuccaagcccaggacugaugaccucaaagucaggggcccaagccaggcacgguggaacacaacucugaugccagcauuuggaagggaggggaggcaggauaaucaggaguucaaagccauccuuggcuacaucguggcaugcagccagcuuggguuauauacuaauuagcauucucuggagaaacgggcacuaugggaugaauuuauauacauuaaagaauguauuaaaucauuuuacguuaaaauaguaauaacaaccaaaucacaccugagagcugcuugggccuccacagcuaaaguaaccccacaguggcuuucucuaacugugggcuggcaaugaggcucaguccucaaagcggggugccucagcacucccuaucuggcucuggaaaccugaaagcuuccuuaguccacaacagaaggcugggaaggcugaucugacaucagagaaggaaccagcagcaacagcaacagaauaaagcaacuuagcaagacagaaggccacacgagcaacaggagagacaauuucccucugggugcccuuuuaaacugggcugccaccaggaagcacugccaacaaucaaggugggucuuccugcauuaguuaaagcauuggggacaguucuucaggcuuggcucccucuccaggugauucuaguguauaguaaauuggcauucaaaccaaccauaauaggccccaugagaucccgucucaaaauaacaacaaugaaauaaucaagagcccaaaugucugucaggaggcagugguuaaaugaauuugggggaggagaaacacagagaaagaacuguggcugccaacaugggguaacuggcaaagcauccugggagggaaaauuugaaagaucaaaagcaggugcucauguugccuagccagcaacucagaaggcugaaacaggaggauugcaaccugccuagacuaugaagagaaacucugucucuaaaaagguagggauggaggggguugggggggggaacagaggaagaagggaagagaggaagaggaaagggcagggagagcagcugaaagagggggaagaggaggggagaaaauggaaggaagaggaagagaaagauuguaggaguuguuaauuagucucuucucuaaucgacacggugguggccacucauucuucucuaccugccucaauguucuggguucucgaaugaaagacauacaccagacagccuuauauuuuaaugccauaaacagcuccauggcugagccgcucccaaacauccacguggcuaauaccuccccuccaauauuccugagguauuacuuacuaaaaucuauauuccaucguuguuguccuagauccaguuggggccccagggcugcuauucccuggcccugacauguggcugucucucuguccuuuacuucucaggccuggcagcuacuccuuucccagaaacuaacccuuuuccugcuccuuccucaguccuuuuuccugggaauccuaaaaguccugccucugucucccagcccaaccacuggccacuagcaacuuuauuaaccaaucaaaaccaacugggaacagagacccucaguaucuuauguauagaugugaggagucucauguaauuuuggggaccaaauuaacauaauauaagcagcauuagaccaaaucuaauuagaccaaaagggagaauagaauaguauuauuuaaaaaauuagauauauuggauggauuacuaaauuuuuucuuguuuguuuguuaguuuguuuguuuuugagacaggguuucucuguguagcccuggcuguccugaaaaucacucuguagaccaggcuagccucgaacucagaaauccaccugccucugccucccaagugcugggauuaaaggugugugccaccacugcccgacauuaaauuuauucuuaaagcauuguauagucauaaucuuacauugguagaaaucuuuauaauugaugcaaaauuaagguuauaauuuuuuacauuaguauagauguacauauugauacaggucuaagguuuucauugguauaaaucuuuauaucuugauacaaaauaugaaauuaauauuguuacucuugugccuaugcaacucauuuacgaaugcaaggcuuagccgggcaugguggugcacgccuuuaaucccagcacuugggaggcagaggcaggugaauuucugaguucaaggccagccuggucuacagagugaguuccaggauagccagggcuacacagagaaacccugucucgaaaaaacaaaaacaaacaaacaaaaaaaccaaggucuagacccagucauucuaauagcuguuauuauaaacuguuuagaaugauuaaguaaagcaagugccagauaauuaagugcaagggccagauagcaacuaaugguuauauuagauucuaauuuaguuauaauaaaguguuuucaauauuauuuaauuagaaauagcuaagaguagucaagguuuagcaguugagauauacuauauauagucuucaagagcaucacaaaucuauagaauaugacauuuagcaucauuucauuauuaauagaauuuuugacugagagacaugucugcucuugaccauacucccuucauggaaucaacaagauauugaccaucauuaccuccauauagaguuguuccaguuguaucaagauagccacugaacaagaauugcccuaauucaucuacagacaaaaauaccgucuaagaaaugauauacaaugugggauagucgacagcuuaacccugccaauacagggcaagcuaguccuucauaauuccugcuucacuuaaggucugucaaaugguucugggccagaaagcugaagacugaugcucuaacauucugaggaagaaggaacucuccaggcagucagcugucuugacaaauugcuuaaguuuugggaagaugaucuagauguaaaaagaugguuuucaggugguaauacaaguuaaagucaaaacgugauucugguagagaauuguaaacucuuuaaguuaggauggaugauagagugaugcaccuaaauugacaaaauugaugcacuauguguuauuaguguauaucagaccuuauaguuuauauaacuguuguuacuauguucauuauauucugagggggaaaaaggcccuuuuaauggacaaaaaggggagaagugugaauuuggucuaacucuuguauuguaauuggguucccaaauugcaugagaauucacauguaagaugcugagggucccugcaagcaguggguuuugauugguaaauaaaguugccgauagccaguggcugggaaggaagacaaaggcaggacuuuaggaugccugagcaagggaccaagacagagagggaaagauaggauggccaucccagaaaaggaguagcagccaugccugagaaguacagacacauagacagucaacauguaagagccacgaaagaccgacccaggggucuagggcaacaaagauggaauauggauuuuaguaaguaauaacccaggaauguuggaggggaguguguuagccccauggagguuugggaguggcccaaccucugagcugcucaaggcauauuaaaauguaaggcuguguaagugugugugugagugugugugugugugugugugauugugugagugugugugugagugugagugagugugugugugugugugagugugugugugagugagcgugugagugaguugugugagugagugugugugugagugaguaugugagugagugugugugugugagugugugugagugugugugugugugagugagugugagugugugugugugagugagugugugagugagugaguguguguaugugugugugagugugugugugagugagcgugugagugaguugugugagugagugugugugugagugagugugugaguguguguguguaagagugugugugugugugaguguaagugugagagugugugugugugagugugugagugagugugagugagugugagugagugugagugugugugugugugugugugugugugugugugugugugugucuuuuauucugaaacccagaacagugagguggguaucgaggaacuuaucaccacugccacugcugcagccggggucgauuugaggaaagguuaauugccaacugcaacaaaggauggcaaagggaggaacagcucugagcagcauccaggccuggggcuuagacuugugauuccagcuacucagcaggguauggaaggaacacaguugaagagcagucuaggcaacuuagugagacccuaucuugaaccaaaaagaaauuuauaaguaaaaaagcagguuagagauguagcucuaggauagauugcuugcugaguguauguagcucuaggauagauugcuugcugaguguauguagcucugggauagauugcuugccaaguguaggccagccuaggauccucagaaucagagaaguggggaggggcaaagaaacuccuggaggaaccugggugguaaggacauaggccauggacccacauggcuccuauaccuuugagauuccaaucaagagaauuaugacacauuuuuuaaaacaguuuuuauaaaaagugaaugauagacacuguccuuguuuagcccucuuaauaguaauaaaacaggcccuguauugagcacccagaugugccaaacccuuggugggugcuguggguucccaacaauguauaggcugcugucucuucccagcagaagcccaggaccccccagcuggacagagggaugggugccccaagauucccacagccucuccccugcugugcauucuagccugggagccucugugaggggugaagguuggccagcuucugugggaccuagugaccaugcugaggucugagccaaaaccccuaaugccuacccugcccuuccuggcagugggaggugggaggcugggccccucuucucugugcuccagggaauagggugucauguccacaaucaacccuuucuucucuggcuguagcgcuugcugcagcagccaaggcagccguuaccaggagggugaaagaacagugagccccagacugauggcggugagggugggcaggcaaagucuccaggaaagcagcugaaacccaccgcaguagggggccaucucucuccuaggucugcccuuccacuccuccuucuaccagccaugcgccagguuuccccugguggcugaagccuggguacuacauuucccacaaucccccagcaaccccagcagugcuuuaagugcuacaggaggaagagauaaauuugucaccugcuguguguuuccaacacagcgagagcugaggaugcucacucuggagaagccucggcuguguggaugaguuaugcucccaagccccugcuucccaaaagccucucuggauccuggggauaagcaaggaggaagaugggguuauuuuaauacauaccccugaggaaaccgagggucaaaucuguuugccagcuaucaagaaaggagcagagcugacauuuuaacccaugagucucaauaccacaucauuuuacaauguuggaagugacuucaaaggucaguuaguauaaccucgaguuugcgaaguuacagagggaaagugacagccaggucucagcaguucaggccucuguccccaaucuggagacuguucuauccucugucaaagacaguagaaagauagguuggcuaucucaggugucuccaaugacgggaagaugcaggcaccauguaaaaagaaggugaggcccugacucuaagcuaaggcaguaaaaggggcuggccacuguguggaguggggagguuccugcccuagcuaaaagauaaaauaagauaaaauaaaaguaagaacacuccaaaacauaacugcaggguuugugggaaugggcacaguagaaacaaaauuggcaugagggcacgguuauuauuuauuuacuuaguaguuacuuuuuuuuuugguuugagaaugucuaacucaguuuuccaugcuggccucaaacuaauagcaauucuccugccucaggcccuaagugcugagauuacuggcaguagccaccacacuagcaugaggugguaacuguugaucuggguguuaggugaugaugugauggccuccuguguguaucugaaggcuaugggcacggcucagugguagaguguagggcugugggccaggcgggugugggaugcggggaggcacugggagucugagaccugugaaagcuggagcuggcuugggggugcccgagccuaugacaagucaggguccaugggguucucaggcucuuggacaucuaggugcuccuggaagucccagaagagcugagaacagagugggggccugagggcuggaucuaggccagguccagggaacaggggggcagaagaggagcuccagcuagucccacuuggcuucauggguggcaggauugguggugguuguggcagggagcaccgagaggccuucuaugggagauuagacaguggcucuguaggcaaaggccuucuccauggcuccccaugucugaagagaccaaaccauuuauugucaugguggaaaguaaauguguaaaaccauaccccacuucucagggcaggccugagauuaaauaccuuuugcagggaggagcaucugggaagggaaucuuacuggccaugcccucugggccucuagguauuucauuagcauggagaucucugccuugagccuaaguggccacagaucacaucucuuuuccuauuaaauuggucugagauguuaaggaugccucaucuacauguggaagggcuuggggcauugcccccaagugacugauggccacaaaucuaugggggugaggagggaggcugaggcuggugacaggggccuggugccugggaacaggcaaaacuccuuagaucccuucagggucucuggggcuucaaacuuuuagcucgaccaaggaacaggcucacaguccauggccccacaguagagcacugaccuaacacaagcaaggcccuacaacucccuccagcacaggcuuuuggggguugugauagcaagaaggcagguaaacaggcagugagugacauuuauaucucuacgcuggcuaggauucccuacaaucccuucugaagcuccacggucuuaccugagacacagacacagaaauaggggcaucucaaaaucaagugacuugccuaagaacacacuuuauuuccugugaguggaagagccggggacuuugagaguuaggggacagugacaagagucccuugugggcuuuguaggucucugaugaccuaauggugacugaguaaguguuucccuuagguucugagccagaaguuguacugaaugcaccuuaaagccaagugugccugacuuuucagauggggacgggggugggggucauuguucagauaacagagacuuuugaauugguuuccaggaaguggauaugcauuggggagccuggcaucauccuguuucugugggaugaccacacagcccccaaaccucaccugagugugugacacaaagcuggaggaaaagccccaacacuguccucaggaacuaggaacaauggcuugcggauuuacaauuggaaaccugcuuuaauuuggcugugugauccucaggccagaguggccaccaaaccaguaguuaccucuuauaucagcccacugcacagugagucuccacucccuuagcaagcuucugggcugugauagggaaauauugucacuguguaugcucugaaaagugucucguggcuccucagugaguugaagaauugacaucagggaaguaaggcgcuuguuagaaacucaaguggccagggcuggacccagcgaccccacccugccugcacagaagcagaggccuugccaagugcuuuccucucuugauuuggcuuaguuuccaaacacgggucaaacggucccucuccagagcagcagcagcagcaggaaacauuauuaaaagugagccguuagcgggcaucggguguggaugaggucuguggaguuuuggcugccaaauaaagacuuuauuguugucaucucuccuuucccaagcucccucccucucuccucugcucccuccuccucccugcccuccccccucugaucugccccucccuccccaaacuaaccuccccaccccaauaggaucugguagaagaaaagucaggcagacacacgcagacacgcaccaacugggagaccagaacuucuagcuggcucucugcugccacagcuccagcaaaggguggggaggaacagaagagugccccagaguccagaggagaggcaggugugugcagguaaguucaggcagugggggagaagacuagaaggcuccuuccuccagggguucucucuagcucuguccaaucuuucuuuccucccuccuggccuucuuccuucucauuuuuccucucuaaagaguucagauguagccuuccucauuuccugaugacacucucuugucucuccaacauccugcauccuagcguuugcuugcugcugaaguuaaacuuucuaagugcagauguuuguggagcacacagagcugugucgcacacagaauuugaacagagcagguguugccaugggaacuggacacuagaaccgaauucucuacaccuuucauguauuaccaugcacugcagaagacagacagaaagauagacagacagacacacacacacacacacacacacacacacacacacacacacacuggguuuugucucuuacucucucacgugccuccucaacugccugaccagagacagcguuuuccuucugagaugacagagccaaaagacaaucacgccuuggcuggucagggaggauaugaacaaucaagugauuuuuuuugaaaauuucuuucuuuugaacuuaaucaggcagaagggagagaaaaguggcccuccagccuacacaguauccucucagcagcccgaauuccugucucccuccccaaaccacuuggcucuuacaaaaagaagucaagcuugccugcaagccuuggaggcccuaacuccugaguuaacaguuccacacacacacacacacacacacacacacacacacacacacuacauagucagaaacacucuucucucugaaguuauucugagauuauccugaccagucagcugguaagggggcuugaaguagaggaagcagggaggggaaccugggagucuuauuugcacagcuccccccucuccugcaauagaggggccccauggcaguaagaaggggggcacuacuugauccucagagggcccugagcaguaggcagggaauauggaagcuuuaguaaaacagggacagacacucauuacagacccaucaaacagaacccaagagguccagagcuguguuaauacauccugagacuccccuaacucccuugggauucacauaaagggcuaugugguguccucaaaaaggagccccugcagucuugacagugagggcugagagccacugcaggagggaacaaggcacucucuugugauuacuaacaucauccauacuaggcaaccauacuucgggggaacauucuacaaagaacauucuaccuuagucuaucuccucuuaccugcuaagcuaccugucccagguacccaagagcuaguacuagcugucaaccaucccuucuagauucucucuccccguaccccacaggucugucccauuugacucucucagaggacagacgaguugauaaugucccuuauccacccucaccuuccuugaggagagcaccucaaggcuagaaggaacaacaacagcaacaacaacaaccacaaccacaaccacaaagacaaggagaagcccuagaucucagaagaagccacaaccagcugaaaagagagauuuccauuugccagccaguguccccaccucugcagaaagcggagagcuggguuaguaagucaggauggagacacacagcgggcuuugcacgggugucuggggaguuccaaucaguugacacugaauguccaauguagucuucugagccacacagggaaugaaguuucucugaguaccuacacuguaagaaggaccccuucuucuccagcaguagggaaaugaaggauguuaaccaagcagucugaugguggggggaaaaccauuacuucagagugguaccaacaaccacuggauacacacugagcaaucacuuugcacaucaacuauuuuaacccuuccagcauccagacuggggcugcagcuaggugguagaaugcuuguauaauaugcacagaacccugguuuuagcaccuccaaaauaaacuuggucagcaagccuguuuuuuagauguggagacugaggcuuguguaguagucccgagcuaacacaaguugcagggugggaucugucucuauagccauauucagcaucacagggauucuucuuggcuuucaucaaggauuaaaggugguagggagagaggcagaaagguggauaaagagggcagugaguuuucagagaucaccugacuguccaucugauuucuuccccauuccccugaaugggaagccuguucuuucagacuccuucccuaaaaccauacaaccuccauucuguuuacauucuuccuguucaaaccggaauaugguguuuacucugcaaaaguguuaaacuuggcuuuagcacuuuuugaccuacacugcauuuuaaaguugcuugugccacuaacauccgacaacuaggagagcuuugcccaaccccaguucaugcugugcauuuugaagaaccccucacccugggcuuuauuggcccacagcaccucagccuuacgcuggaggaguccaaacauugacagucccugggcucuuacaacacauaaacaggacaggugggaaagaggacuuccgcacuuuaaauucagggagccucucccagaaccugcucuucuguaaacacauugucccugccauuuccagagucuuguuucuggaucgugccuucagaugugugagcucaucccauccucauacagaugucaauccuggggcccaaggggagagagaggcagaggcaggauucaagcccagauccacgcugucagaaccgaaauuugaauuguaaacucuuuuaagaaagacuucuaaauacagagcaugaacuggguuuggguaaagccagcagcuuucugagagauguagucuuucugaggggcguagucaacgaguacucauugauugacggugaacagggcccaauagggauccaaauuaaaugggaggcggggagguauguuuucagaagcauaagagaucuuaagcacagacacccccacccacccggagggagcuaaugauguggaaggcaagagcucagggcccugccucuggucuuuguugaugagacuacaaccccucugggguagggcuaucuccaguuugccucagcgccucuuauuagagcucugaggcaggggagcauggcuagagagaauggccaugcagugaguacuucccagaagcccaggaccgccuggcucggcaggaagagggaugugccugugagaauggccuuggcaaugagcaguucccugugcacucugcacacagaucucugguuccgcccggggcugggagaggagaggguugagccucaucgccuagugaaagucucccacuucagauucagggaggaagaaggaggccuggggaccccaugucugagacaggcagguaguacuucccacuggguagccauggcagcgggggcagggcugcccaacacacggacaacagagacccaccccuuccccagcaucagagcccagcugccggggcugucugucuccagggaaggcucugcuggaugucccggaaagcuuuguuuggcuaacuuaguguccauuacuucaccuuggaagugcuuuuggcaccaagggcaacaaagcaaaccugggaaauuucugucgaaccuaauuuuggccuuagggcaagguuucucauagcagggcaggcagggguggcguaauuuugccuacaagcuuuuggaaaauuuauaagcaaagagauuccaaaagaacaacaagaagagaauaaaaacaaaucaguuuugcaaagacuggugcuuuuaaaauguuuuggaauaguaaggcuuugcccucuucauuucuacguaacacgacuauucuauuuucaagaaaauuaaaagcuuuauuaaaauguuaauccauaacacaccaguuacagagugagguggggcugggcaacagaggucaaguuuaaaugcugcaagggaugugcugucuucuuaguccucucagagaagccuugguacagauaaaccaagaaccuaacugcaggucccuugucacagaaggccuagggaaaaugaccuucuagauguccucaagaggcuugucugagaugaaacccaccucagacaggagagagaaauaccaggcaggauagacucaccuucuccagucuacccuccuuccuaccuaggcugacacauaaagcucacacaugcauauagggcccugaggauguguacaaacugguaugggcuagggacaaagagguaguuguguguguaucuguguccguguguguguguguguguguguguguguguguguguguguguguguaaaagcauguuuauaaugugcauaaaccuuuagggacaggcacaguuaaauucugcccauuaaggaugaacucugucagcuugcccguuaucugucauauuuagcuccacaccuuggggauccugccacccccugcucuuuuccuuugaccaaagcaagcagaagauaguuccuaauaaaagcaaagggagauuugacauagaucuaggcucaggggauagguggggaauggaggccaugaucacuggguucgaguacaagcuagggacacacuucagcccacucugugucugagaagaccaagaggcuuauguucugagagcuacgauaguggggaagauuugaggugacccugaugugaugcacaaaguaucagggguggggagcuguagagaaaaaguacagacacccucucccugggccccucccaacccaggcuggaaaggggagcuggcccuggaagguccuaggaaggaucuuuucaaccuagcucccacugcacaagccagcagagccacccaacaaacgucuucagcucuugaucccagugucaccgagguuacagggaagcucuuccugaugccuccauuccaacauuaucaguuccaaaguauauggagcaauaauaccagguccaaagaaaggaaaguguuuuccccgagucuuuuuauuccuuuccuguuuauuuucccaagggccucuacaucuggggaagaauucuuggcacggcucaugcuggcaaagacaggcagucccugggccaagugcaggggaggggacagagcaagggugagugggugagcgcugguaucugagcaguucccuuccaggacaccuccugccuuuuugucccgugcucacugucagucuccuggccucuucaagccacuucuccacccccccccagccacagugggagcuggacaugguggguggacuguagaccauuuauagcaaugaaauguuuuccucuuuucuucaaaugcugugucuaaccacccucgugugugcguguguguguguguguguguguguguguguuuguucuuaccucucucaguauuucugucuauaacagauuuaaagaacaaagccacucaagccaacacagaugucaccuugggggccccuucucaguguaccuccucagacugugcacaggaguguuaggcaccguuugagaacgugggauuuguacagaaccuuccagacccacugcuuaggacucugggccauauccuagcaucccuaugaagaagguggagagcuuuucuugggggaggggugauauaaaaaguguugagcagauuuuggaugucacuccuggcagaccuuaagcacucuccuuacaagagcugagacgaucuucucaucuuacagcuagagagagcacccccugcccgcccccacccaccaccccaccaccaaggguuuccaacaugccucaagaccccugugcuuccuacgaacacgcaccuuuccacaagaggcuaaacucccagucuccuuccugcagguacaucaccuggaucaugagggcauccuucuucuggcuccucccacuucuccucaucuuggccucaguggcccaaggccaaccgacaagaccaaaaccugggauuaggcguaaacccaagccgaggcccacacccagauuuccucaggcccccgagccagcagagccgacagaccugccuccaccucuuccucccggcccuccaucugucuucccugacuguccacgggaaugcuacugccccccugacuucccgucagcccucuacugugacagccgaaaccugcgaaggguccccgucaucccaccccgaauccauuaccuuuacuugcagaacaacuucaucacugagcuuccucuggaaucuuuccagaaugccacgggccugaggugggucaaccuggacaacaaccgaauucgcaagguggaccagagagugcuggggaagcuccccagccuggcauuccucuacauggagaagaaccagcuggaagaggugccaucagcucugccccggaacuuggaacagcugaggcugagccagaaccucauuuccaggaucccgcccggaguguucagcaagcuggagaaccugcugcuccuggaucugcagcacaaucggcugagcgacggcgucuucaaggccgacaccuuccagggccucaaaaaccucaugcagcucaaucuagcccacaacauccugagaaagaugccccccaaagucccccaagccauccaccagcucuaccuggauagcaacaagaucgagaccauccccaacggguacuucaaggacuuccccaaccuggccuucauccgcaugaacuacaacaaacugucagaucgcgggcuccccaagaacuccuucaacaucuccaacuugcuggugcuccaccugucucacaacaagaucagcaacgugccggccaucagcaacaagcuggaacaccuguaccucaacaacaauagcauagagagugaguuggggagguggggcaaaggggagagaagagguucggggcagccacacuuucucaggaacaccacugugagguaacaagaagcaacuacugggacagugguauagcagccgucaccaccuccuccuccuccuccucuuccucccccccuccuccucuuccuccuccuccucuuagauaggguuucuguaguccugacuguccuggaacucaaucuguaguccacagauccacuugcuccugcaggugcuggauuaaaggugugcaccaccacccaguucagaaaucuuucuaaugugcacauaagaccuuacauucugccgggcggugguggcgcacgccuuuaaucccagcacuugggaggcaggggcaagcagauuucugaguuugaggccagccuggucuacaaagugaguuccaggacagccccugucucgaaaaaaaaaaaacaaaaaaaaacaaaccaaacaaacaaacaaaagaccuuacauuguguccuuagcauugaagacaaggaaaaagaaaccccacuaguuuugacuguggccucacuauuuucugcgucugaguaaccuugaaaagauacuagacccauauggaaugucuccuuaccuguaaaaugaggguggcaguaucuucuaacacagaaucaguaggaugacuuaaucguguauggauggagugcgcugaacaucaugcuugaaaggcaugagguuuucuuucucuauccccucucaucagcaucagcuucucuggccacuggaccuguagaucagacagacacagaaauacugcuagcuguucuccuaacaguagaacagagauacaaagugcuacguccugggccuggccugcccgcugcaaaagaagccagcagcagucaugacaaaggccuucccagaucugagccuuggcuuuuagaaagucugugacggggaaucagaggcagcuacauagucaggguauaaaacagcuaaaaacuguuuucugauucuauuggaagauuguaauguucagcuaggacaguuuccacaaggaacacucacagagucccgaguuugaugugccaacuguagcccagagcaugaggcucaguccucuucaggcaagugucaggccagacauggcaguacacauguguaacccuggcgcuugaggaguggaggcaggagacucagaaguucaaagcaggcuuggacuccaugagacaaaacaaaacaaacaacaacaaaacucugucaacugggcauggugccuguaauuccgacucugggaagaaugaagcaagaagauugggaguucaaggucagccuaggaaguaaaaucgccucugagagcauugccagaaaggcucagagaaagacgcuauuguucaguuguuuaguccucgaauaaaccauuccuguaggaaaugaccccuccaugaucauccccaacugaaaucauuuuacaacugaauagauuggcucugaaaauuagaugauuacaaucauaccugcucuggaaaucaggugaccuacagucauacuuucccagagucacccuguccagagaauaggauagacaauggagcccacacacucuuggcucucauccccuuucuccucucccgugcugccaguuccucuguggcugacuucucucccuuuuuccuccacagaaaucaacgggacccagauuugccccaacaaccuaguggccuuccaugacuucuccucggaucuggaaaacgugccccaccugcgcuaccugcggcuggauggaaauuuucugaagccucccaucccacuggaccucaugaugugcuuccgccuccugcaguccguggucaucuaggcugugcccagagcuggaccuccucugacagcacuugaaggcugguggcccaagcucugggguccacuguuuuuaucugucucccucucucgcucccagcccugcccuuccucucgucccuucgugaggaugguaaauacuguauaaccugcuccggcucuaaagcaagauuccccacccagcccaaagacacccugccagccaagaccucugcucuucuuuggucucccuuugcuucagaaacacagguguacgccaacagacauauccccucucuucccccacaccacgagucucucauggguaaggcugggccauggacugacaucuuauuuuagucuuagccgagucagaagcagaagucauuccagaggugaacccuggaaaguuccuccauugagaacucccccauuuggguaacugucucaagaaggccgacaaauccaggucuccuaggccugagaucccuuccaaagcuguccucugccacuguuuccugacaccagacagaugucacccuguucccuacugucucgaguucuucagaaaggaagugugggggaugacuaaggugggguggagggucaggguuuccccacaacuuccagccuuuccuccgcuucccaucucccuccuuuggggcaaacacaguacacacccucuuggcugggccucagaaaggaacagccagggacaaaguggugcaaggaacuagacuuuggcuaauaggaggguagcuguggggucagagcccaaaacugggccuauguggaugucgccaagcccugcaaucucccuuacccaaacuugacaauggagggccaagaggcaucacaccacuucaucugcucucuauuaugugugagacucagucgagucaucccaccccaagggcaguucuugagaaacagaggaagagguggagcaccugggaaucucccagaagccucuuccauacuggggauuagccucuaccucuaaggccgacucaucagcgacaucugguggcugguggcaugauacugcaauucccugauucccuaggggaagagggccaugggcuuucuccuacugggucugaaggaaagggcagaggcuggggguucauuccuaucaggagugauugugaaugagaagucuuugagagucuaagggaagcuaguuugacagaggccuugccagggcucauuuugcucucggcuuccacaucuguaaacugagucccucccagagcuccuguuugugcacccucuucuagagcacaccuagcgcaggacaaguggcaucacccauucucccucugcaguuaauuuauucccugcauagagugucccucccccgcagacuugcuacccuccuuuccuagcccaggugagcagcuuggcggguuuccaagaaccugggcucccugccuuucucuucuucccuucuccucccucaccggaaggcugccuuugcccugccacacuugccuggguggagaaggauguggagaugaauguucuagaagugagugaggcacaggaccaauucuccuuaggcugggggagucucuggaggcuuuuuccucuccccaagauggugucacacaacuguuuuaaaacauuggauuaggcugggcccuauaguccagaaaccccauuuauauuccccaucaccuuucucgcauugaaaauagagcccacuucacacaaccucuuuucccugcugugcaacuuccucacccuaguugcagcugguuucuccaaggcuccugcuuaagucaauguaucauuacggcugaaagcaaccuggugcuacagccuggacaagccccuucugcaccuaugacaaccugcaacuuuugccccuuucaggaggcccacagggaucacagcuccuguggcugcuagggaugggggcaggcacugauccugcaaaccugaacuagcaucccaccaucagcaucccauuauccaaccguggaccuugccagcuuccuccacugcucucugcagccaucagcuagagggacaagaguuaaacuggcuuuacaggaaacacacacagugcugguuaccuugagguuuagaaagccccuccucacacaaguuuauucaaucagugccauuagcauuuauacaugcaggugcaugugugugcauaugugugugcauaugugugugcgcgugcaugcgccagcucucacccuguacaucuuaucuauucuccaaaagaccauguuaacucugauacagcguccgcauuccagcaagcuucacagcagaggaaauaaagucauauggaaaacacccagcacaaagcugacugugugaaugagucaaaggca

SEQ ID NO: 375 - RNA, 3011 nt, Mus musculus
aguagaggaugaagagaacuaaauugcuccaccuaagaaaugagaggaauuuggauuuuaucccuaagagagacauggaggagacggggaaaggcuuucugaauaauaugguaagucucgcccugaacucugaaaacguccgguggguuuuugaaacuaagaccaggaaugacuucuuguucacggguuuuguguuugcuacuguguaaggagcuugcaaagccugccacaucacagaagcccaugggagggucuacuguguucucugucuggcugaaggagacaugguacaggguaccuagcaggagugguggggugaacucggacugacuuguucauccgacgcaagggugcacuguagaagugugagggaccuggaacugagauuuagauuugcuuaugauacauucauuccuuuugaacuuaggacccucuagucuugaaagggacaaagccaccugcaguccauggcagugucuugggguguucauugcacagcugacagcaguguugccauccugccuggagauggccuaucaguguuaccugugcuugugugggaaucugcauggauaggcucacaugcuggguccuuguuagacaaacaugcuacugaguauguccagugaucuugcuuugcuuccucacugaaguccuucccaagcuaggagcagaggguuucucaggaccaagccagccccaucccucucugcauucccugcuugaaucugccuccucuccugccccugccuguuuucccauucucuuccuccagcuccaaguacagccaaagcccuuaacuaagagcaugaaaacaaaaaaaaaucaggucaccagaugugcuccuuucuguccucuggcuccucaagacuccucaccacaagucaauaaauccuaaguguaucuacagcaagcacuuggcauccccccagcucacuguccccgcugccuaguaaccaaccugacugaggugcucggaugagugcaccacacagcuuacccaugucucuggcaccaugauauggcuggauuacucggucuagacagcacacauagacccccagugagaggugaugucuuugagcuauggguaccuacuccucgggcuuccucuuccuuguguuacauggccugucugauacucugagaaaacauccugucuagaugcuggcgggcugagggagcugcagcucugccucugcuccuagguggggcucccccaagcuggcucccaccuagaccuggaaggauagaugagcaucugggauucucaucgcagauuguuuacugguggguuugcauggcagguuaacaaccucgcagcagccugcucccugccagggacuuucaggaacaauuucuccaagccaguguggccgggucugggcaugggcugccccccccccccuccuucagcagccacguggaugugacucaugcaagcucucugagcccuugcggagggcagcuagaggccugccugcauacacuugcacggaguagggaacaauucggagucucuguggcaaucuggugggucucugaagccuuuuguacuucuguuccccagaucucuugccauccgggcccgaugcagcagugugccccugaugcucuugaaaacacucacccccccaacaccccaaguuaccucuuucuucccagagcacacaguauagucagagcccuacaaugaggacacuuggcuuugcaccggaacagaauauggauuagcccacgccuagagcgaaguacgcaaccuuguuuuaucgucaugaacucuacugcucuuguggcgcuaaaauggaggcugggguggggggaggcacgauguacuugucugggcccacagagcaugcgcagugaguaaucacugugaauguggcgaagaaaagggcaccggugugguuaguucauaaaggggcaagggauauaugggaaauucucuguacuuucuaguccauuuucuucuaaaagcccuccaaaaauaucucacuuaauaaauacacuuuaguaaauguuuuuaaaggagauugauuaaugguccuguagcaagcacuugaucugggauacagggcggcuuccucgugcagucuguagucuuucuguccaaggcgucagugaauaccucaucgcuggagcuuuccacggugaauguccuccugaagauuuaacagcaauacuuugccauucauaguuccucccuagaccugucugcuccacauuccacgucuaagacuaccgagccuccacgcauuucuuaccgugcaguggagugcucagcgcagaccuuaaauagauuccuguugagggaacaugugugcauuaaugcauguaugcaugagugggugaacugauggauagaugaaggaagagugggagauacagggaaagggcgauagaaaaggagcgagaagggagauggagaaagagggaggggacaggaagagggagaaagagggauggagaaagcaggaugaauacagggaugaguaaagauugguguuucugauuugucuuccugggcauugaaaagacccuuuugguugcuucuuucuucccucccucucagaaccaaagcuccauccaucaauccugcugugccccaugaagacuuuaacccuuagaauaagaauugccugccccauuucuacaaaaugaguguguucuuugagcagaagaggagagaagagaagaaauggaacaaucuuugcuuuggaaauuuagcugacuggccucauuuggaauaagagcgccuucaaucccuggccgcaggcgggcaguggagccaacaguaacaccggaugcugggaugcugggaggaggucuggaagcaucagaggagaugccagggaacuuggaguccagaaggcgguaguggguuccucucuggggaugagucccaguuuccucaacuuuguccagaccccuuguccucaggcuaaaaccuacuauuuauuggauagagcauuauccuggaagcacuaagagauuggaggagaagguccuga

SEQ ID NO: 376 - RNA, 1851 nt, Mus musculus
ccgucaucaucguucuaauacagcuacuuccucagccaccgguaugagccacgggaagagaaccgacaugcucccggagaucgccgccgccguggguuuccucuccagucuccugaggacucggggcugcgugagcgagcagagacucaagguuuucaguagggcgcuccaggacgcacugaccggugagcacacgucggggucuuggaaccacucgggcgcggccacuucuugccuggggugucuuuaucacuguucugugacggggaccccuacgcgaacaacuccgggucucagaugucuuucucuaauuaaucucugaggccacugaugguccucugucccuucgguuaaguccccgucucccagcccuccaguccccgccucgcucccgaggcuccgacccucuuccuugaguacauucugagacccugacaacaccaugagaaaagucaguguguguguguauucagaguccgagcucacccuuaucuccgaaucuuggagaacaacagacccucaggggaugugaagccaggccaagcugugcgacuuuuaugcgcaauugaacuuucuagacaacucuugaguccuagccacuguugcuguauaguccugagccugucaucauacaggcccauucugccgcguguuuacccgcugcaaguuguaaucugggcccccuuuguauuuuuucuuuuuuggucccucuucaccaucugccaccuauuguaguacagaaaagagccugguagccuagccaacugcgagggcggggaggggguguguguguuauggaggcagggugugagggacggagguggaggagugauaagccacccuuuagccucuguccgcagcuguuauaacugguugguugccuugggcugcgauagccaucucucaacauguuggcacagaucugaggaccaacagcuguuucaucaaaacaaaaccauuuuuuauccccuuaccuuugcuaaagaucucaaaacucuucugaugcggaagggaugagaggccuugugacuuguugggcaaccaacaacauuggccgcuuaccuaccggcuuugaaauuucagugccuuggucgucagaggcccugccgguucuugcuagcccuuccugccuuaaacaggauugugccaaaaauauccaugaccaccauagagcaucuaccugaaagcucuggggcugcuuuccaguguacaaaaacuuggaaaggacccaggaaucuuucuaaguggcagggggaguuuaaggagaggcucuuaaauacugucgcugagaagaggaagucuccuccccagcccucuccccucauccuccccuugugguaaacaucagagaaugcuuucuaacggcgcaucuuccucuuguuuuuuuccacagaucauuacaaacaccacugguuuccagaaaaaccauccaaagguucuggcuaucgcuguauccguaucaaccacaagauggaccccaucaucagcaagguggccagccagauuggacucagccagccccagcugcaccggcugcugcccagugagcugacccuguggguugaucccuaugaagugucuuaccgcaucggggaggauggcuccaucuguguccuguaugaggaggccccgguggcugccuccuaugggcuccucaccugcaagaaccagaugaugcugggcaggagcagccccucgaagaacuaugugauggccgucuccagcuagauaggagccacccgacccuggcacucuacuguucucaugcugcccugacaacaggccaccguauaccucaaccuggggaacuguauuuuuaaaaugaagagcuauuuauacauguuuuuuuuu

SEQ ID NO: 377 - RNA, 3011 nt, Mus musculus
uaagucuauuacauuuuauuuauuuagugcaugugucuaugugugugggagugccacagugcacauauggaggucaggagacagacagcccuugacagacaguucuccucuuccauauuguggaacuugaggauugaucucagguuguccggcucagcaauaaacucauucacccaaccucuaccuuguuggccucuugcuuguccuuuuauaagcacucuguaucaaacucuccuucaaccagccugugcggaucccauaccuucuagguaucauuccugauggagcugccaucagacuaggacucugcuggaggcagcgaaauucgugugcgugugcuguguguagggagucaaauggccaugguaggagguucaucuagucaggggucggggcaugugugaaaaacagcaaucacguuuggcacaggguccauccagucccuugggucuuccugcucagccuugguccucccacaguguccuccucucccugaggccacuggcuggccccauggugaacuugccauagggcugacaagaagcaaaucaagacuuaaaagaggaucacagauauaauucagcugcagaaugcaaggcuagcacacaagaguccugaguuccauuccucagcaccaagccaaccaaccaaccaaccaaccaacgaaaaacucacuuugccuaacaccgugcuggauugugucuaucauuccaguauuggaaugagacagcuaaaaugacugaguucgaggccaaccugagcuacauagcaagucuuugucuuaaaaaauuaaaauuaauuaugugaaaggcuuuaugccuuaaaggcccugagucaaggaaagaaagagccaagaggcacagaugccaugcagaucucagccucaugucgcaugguaugggcaggggcaggauggcagcuugcucuuaggaguagggaggaaugggagguaggcaggaaggaugccugucauggaugagcugaucuuuugucaucaaacucacaguccccuguugucugaggguggaaguggaagugaagcccugggucuccuggaaguguccuccccucauugggcuucuuucucuggagaaaaccgaauagcucccacccuuccucccagccacccagguuccagaggaaacugcuccuuccugugcuccugcagcacaccccagcagaaguugcucucccuccugugggcagagcccuucuccucagcugggauccagcaagggggcagcagguuguaggguuuccccuagccugacucacccagcuacuguacagugcagacccuugaccaacaaacaggauuucucagggugggaucucucuauaaggcacugagagggaaggcuuggggcugugcgugagccagugaugaagugagggccagggacacugugggggagggcgagguggggagggcacugugggaagggcacugugcuggugcuucaguguguuagucuuuggcaaguuccuuucauuucccagccugaaucuuuuucuggagcacaagggauuggacuagauacuguguagucuuaggugcuggggcagaaaggagaaggagaaggaggaggagggggaggggaaggagcauaguaguguaacacugacagugggggucauuucucugagccucagcauccucaucugcaaaauggaaauuacgaagagccugaaaagcacucugagcgauggaugagaaagggcuaugacucaggagacugccugcaaaguaacgugugugcgggaagccugugcgcuccugacagugcugggacugcuuuccugaagagaguagguuuuaagauuaggggaggcgcccagaugccaaugguugguggcggugggagaccagagaggggcccucuugagucccgcaggugauuagggcuugggcuguccgccugcugcauugagaagggagggagggaguaagggaaagagggaacacgggaaucggcaccucgguacugucccugucccgaggccggauccauacaucacaccauucgagacgcucacguuuucccagcuuuucucacacugaaucacuuccuuuguuuagaggaggggguaggggaggagacggagggcgacgagggaggggcccgcgggugccgccgccgcccccgcccccgcccccucccccucccggugugcggagcccgauugucacucagcucccgcgccgggggcgacgaaggcgccggcgccagaguggagucucggcuggcuaccaccccuuggacauaacuggcuagcccuggguuccccuggcauccucugagggagcgacugcccaagguuuugaggucuggggauacuuggcuagacaguucagguggccaggcgcucugccagcuuuggugugaccuuggguaagucuguggcucaguucgugcaucaugagugugcaggaaagggguggaugaaaugacuggggugucccccuuggggcagucgauggguaaggauucugggcagagcuggagcuggaccaggcuucuguuaagaaucgggcaccagcggcgucccaggugggugggcacaggguaggcgugcgcgcacgcggggaaugggagccgguggacccgccagguccugggcuuagucccucagaaucacgccugccauccagucccagguacgaaacaggggcacuaccucuuuaaaggcguccggggcugagccucugccacaccaugugauugcuugaaaggccgggcugggagcgcagcggcgggagccuggagaacgaugagccgaugcgcgcgcggugcccagaacccaacccugcccggcgcggcuccggaaagccgcccggggaacuuagggcaacgccuuugggacccccuaccgguuggcaggcaggauggugagcuccuugccuccgggucggcggacaccugugggcacuguggauucacaggggauccuuguggaguaaguguacagggagccaccucacaccugauacaaaaaccagugguggagug

SEQ ID NO: 378 - RNA, 48122 nt, Mus musculus
aaugcuugcccugcccucucaggcucgaccaagauggcgcacagcaucaaagcagcgcccuugucacgugcgaaccagggcuggggagcgcccgggcgugggggcguggccucgggggauauggccaggccccgcccuuagggguggggccaggguauccgcggaggaagggggcggguccuugaggccacgguacugggcgguggaggcugcagcuaccuuugcaggcuugccucuaggacgccucgcgcugccgaggucgggggcggcgcccugcuaccgcugggccuucggcgauuccacgcaggugagcacccacagccacuccgcggggaaggauaccccuuuucccagcuccagcuccccugaacaguuugaggaggagucucuguuagugcgccuugggaaacagccucuucuggucuggauguaucucugcggggcgcggaauucguugccccucgccuuugcugugcccugugcccuuggggaugaggaugggggucgaugcccguuuugcagggagggcguggaguucgcccucagcuccauccucucucugggagggggcagccggguggacugcgcccccucauccucuccaggagagucagagcaaaagcgccucugggcuugggggccaacucugcuucuuugggcgagcgcuggugagaggcugaagucuucgaucuucccgggggucuuccuccuucccgcaugccucuuuucgcccuugguuacuaucgccagcucugcauuccuucaacugucaggcuguaccagagaugcccccaucuccgcagugcuggggcggugggguggaaggaauggccagccgagggccugguuggggguggggaugagggugggcgcaacaggaaaagagguucguaauagagauuacugaacuggggugggggugggaaugauaggguugauuagugaacacaguagggguauuucccagcacggguguugaggguuuuaugauugguaggaagggagguuggccuggaggacuuggaaauauguuguaggugguuucucugagaaggaggagggaucuagcacuaagugccacuaggugcugaugucaccuuugaggagagauguguuggagaggaggagaguugaggcagcuccucaguacuuguucguggagagcaagugguuaagggggcugugcuuagccugaugagucccuccuggugugagcuuaagaaggcuguuccaggagccagguuucagggacucccugcaguccuuuccagacuuguuggaauuggcucuuaguacuuuauucaauauugaguaaacauuuauugggcaccuacuacaugccagacaccauacuagagagauagauacuugccuauccaaaagcuguuaaaggccauggagcagguagaugguacccgaaauaggcacacauuccccuauauacauuuuaguuauccuguuaguggaauggcagaaacaaaacaaaacaaaaaagccaaccggaucuuaacccacagaauccacaccucuguuaacuggccagauagucuuuaguaaaaaugacagcuugaaugguuuauauuggcuauuuucuuagauuuggggcuaagauuugaggaggcuucucaagauaaaugaugucccaaaguaaugagacgagggauagcacauuggguuggggggcuuugggggcccuagacacugugcagugaagacacccucuccagaaaugaguggcugcaggagcguggugugaggggaguuuucaucggaugcuuugggccugugccguugggcaugucauguugagcauguauaugaugucaguauaugagcucugucccagcagcuggccugugaaggaaggauuggaggaacggaguagggccggcagucaggcucguggguccucucugagugaugacugaaaccuuagaauuggaaagagugaggaggauuugcuguggguccuuucugagccucugaggauagcagagcaagagcuggggagagggugauuaguuggacugugcugcugaugaggcaggggugaagcucaggagggccaggggacugggugccaacgggguuuuaaggugcagggaaguuaacugaggcuuuguuacggcugaaaugcucuccgugggccuccaagagcuguacuauguuaaguugguaaaggauuuguucuaagaacauggugggcuauacuggccgagcaguauagagguguguguguacaauacauucauagugugcauaugugugcuugugcaaaugugugcacugggagugaggacugagaaagacugagagagcaaaaccagccccagagucuggguuccacuuaaggaauuggaagaaauggagggagggacuggggucagagggagagacaaguguguauugcaaccacauaagucaccaucuguccccucucuggccugcuagcucacugaccuauaauuagcucuggagggcauacggugcuggcucacuggaguguggcacuuuggguguccagcagagucaagaacacacagagaggcugugguccuaugcugaggaccaugucccaggaccacgaccccugugaauucuccagucugagaagggcucucuguauuauugaagagggaaggggcccuaaggaccugaggacguuaauaagguagaguuagcuggugaggcaggcagcagugggacaaggggcucuaagagaggguuacaugagacuugaggccaccagacccuaaggauccacuuuuauccaccccuggcugcugccucccucacaacacaagcaugguugcaaccuggcuuaguacuccaacugcggacaggccaaggcugucacauggggucuuccuucccaucuuuucuagcugucccagaagacaguucuagcacagggcagcugcaugccugagagaguuagggacugagaggccuuggcucagggucacuuuuucugagaguuucagguguuuguacuccagauggugcuuagcauggaccccaguguagagcagaggcuggucaaacccagcucuguauugcccugaaacaagucucaguaugacuguacccucccaagaagccuauuauguaucuucuacguuuucuguaucuguggcaggacuauuugagagaguaucagauugaauugaaguggucugucuucuggucccuuggguuauaugaagcagguucuccucgaaauuaagauauuuaaccugcagccgagaugugccugggaacccaguaucauacgauuacauuccacugggggaauuggcaguagauaacaugaaaaucccuaagccugucauaaagcagaguauuuggguuuagguuuaugaccuugaauguauagauuuguauaucuauagauuuguauaucuauagaauguauacauuugguauaucuuacauauuuuuaguuacuuauagaaauauuuaacaugguacuauauggcaauuuaaagaguucucaucauuuuuaaaaguuuaaaaagauuuuaauuugggcuggagagaugguucagccauuaagagcacugacuguucuuccaaugguccugaguucaauucccagcaaccacaugguggcucacaaccaucuguaauggggauccaaugcccucuucuggugugucugaagacagcaacgguguacucacauucauaaaauaaauaaauaaaucuuuaaaaaaaagauuuuaauuuaauguauaaggguguucuguuuguaaguauggcuaugcaccauauguguuccuggugccuauagaagccagaagaggacauuaggacuacugaaccaucuccccugacccugaaauacaugcauacaaacauacauaauacaccauacacaugugcauguacaugugugugugcaugcauauauauauguguauauguguguuuguguguguguguguauauauauauauauauauauauauauauauauauauauauuacacauauauauuauaugucuccugagugcugggaccaaaagugugugccaguaugcccuacucuaaaauaauauuuuugucauaugaagaaguuaguuugcauuuagaggccuuuguugcuaucuugcacagccaaugaguugaagucucauuaaguuaugaauacgugcacaugcguauguguucaguaggcucuccuguagcacaggcugucgucagacuugcugcuuauuugaggauggccuuaaauuucugaucuuucuguccccauacucaggggcuagaguuacagaugugugguucuaugcauggcugaccacuguuuucagauagaugauuuucuuuucugagaggauacagguuucucuucauuuuaagcagcuacagggguguguguguguguguguguguguguguguguguguguguugggcggacgaugaucgugguacaguggaccuuggugauugcuucagaagaaugcguuuccauguuuacucagaggaguuggacugagagugcgcagcaggaagccuggcugucugagacuggcugggacuggcugggacugguccaugcuaauuuauauucugagauauaacauggcgcggacccagccuucucucauggccauaaagaccugggcuuggagcaugcagcauaucccuaauagguugaggucaucaaagggaggguugggcccauuccugggaccugagcucacauacgaccagaguagcuugucuaaauccuuuggcccuaaaaggggcagagcgccgggaucagaaggaagguuuuauucuugcauccccaccgcucucuccauuccucacagguauccccaccuaguuucacuuagacucuuucaugacagggcuguagagauggcgcagugguuaagagcacucauuguuaaguuuccagcacccauacagcggucccugaccaucuauaagggaucuggugcccucuucuggcauguagguguacaugcagcaaagcgcucauacauaaaauaagcaaaacucaaaccuuguggggggggggggaagcacuuuuaugaucacacacaugugcacgagcuuucaugacccacuguccuuuuaggagcgugcguacagaguucuuuccuucuacaugcaugugccugccguuaccgcucguacggugcacaugcucacacaccauccuguguggucacacacccugacgcagaacuguaaccacacgcguacacgguguguuuacacacucaacagcuuucaugcacacgugcaggccccaauugucacaacuguacucuugucacauauuccuucucuuucuaacucuuacauggcuacacacacauacacgcacauaccaagcauucucaugaccacauacauauuugacuauguaaagacauaugcaugaccuccuccucaucugucucauaaacacauacacauguugguuuugaacacacacccacacgcacacacaugcacacucgcacaugcacacgcccacucgcaccccuuuuacaguaguccuauacucugaugcuucagacagcugucagcacuccgaccaggacugcuugcugcaaugugauagcuccuuaagcuuagcccugacucacuaaugcagugaccucugagcaucuuuuuuccacaugccagagaggucuguugaacauuugucccacacagaucccuggcuuugaaagauuuuuauuuuccaaauauaccauccacguugcuuugcuucuucuuuugaaaacuauuuggggacacuuguuucaguugacggcuccggucaguaugagaugccugggaugguugugcucaguaaugagagauggagaagcugagggcuguguuccguaucugugagaugucuggaaugugggcagugguugacaggccccaguguuagcuguggcugucccaggucugcugcucuguugcacugauguucuggcuuucugguugagacuuuucauuuuagcaaaacaggagaauuguacuuaguuuuauuuauuuauuuauuuauuuuauuuuauuugguuuuucgagacaggguuucuuuguauagcccuggccauccuggaacucacuuuguaggccaggcuggccucaaacucagaaauccgccugccucugccucccaagugcugggauuaaaggcgugcaccgccaccgcccagcuuguguacuuagugucuuaauagacaguacuuaaaucagcacuugcuaaacacacguuagaccagcaucccuuuaauacaaaugaaaccuuaaucaaguguccuaugaagcagauuuauaauccaugagacugacgcugagccgugggcugcugagauggcucagugguugaaggugccauccacgaagacuugacagccugagauugacccccagauccuacaguggaaggcgagaacugacuucugagaguuaccuccacaagcauacuauggccuacacucagcaggccuuauacacauaucacacacauacaacuagaauuucaaaagauaaauaagagaguuuagaacccuuugaguugguuccacccuggcuguccuugaaaguacacccuauaaucgcaacacucaggaggccgaggcaaauggaucucuugcguucaaggccaaccuggucuacagagcaaguucugggacagccagggcuacacagagaaacccugucucaaaaaacuaaaagagaagaaagaaaaagagggggguaggggagaggagagggggcgagagagagagagagagagagagagagaacuaugucagaaaguucaauuuacagccuuuggaauuagagaggaaguugugaucacuggaauugggugucacaaaggaggagcuaaacugacagguguagaccugguuucuaccaguguccuggcgugacugucuacaauacuucucuccaaugugaagaaggauuuaguguggacuguccauugugcgcucacagaggugauaugagguacguugggaaggagagacccaucgcugucuucuuagggaguaacuggaaaguugagcuucagugaugcuggcccagagagcuuguugggugagccagugccucccuucuccugugcccggcggagugugcuagguauuaggggagcugagugcuaaggcuggaugcuggugccugcuugaacuuggaacauauuugauaccuuuucagaacccccuuucugucuguugucuccugugagacccuugacaagcugugaucucccugaaguguuggguguuauguccuuucucugucagauguagaaacccgaaauugcagaggcaaaaucucacugcugguccuguagaaggugcagagagaaccgggcaccucugaaggguuuguggcaggcugccagcccuaguaaaucucacgcaagacguuaugcucugggcauggcuucuagaagucagcuuuugauuuucugacaguauuucgggugggcccagccuugagggcuucaggagccaugggugcugagcuaucacagaguuuguauugcuaggaaguggugucuguacuuccuuccauguguggggacuuguaauucgcugccagcugccugacagugguugugugugugugugugugugugugugugugugugugugugugcgcgcgcgugcuagcuaucacuccuaucucaagagaggauaaaagccuucccagggucacaugaccagccuacuccagagucugccaccuuucaagagaggaguggccccagguuguccugaggggcuguggcuuucagagggcaaguuaaaugacccuaauccugggccaggauuuccuccuuggaguuucuugaaagucuuauuagguacaagcuuguagacucacacgugugcucaguuucuuucacaugaaguucugguguuagagcuuccaaagcugccuggaguucuuauguagggucuacagcuacagaugguguaaaggaaggccagugaccgugagaggucuaaguauagaucuguaaaggucacccucacgguuggcaggggaucagacaagguccuaugggugacaugugggaagagguggucgaggucuugagggagaugaacuggccaucauccuccauccaggagcaggagaagcuuuggucaggugaagauggugugccgucugagggcacgagcagaugguuguggguaccacuggacgacugaggaugccuugagucagagaaaagugugggcuggaguccaggucaguuggaggagggcggagccagcugagggaggggccagugaaguggguggggcugugagugggaaggcgcacgcccucccaggcuugaggagaugaguggaagaaggguucaccacaggccacuaugggugugacacggggcauucucagggaagaugagaugccugaaacacaccccucuugguguuagguacaccacgacuccugauuuucccuuuuacugugacucugggaggagggggguggggcuugcuuauguuaucccgaguccugguucucauaucugagacauggcaagaagggugauguuuccuugugaggaacuuugaggauuaaaggagcaccauccuggcacgggaggaacacuuacacaucauagugguggccaucaucuucaucuuucugggucaccaccgccauuuccucagaccucucucccuuagucugagguauguaagagccucuucuuguucugcuagcuuuaaagaggcuccuacucaaugcgccaucuuugcccagaucauggcaugagcucaguuuccagcagcuugguuggggcccuguauccuuugcugagcugggcaagugguggggcuugccaucugguagggcaguagggagccaggccugugugaauguauagccagccagagagcaucagacuggagugucuaucccuccuguuuguuaggggaaaauggggcuggggggugggguggcuuuggggaagccagagaugccucagagacugucuuugauguuuauagagccagaggccuacauuucaggcagcccucccuccguaacacacacucacacccaccuacucuugagccuucugcuguucacagccuaccccacacccuuccuggcagagccccuugcaaaugcuggcucuggggccuggcacuuucgccucugaaucaggaccugugaguuugggaguugcaacuucugcuaagcugagaugauaauugcacuauuuaaagcaggcccccgagccagggaagccagguguccccauguggccgccaaucuaaaguuucuuuugcuuacccacuccgguagugguuggguuggguaggagguccuacgcggaccuccagggguuucugccugcaccuuucucuggccucaucuccaaccagcucuaugugccaucucaccagaggaaguggaguugccaccuggcaccugauuugcagggaggcuggggaaagguuuuuggcugcagagccagcuucucaguugucagaguggccaggaagacguggggaggcugggcugggccacacggccagcagcucacaguuaucucugucucaccuugcggacucuagcaucguucuuggaagaugagagggcguugccauguggagacauggccuaagacagaaggagcuuuucagacaccacucccgggcucuccuuuacccaagaugaaggcaguucuuucucugccaugguaggggugcuuucuccuuuaagccaggcuccaucuuauagcccaggcuucguggaggguaccaugcucaggcucacccagcuagacucugguagaauugcacccaagauuuccuaggaccuggcucuagccuuuuucauuugugcuagaccacagggucccuaggggucuggcauugaagccaucugcagggggcugagaauagucucccucuucccacucccucuccccuuucccuccaccccucccccugucuagugaccaagaccagggucuugcacaagcuuucaacaaacagacagacagacacccccaaaaccuaagugguuguggggggcuacagagagaaugugagcgcacuguuaaugaguuuggagagggaagguggggccccggggccuuucagucucucagccuggagcacucaggaugaaggggcucggaaacacugggcaggagauauuuuggagaaauugcugcugucagcauccccuagggcaguuuaucagacuggaguagccaucuauccuguguucccagcugcucugagguggggagggagcaugggcugucugaccacaacuuuccaccguuguucagcuggugggaaggaucuccacgagaaacguucauaucuauuucucugucugggagcauguguguuugcccuagcucuuuccuuguucccuugucugcccucuguguguguguguguguguguguguguauguguguauauguguguguguuuguguguguguguguuacuggcuagagccauggcaccucuggguauggcugugaguucugggguuuucuagcuguuccucugucuccucccuugcuugucccccaauuuugccuguuuugucagcagacugguuuucucuguugagcucggcccugccagaagcccacaucugaucucucacucguacaggcucuugccccuccuuggcugcuugcuucaccugcugaagugcccuacaucuuuagaaauggggugggugaggugggaaggacagcacuacuuauggucuccagaguagcaaccauuguauugggaccuuucugcaguuuuggaguucuccaguggaugaccugaggacauucccugugagagccgaugaagccaguggccuagcccuggccaggagguggaaaacugacgguggucagagaacuuugcagcugagaacuucuaacuuccauguccaaccuuccugugcugugaccucugggccccuggccugugcauguaaauggucauggucugacuggugacuuuugguagcaccagcaguggguaauuaccuagaccaagggagcagauugccagccaugaguaagcugccucacacaaggucuuccucuggaagcgucccuuuucauucccauuuccuuuuuuuuugagacaggguuucucugucuagcucuggcuguccuggaacucacuuuguagaccaggcuggccucgaacucagaaauccuccugccucugccucccgagugcugggauuaaaggcgugcaccaccacgucauucccauuuccauaaggacauggggagucuuugucauccagucuccaacaaagagguggaggcugcggacauacacuggucugcgugcauucuccucagcagacuuuagaagugggaaaugacaagccagccucaucccugaguuaugggcauccuagcaggucagggcucugccugccccacugcccagccugagccuugcuaagaccucagccauguuaugggaguccagccugggcgggggggggggggguguuucucccauccacuaagccuuuuaaccccuucugugccuaccuuugcuugaaugugggagaggaggcuauggggggggggagggggcgagauaccccauuuccuuuccuuccaccuucaggucucaggaggacucugggcagccugccggcugcuccccuaccgcugacugaaucauuucuauauuuggccagcaagccacguggguggggaaccacuguggcugcacuucugacagcugcaggagguggggggcaggggcugcaggcacagagacuaggcaggaggcaugugcauuccgugggcaaccuaacaaggugccaccaacucgagaaagccccgagaagggcaugugccaacccaccccccauccucucccacucugguucagggcccgccuccuuugcuccucccccgaugcccugcucucuuucaacugguccucacggcacucucuucucccacagaccacaccgcccuccagaaaccauggguguugcuagacccagcugggauucugccaagcucuggugcucagucuaagacaagggcugccuuccagcccuguucgcccagccugucauggccacacaccgaugccucccgcuuguguggggacacagggcacccagccccaacccugaaagguuaagccaggccuucuggcuccauuccacagggacacugcaggcccgaggcuccuuucagagcaagagcaacugaugucaugggagaagccccuacccaacuguccacuugccuggcacugccuguucugagacccacgcccuggguccuucugcaggugccaaccccgugagcucccucccacccccugacccgacgcugagaaggcucucuccauucccaucaugugugaggugaugcccacaaucaaugagggggacccccuggggcccccccacggugccgaugcugaggccaacuuugagcagcugauggugaacaugcuggaugagcgagagaaguugcuggagucccuucgggagagucaggaaacuuugguagccacacagagccggcuccaggaugcccuucacgagcgagaucagcuccagcgccaccugaacuccgcccuuccccagguaagguuccagacucuccccagcuccuuugacguuaucgccuuuggcccuucagucucugcaucucuuugcacaucacauacuggaguucacagaguauuuggccuucauguccccuccuaagugcagcugcccggauuggcuucaccuggagaagugaacucagaaagaaaauccagccaugacugccaacaguagggaggccauacuaccaguagguggcgcccuagacuggaaagaaaccuccuuucuaacugaguugacaggaaaggggaaucaaggaaaguagaguuaggagaagcagcagagaucauccuucguuuccaugaagauaagagaccucacacagauaaccauaggcugagcuaaaccucagggccaggugucuuggcguccuauuucacgguccucaauaacaccuccagcagcuaaaaccuuucauuuauuguguauauucugugggcuagguuuucuuuauccaucaucucaguagauuucccacaaugaaacucguacaguuagggccaucacccuguucugucagcggugaaacgggcgcuuaggggaaucagucaguggcauauugcccuccaggugguaaauagcagcaggagggcugugucucccccaccccccaagacagugucuguucucugcuuuauuuccucuuuaacacauggguucuggaaaucugaguacccacuuauaccaguaccuuuuauacuuauaccaguagauauucuggggauggggaugcgugguuagaggcuagagacuugcauaggaacccaaguuauccuacagcuucuccgagaagguguggucugccaggucaccaaguccagggaggcuggaguuugucugucuauacguagaguacagagucuacucggccagcuugccuuuuccaccucuuccuaggagagaaauggguuugcgugcucugcaggaccacccugagccagugggggagaagcagcccagaggagucaaauaauucaagccucggcugcaggucccuucuccaaaucuagggagagccagggcugagccuggaguggugagcuucaguccaguggccuagagucuugugguaguuuaugucuuaagaauauggacccuggggcuggugagauggcucaguggguaagaggacucgacugcucuucugaagguccggaguucaaaucccagcaaccacaugguggcucacaaccauccguaacgagaucugacucccucuucuggagugucugaagucagcuacaguguacuuacauauaauaaauaaauaaauaaauaaauaaauaaauaaauaaaucuugaaaaaaaaaaaagaauauggacccugguggagaggagguguggccagguggacccuggcuaccuuguccaucacaagcccuggguaauauaugcaagauuacauagcuaacuggggagagcugagauuugacuucuggucuucccaacaguuuauagucaaagcuucauuggggggaggcagugacuggcaagggucggaugcucuucagggaggaauacuuccuuccauuccagagucuggaaagccccugaggaggccgaacccuuuggagguggccuuuggaaguggaaugugagcuccucagagggugacagaggcuguguaaggggagaugucuugcccugugaaggcgugcuccauagaugguuaauugauguuuggaaacaguaagccaccaaggugaucaaggucuugggguacucagaaaaaagccaccagagaaaagucugaaaacuaguccuuaacuuuauggacaggcuugcccguugggggauucuccuggcagcaggcuaucacaugaguuagagcuggagagggagggcacagcaugcaggguagggagacagggcagcugcccagcguggggccaaaggagaggagaguguuagagaccauuagggguagauaguauugugagaugugggcaccccuucaaguccucucucuagggguguguguguccccguauagguauaugugugcaagcuggggguuaaagcagugucaggcucaggccucagcuuccagauaaugaaauauugaacucuccuucacuuuggcuguagaccuagauagaaagggaguaaucaggacuagggugacaaguccucguuuucuccccgucuggcucucuggucccuugccacuccccacaacuccuccauccccuuugccuggucugcagcuacagugcugccugugguuaugaguucuugguauuuacagggggccacagaggaggggcgaggccccagccucugcagucuguguagacuucauggccacaggaugcagccacucauccaucugagaaugguucuggggaccguguggugucaucaggcuggugggauguggugggccuggaacuucaaggagagcacucuucccuuguaguuuguuuaauaguagagcggggcuuggaaagaccucuacauggcagugugggggaguuuccccucggaagggacagucgguauaugccaucaagugcugagcuguagacuuggcuugauugaauaggguucccagaagccagggcgggcaccacagggcuguguccuuccacucucauguaggugggucuuucaaccuauuuguuguauuagcuaucugcagcuugcaaagcccguguguguguguguguguguguguguguguguguguguguguguguggugauggcacacaugagcuuuauugcauccuucuagagggugaguguagucuggucacuggugacuggagaggcaggccuuucagggcagacuuacccguuucuguaagcaguccuguuucuuggaauccuaauauguucuucaccuccaguaguucccgauagcuguaggcuuccugcacugccagggggccaggcugggaugugagggaggugggccgauaagagggugaauaagagaagccucccauggauuuggguaugcagggcaccgguuggaggugaauccuaagcacugaggguuucugggggcuuucaggaauuugccacuuuaacucgggagcuaagcaugugucgggagcagcuucuggagcgggaggaagagauaucugagcugaaagcagagcggaauaacacaaggguaaguaagggguggucuugugcgugugcgcaugcgcacccugccacaggagcaggcagcagcuuggcugagcagguucugccucccauccugggguuacgggcagacaaggacaccuaguccccagcacuggguucuugcuugugguuccugggucacagcgggguugguugaaguucugggggagaggccaggguagccacgcuggggugggcuguuuaauggaggagcagcuguuuauggacaucgugcuuggugauccugugggcccugcuuuguagcccuuggggcgcaugcccauggcccucucccccccgccccccaugcucucucccagcugcuucuggaacaucuggaaugccucgugucccgccaugagcggucauugcggaugacagugguaaaacggcaggcccaaucaccuucaggugucuccagugagguggaggugcugaaggcccucaagucacuauuugagcaccacaaggcccuggaugagaagguacccaccugccucacccuuucccauccaggccucccugagucuccuguccucuuuccuggguuuaucuacaccugcuguuagggaacuugucuuccagcuguaggaccccuccugccauuggucugguugccaauccuaguagguucccugcugggcuguugcaucuccacaggcccuucacauucucccauguggcagaccaagccugugcugccccagccccgaguucuguaggauggcuuucuuccccacaucucuccuuauccugggcaggugcgagagcggcuccgggcagcucuagagcgcguuacuaccuuggaggagcaguuggcaggagcucaccagcagguaagcugcacugucccucugagaaagccagccaguaacucuugaucacacuguguucuuuauuagauauccgccugcuguggcuggggacagguagcugaaggguguuuuucuaggaggacucuucugugacucaugguuuuuauuuauuuugugugugugugugugugugugugugugugucuuggggcugugucuuacagguaucugcccugcagcagggugcaggaauucgggauggaguagcagaagaggaagggacuguggaucugggaccaaaacgccuguggaaaguggguaauggggaacuguuugucaggagccugcaacccacaggacaggaaugggaggucccgccugccugggcucagcuggcuauggcuuuaauuaagcuuggggcguucuauccucuucccacuccucuuuccccuccucgcuccuuggcaagggaaucuguagguuuccaguuuugugcuacugcacaugauaggccugugcacacaucuuccugugggcaagcaucugacaagcuuccucuggucuccgagccuuucugacccuuaucugccccuuccugggauacaagagguggagcuagaaggaaaaacuagaaacaugguuuuuguuuguuuguuuguuuuuaaagauauacgacacacaggagaccauggguauuuggccauuaucaggagugagcuacuaggcucagugauccuaagcucuaaugugggguagagcuaugagcugugggcauggguuccuuccucccagccucccugggauggagcagggugggguacgggcaucucuggcuccuugggugaugguucgcugucccuggaggaugacacuggccgcguggaagagcugcaaggacucuuggagaagcaaaacuaugaguugagccaggcccgugagcggcuggucacccugagugccaccgugacugagcuggaggaggaccugggcacggcccgccgagaccucaucaagucagaggagcugagcagcaagcaucagcgggaccuccgagagguaggcgagggaggcccaggccugcucuaggcaacugugucuugcuggcuacaggcauuggcccuugggaggauaugaacagguguccagccagggaggguaagacucaacccuuggcaggguccacugugacgggggagaugggaggguugggucaaggccagacacugauaaggggagcacagagcacaggccuuucugggcaugcgcagucagguguuagugggaggggcagccaugagaagggcagggaaaggcuggugaccuuuccucuccgacucucugcuccgcccaggcucuggcucagaaggaggacauggaagagagaaucaccacacuggagaagcgcuacuuggcugcucagcgagaagccacauccauccaugaccucaaugacaaacuggagaaugagcuggccaacaaggaaucccugcaccgccagguaacgcggcuagauggagcggggugacauuguaccugacucuaggggucucgaugaucacguggaaacuauucuuugguggccauaggaaagagccaagacucuucuggccugucaccugcuugcucccugcuguggcugggauggagauggggaccgcgcgccaucuugacuuguucuccucuuuguacugcuagugugaggagaaagcccggcaucugcaggagcugcuagaaguagcagagcagaaguugcagcagaccaugcgcaaggcagagacucugcccgagguggaggcugagcugucucagagaaucgcagcccucaccaaggcaagugggccgggggccugagaucuucuaucaccuccuguguccuaggcucuuuuggugccagggaggcacagcaggcugggggccagggaguugcuccccacagugagacaccauucagcacagugccuugaguccuccagucucucaguugagaagguaaugcuggccuucacuacuuuuuguuuuguuuuguuuugguuuuuugagacaggguuucucuguguagccaucucucuguccuggaacucacucuguagaccaggcuggccuugaacucagagauccaccugccuuugcuuccugaguucuaggauuaaaggcgugcgccaccacuccaggcuuaaggcagaguccuuuaaggagaagccucuacagggacacaggauacuuuuauuaucaucugggccauuccagcugauacuucuuuuuguuugaggcugugggauucgggggacuguaccaucaaggcaggagcagggagaguuuuagucugagcauaucuuucuuuacccaacugaagcauucuagcccuggagagcaucccugguugcuugaaggcugcagcuuuagaaugaaguaaagauguauauaaauuuaccuaacggagagguaacugcaguaauaauuccugagcagcgugcaggccagacaccaguagacucagcggccaaagcagauauggcccuggucuucagaggcacaguugggcugugaguucagucuuuggaggacccaucugucacacuggaagucuguaagcaucaggcucugggucaagugcucaugugacagugguugcuuuuucuuguguccggccagcagaccacaaccuggguucuagccuggaaaggcauuuuggaaaccuggaagagaagaggggcuagguggcgagagaaaagaauguagccaagacaguuacucuaaucaaggcucaaauuuuauuguugcgacacuaguuaugaaggaagggggaggggacccgauucccgccgaauaaucucugguccaguagaaaggugcacguguguggcuccacagguuccagcagugggcguggcagaacgaaugagcaggaagcuccaccccugagcaagcagguuucaggcugggggaggggagacuacagcuuuuaccugaggguuuagggagagcucuggugaucacaagucacaccucuacacagucucccaucacaacgacagaauucaucucugguuaauccuaggugcgugcacuuccuccucucucagagucuauuggucaggucacagagccucucccuaacugcaccucaguuuccuuacuucuaugaugguggaguugccgggguagccacuauuguccuggcagaccuggaaugaggcccgagacuuaaguuccaguagaggauguuguggggggaugcugagcaaaaucugucucgaagggaugggcucaagugauugguguguucaagugagucauagcaggaggauguaaagaaaggguuuccugacuguaagggauguaauguucuggguacagauacaacaggguccccaugacuggauaauggccaggaauggcuagcugguuuaguagugguuuagguaauagccaccaggaggcuagcauucuggcaugcuuaccgcacuuggacauuuacuguggauuauucccuuuaguucuuguggguccagugggcauacacuuuaagguuagcccugggcaagaaggagaggggaaaagggaguaacaguucugcuccaagaugaugggagagagcuggguuucugaucccgagacccccgauccccaagaccaccuugacaccagaguuuguggcauauggggccugagcauagggaacaaagaucuccaagguggcugacugucccugcaccuaggcugaggaacgucauggcaacauugaggaacaucugcggcagcuggaagggcagcuggaagagaagaaccaggagcuggcaagggugagggcaccaguuagccaucuuggccucuucuccacccccucagggcaggcuuacagggugguccguggaggggggagguguacagaggaaaggcuaggccagggacaaagcucgcauggggucaggaggaggcucgcagacagggaggaguggauugaaagagcuggagagaauuguccuagaggacagaugaguggacaagugaguuggcacagaaccccgguagaaauggaugguuuuggaagaggguggugacaagccuuguggagacuaaguacaagauggugggaugugcaggugcgccagcgggagaagaugaaugaagaccacaacaagcggcugucagacaccguggaccgguugcuuagugaguccaacgaacgccugcagcuccaccucaaggagcgaauggcugcccuggaggagaaggugaggaagcuggggugagcacagugggcagggugggcauggguggagcccaguggacuggaggagugggauugugaggaguuaguguguggugguggggggaagggcauauaaaaauaagcauauugguaaagccaccugagccacaacgagggaagggaggagcaucccuggccagggaggaccaugcuggccuggagagguagggcuggaagaagaagacaccugagaucggggucacuccaagaucagagucaggaccccuggcucacagcugcucucccucagaaaaugcugauccaggaguuggagaacuccugggucauagagaguucauagaagagcuacagguacccagcugcuggcuagcccugcucaugugggaggccucaggcacagugccugguguucacgaagcugcucugcuagccucucuuaggucacgcgcacacuaugccaucgcccgccugacacaauagcuauagacuguauauaugcuguauccauacagaggccagaggagcagaggccacggacauaggccauaggguuagcucagacucugggcccacugaaggaucuggugggagcuucuaacuugugugaggaaagaguccuaccugcuggagauagcagccgugucuuuagcggugugugccgcaaagaccugguccucucugcugccuggcuucauuugccuugcauuugucugguggugaggcaccaacuggccugcagaacucuucucuaggcagggucgcacaguuucuggcccagccccucugucaaucuugugcuccuuuucccgucacaccucuuccuuggugucauccacggcccuagcuuggggcccuuggcuucggaccuugcaguauguccuucuccuuugccccaccucuguucuccucuuugccccucucugacuuccacucuccccucucugccccucccuggccccaucccacccugggucugccuggcacagggccgucugucugaagagauugagaagcugcgccaagagguggaccagcugaagggucgaggggggccguuuguggauggcauccacuccagguacuagagugugggacucagugcaugcuggguuaugguccugaguggaucuuaagaaaggagacucccccaccaaaacacugcccgggaccucagggucuuccguccugucaggaggggacacuggggcucagggagcuuggccaguccuucagcucaucugggcacuuaggaagggagcauaccuccucuagggggugcugagaggcuaggaaucaauagugguccuucucugcugugggaggaggccaugcuuccuagauccuugccagagggcacgcccuugaaggguccacugaguuacacgcucuccguuauccugcaagacccucuguagaguucaccacucacugaaguucuugugagagucaaggaccacccaaguucaaguaggagccagcggacagagagacaccggggaaagugaaacaaggcagcaacccuccuccuguuggaaguggagaagccacguuucuccguggccuccauaucccuuuaccugaaagcauuguaagacauggccaguggcgcuuguagccauacuuugugaagcaguuggcguugaacucaguucucagagcaucgagguagggugaagaggaagaugacugaugcuacugccuaggguucuugacuccuuguugucucugagaugugcugaucccuucaguugguguucuugcugcaccaggacauggacauuagcgguuaggaaggugguuacgggaaacacacauguaugugugcauaggaggugcuuguaugagggcaaaggaugcugggcuggaggugagaggccucuggagcucugaggugguaggcaugcaagucucaucuucaagcucacuagaaauuaugcucuuguauagggagggggugaagaggagguggcagggaccuuucugaccucuccuuccccauugguugaccagaaggaacaagcucucagugaaugagaacuaacccagagcacaccaaagcccuuugcugcugcuugcuuuccuugcugaccgggaacucuuggccucacauguugagucacagaacugagguggggaagcuaggcuggagcgcccucuucccggguacaugguuuagauuguaggcuccuuugccucucuguauuaggcuccaucaaggcuucugaacugaguagccauuguggaagaaucccagagaaggcuucucaauaccagacauuguuccaggugcccuaaagucuugcacuugagacagacauguugggcagccaaaguggacucucuaucuuguaucugugauuuagcuuuggggucuuuaaagcuuccuagugauguggaggacacaccugggugaaucugagccagguguucaguucagguuaucaggaaaccugcagagagugucuagagagaaaaccaagaugcaaagaccuccagacuugaauggcccuuagagcuccugucuuuagauucaucuuuguccccugggccaggagcccuccugcauggcugugaucgcaaaagcccaaggccuuccacuugaaugccucucugacagggggcucaacuuuuuaaaaagcauccuaacacuucuugucaggagacgauccugcucaugcagaaugguccaccgcucccuacagcauccucccuuggguccauuugacccacccccccaguaccggggcuuaaguggagccucgugccucccuggcagcucuucugauguuugaaacagcuguaucccagacugcuucucuccaaacuggccauuccccagucguugggcccugugaguguaggcuggggcuaucagucuucagggccugucuuucucuccugucacucaaggucacacgugggcagcgcagcagaugugagguucucacugaguacagccacacacgcgcccccaggucugcaucgacgcuauucggcgcugagggaugaaucugccaagguaagggguggagggauaugugugggggucucccuggggaauguggggucaguucagccgugugucuggcuccaguuacagacgacuggcguguggugcaaagccucgcccagccuucuccccugucaaugacagcugcagccuugggguugggacucuugucagcugcaacagcugugacacacccccccccccuuuaccucagccucccagugggcaagagguagggaguggaagguggccaguggucccugaggccccacuacagcaugugagcgugugccuggcugugcaccauucauuucuggugccagagagggggcuggaaggguaaaguggaauuaaugagcuuccuggaacaaaagcauggcuuauagugucgaggagggagagauggcagauuaacuggccccccaggcaauggcaccugagaagcagcugggaguuuacacuguuguccaggaacuuggggugggggacagggaaagagaaggggcagaagagggccagcuguccaccaaucgccaguccucaucuguucuggggcccuagaguaugggcacagagaaagagggaacaccuagucggauggggagagagucaucuucaccuuugagaaauuccuaauccgagcuugguguguagguguguuagcguacuugguguguagguguguuagcguacuugguguguagguguguuagcguacuugguguguagguguguuagcgcacuugguguguagguguguuagcguacuuggaaggcugaggcagguggcuugugagccaguugaggcaacaugacuagaacccauugaaagaaguggggaggaggaaggagugaaagaagaaaggaaggaaagaaaaaaggaaggaaggaugaacaaaagaaagaaaggaagaagcaaauaaacaagcauacaugcagggagguagcaaugcaugagggcagccagguagagagacaggcaggcaggcaggcauugggagacaggcaggcaagcagggaagcaggaaagcagagagacaggcaggcagacaagaggcaugcaugcaugcaugcaugcagcuaggcagagaggcaugcaugcaugcaggaagcuagguggagaggcaugcaugcaugcaggaagcuaggcagagaggcauguaugcaugcacgcaggaagcuaggcagagagacaugcaugcaugcaggaagcuaggcagagaggcauacaugcaugcaggaagcuagguggagaggcaugcaugcaugcaggaagcuagguggagaggcaggcaggcaggcagagaggcaagcgggcuggaaugcaggugaaucugcucacagucugaaggccucuucuuuccuuccucuccugacucuuuacuccacuguuuauaagaacacagcagcugcuuagaugcuccaugcaaaagaggcagaggcugaaaugcagcacugggguggggugggguuggggaugaggagugggguguagggauggggacacaggacacuggagccuugggucaaagaggcugugccagagccuuucucuggccacaucuucaucaggcuuccagaggaggugcaggguucuagccccuagcuuuccaggguucuuacugccgccccuuuccuuugcuaaggacuggaagccaucgccacugccagggguguugggcgccaccacgccugccuuugacagugacccugagaucucugauguggaugaggaugagccugggggcuuggugggcacucaggucgaugucaucucacccgguggccauucagaugcccagacccuggccaugaugcuacaggagcagcuggaugccaucaaccaggagaucagguggggugggagugaagcugccugggaggaugggcccuuuggguggggcacugcaggagaaguauugacuccugucccgucuuacagcuuaggacagccauccagggacacucgguagguaccaggcaaggauucgggccucguauugacccuagaggggcagggcuacagaugacucuaggugucaucuguccccucugggcugggagguggcugggcuugggcagauggagcugucuauguuccugguauucaguaugcccgugaagaagccagcucagggugggagcuuugucaaugugaugguuagucaagagggguuuagugauuugcuuacaguugcuaaguggcugagcccagacaggguaaaguuaaguacagguagaagcucuccagugccaugccucucaagcuauaaggccacaucaaauggaaccggagacagggaaaguugucaaaaccuuuacuacauccugugucucuagcgagcuuauuuaugguacuguccaugcagcaaggugaaauugacaagcuguugacgucagacuuucaaauuugagaaaucagcaucaagacacacaugcaaauacaagacuccaguguggaccucuguagaguauuccaguagccauagcuaccauuuacugucccagcagauuuucaagagaaaagacauuugaauggcuucagaguggggaagguguuguuucagaauaaggacacgucccucucugaagcccaguuggcaucuuuccaucagugggugugaaugcauaugcacagcuuucccugagugccccuugggcacaacacaccaucucccguguuucucauuugcagugaaacagagguaccuaauuagaggcuggcaugaauuuacaaaugcccuguuugggcauaaacaugaucccaaugguggcguguacugggagcgaaggccgcucaaggucacuccuguagcuagugcagcucagagauucccgcugagaugggucauaguucauggaccaaaugccuccuuccagaaaugggcuuuuguuaaacugggaaggugacuggccaaagagcccugggagcccugguggugccuacggguguugcccaccuuuggugcuagggugcugagugcaaggcaguaccuagcaacacccugguuuucugagcaggaugauccaggaggagaaggaguccacugagcuucgagcugaggagauugagacccgugugaccagcggcagcauggaggcccucaaccugacccagcugcgcaagcguggcucuauccccaccucucugaccgcccuuucccuggccagugcaucuccaccgcucaguggccgcuccacacccaagcucacuucccgaagugcugcccaggaucuggaccgaaugggggucaugacccuggugagucugggcggugguugagaggccuugcgacccuuaggcccguggaugccauucuggcaucuuuugccugugacaugacaugcuaggucaccagcaugcccuucuggguaggaaggacuuuguaacauccucccugcucccuucuuuggaugaucacaguaggcuuaaagccacaccccacugucuggcugcucucucuucuugggaggggauuuaucuuuccaggugcuccguuccuuccgcugugguacuuuuuccaggcugguguguguccacggcuccucugcucccauccuaagcagacucgcccuguccucuuucucucuuucagcccagcgacuuaagaaagcauaggaggaagcugcuggugagugcuucccacaccagguacuagcuuacaccagguacuagcggguuacaggguuaccagcguccagacccuuuccucuggccuucugccccuggcccuggggucugaguuuaccuugagaggccacagggccuccccgaaguguucucugguucuccgauccucugccuugucugggcuggguaggcaggccccagcucucucccucuacccccugacaaccccacugucuguucagucgccagugucucgggaagagaaccgagaggauaaagccaccauaaaaugugagacuucuccuccuuccucacccaggacgcugcggcuagagaagcuuggccacccuggccugagucaagaggagggcaagaggugagugagcagggcaggcuccaccucuggucucugucccgcagccuugaaggggcugcaucucaccugccauaggugccugacugcuucauuucugcuugggacaccaucagagacugauguccccacaucucccucagucaccugcuuuggcuccacccccucccauccauccacccccaacacugauaguuaacgccuuccugaacucuaacuuccaucucucuugcugcaauugaaguguguuucuucuuauucaccccuuccuggcugucauccuguagugccuuggagggucaggacagcaaccccagcagcagcaacagcagccaggacucccugcacaagggcgccaagcgcaagggcaucaagucauccauuggccgccuguuugggaagaaggagaagggcaggcugauccagcugagucgggaugccacgggccauggucucugccuuucacccagagagcugggcggguacuggggagucagcuuccggagggccugcuuuguuugccuguccuggggcuuguggguaggaaccagaugccaacagcuuccagcucuggagagagggagguuuucauagaauugugucaugcuggacuggguuaucucaugagcugcuagguuccugugccuacgagugccaggugguggcugcuguucacugaccugaugugcugcagaggcgaaucuguguggaggcaaagauggcucccuguagcugcuuccucuguggaucauuucuguugggcauucuaggaccugagggcaaccauccuggcucucuuucauuuaauuaacuaauuaaauaacuuccguguguguguguguguguguguguguguguguguguguguguguguguguaugcaugcaugcauuuaucuuaucuaguuauuuuuguuggucguguuugguucuguccuaggucucugggccauccagccuguuuccugccccuccaggcagugucacaugugggcucccccuuguggcaugggucucaaguugggcgagucacuggcugugccccagcucuuaagaguuggaucgccacuagcucugacuccuaagugcaucugaguuuucacagggcugaggaugaaaucuuccgcuuuguuuguuuguuccauuaucagggauugaacuuggggccuccaacauacuagaaaagugcucuaccacugggcaauaucccuaggccucuguuuaagauuggguuucauuauggccuugaaauucucucuguugucaaugcuggccggccuugaacuuaugauccuucugccucaguuucuuaguaccugggauuauaggccuggguuuccaggcuggguucuaauuauaacuuaauguuuauuuauuauuauuauuauuauuaugugugugugcacacacacgugcguaugcaugugcgugagagugaguguuugagauagagccuugcuaugugcccuugauuggucugguacuugcuguguauccuaugauaggcuuaaacucauaguaauccuccugucuuugccuccugagugcugagauuacagauucuguggccuuuuuuugcuggagaagaugguugggcaggaguggcccuucugacaccauguggcgguggagagcugugguucugcuuggccugugagaggcacgcaauaaaccuucgccuuuccacccuugcucuacuuccuccucccucucucuuccucucucgucuguccaccauuuccccagucauuaucuauacauuaaguaaccccauuucagcacaauauaaggggguggcgccauaacucagggggccuggcagcugauucaaaaaggaaaaacaaugaaauuaucccaaaacacuauguuguagagauggcccagguguugcaggacccagcaguagccauggaagggcuggagaaggggacagguauccucugccaggaagcucugagcugaagccuguagggugacagaauuuggccaagacaagaaagguguggggggcuggggcaggggagagggugcagcuugaggaagggaaagacauggggaaaagaccagugugugccgcugcccacuguagaggaggaagaggcgggaagauuggggcagaggaacggauggcuggccuagcccaucuuccugagccugagaggagagucagaaaucccccagugacuggagcauuaaugaaucucucagggcaagaacuugaucagccggaagaaaggaaccuauggaccuaaaugcauaauuagaccuucccugacuucacaucccuggaagggugugaaucagaacacagcaaucugagaaaagaagaggacgaggaggguaggagucucacucagccuggaagaggggcagagcaggcaggaagggaguggagccagcgacagaaaggucugcucgguggcagaggcaaccugcaagaggugcgauuucucguuccucacccagugcugacagcuaagcuuguccauguugcacugcugcugccguguggacagaggggccaggccuacagugacuucagugacaaugcccucucccaggaauucuccaggguuucaugcugaaucagggagauugucaguaggagagggugaaggggagucccccuuuguggucugugcaagugaaugcaccuggggagaggcuggugugcaagaggacacccagagauggugcgugcauacaugugcauguguguguguguguacaugcauaugcacaaagagugagacagaaaaguagagggagagaaauagagggagagacagacagacagauagacaggucucucuuacacacacacacacacacacacacacacacacacacacacacacacacacacgaguaugauagaguguagccagagagauugcccaagagauagaucucucaauaguuuuuuuuaucaagucaggauaguccuuucugaauucuuuucuguguccauucauauuuucacuugggguuugcuuugcaccuuggcuuagagacguagugggcucugccuagggaucuagaguggaacaacucugauccaucuuguuggaaaacacucccagggcucaggaucccccggggaugaaucaaccagugucacucuggggcugccuggaauguggagacuucggggguagcccugggaaugagauggggacccgucagcuuugcuuggguugcucuguguguguguguguguguguguguguguguguguguguguguguguguagaaggugccuucugcugcugcuucauuuucuagguccaggccaaggcagaagcagaagggcugcugacauaucugugucuucauuuccaguucugcucacagacuccgagcucagucugcaggaaccaaugguaccugcuaaguuggggacccaggcagagaaggaccggcgacugaaaaagaaguaagagccuuggaccaaggugcuacuaggguggcccgggcccccagcugcuuuuccuccccccauuuugagcucagagagauagaguccggcaagacuugguccaugcgggcacaccugaacgagcagucccgaguugagaucgaggccucaggaugaucccggggaacaggaaucaggaaggcugugggagaguaaucuggggccuaugguucucuugcagggcacauggagaugccuaagucagugugugugaggugugaggacacugugggcaugcaggguguuuccugacccacuuugaaguuucauauugcuucaggcauagagcagaagaauucaaggguggggaucggggggaagagcgaaacggcagcucuuggcccagccuggagugguccccaggacucagccugguugagagaacaaaacacuagugagccuguuguuccucccccaagacaccagcugcuugaagaugcgcgccgaaaaggaaugcccuuugcccaaugggauggccccacgguggucuccuggcuggaggugagccugggcgauggagaugcucugggaucuggagggaggaccaugugagggcggguuucuccauuccuaccugagaggacaguccucugugaacccaagucacuugugucugcucuugggguucgcuuugcacccagguuuggugggaugaggucuccuaagcagcaggugugaugucucuguaacuucaccagaguauuucucccacgugugugccauaccaagaacgagggagcaaguuacagagacaucagucuuucacaggcagacucgcucucccaccaggcugccccaggaguaaccacccaaaugaugcugaguuguuccccugugcccgaugucuguagcucuggguggggaugccugccugguauguggcggccugccgggccaaugucaagaguggcgccaucauguccgccuugucggacacggagauccagcgggagaucggcaucagcaaugcccugcacaggcucaagcuccgccuggccauccaggagauggugucacugacgagccccucagcuccaccuaccuccaggacugugaguagccuccuucauccucagguccacaaaggcccugacauaguguuugcacagucuccuacuggucuuuaggaaggcgggaguacugagcccugcuuuaaccucccaucuccaccagucuccccggucuucagggagguacacuguugcuucugggaggauccuuggagaucugguucucugccucccaugggccacccauaggcuccauuuccccaugccuaccugacaauaacugcagaucuggggacaguuucuaggauagauuguguagagcuagccuguggggagcuauaggcucggcacaugggaggagucagggaagggaaaguuguacuuggggccuccucugggggucuugaggggugggguugcggcaucagggucuaggaugccuuccucucugccugcagucuucagggaaugucugggugacccacgaagagauggaaacucuggcaacaucuaccaaaacagugagucugccccuuagcccgaggaccagcgacacccaugaagauuaaguggaaggugugggaagccagaggggcuggcagggauccaguaucccugauguugccugguucuguucucaggguggaggauugugcguaggcaagaugagauugggacucauauguuacaagcucuguuccagucauaagacccuuaguggcguugggcuacagaaagcucuucccuguuaugggucugagucacaaacuccauguucauggcuugguccuagggagcaaucaaacccgggaaccaggaaacauguuuuugcuacauaaacguguuucccucaccacaauuaugcauguauacaccagcuuucucaacggacccaacuaguuauucuggucgcccacuagcuauugggaugucucuccuccucuuuuggggaagccuggguggaggcuccagguuucuugacuuucaugucuccccugacaugcggcacuggcuccugcuaggacagugaggagggcagcugggcccagguaagaccccuccucccacaucagaacuacuacucuaugaaggucaaggcagcaucccccccaccaggcucugaauggcacagcuggccgaguccagugugugcauguccuugucacacgcggagcccugaacaaaguuccuuccccucucuacccccaaacucccuuuuucauucuuuuucugcuuuccuaggaugacaggugaggaguccuggggggcugaggccccagcaugcuggagccuucacaauuggacucucuguucaugugugaugagucuuagauucagacaguccucuuccauuccuuauccuuccaaaggucacuuucgugagcaucuauuaggauuggccggucuaaaguuucucaaugugugaagggauggcaugagagguuugauggaauaaaaggaagggugauauuuacaaacacagugacagggugggacaguggcugcugugguggagaguguggcagggcagucaugcuugcucucccugaccacacuaucggccuacacagaauucacuccauagaccagacuguccuuugaacucagagauccaccugccucuucccauuaaguguugggauuaaaggcaugagccaccaccaccaggcuaaugccuucuuucuuguaguagaaggaugguagacaguuggguauagcaacugugugugggcaggcaguggggagcaggacgcaggggaaagaaagggcagaggcucuccuaguucugcacuuggaugcggacuauagaggauaacuucauuugucugcuugauaauaaacauauucuauucgguguacaauuuuacauauaucagcaugugcaguuuccuuuuaaaacagaacagcucaaugugaaaacaucuagcaggauaugggaaagguguuugaggguugcuaucaaaacugaacugucccuguuugcugucuguagagguaaugccuuguagugcagucuucuugaggcgagugacaucaugagugggaacauuaauaaaggaccuggagaauugcccaagugaugaccuggccuuuggggaagcacacuggcuauucaaguacaggcuacucugugcuuuuuuuucuccccuagccuucagccaacauucagucauucucuggacuucgaagcuagccauuccccagagucaggcuggcauccuuugcagauccacuauacccuggcugccucuccucuggcucagcaggcuugagguugacauaaguuggcaaguugucuauacaucacuacacaccaccuuccagagguggcaggaagggcucuguuuuucuuacuccuuggacaauugcucuuguucauugauguaggccagaaguucucgacccgugggucacaguugcuuugggggucagauaucagauaguuauauuaugauacauaacaauaacaaauuacaguuaugaaauagcaaugaaguuauuuuaugguugggagucaccacaaggugaagaacugcaaagggucgcugcauuaggacgccugaggaccccugguguagacagcugauaccugaguagaccugggucauucugagauccugaaauaccucugucaccuccaaucacuaucagcuccuuaguacaaauaaacugaaauguuauugaacagcuugaccucucaugggugaaggggugauugguauuucuuccuaauagauaugccaccuguaaccuguuggcacugccugccucccaacccccccccccccacccccacccccguccucuucucucucauguccccagacccuggccuauggagacaugaaucacgaguggauuggaaacgaauggcugcccagccuggggcucccucaguaccguaguuacuucauggagugccugguggaugcccgcaugcuggaucaccucaccaagaaggaccugcguguccaucucaagaugguggacaguuuccauaggugagccaggcuggagccagggccccucccuggugguguggugucucccccagccccgggucucugucuucagaaauggagagggccccugucucuuuccagggccuguuuugggugguaauagcuuucucuguuaugaaacucccucauauucuagucauauucuacagguuguagauuugauccugucaccuuuaacccuuaggacacaggucguuguuuucaauagcaucaucuuugagcauuuccgcucauucugaauuuccuuggcugucucugggcuugcugaauucucuguguuaaccaagaaggcucacagugaaucaggcauugaguuuaggcacugcauuucuucuaggucgugucaucauuguaaaagaauaccuugugaaaugcaacguaagaaggcagggcuuauuuuggcucacgguugcaggguacaguccaucaugauggacaagugaagacggcgcagaagcgugaggcagcuggucacuuugcaugcccucacuaguagucaggaagaagagggggacggaagcuugugcucggcuggcuuucuccuuuacauagagucuacgaccccagcagggacuggugcuuauaggaaagaccuucauaccucaaggcuguaaaacuccagagccaaccccauggccuaaugaggcucuaagaguucuguuaucuuuccaagcaguacugccgucuggucaccaaguguuuaaacacacgagggaccaccgcaccaucccaggggcaaugggccuguugugcuuugaauccuuagugggaguuccucugcuugggaccucuguuccuuuaugcagaaugucaccuaauccuuuucuucuuuugaugaaaagaucuguucaaacaugucaugguagaggucccaugcuggcagccugugaguaggugaccuauagauauauuuuguuugacccacaugguugccaguauuuugcuuuuguucuaauuuuuauuauuuuuauuauuuauguguaugguuguuuacuugcauguaugucugugaacugcacaugugccuuuugccuguggaggcuggaagaggacauuggauccucuggaacuggggucacagaccuuugugagcccucuugugugugcuggaauuugaagcaagguccucuggaagagcagcaagcgcucuuaaccacugagccaucucuccagcuuccguugucaauguuuuaacaguaguuuguaucugaguaucugguauuguggcuucuuuugaaagauggaaaguucugugggcacaguguagacuggacaccacagccucuccagcuugcuucucaauuagcuccuuagcaacagccagcaucacugccuggucccagcucucagagccgacuguuagauguucuuaaccagcuuuauagagccccacuucccacuuaagaccccccuuugccucaagucaaugguaagauggcagguggcauuggguguguguggcuuuucuaguuccuucaaggcuugguagauaucuuccaguugauacaccauaguuuuguuuuguuuuuaaaguuuuuuaagacaggguuucucuguguagcccuggcuguccugaaacucucccucuguagaucagguuugccuugaacucacagagacccaccugccucaguuuucugagugcugggauuaaaggcauguaccaccacugccuggcuuacaccauagaaauuuaaaucugggcaggaucuaguuaaccccuucgugaccgaggagaaagaggcacggcaagcagcagcuuagggaugauggccgagcacaggcggaacuaauucugcagacucaaguucagucccgggccccuagccuuugugaccccacagggacuugugagggcugcagggaagcgaagcuaugucuccucugcccuucgccccucacugaggcuaaaagagagucuuugucuuugccugggcagcugccagccccagcugcaccugucuucuccugggugauugacagcugagagauaugcuacuccucugccagucugccacgugccugaauugccggagaacgcccucccaggcauggugggagcccucccacagccccgagccugccacagggccauagagcagcucugcugcuucaggcuucugagguaucaccacacagccugcccuugccagucacucugcuuccauuccaccugccauuccaguaccacggucuuuguuuccuguuggagccuggcgacaaggacucucacucuauagcccaggcuggccucaaacucacagcucucuucccaucucauccuccagguacugggaucacaggugugagcccucaugcggaaccucagaaggauacuugugggucuggaguuuguccuuucuuuuugaaauggggauucucuguguagccucuggcuauucuggaccucacuuuguagaccaggccuuaaacucagagacccuccugccucugcuucuuagugcuggaccuaaagcaugugcuaccacuggcuuagauuuuuuuccucccuuuguugcaacaguugggauuuaguguagagucuuuacacagacaucaggcaugcuguuuugguuaggguuuuacugcuguaaacagacaccuugacuaaggcaagucuuauaaaaacaacauuuaauuggggcuggcuuaaagguucagagguucaguccauuaucaucaaggugggagcauggcagcauccaggcaggcauggugcaggcagagcugagaguucuacaucuucauccaaaggcugcuacuggaagacugacuuccaggcaacuagggugaagauauuaagcccacacccacagugacacaccuacuccaaccaggucacaccuccaaauggugccacucccuggcccaagaauauacaaaccaucacacaugccaacacugaguuauaaucccagguaccccucccuuuuuugaaacaaggucucauauagccuaggauggcuguaaacuuucuauauaguaauaauaaccaugauccuccugccuccacuucuaggcaugugccucugcgccuggucuccccgccaguuuuguauuuuaagacagggucucacuaaguugucuggucuugaacugauucuguaaucacacuugaacuugagaguccucuugcauuagccuacggaauagcuuggauuacaggcuugcaccaaggcaguuuuggagccauuauuuuuaugacgaggaaggggcauuuacuaacggagguagcaaauccaggacagguuguuucugucugcucacucagcuggacggcuaaucuuuuucaucuuuucacgucucacccagugcuucuuggcucgggauacuccauugagugggguucuacuguuauagauccuugucccacaucagucacaccuacccuccuaacagugguccuccuuuugagucccugagauguccugggcccuuccauucauugucaauuuuaauccccaguacaacccuuaaagagaggcgggguuccaucuuacagaugccggcugcccucugguaggcugugccggggcuggcuuucaaacccaucuugaccuaacuucaagggcuuuauagcuuugcuauguuguacaauagcugugaaagucauaggaacuguguaaaagauuacagugagacuaauguauggggcauuucccagcaggggcuguaugugccuuugacauccagagcuuaagacagccgcuugagccaucaauacaggcagccgagaaauguaucucugagcugugaguguuccaggcagaagagcuuugcgaguagccuguauaauuuaaucucaaagggguuggaguuaggagaagacuucuguuucguuucucagugugagggacaaguccagaaggugaaagagguccuuucaaggcagaacccuuacauuugucccccuguaaauuugucccccugcccagccauggagggguuacacuguugcucagccagcacuguggaagugcuguagggugaguccuagauuuggagaggcuuggacuaagggccaugguucuccuucuaacccaagguccucuguucauucucugcuuaucacggccugcugcucucuuaguauaguuaauaaguuaggagaauugccucauuuucucauuaagcacuuacagagcaccuaggacacucuagagaucugugacugugaguuaaacagucccguccccaggaaggggacauucugacuuggugagacaagacaguuaaggaacuaggagaaaaugagaccaaguuacugugggaguuacuguggcgcggagguggugcuguagugggagccugcugacugagcaaagacuuaaaggugaagaaagagccuuggauuacaggcuugcaccauuuggaaaauugggggugggauguucugggcagacguagcaaccagugcaaagaucugggacacccaggucucagaagcuuuccguguuugagggacagcgugaugucagcagagagaacaaguugggcgggaaagggaacaaguccguuggcaauguacaggcuauagaaaaggcugaggaaaacgguaauacggagugucuuggauuucucuuuccuuugacuugugaguggcaaugauuuuuauuacuucagcgccugugaagaagggacauguccgugucauccaaagcccucccaccagucaggccacagcuuaggaggaagcauugauuuucgcuucuucuuugagcccuucguugugaaggggaaagcagagagaaugucugggcccuuaggcugugcccuccccuuucauuccaucuggucuccgugggauggagccguccauacucaggaugggucucgccaccucccuuaaccaccccuggaaaugcccuugaagacaaugcagaggugccuuugacuaaccuagguuaguuaccaaggugacugucaaaauuagccugcacaggcccuuccuggcugaaguggggcaugcaagcagaccucagaucagguacaagccauggcagcaggagcacggggguagggcgggggaagcgggggacuggaguauccucuguggugcaugcagugggccugcgugcacuguacccacuauggcugguacagaauuggggccccaugggcaggagugcagccacacugaagcccuggcucaggugcugugugucugcagaaccagucuucaguauggcaucaugugucugaagaggcugaauuaugaccggaaggaacuggaaaagaggcgggaagagagccagcaugagaucaaggguaagguugccgucacccucagccugggcuccagcgagccucagggaagacucacguuagccugugugacaaaguagauauauuccaugugugcucacauguggcuccccuucccucagacgggccaccaagcagacagaugcgaccccucugauggugcuguggacuggugugcucguagaaauugaugaucuggggggagagggagaauugagugagagagaggcagguuuuacguaagacucugaaaauugaaaaaacaaggccacuuuggccuuggguuggggaguggggguggaggugggguggggauggcccaugcggggacuucugggagaugcagugagguggagcuggcucaaggagcccagaugccauggaggacagaaagaugugggaagugagggaugggcugaggcucugcgucuaggaaauuuuauuucuacaccgugaagagccugggccagcaugcuuccuuuuugucuguuucuuccucuguccuccagaugugcuggucuggaccaaugaccaggugguucacuggguccagucuauagggcuaagggacuaugcaggaaaccuacacgagaguggugugcauggcgcccugcuggcccuggaugaaaacuucgaccacaacacacuggccuugguucugcagauccccacacagagcacccagguagcccucagucagucaccaccuuccccaccccucguguguguguguguguguguguguguguguguguguagcccuucagucagucaccaccuuccccaucccucccgugugugugugugugugugugugugugugugucuccagggcgagcuguguccuuagugguccuuguaagauauuuuucuuuacccagcucuggguuugcuucagcucuucccaagccaauuuuauagccaaagcuugugacuuuccuuuuccuuaaauugcuucuccggcccaacguuccacagggaaaaaacagccucaggccucacagggaccugagagccuguaucucuuuuguuugcuagccuggggaucugcuucugggccccuaggcuucagcagacuaaauauuaccaguaagcacagcccagagacucuccgcagcaggccuuugucucccugucagcagcucaaaagauuagacgucuccuucaauuacauuucauaauuauuguuguaacugcuacccaaggauagaucuaaauucucuugacccuauuuauauuuuuggccccucugacuuccuguggguaauggauccuagcuguacucacaguuguguuaaguacuuccugauuuuaguuguccuaaauaugccucuggcaggcucccccuggggaaaggcccgccucuucccuacaguuccgguugaugagguuuucuguauuugaccagcuucuccuuuuguaagaacugugaauuucauaaacucugauuauauugcucugggcccaagccuuugucucuccagacagaccggucuuaauuccuuuagccuucccuagugcagucucgcugcugccccugaucauuuuagcugcccuugucugaacuguuugcagcugucagaucgcuuuugaaacccagccacuagcugugcuggcuauucugggagcagacacuuuuuggcuugagggaggguggggcuguguugucucuugguucuggaugguguguuggccuucggggacaguggcagcccacagggccaauguguuugcagacuguuugcugugaccccuauugaccagucagaacgcauagcuuggaaccuuucuuuuccaguaaaaguuuggauuuuuuccaaaugcaauuucccuauacuugccuaccucuaacuccauuugcagguuuccugcccgccagcgcccucagaagggcuucugcaguugagaucuaacuauuuaacccucacuauucagaagauauuugaaauauuuuuuuuagaucauuuguaagacauaacauugccauuucugacaaacacuauuccuguagaacucugugguugauauuuucccccaggaguggacuuucucuuucuuugcuuccuaaaucagaaugcauauuucuucuuucuuuucuuuccuuccucaucucuccuccucuuccuccucuuuuucuucuucuucuuuguuuuuugagacaggguuucucuauguagcucuggccguccuggaacucacucuguagaccagguuggccucaaacucagagauccaccugccucugccuccugggguccugggauuagaggugugcgccuccaucacccagcugacccaguauggaagccuccaugaacaaccuugagaauaucuggugacagaaaguuuugaagaccucuauuuuuuucuugcuuucuuuuguauuuuauguguguauaugcauauguguguguaugugugggugccugcauguauguauguagguguaucauauguaugcugguguugcagaggccaggagaaggcuucugguucccuggaacuagaguuauaggccguugucagccgacugcuuuaggugauaggaacugaacccaggcccucugcgagagcagcaaguacccuuaaccgcugagccaccucucuacccacucuggaaguuucccuaaucaguaauuuuaaggagucuagaaaaaugugugcaugccucucagcucagggcucccgcuauccuccacugggcuucuuuuaguucaaguuuguaauugacccaccugacagagauagguugguuuccuuccuccuaggaaggcuuguuuccugugcugugcaugcuugccucucuugcuucugcccccaccaaaggguagcaagccaugacuucuccuuuagagacaaaauguaggcuuuuaaaauaauaauuuuuaucugcucauauauuugcauauauuuguauaauuuauuuugaacauuuuugucuacuuuagccucuuuccaguuuccacaagugccucccucccauguuccaguccucuuucuuucuuguuauugauaacuccccgaguccaguuagugaaaauaguuccccccucccaauaccuaaagccugucucuucgugugcuccaugaucaauuuuuaaaaauauauuucccuccaauuugcccucuaugaaggaaugccaagguuagcaguuuggcuuuuaguagggcacucuuagugauuugcuggaagcaggagccuugggaagaugugugagcuuuccagugguuaaguacacuagaccccugcccugucucugcccuuagacacugggaaacagcugaaagaugccaugaggaggaugcugagguggcucagugauuaaggugcuugccacaaucacaaugugaguucaguccccagaauccacaugguaggagagcaccaauucuuguguguuauucucugaucccaugcauuuacugugguguacguaccucccccaaaccccauguaaaauagaaaagaaaagaaaaagaugaggcugguaagcuggcuuaacaaguuaaagcacuugccaccaagccugaugacuuaaguuucaucccugagaccuacauaaagagagaagcaacuuuugugauuguucuccaaccuaggaagugcauaguugcagauaugcuugcaaagacacauacacacugaauaaugugugauaauauaaaaacugaauuaauguaaauuuuaaaagaguaagauagcaucguuaacuagagcuccucucucucccucucacccuauggguuucaggcccgccaagugauggagagagaguucaauaaccuguuggccuugggcacagacaggaaauuggaugacgugaguaccuggauaugaauucagagccuuggcuguuguuggcuguuugauuagagggucaugagagcuccugccccagggcugagugguggcuggccuaauggaggagagccagaagagccagagaauggaagcugugaggaggaggaggucugugguuggguagaaguggucugcuguggagaagucugagggacugagauaggagucauugagacaagaacaggggucaguggccguguuccugcucacucuaccugugucguggggccugugcaguucugaaaacacaggcuggaagacagugagcugcggcucuggggaguguugggcagccugugggauucaggcucugggagcccacugcagaggugauuuuggagguuggcauugauggggagcagauagugaggguugcucucuguauccucuggagaagccugucucuggccaccugacuuaucauuguccguauguucuggucucacugggauaggcagcgugagaaauaaauagguuagacagauguuggaauuuacacuuugaagauaagaaaacugaagcccggagcugucauguugcuaguaauguggcaggaaccaagaagggcaucccagaagucuucaucccagguacugcuuuucuagcaaccuggguaguauuuuauauugaggacccagcaggacaggagagcagugcuggggcugacccaugacuuuccggagagagucuggaaagaaaaacauguuaggaaagcagugggcugucugagcucaguuuggggagguugggguggguagagcaauggaguucacugcuggcccagaccugauaggagagaggaaccuccugcuggaucuuugagaucccuugaaaucaucuucagccuccaucuauccuacacgcaaaaccacuaaggucuagagagggggaguucagaaguaguaccccuuagagcuuuagggacugggcuggcaacuccaauaugccccuuggugcagggagaagagaagguguuccgccgagcacccuccuggaggaaacgcuuccggccucgggaucaccauagcgguggcauguugggcaccucagcggagacccucccggcgggcuuccguguguccacgcuggguccgcugcagccuccaccugccccgccuaagaagaucaugccggaaggugagugccaugcugguaauggguuccuccccgcacccuggagccgagcgggcuggagaggggcgaggccgaggcugagcugcacuaacgcugcgguggggcgcgcacuaacccgcgcucuguguguucucccgccgcugccgacuccugccagccgggacggcgggggcgcagagacuggagcccucuacgguccggaccuacuccugcugaccccccccacccucccgccccgggucugacgggggugcgcccccggcucgggguaagugggccaggcuguggcugugcucgccccguccugccgccgcuccggaccgcccugccgccgcucccucgcugcagcaucgcccggcuugcccuucccgcuucgcuucgugcuuggcugcaugccgcaccuaccugcugcccaccccgggaaccaccuccacucacagagccugucucucucuucucucauagcucacucccacuaucucuacggacacaugcucuccgccuuccgggacuagccacggcccccagggcggguguccugguuucacaggcucagccggcccugacccuuccugcucguucccuuucucccuuggcucccagucucuccucugugauuuuccaguugcccgggaucucagaauaugcucauccacuccuucaucaucccacuauccgaguccuacuucguucccccuuuguaagucucuggaggaugugaccaaggucucccgugagugucugucgggcacccagguuguagguguuugagauucuguaggagggagggaaggacagcaccuguggccaccuucccucuuccggaucuguuuuggucuggacuaugggcucaucaggcccaggaucccggaccaaagacugagaugacccuuccaauaaaaggccauuucggacucuguccugcuuggacuaauuggccuucuggaccccuccacucuggccguacccgauggucugagugguuuugccaccuccucucucaguaucacucccuccuccccaaaccccaaucuccagugucuguagcucuugccugcaagucuugcuuguggggugacgagggguguagaauaccccgaacccucuuccaggacaaagccaggaguggagcugaggaagacuaagguagaaacucugugcccaagcugacacagaaccccaaaugugugggaggaauggaccccagagcuuugggcccagggugagggcaaggggaacucuucagccccuugccuagagagauggccugauggccuuuugugcuuccccccagagggcaguggggaugccuccagccccagccccaaauggugcugcuacuggaucagauugugaacgguuaacucugcccugaagugggggugcgggaauggggaggcuuccccuuuagugacucaugucccaggucuaagaaaucuaaaguggacugaggcaggcucccuugugugucccuauacccuccagcccuccuuuaggguucuuuuggggguaaggggcuaacugcucaagaaaaucuugauccccucucuugucuccauuauuuuaauugcuuuuucuggcagcacgguggggacagggcagauuuaugagaaauaucaauugccccucucuucuggaccaauuccuuaaccuugggaaagcucagggccuaguaucagggugggugauagaacccgaaauggaagaggacgggaaagugccugggcugugcuugugaccggcaguacagugccauccuggaggugacuggaguagcugcuuugccauuucaucacugggauucugaacaggcgccaagcuaacagguggagaaaugagccagaacucccugucugaaaaggaugccgagccuugugcucagcagagggaaguuuggcuaaugggcugaucgaaugagcuaacaugggcuggggcaggcaacuacccguccucaagcccgcuguuucugucucccuaccagacaggccucugggaauggagagagaagcagcugaguagaacaugaacuaguuagagcgagagaacccuugguccugaauaguggaguuauagagaagggccaguccuaagauggaaggagcccuacaaucugacuccuucuagggacucuggggcuagcuuugugggagagucagcccugccccuccucucccaugugacccugucauaguuugcaguguccuagguagcacuuggggagccaggugcauucagggucaguagggaggacaaaauagggggcucuacgugcagugaggaaaggcugcugucaugguguggcccugccucacugucaauaucuguuuucucuggagaguccaccagugacccaagcucucccugccagccuccugugucaaaccaggucccuucucaguacuguauuggcucagugcuuucaggagugagugugugagugagugugugagugugugugggcgugagcggguguguacguaccaauaaacauccugguuuuaagacaauguacaaau

SEQ ID NO: 379 - RNA, 5960 nt, Mus musculus
uccuugagaucauuagggccucggcuccauuuauuugaacagccagacacacuuuguacaggcagcaaucuuaaguuaugaguaaucauuucacgcuauccugggcagggccugagauacacacacacacacacacacacacacacacacacacacacacacaccagccuccuuucucugaggucuagaauuccggaaaauaauucccuuccuacaguuucuguaggacugugucuauaagcgcacucaaccuguacucaucuaaguaguggaugaagugcugaacacggagcgaaaugcauugcccuguccauugcuuucauuacagacacagaggugaccauaaugcucucagaaacuaggcagccucauaacaaauguacacacacuuccuucuuucuggcucuagagacugcuccuugagccucaucuggaccuuuuaucacaaggacauuaguuaggauaaaggaagcuucaagggagugacuuagccuugaccugcauccaccauagcugagggaguguuguuucugcaagcacccagauuccgggaugagacacagaaggcugaugcucucagcaaaggcccuagggccucuugguauucaagaaucgacuagaaacaacugcacacauggggugagggaggcuuugcgaagcucaguaggugaaucgcaucuuuugugaauagcccagcuuauccaaguuaggguggcaggccagcugcaccauggguggugguccacagagcagcagcagcacauccucugcuggggcaggcaggugcuccuggaucaugucagccguaacaaagcccuugcuguagguccagucuggaggacagggaggagaggaaaacacguacuucagguccauaccagcaagagaaugugaugucuccaggacagacccuugggaugaccagaagggauccugaggucucagguuggagcagcgacuacagccacagcccugccgcccaccugaagauaggagccugacuuuaaagggaucacuguguguaccuggauuugugauucuggcagugucaggaggaucuguuuuacugaaaccagaacucaaagaggggcaaggccuugauuuugauaacgacggacuaucuagauguucagaaauggcaagauaccuucuggaggagaguccagagugaaccagagcuuaaagcgauuaggauacugggccugaaguuccucuagguccucccgcaggauuauaucccuuucagucugaaaugcaaauggaaaagcagagacuuagaaaccgcagguccaugcugugacaaccucgcaacagagaaggaaaggaauaccaaaggcaugcuagaguucuagggagaggcuagacuugcaguguguuuagggugcugaggaccaggaaguggccuucaguuacacauuacaaaggaauauuugcccaugaagucucaagggccuauggucagcaugagacaccuccaucuucuccugcuucuguggcuuaauacuagguccuuuuuccuucuuuacuuuuuuauuuuaaagauucauucauuugcuuuauguaaguacacugucccugucuucaaacacaccagaagagggcaucagacuccauuacagaugguugugagccaccaugugguugcugggaauugaacucaggaccucuggaagaguagucagugaucguaaccaccgagccaucuuuccaggcccccaucuuuucuuauuuuuauuuuaugaguguuuugccuacauguguauaaaugcauuucaugagugccuauugcuccugaugcccagaagagagugccagaucucuuguaacuggaguuaaagaaagguguaagcugccauugugggggcuggaaaccaaauccugggcuucuccuugauggugcccucauuccuucuuauuguuauaaaggacucuggauucguagaggggcuucuggacagaugcuagacuaguucccaagccaguucugucugucucagcccaucuagucacacagccaacuuggaagugcuggcucucagaaaaggaaaccaaccugguuggcaaaaagcagaaagcacuggguuggaucuucagggacuuucaagauggcccggaucagcugcagcauuggggugauuccugaaugaggauaucccacgaugagaugugcauacucucucuucucucucucuucucugucuagcuccuucgcugagcaacccugucaucucaguuuaucaccacacugcauaugcucuccugcuguagccaauccucugaccucugccugcacguucaccaggaccugcuuuucugaaccuuaauagucacauuagaagccagaguagaauuccuucuaaggaguucaucuaaaacacuuguucggaggaucccuuggagguaggacauuauagauuaggccgaauggugcaugccuuuaauucccagcacuuggguagcaaaggcuaucauauuucugugaggacagaguucugggccaaccagagcuacauaacaaaaacaaaacaaaacaaaaaacgaagucauacauauacaccaacaucccuucugaugaagauuucuggaacacugcuuagaagagggaagaucauguucuucagaaucaagcacagucagguuugaauccuggcuguggccauuacuaauuaaauaacccuacagaaaccaacacgcuaggaaucuccauucccucauuugcagagggaaaagcucacagcuaccuauuuauaggguaguagguaccuaacaaauaguccugcuauauauaguacucuuacuuuuccugaugagauauagaggauugaacaugcuagguaugcucucccacugugcucacuaaacugcccaggcuugguuacaauauuuauguaugcagccuaggcuggcacuaaacgugugaucuuccugcuucgaacucccaauuucuggaccaccaggcccgcaccaccaggccuggcuucuuccuccucaaguauucauacuuggcuguuucucuugacgucauuaaauccacucaguuuguggaagacccuccugauugacugcucuccuucugucugugaauuuuuguuauuguucuuucuacuucuuuaugauuuccgcuacuggggaaguguaggcagugcuggucccuagauuaaggacuuguccucuauuaucaaaccugagaaggaaccugcagagcaaaccccaagagugcuaagcaaaaaacgucccucaagugauacagaccugucccaccagcaaucauucccaauuucuucgccacucgcaguucagguggagauuuuuuguugggcugaauauuaaaauucccugggaagccaagugcagaauuagagucaauuuaaaacaggaacuaaguaaacaaacagaacagaaagcaugcccuaggcuguuuagcagcugcuaugaaaucugauccuggcacgggcuugaguggagguuugaguuuaacagaccgggacaauuacucaggaaggacaauggcgcugggaugucugucugcuucucagucagugcaggcacagaagccacacuuaagggcccagugaucccacacagccuggaagauucagaggcagcgcaggcaagggaggagugcggaacgaagaccucuggcagaagauuguccccuggugaaggugguaggcuuggggccagggugaauuucccuagugguccagagcaucaccagagacagggcacaguacucgggucgucuccaugggaagaacuaaaaagcuuucucuuuugguccuuggccagagggaagucuuuggugaaggaaggagaggcauagguuuccucugguaaucuccacagggugaaaucugccuuuccauauagcaugguugcuucaggagacuuugcccagguacacccaugcacacaugcagauucuggggggaaauggaacaaggagguugaagaugggacuggggcugggccugggggccuuggacuguagggacaggagaagugagacuguaggaaggaaaggacagauacucaccuuucccagcauaacugagcaacccgcucggcccccggaacuccaccauauccccaaucuucaggcuauccagguauugagacaucuucccuccuucaggaaauuuggggugcacaccuuucagauaaaccugaugaggcagaaagaaagaaaaugccacauuugagauguaaugaaaaccaaaucagagcguauuacacccauaaucuuuucucccuucccuuagacccacaaaggacucaucauuuccuguugucagaggaauccaggaagcuucuaaaaaucccagagucuuuggauuccuuuucuuuuggcgucucugcguguguaugcacauguaugcauacacaucuuucuuguucucgaaaggcuagcuuccccccaaacucugaguuucuaauaauucucagauacccauuucccauuuuccaguagagacaugcugagauuucaacuuuuacaugaguccaaacugaggcuuggauggcaagugcuuuacucaacaacccagccauccccccagcucggagauuuccuuucuauauacuuaccuugaugacaagaucuacauagccuuggucuucaucacuggugacagggguguaaggccugaugaccagacugccaucaauucgggcagagagguagacgugcuuaccugggaaccauggagagagacacauaagcugcagucccacugagaggaccccuccgcaguaucuccugccuccucccaccuuugaaacucccuacugccagggccuuagcagcagcagguaagcagaggauuugcauaauggaaaauuaguguuuucugggauaggaggcggguuauaauaaguccuaaggaaagagagaagccuggagguuagagaugcguaggggcacagaagccacacccuaaaagaguggucccucaugggcugaaggauugacagaagggcaaugguuuuucuuagcaggaaaaccaccuaagaagugacucgcccucauacgaugccaaguagagaagcccacucccuuuuuucuuacccacaggcagccccagaauguggugggcggugggcaaggcaaagcggaaccuccugguguuguggcucacugucuagaggauagaugacaagauguuucaucaggcaggucuggccugccaagucuuuuggagcaauccaaccacucucgaugcuaucccucaaacuaaguauccacucucugcccuagcccacuucuucacaacuuaccgucuugucuagcaaucgcagcagguacuucucauccggguccuggagaguaaccugcggccggcgggaucuucgaaccaaguagguacccagagccaggccgagcagaguaagcagccccacccccagagaggcuagcaagaccgggcucuguggauagaggaggaagcgugaucgccacgcugaggaagugccaggguguggguggaggaccaggaguagcgauccugagcuccagcgagaaagcaugccaaaaccucagaagcaagcggagcagugaacucagcccgcagcucgugcagcgagacuccagcauccaagguggguauggcacagccccgcggggcagacugcccagaaccagcugaggcggugaccccgggcucagggcacagaacgagggucuuaccggcuggauccccaugaccuagaggugcgucccgcuccgguggggcggaaagaucccacaaugcgccgcggggcgggcccggaggcggagcucuccggggcguggucuauggaggagggccugacugaggcaggacuagcggggacuaugccccccccucuuccgugcggaguaggugguccaagggcguggguaucuuggccgucucaggcccuccuuuugagagcuuucuucucucugcaacuuagaccuaccccaaaggaugacaguuuug

SEQ ID NO: 380 - RNA, 17980 nt, Mus musculus
uuggcacgcgcaggaaugccuggaucggagcgggugagguagcgccgggaaggugacgcggcugcggaggugacgccgugcggucgcgcggcccuuccggcgcgggcagggcgcugaggaucgggcgccccucggccgcaggccgccuccagugccgcgggauguagcgcccgggcccgcggcccccagcagaggcagccagccaggccguaagugucccgggggugggcggggcgcgggcccugcaggcucuggaggggacagcacgggaguggcccgccccuggaucgucgcucaccgcccggcccuccgaaagguccuccguaaacauuuccggccccucccaccgcgcaccgccuccguucggggggcugcucgccgccgucggggcccggcaguccgcgagugcugucuccgcagccgcgcgguagacggccgcguuccagcccugcuggcgacccccggaguugagccugcgaguugggugcgggaacaccggcccuggguggccgggaacccuaaggccaccaccgcgauccgcaggucaaacgugacggggcucccuccuggauagggucggucgggaaguugauggagacucgacaggccuaagguacuacucaacuagaauguaaacaagaugccgaaguguugggaagggccagauuucaucucagaaaucuaggguugauggaugcugguuuguuugagaauuugagucucgcacuugcuuuuaagaaaauaaaguggcucgccgucaguuucuggcgguucguaguugaagaagcuggacaaauuucaguuuacauaguuucagaugucagcggagcacuaagagaccaugggaucuucuauaauaauaaucugauuauuucccucgggucuuuagcagacagaccagaaaacccagcaguuaaguugugugguaaaucaaacgaagauggcaauaggugguucuuugcagaaccaaagccauguugggaugugcucacugcuuuuuuuuuuuuuccuuuugauaaugcagggcaggcugugauggugcagucgcaguuccugagaguuuauagcaucaguccacugccaggaacucagucagauaggauggcgcuaaguggauugcaaugucaggguucccggccugcagccacugcauuucuuuauuacagaaguaguuuuuguguccauuuuuugugaaaggucuuugagaagucagucuucaaaagcugguguuauuagugaaguauuagacauuggugugggccuucaaacacugcaccuacucccgcaggguaaucuccgcugggguguucacaguagcccagaaacgacaagauuuuugagaaagaaguaaaugaguggcuuuacccgugugaaagauaaauuaaggaagcagccuuaauuucauagccucugcgccucccuccccucacuccacccccccccccucacggcaggaggaggggagcggucagcaccuuaaaaugaaugguaggcuaaguugugucacuucagagugaccucauuuucuuaagcuuccugauggaaagugcauuauucgaugcucuggguagccaugcuaccauguaaaccgcuguuuacacaacuguaccccuggaaugcccugccucagauguccaugccuaucaaaucuuaagaucuacgaaguuuugaucaucucuacuaaagugaaguuuuucuucucaguuccuccagcaccuguuagcucuuagcuucauaaugaugcuaucagaaaacaaauuaucaccuagguggaagggacgcguacuuuuaaucguuaucccagcacuugggggcagagacagguggaucccugaguucgaggccagccuggucuacagauugaguuccgggacagccagggcuacaaaaagaaauccuaucucaaaacaacaacaacaaaaagaggaaaaggaggaaaaauaaaagaaaauuuucaauaaacacccuuaagauauuuuaaaaauguguacagcuguuugggccauauguuaaugccuguugcccacagaagauggguucaaaacugaaccuaugugaaugcuagauauaaagcaaggcccucuggaaaagcagccagugcuuuuagccauucggccaugcuccagcccucagcaacccccuuuugguugcugcuuuguuuuuuuguuuuuguuuuuguuuuguuuuguuuuguuucuagacagaauuuaucuucguaggccuagcuguccugaaauucuguaaaucaggcuggucuggagcucagauuugccugccuccaccuuccaaaugcuagaaucaaagguguguaccacuaccaccaccggccgccaccuggcuuagcaacccuucuuaaaggaccucaccaaccuguccaagcuccuuacucugccuucucccugaagcaauagccagaacugugcauuguauaguacucaauagaugcucucagauuaaaggacagaauuuacccugcuggaggcaguugcauucucccuguuucuguaggaaggaaauccaggcugaagcucagacacacccggcuagguuauccugcuugucugcuugacacuguguuaaguaacauggaguuucucuuguuugguacugguauucaucaaacuuguuacauuuugucuuuaaugguccuuuguccccaguuggcucaucaaacaguauucaccaugcugaacuucuucccauuuugcugcuuagaaauggggguaugacuaauguuuauaaaguuuguagcaaacuuuauaacucugcaaauugaauugcaaagaucuugaagauacucucuagucaaaccaguuccaggugcuuggcuuuuaagccaguaccuaccaguuuccuugugcuuuagugggaccguggggguguacaguuuaaaguggguuuggggauaaagaguuuuaaaguaacuuuggggguacacaguuuacugugagugcuaugcuguacaaacuauauugaccaaauauuuguaaugagcuugauuuuuuuuuuuuuaagcagcuggcaugggacauaccuauaagcccagcuuucaggagacugagacaggagggugauugccagaguuucuagaucaauuuagguuacuuaaaaugccccaagccaggcaggacagcauagcaagacccugucucaaaaagagcugagguaaugacaugaaaaaaucucuccuccuccuccuccuuucuguggagcugacuguagggaaguuugccugccugugagauuaaaaagacuucuucucuucuguugagauaggagagccucaaaggaaguuagauugugacuugucucccuucagauucggaggcagugacacuuggcaucaaguaaaguucccauuacuguaguguggggccuugacucauuuuuccccaguggagcaaugaaaucaaccucccuaacaggcuggguagaggagaaaauggaucuuugucuggaaugcuaggcugcucuguagaauaaugagagccaagcugcauagauagaccccaacucacccacccucuuaaaaggcccggaaccuuaggucagaucuccuagaagcucugccuuagacuccagggaaaguaugugucauagccuggaaaacuuggaaacugcuucagagaauaaauuaucuucagaaucucuaagggcaacucuccagcuaauuggcuggugauuaaaacucaacuuuuucuccaaguuuagugcgggauuaucuuauuuguaggaacacaaacgccucuccuucuccacggcuuuagucuauaacagcuuacauuuauccaguugggaagcuuagugguaaaaguuuauuagcuugaguggaagaaaucccagcaaaaaugcccucuuggguuuggcccagucauaauuugcugugcuggguguggcccauuugagaggaaagguguuuccucuaaaaugcauaaggguuuagaggcagacacacagugggauuccagagucucuuggaaucagucucacaccuuagggcuuuguguugauuuaaauuaagagccuaagaugcuugcaauuuccuguuggugagugguccaugcuauaggagcaaugguuucagggcccaguguuacugcucucuccucugccagaccucagaucccucccucuuccuuuccugucucaacuuuucguggucaauuagagaaacaagcaaaaauacuagcuuggauugugucugaucuuuguacucuuauuguacaaccugaaguuugugcuauccuugugccucugguggaauguguaaacagcacccagugaauuaaaugugugaccauucugcuuagaguucucuuccuacacugccuugcuggagcagugagaucaugucacaaguuaacuuacccaucuaguuauaccaaagacagggacagaacuuguucaacuucuguuuugcacaggaccuuauagaacuaacugcauucauuauguauucagugagugaauuggcuuacucuggaggaaaggauaagagauagcuccaugguagaaagaaaagggccccaaccuugaccagugguauggugguaaaucaugcuugcuggcuggcacguggcccagucagucacuuugaaauacggauucagaccaaaacuuuugaucugcaucguuuaggaugcauguacuauugugcuccagaacucgaaugccuguguguagucucucuccuguugccugcuuuaguaacuagagguuuaguguucccuucuuuucagacuucucaaagaugaccaaagcucuuuguuugcuuguuuguuugucugggagcuguuuauucaguaagacuucccuuugaggaaggauguuuugaggucagcuguuaagauuucccaauacugcuucucacaugaguugcuuauccgcugggcuucccaggggccuccaguuuccuguucuugagcucaaguguugauugugacuguguguguuaacaaaugucuugucccaggcuugugcacuaaaaggaggaggaacugucuguguugacauaaagguauauuggguaaugaguuauuguuugugucucucuggagucuagauuugacucuuugagcugugugugugugugugugugugugugugugugugugugugcgugugugugugugugugcgcguguuugugcaggaaugcauaugaagcagaggaugaugcauggcuuguaugaggauugccuucaccucagggcagauuaagauauuagucaggcaucuccagagccaacagaaggcaggcaggcaggcagauagguaugagcauuuguucagggaauuagccacaagaauguggagauuaacucccaaaauggaccaucuacaggcuagagaacuagggaagucauuggcauaauuaccaacugaaggcugaaaggugcuaaccuuagaguccaaaggccagagauccuagaguucugaacagcuacaagaggauuuuaucauuuguuuguuugaggcaggguaucacuguguagcucuggcuggcccagaacuuccuauguaaacuaggcuggucuugaacucaccaagauccaccugccucugccuccugagugcuggauuaaauaaaguugcauuaccaccauacccucaaaguucccucuucuucuguuucauucuaccugugggguagccaguuagauaaugcucacucaugggugagagcauauccucuucucucgggucacuaaaucaaaugccagccucuuccugaaaccccacacccccgagaaugcuuuaccaacuaucuggacgccccuuaauccagucacugaucccuaagauuaaccauaaccuacauauaccuaauuauaaucccugagagggaauugagauuacucuuggguaaaaacuaguccagaugccaaagauguuuguuuacauagugagcugccaugggugaagcagugucucuccagggaauagucauguuuacuucccaccaugaaggaggcagucucccaaguuuaaaugucucucucaucauauaacccacggugcugucuuuggguugcccugugguauucuucuggcucgggguguugcuaugaaguaacaaagcccugccucuggaaggaagaagacuuagaaauaccacauagaagucuuaggaaacuuugcuuugcuuuauucuucucugaagccuaauuugaaaauauuacauuaaaaaggccagugcagaaaauccuacaauguuugagaaugugcugggagucugaauucugauucuuccuuaaggaucgugcaugacugugucuaguuuauacaaaguauuuugaguggggcuuagauuuaugggcuguggugguugggacgcgcucuugcagagccggugauuuagggguguguguguggcaaagggcggacuuggggagccuccuugucuuuuaaacuuccugcuuccggguagaucauugcuugcugugaggagugugaugaaggcuucuuauuagagccuugagcccaggcuguaacccugaaaaugagcggauuugcagaggaaacaaccagcgggcauacccagccuuuucccaugcaagaugugcuugucacgucuaucuaaaggccaaaugaguacaguugacacuuaauccauuccuaagccuguaugcucucucaauauuguagccagaugugggcuucacuuaaagaaagaagguaggcaugguggugcgcaccuuugaugucagcacucgggaggcagaggcagaggcagguagguguauuucuugaguuugaaaccaggcucaucuacauauuaaguuuuaggccaacuagagcuacauagugagauggucucaacucccccccuuucccgccccacaaagaaaauagauuuauuuguguacugaaaugaaacagccagacuugagagcauagccuacagcuggucuugguguuuugaugucaguugcgcgucuaggccuuucauggggggaaugggcuugaggaguggugggcgucgcccuucucacgagcgggcuccauuggguccggugauguugacaguuaguauaguaacaguagaaccugugaaggcagagaacuagguguuaucuuuuuuauauuuauauguaaugugaucauauauaugagauuauauaugcacauauaaucucauauauauaagauuauauauguguaucugagauuuuauauacguaucuaggugagauuggagaguuucuggugaagcauaauauucuaaaggagacagauuuguuuguuuauuuauuuauuuauuuauuuauuuacuuuucaagacaggguuucucuguguagcccugucuacccuggaacucacucuguagaccaggcuggccucgaguucagaaaucugcuugccucugccucccaagugcugggauuaaaggcgugugccaccacugcccggugaagacaguggauuuuauuuaaacaaugagcuagccuuuacaguuagaggcaggguaagcugauuagcuaugucauauucaguauagcauuacagaaaugaauccgguguugucauguuuguaucugcaguguccaccaucacaggaagaucucugcccucuggggcugagagaccccaaccuuucuucaagcugaagcugccaggcacugagguaccagccagaugucuucccacaaaggcucugccggggcacaaggcaauggggcuccuucugguaacagagaagcugacacaguggagcuggcugagcuggggccccugcuggaggagaagggcaagcgggcagccagcagcccagccaagguaaacuguuucccagaguugcucgcuugaccagugcccugcugaaucuauucagucucaguuuaagaucucccucccuuuuaaauuacccauaggacccuggggauaguucuggaugugucuugauugugcuugguuuaggugucuuuauuuuugucucugagcuuugggaguuaauuucccaaaagagcacacaguacuuuuguaaacucaguguccagcagaagaagugcaguaaaauaaucacuaaauagaccugaauuaagguaauagacaaaaaucccuuccacuggggcaaauggagaucucucaggcaagagggcccagugaguaaaggugcugccgucuagccugaugagcugagguugaucccuggaaccuacagaguaggagagaaccaauuuccucaagcugucuugaugagugcaugugugcgcgugcacgcacgcacaccuacacuaaaauuguaaaaaauguuuuaagagaacaggcacauaacaucuaaggcaacauauacucauaauaaaguuuaaauaaguaagaaauuaaaauuuaaauaaugucuaggcuuggugcacuaagccuguguucuuccaaugauagucucagucugcgucuugugugccaaaccaaacuuucacccaguguagauaaaguaggaaucucaggcgacuguggccaacucaguaucaugcugugggggcggagggccagcguucugagggugaagcugugaguuuggaucuccccagaaacgugcaguuuaggaguugaugucuagacuguuguuguguuccuuuaggcugaggaagaucaagcaugcccggugccucaggaagaggaggaggaggugcgggugcugacgcuuccucugcaagcccaccaugccauggagaagauggaggaguucguguauaagguguagccuagagcugggaaggggugggggcaggguggagccgaggucucugggaaggggcggggcaggguggagccgaggucucugggaugucucuaacuggcgagccuaccuggaguugaagagcacuugcuugaugaccuaaggucaaucccuugauccucgugguuaaaaaaagagaguaauucucacaaauugugggaauuuucugauuuucacauguacacuguugcacuuguaugcccacacauacacauauaaaauaaauaaauauaacuuaaaaugaagaagaacgaauuacugcuuuacaaagauacagaauuagcacaguaaggacuucagaggaguaaacaaggagagaggagcaggagccagaagacuccaggaaaacaucaggagagauuuguguuugugaaaaacaugcuuaggauuucuuugucuucucucaguauauuaauuuugaaaauucaaggagcauaaaggagguucccuauaaaguggccaacauaucagccaguccccugcuggguaucuccaaggcuagccuuauuccccugggacuuggcaccaccugaagccugagugaccaccuccuaagcagguucucuucagugcgguuuccccaggaaagcuccuuuucacuacagcccaucuaaaggcgucguguguguuguaggucugggagggacguuggagagucaucccguaugaugugcuuccugacuggcugaaagacaacgacuaccugcuacauggccacagaccaccuaugcccuccuuucgggcuugcuucaagagcaucuuccgcauccacacagagacuggcaacaucuggacacaucugcuuggugagugauuuggaugaggaaaaaaaaaaaguuuguagugaugcgugcuguaccacugggcaccauucuagucauggguuguugguggcgaugcacuccuuuaguuccggcacuucgaucucugugaguucaaggccaaccugguuuacauaggaguuccaggcuaaccaaagaaauaaacaaaaaaggaauuccaaucuuacuugccaaggaauuuguccauggggagagaauaaaauguuucugaauaguugauaucaggagucuggccuuuuagguuauuguucaccuuacuugauaguugauugcuggucuuuaccacaagacagaagacccagaacaugagggaauggcgcugcaucuuggcuuuggcuucuugcuggaacaucuguguagugggaacucaugauuccuaacuugccacucuaaaaacaaacugccaccauucacagacuaauacuuuuguggccuacgagugugugcuugccuagcuccaagaagcccuggcuuugacuccuagcacugaguagacugggcaugguggcacaugccugcaaucccaguauucaggagguggaggcagggaggugagaaguucaggguuacccuagcuacacagggguuggcggccauucaggaguacaugaaacccugucccaaaauaaaaaugucaggguuggagaguuagcucagugguugaaaacucgugguucuuccagaggauccagguucagcucccggcaugcacguggcauucacacauccucacacagacacauacgcagacaaaacacugauacacauaaaauaaaaauaaguaaauuauuuaagagauaauaagauaaaagugucugucuugguuugucuggcuggcugauggcaguucacauagcuaauuccccuguuuacugauagaaacaguggcugccucgguguguguaguccagauuuccucacgggugguuuuuccuuuuugucucgugcagguuuugugcuauuucucuuucugggaaucuugacgaugcugagaccaaauauguacuucauggcuccccugcaggagaagguggucuucgggauguucuuccugggcgcggugcucugccucaguuucuccuggcucuuccacacugucuacugucauucagagaaggucucucggacuuuuuccaaguaaguugaaaggccagccacagcaagagaccauguguguuauugucacaucuugucccagggcugagcaggcacuuggagcugcuggaauucuuaacggaucccuguugugcccggggaagugaaguuuucucuucuguuguuagagcaaaaugacaaaguuuuucuuauagaaacuaaaacgucauaauaagcuucccacgaccuccucaacagauggaaaccaauucugggauauguuuucuacugagacaguagugucuuuugugaaacuugaggugcugauggauugcuuucaacaccauguaccuaauacuagcuuaucuuuauugacuggggccaagugguguguggcaagcagucugugcuucagaccccacgcaaggcuuaucuuguuggccagacggugcuagaagcaucagcuaucugccgggcacuccauggcccucgcucagcauggggcuguuuacuuggguagugguugcugcugcuuucuuagugauagugguagauuguuuuauuucaccaguaaugagagugcauguguauuauuuugcacaucaguuucaaggaaggugagaaauaaauaaaauuuuuuaaaaaacaaaguucaaacuaaauuuuuaggucaggagagauggcuccacgguuaagagcacuagucagugcucuuaaaacuagaccucuuccagagguccugaguuuaauucccagcaacuacaugguggcucacaaccauuuguagugggaucugaugcccuuuucuggugugucugaaaacaguaacaguguacucauauaaauaaaaauaaaaaaaucuuuaaaaaaaaaaaaacccuaaaguccaaggaggguggggugcaccuguauucuaagcuacucuguaggcugaggcaggaggaccacuugagcucagaaauuugagacaagccugaacaauauagcaagaccuugucuaaaaucaucaagaagaaaauaggucugguagcuaacauuggcaggaaaacugcugugacuuucaggcuagcccagguuacauacuggauuucaaggucauccggggauagaaagcaaggcucucuucaaaaacaggagaguugguuuggugauucugugaauaaaagugcuugccaccacgccuaaugacccagguucaguccugggacccacaugguagaaggcaggaaccaacuaugaauacucaggugauagugaacacacaaauaaauaauuuaaaggaaaaagucaauaagaacaggaacagaaguacuuguuaugcugaaugcgguggcacaugacuguaauucuagcacucaggaggcagaggcaggagaaggaacuaaaacuggagaccaguuuaccuaaugaguauaaggccuuuuagcaggaccuugucucacaaacaagcauccccuaugaugcuccuaauccaaggguuuuaguuuuagaacuccaucagauuggggaaauaaccagagccugaguguuauguucugaaagugucugauacagcccaggcuggacuugaguuugcucuguagccuugaacguccccaccuuuugccuccacgauccaagugcuaggauuacagguaugcaccacacaccuggccuucuuagagauuuuuuucaaggggguuggggguagggggccuuggaacuccuuccuuagagcaggcuggcuuggaacucauggagauccaccugccucuuccucccuagugcuaugauuagugacaugaaccaucaccacccagcuuuuagagaauuuuuacugaaaagcaaaauguucucaacuuugaggaguuuggguauaggauagaguauagggaguguugaggaguuuggguacaggauagaguauagggaguguugaggcuggagauagucaggucugggugcaggugagagacgguuaacugggucaugagccacaggcauucuuuucucaugcucacguguuugaucuuuguggcuuacuucuagacuggacuauucagggauugcucuacugauuauggggagcuucguucccuggcucuauuacuccuucuacugcuccccacagccgcggcucaucuaccucuccaucgucuguguccugggcaucucugccaucauuguggcacagugggaccgguuugccacucccaagcaccggcagacaagagcaggugaguggcguugcaggccucuaaugcagagguucucggccuuucuagugccgugaccccuuaacgcagcuccucaggcugugcugauucccagccauaaugcuguuuuucacuacugcuucauagcuguaauuuugcugcuguuaugaagaguaauguaaauaucugugauuucugguggucuuaggagaccccugugaaaaggugguucaaccuuccaaggggucuagacccacagguugagaaccucugguuuaauuccaaguacucagggugguuggugugguuggaucaaguucaaggccagccaggugaccuugucucaaaggaaugauaaaagggcuggacauaacaguuacaaggaaggguguuugccucuugcccaguaugugcaagacuuggggcucaaucccuaauaccagaguggggagaagaaaagggaagggggcugaguggguaggaagacagugcuguagagcucagggggauuggaccgugcgcugagucagcucaacccuaaguuuuaguucacagaauccacacaaacugauuuauguuuaaaacucgaaaaguggcgcaaauuuucaaagcuguuuucccuugguauuucagugcuaaugggucaggucauaauacaguugcucacuuagcuucaagcaugucugugcuuugaugcugugaaaauauagcaagcauaguuguucuugugacugacuccuaggcacuaagacaagggaauaagaauuagcacucccaagccagguguagugauccuuaucccagugcuugggagggugaagcaggaagauugcguguguuccaaggcagcgagggagauguacagaucaagacuccaucccaaaacaaacauaaauuaaaaaacuacacacucuggugcauuuuaccaggagugggaugucugguuugaugaguacaauacuuuuuuuuuuuuuaaagauuuauuuauugauuauauguaaguacacuguagcugucuucagacacuccagaagagggugucagaucuuguuacagaugguugugagccaccaugugguugcugggauuugaacuccggaccuucagaagagcagucgggugcucuuacccacugagccaucacaccagcccagaguacaauacuuuuguguauaacaauuaguagcaacuaauacaauagcaagcauuuaucuuccuacauguugauucaccuagagucucaaguuuuuaguaaacggagcaaugccaucgauuaccacaagcuuucagauagcucuuuuucuauuuuauauguacguguuugugguugcuuugcccauacaugagucuaugcacuacuugcaugccuggugccuucggaggccagaagaggauauuggaccccuggaauauagauagcugugagcugccauguggguacuaggacuggaacccagguccuaucaagagcagccagugcuucuaacuccugagccacccuucuuuuuuugcuuguuugguuuuuuguguuuuuguuguuguuuuuuuuuuuuuuuuuuuuuuguuuuuuaagauaggguuucucuguguagcccuggcuguccuggaacucacucuguagaccaggcuggccuugaacucagcaaucugcuuuuugcugcaaaguagagcagacagucucugccccaguucuguacagggugggaacaagaacucaguccuuuguuacauacucaugugucccugaugcuccaggcagcugcucuucucgguauagacuucuaucuguucagguggucagacuugugguuacuucagucuuuugugauuugauuaagaauuuuguacuuguauacuguguacuuugguucuauguauucccuccuccaucugccuucccugccugaccccuuccaaccucgugcugcccauguacacaggguguggagccaucacugaagcaggucagccucccaguggccacaccccucagagaaagacgacucacuuugccaguguccgucagcugucaguagcuccucggagauggaaccuugugaaccucucccccaguccaugcuggaauuuugacuggcuugauucugugcagguuuuuuaaugaucuuuuuaaaaaaugaauuauuuaugugucuuauugugagaucuucuggagcuggaguuccaggcaggugugaguugcccagccugggugcugggaagucucuggaagagcggcaaacaccacagcaccaagcugucucuucaucucuuucuaugaucuuaaugggaaucuacucuucuggcuuuggagccacacuaggucuuggcuugggucuauaccaaguuggccaucagaugauuuuuaacacauuuaaaaaaaaaagauauuuauuuauuuauuuauuuauuuauuuauuuauuuuuggugugcuuguugucuguuuuuuuuucaaauuuuguuauguuucaagaaagagucuuaguacuggcugacccagaacucaguauguagaccaggcuggccuggaacuaagugagauccaccuuccucugccgccugaguucugggauuagaggaguacaccacuaugcuagcucccuguuucauuuauuuuaucuguauaugugugaaucugugucugucauauauguucagguacccagggaggucaaaagagguccuaaauacuuuuaaacauguauaguucaugagaaagcaguugcuuuucguaaguacaucaguuccagauccacagcagugcuuuccuguagcugcuuccuguugacggucgugucugcucuguucaggaguguuccugggacuuggcuugagugguguuguacccaccaugcacuuuacuaucgcugagggcuuugucaaggccaccacggugggccagaugggcugguucuuccucauggcugugauguacaucaccggcgccggccuguaugcugcucggauuccugagcgcuucuucccuggaaaauuugacaucuggguaagaaaugacucuuagcggggccugugauggugagugacuggcccgggucagagcucugaguagguggugagagaguugggucaugaaguauuuaaguguacauugugucugaaggaagaggaugggcaagaucagcccuggugucagaguuucuuauaaugcucuagaacaaguaucauuuuuaugacguaaacaguuuuuauggagaaagcagaagaggcaaauguuuccuccaacuccucuguccuaaaggugggucucuguuuguucccacaguuccagucucaucagauuuuccacguccuggugguggcagcagcuuucguccacuucuaugguguguccaaccuucaggaauuccguuauggccuagaagguggcuguaccgacgacucccuucucugagccuccccaccugagggguggaggagggacuucccaagugcuuuuaaaaauaacuucuuugcugaaguaugaggaagagucugaguugucuguuucuagaagaaaucucuuagagaagucaguaccagugacaugucagcucacugucccagccuccguccgggcaguacacuucccaugugcauucccggcagucaccucggcaaggcaacugcugcuccuucacagauaggacgugggagcucauguugagauuuuacccauuccuccagccauuuugggaaaaaaaaaauuaugaacugggauucuucagaaauuauguuuuguuuuuucuugaagaaaauaucccccccuuacccccguccuuacuuuguaaccuggcugauaacgggccauccauuuuuguagcacacuuuucagaaacaauuauaaccuggucccaucuuucuaggacaaacaaagccacgccuugauguagcccggcuaaucauggaaguacguccaggcuucaaauaacuugaguuuaaauccuuuuuuuuuuuuuucuuggcagaguaauguaaaauuaaaauggggaagauauuuaauauuuaauacuaagcuuuaaaaagaaaccugcuaucacugcuauguaucuugaugcaaagacuauggugauaauaaaagaaaguauagacaacgcuuggcauucaaagaguuaacuguguugucuccacuguuugcacacaacuccugaggcucgagguuucugaggacucagcuucuacugagauacaaaucggaaucauaccagcagugagacggguguggucagcgaaugagcauaacucaguuccuaaccucucaucucuaauacaacuuaguaccauacagacuccugauuagugucccucagaugguagagugugugccuagcacccacaaagcccuggguuucgucaccauuaucagauaaaccaggaaugguaggucaugccuauaacaccaauaccaaggagauugguauauacaugagacugucucagaaaggaaaaucacuguguuaccauaguauuuuugguuuuucgagacauggucucuguguagcauuggcugucuuagaacugacccuguagaccaggcuggccucaaacucucagagaucccccugcauccaccucccaaguguugggauuaaaggcauguggcaccacugccuaguauagacuaugagagucuccaguguugaggcauacccuagaacuuaguuuuaguaacacuaccuuguuggugcuagagaaucauucaguuacugcucgcuggagagaaaccagggaaggcggcaugugauugugcucucagagcugagggcucaggcagguagaucacugcucccuacgcagcaaaccugcauaguugacuaguuucagggaaucggacagugcuuccagaacaauucuugaguguaaccuccccuccucggccugaaaucuggcugaucagguuugacuguuagugcuaggagagcaucagggguggagccugccacccuaucggucugccacucccacugcuacugccugccuucuagcgguuccggagccgacuugaggucaccugaaacuggacuccaaggaugauuuggcuggaaugggccccucccccuucuucauaacccagugucucugaauaguaaaauugaaccuugaucaaacugau

SEQ ID NO: 381 - RNA, 793 nt, Mus musculus
uauuaucaccauagucuuugcaucaagauacauagcagugauagcagguuucuuuuuaaagcuuaguauuaaauauuaaauaucuuccccauuuuaauuuuacauuacucugccaagaaaaaaaaaaaaaaggauuuaaacucaaguuauuugaagccuggacguacuuccaugauuagccgggcuacaucaaggcguggcuuuguuuguccuagaaagaugggaccagguuauaauuguuucugaaaagugugcuacaaaaauggauggcccguuaucagccagguuacaaaguaaggacggggguaagggggggauauuuucuucaagaaaaaacaaaacauaauuucugaagaaucccaguucauaauuuuuuuuuucccaaaauggcuggaggaauggguaaaaucucaacaugagcucccacguccuaucugugaaggagcagcaguugccuugccgaggugacugccgggaaugcacaugggaaguguacugcccggacggaggcugggacagugagcugacaugucacugguacugacuucucuaagagauuucuucuagaaacagacaacucagacucuuccucauacuucagcaaagaaguuauuuuuaaaagcacuugggaagucccuccuccaccccucagguggggaggcucagagaagggagucgucgguacagccaccuucuaggccauaacggaauuccugaagguuggacacaccauagaaguggacgaaagcugcugccaccaccaggacguggaaaaucugaugagacuggaacu

SEQ ID NO: 382 - RNA, 984 nt, Mus musculus
uacgucaccuuaggaggccgagccaagaaguccugcuuaccugagagcucagaaaaagagaccugagaguggguagacggguggguggggagugccgcgugugacagugcgcuggaggccagaaggacccaagacuggcgguccccacgcgguauggcaggcgcuaggcugcguuccugccacacucgggagacccacgggguuucagaguucucuaggucgguuucugaagaaucaggcuccgcuucaccauagggaggacuuucccaucccggauaaccacaggguccuaaaugugccugucaccaugaggcgauugcuuccuucacuccaaggaaaaggaacuuguggauugacugagccaccagaaaugggucgcaguaggggaaacugcaaagacccuucucaaagaagacgccacagccaucuccucuccucugacucaccauggucguucauuagugcugcgguucuuaggacguuugcuuuucguugauuuugacuuuuugccuuuggcugagaagggaaagauguuucuuguuccaguauagaugaaugacuaauuggauuauccaguuuuccuuugcacggcguuugguucuuagggauaguaaaguguagucaagagggcagcgucuucguuuuacauaguguuuucuucgugucauagcuucuugaucccaaacuguuccugacauuuaaauaugguggacagagugcagaauugauagaaaauguugagggcacucuggaaauaguuguuaaaaugaucaauguagaucuauuuugucuagguuuuguaguguagucaucagacuucagggcaggaaugcuuccccaccaaaucuggacccagaacuacuacagcagaugaacuuaagguagcuagaacagaagcuaacgaucuugggcaccaggcacauacauggugcucauguauacauguaggcaaaccauuuaugcacauaaaaucuuaaaauuaca

SEQ ID NO: 383 - RNA, 75117 nt, Mus musculus
cggcaagacgucgucggaggaaggcugaaaaagcccuagguguugccguugcuaguagaagucggaccugucgcccgagcugugcgucugcacggguuucggacggagcggagcucgcugccgcgguugcggagccugcccugugcucgccccugcccaggucgcggugauggagccggccaccacgcugcccccaggcccgcgcccggcgcugccccucgggggcccgggcccgcugggagaguuccugccuccccccgaguguccggucuucgagccgagcugggaagaguucgcggaccccuucgcuuucauccacaagauccggcccauagccgagcagacugggaucuguaaggugcggccgccgccggugagucagccagcaccccggauccugcucgcggcugggggagggagcgaggacgcgcggcccgggaggccggaggcgcgggggcggggagcggucgucccgcgggcccggucaaguuugggguggcuccgagggucggagaugcggcggugggaggaaggcgcgggggcccccgucccgggugggaugugggccgugaggaccgcgggcuccggcggggcggccggagggggcuaggucggugcggcuccgggggcuggugcgcugcaccgcccggcagcggugcgggcuggagugguuggcagccgccgggguggucgcuggggaguccucccgagcccggcugagacgcgggcgcggaggcagggcucugggcccgcacggcuccguggcugguccucgccuccuucucggggugcgggggugugugaugggugggggugggggacuugcgaguugucgugugaggaggaaaguuuucaauauggcggcgggagccccugguccuuugugugguggcggcgucggcccgaagcugcccucaccugagcgccccacccuccggacccgggucccccaccaccaccuggucccucggccucugggaguccccagggcgagcugggccagggggcggccggcgcuacugggggaggggaggagccgcugggccggucuggagcggcugguugagugguggugggggugcaagggucgggguggggggacgacacuuugaggauggugggggcaggccaagcggcgggggcccugaugcucgcagguccuggcggacgcucccacacggacuuggggccggacugcuuugcucccggcgcgggggggggggggaggccuggcuggggcugagguggagaggcugugcuuguaggggagaugucagacgagcucuuggagauuucauccuggucccuagcuuucccuacucggccuucccggcgggggcucuagcgccucgagcuuggggggcucugaggggugggguguccccaagacggcccuaacggcugcaacguccgcggagagcccggcccacuccuuccccguccccgucccccuccccguacccccuccccccgcagccggaacuggaugcgcugcgacaccccagguuuuucgccuaccuuuugggaugaccugagucugaguuggccuaaacgaccguuggaccggccgggucgguuggaaagguuuaacugccuugccuaccguuuaagaauuuucuaucuuucccugcucucaagugaaaaagacccccccccacgccuuuuaccccuuucucccuuaaacuugcucuauguaauggcauuuugauuuaggggauuguguacguagacguucuagaaaagauguuugcgagagaucccugaauaaagccuuauccuuucacuacccccacgaaagaaaaauuaaaacacagauaccauauuuuaguugcucuuggacaacuuugaaagcagaaaugaaaugccucagaaaauaacuggccaggucagcuaguauggggggaaauguuuggaaauagauucauuucuucuggugaaauggacagaggcgauggaagguuucuuuuacuguagaggccugcagaaguuacacccuugccugguuagaccuaggguuuugauucugaaauguggaccacguuucaaacauugagcgauuuagcuuuaucuuaauguaccaggaaagaugaaugugacuguugcaugcuugcauuaaugggauuuuuaucuagaaauuaggaaacuugacaaaguuauuagaaaccaaaaucuaagaggaguuaggauccugugaguugcccuccauguuggcauuguggcgcacuaggacuggguagguccuuuuucuuaccgacuuugccuuuuauagagcuauuuucuucgaaaaauaguugcuuugguuagguuuggcuacccauuuccucaugugggcuagcagcuuaauggcagccuuuaggauuugugcauuuguuuugcuuuuucccauucugaauugucacacaugauggccaccauuuucuauugagacuacuauauacuacagccugagaggagaagggguaaagaggaagaaauaauguacaaacauaacuguuuuggagccuccuuugugugaaggggacuugcuuccuccuuuguuuaacaaacuccugugucaguguggaagaguuugccaguauuugcuguugauagaaccacaaaaagaaaacccagaaguuguagcucuugaacagagggguccuggaacaaaggcuucuuaagagaccauaaacagucuuuguuugggaaauguuuuguguuaggaaagcuggaacaagugguuucauauaguugaaauguggcaacaaaaaaaaaccucuaagaaauaagaaauauuuuuuuauggugcagucuuuuuuuauaauuccucuaucuaaauuucuguucauugagauuuuggaacucuaauggcaaaauuugaaugauuuggagguugugguauacuuuuagggggagaauuauaaaagcguuucuauuuccuuuuguucuuagcuuuaauuuuuaauuaauaguacuugaauagcauuggucuguaccuagugagggucuuaagcuucuuugcuuuuaaagcuuaggguguuuacauuauuuuguguaugaguacauaagaguuaacagaaauuuguggaaauacaaaacagcaagguagcugaugaaaugaugagucaagacuguaugcaaaccaaguuuaagacaguagccagaagagugaggagagcuagacguacuuuccgaggugagacauugacuuaauuuuacuuguuuuuuauuuucuauaaaaugcaaguauuaaauguuuaaguacaaauguuauuuucacuguguaguauuuggcugcuaaguagauauuuucuugauuuuuuuuuuuuuccaaugugauagaagugugcgauagcguucagauaccuaacagcugcaguuaggcagaguccacaaaauucuccuuccuuaaaggaaugaccaaaagucagauuuaaaucaagccccagauggcacaauaaagacuuuuuuuuuuuuaaguuuuuaacuucuuuugguuguuuugaauccucaucuccaucuuuauagccauuacauauaagacuguuggaaugaaguuggcaucuuggagugagugagcuuguuaauuccacuuggagaacaaggaggaacuuaaaauacacuuuguaagaaaugcuaauuacaacauugcuugagggguaggagcgugucucauuuggcugaauccuugaacucaggccugcugggguuaaaggugugugcugggguuaaaggugugugccaccacaccuaccucuuuuuuugggggggcggugucaaauguggaacccugccuguccuggaacccuaucuauagaccuggcuggccuugaacucugagauccaccugccucugccucccuagugcugggauuaaaggugugugccaccacuguucagcauuuuguuuuggcuuugcguuuuguuuguguacauuugcauacaugugugcauaauauacugcagugcaccuguugaggucagaagacaguuuguagauguagaacucuggacugucauuuggguucuguaaucaaauucaugaacuugcuuauuuaauuuggagggcaguaaaagucaaggauguuuggaguacaggaguggguaggcaaaaguuugcuaaaauggcaacuuauuuuuagaguguuuaaaauauauauuaaauacauagauaugcauauagccauauauagucuguauaguuuaugugcaaugaugggaucauuuuauagacuugccaccuuuuauuuucuuugugauugauuuuuacuuuguguuuggcguguauauaugugaccaugggcauggcuguuguccagaggccagaaaagggcaucggacggaccccauggaauugaguuagagaggggagugaucugccauauaggugugggaaccaaacugggcccuuugcaggaccagugcccuuaguuauugaagcaucugugcaaccacucauugcugucuuaguggguuuacauuagcacuuuagaaagaagugagggcuuagugugacagcauaccagccugaucaguuccaggcuggagcuacauaguaagaacccaccgaaaaacaaaacaaaacaaaaggcuggagaaaugguuuagauuaagagcauuuguugcucuucuggaagacccagguuugauuaccagcauccacuugguggcucacaaccaucuuuauccaguuucaccagauuguuguuguugccuucugacuucuacggguauaggcacucaugugguguucauauauacgugcaggcaaacacuuaauauguguaagucuuaaauauuuaagggaugaagaguuggcuguaugauuaagaguuauuuacuggccgggcgugguggcgcacagcacuugggaggcagaggcaggcagauuucugaguuugaggccagccuggucuacagagugacuuccaggacagucagggcuacacagagaaacccugucucgaaacccccccccccccaaaaaaaguuauuuacugugugugcaaacaugaggacuggaauucuuaaucaaauauccaaacagccacauaacaaauugggugugguccauauucucuuguaacucuagcacugagugggaaguagacaggaggauugcugggguuucccuggcuuccagcccuuugcagaaagugauggaggacuguacuugguggccucuggugcaugcuguagcacacacacaucauacaugcagcacauucacacauguacacacauacucuucuuacauaagacuuugaaaaucauuuaaaucuuuuuuccuggauauaagaauacuuuuuugauaaagccauaacuaccaggguagaaaugaaguuuaaguguuuauuguuuguuugugccucuguuuguguggaaggaagugagcaggugcacacguguccugcuguccuguggaggucagaggacagcucucaggaguuguuuucucaguccacuguguuuuggagccaggugcuguuucugccaggugugcuucuggcuagcuguggagaaggcuucagagugcggugugaccacagagacaugccaccgaaucuggguuuuauaugggucccagggauaaaccucagguugucgggcuugugcaacaagugaaaaguauuuucacucacugagccaucuagcucucaguccccuaacuucuuuuuuuguuuguuuguuuugagucagggucuuucuguguaauagcucuggcuauccuggaacucuguagaucaggcuggccuggaacucagagauucacuugcucuggccguccugagugcugggauuaaaggcaugggcuaacaugcccggcucuguuuuguuuuuuuuguuuuuuguuuuuuuuaaagaaaaaaguuacuaguauggaaaauaauugcuguagcuauuuuucuagauaaaagcaaagggcaguauuccuggaaugaggaccaagcugauugauuguagagaagaugagguuuuguccuguugcgguuacacagguaacauugcagcaauucagagugagcucucuagucuuuaaugcgugacggucacgugccuaggugagcgugggguuauagugccuggguuuuagccagugcuuugguugccuuuuacaguuuucagaacuuguaaagaaacuugaccauuuugggaacaacuguuagcagguguagagguguggggaguggguggucggauuuccugucugccuuguuccuuugcuggaauuggccauauuuuauaucaacuaguuuggaagggacuuucugcacagauuagcccuuuugucugacagaacaguugagggucaggagugcucagggaagagaaugaaguagccuuucuaagauucuuaaugugugauuagguucuuagguaacuuuucuucugugcaggagaguaguuuagcuuucagcauugaugcaauuucugugaguagaauugcuaguuaacauuuuauaugguguuaguuuuuucuuccuuuggugcuauuggaaguccuuguucauguuuggcaaguucuguaccaucaagggcuguauauucccaguccuuguuuuguacuguuuugagacaggauauugauauuuuuauuaagcuagccuggaauucccagagcaguucaggcuggccucaaacucaguacuuugcuuugaauucuaggauuacaggaguaucuuaacauacugggcagacauccccuuuaauuuuaauuuucuuuuaauguuaagauaaaguuguugccaggcauggugaugaugcacaccuguaaucccaguaucauaaggcaagaggagagaauguuuaaagccagcugcucaucucuuaaaaaucuguuucuuccaagaaauauuuuuuuagggauaaacauuuuaucaaaucugugcauguuguguguauucuuaaaagucaguuuauuauguacaaggaagggcuauuuuaaaagcugccuagaguuguuuuuuugugcauccguauucauauucgugccugcaaaugacugugugcucauuucguggcaugugcacacggaggucggagaauaauccuccugcguguguguugguucauacuuuuuuuaaaaaaagauuuauuuauuuauauguaaguacacuguagcuguccucagauacuucagaagagggcaucagauuucguuacagaugguugugagccaccaugugguugcugggauuugaacucgggaccuacggaagagcaguuggcgcucuuaaccacugagccaucucgccagccccugguucauacuuuuuguuuaagacagccuguuuuucuacuguguaugccagguuacuagucuucacacuucugccucuccuugccaucuucccauagaagcccuggaaugaggaaugcuguuuccaugugguugaucuucauguuugugcagcaagcuauuuuacccacugagccaucuucccagccagcccuagaauuuuuuaaucugguugcaucaugaccuuggauaaagucuguuuaccccaguguguauaccuucucaucugcucuaaagggaucugacacugaccgagggcuacugucuggguuaauuaauggauugcaggagcuuaaaucuucaagucucccuuccccccauccccacccccuuccuuugcuaagaagagucugggaacagauguagcaagacagaaaagucugggacaaauacauaucccucauuuuccuacagagaagaauugauuuuagugaaauuaggaaaggcaaaaaagcccaacaccaucaaagcuagaauaagaacugggcauggucugcauuccugucugcuuuaguuuagaggcaggugaucaguuagaggccagccuggcuuacucauguucuagguuaguuuuggaaauacaacaagaccucccaaccccauuucuaacccccaauccuaggauauaccuggaugugauagguuauucccagcauccaguaggcagagacagaaucaugaguuuaagaccaacccaagauaaauagugaaaccuugauuuuaaaaaauccaaacuagggcugggugguggcacacaccuuuaauuccagcacuuggugggcagaggcaggcagaucugaguuuugaggccagcuugcuucuacauaguuaguuccaggacagccugggcucuguuacaggagaaacccugccuugaaauaaauagcaaccuccccccccccccaaaaaaaaaaaaaaaaacuaguggauacuggggagguuaacugaagggcagccaugaggaagucauggcuggugagacucuucagugauggcucuguuuugggguccuguaaguaaccccucaaccauuaucugggaagcccaauaaaugcacugaaagaaaacccacacagagaagccuccccccacaugaaucuaacaaguauaaucuuccuuuuugcuugcuugcuugcuuguuuaugagggguucauguaacccaagguguccaugaacucccuaccucccagguauugaauuguagcuuugcauuaucauauucuaguuuauuccuuguuuuagauguguaaauguuuugcuuguguguguguguguguguguguguguguguguguguguauacguacuagugagugccugaugcuuaaaguggucagaaaagggcaucggauuccccuggaacuaaaguuacaaaugauuaugagcugcuucaugggugcugugaauugaaccuggucuuuuggaagaacagcaagugcucuuaccacugaaccaucucucuuguuuuuauuuuuuaaagauuuauuuguaugcauuuauuuuggucuaugugcaugaauaugcauaugugugugggaauucagguacuuaacuugugcaccuguagaggccagaaaaggacauuagagcuuuagaacuuggaauaacaguguugguggauauccugcuugagguacugguucugggaucagaaccccaguucucaugauugugcaacaagugcuuuuaacugccgagccauuugcuccagcacuguugcguuauucuugagacagggucuuacugugcaguucaggcuaacaucuugguugauucagguguagauuuucucaguaccugaaucuuuaauuugaagccugccggaucuauaacugaaaaacaauuuguguaugugugugugugcgcgcgcaugcacacacaccuguauaguaacagcaauugaacuagggccucacucuugcuaggcaagcauugugccagugagcuacagccccagcacaucugccacuuucugugucacaguguuuuaaaaaauagacaaacuuuuucaaugaaaguaacuagaauucgcaaucagaaaaacuuggaacucugagucuggagauuuauggaucuuauaaagaaccccauuggguuccuagugcccaugucaggcuucuaacugccuauaaugccagcuccaggaguccaacuccucagacuuccagggacauuugaagucacaugcauauagagacacauaacuaaagccuuggaauuauguagucucuucuauuacuucuuagguggaccuauauuuuauauuuuacuucucuuuggugggccuaugcauuguauacuuuuacuguguuuuuacuacuaugcuuuugugaguguauguauuagucuuaagucaaacuuaauaauguuuucuagauguauguaaguacuguccagcugaagggauggcuugcucauuugauacaaugcuugucuguaugaaauaugagagccugaguuugagaccaagaaauauacaaaaucuggcuguguguaguagccuauucuggucauacuguucauugcuggggaagcagagaacacaggaaggugcuuggggcucacuagccuaucagucuagccuaauugucuaauuaucagucuagcugcuaggucaaccugacacuuuuuuuuuuuuccuccagagacaggguuucucuguauaguccuggaacccacuuuguagaccaggcuggccucgaacucagaaauccaccugccucugccucccaagugcugggauuaaaggcgugcaccaccacgcccgacuccugacauucuuuuuaaaggaguuaaauguuauuucaaaggaauugacuguccucucugaccucauacacuccucaacacaugugcaccugcauacauacacacucauuacagagacacuucgaugauaguaaggccugccugcucuuaguguguuuguguaugugcaugaugugugugggugcacguacuaugccaggccguggaggucagaggguaacuuugucaagcugauucucgcccucuaccuucauauggcuuccaaggauugguuuguaagguaaaaacuuaacuguggaguuaccacuagagcccgccccauccauguacuaaguuacgaucuaugucuucaaauguuaggcauuuuaguugguaucucguaguuuggcuagguucuuuuucuguguucuccauguggccaguccucaacauuccaucuccgguucuuugucuaggauuaagauaucauccuuauucaggccuuguuuaggcagucguguugaagagucucuauggguguagcuucucuuaccaaacuuccuauucuucugguucuuaagaggucucccacuuccugcugcuaugauuccugacccuuuuguucagcaguuguguugcagauguaucaguugggcugggcaccgcacuuguucuuugcacuuugagaggcuguaguuuucuguagugaucucucuguuggugucucuuugagagaugagacccacacugaucuuuuucuuaauguccugugugacauugacauguauccuguaggcuacaguugugaaacacuguuuuacucuaauuguauaaugccaggaacagaacaaauccccgcuacaccuccauacuuagagagcuuuaggcaggagucuccugguuucugugugguuguaccaggucaucauuuggagauauuucagccagauggcaacuucucuucuuugccagacuauauuugaagguagaagacaaaguagguucucuuucuucacaucuauacucugguccuuguguguguguguguguauguguguguguggggcaaggaggaagaguggagaauggaaaagguguguuuuuugaaguauaaccucuacuuuguaaaauucaaaguauuuaagauucucuuccuugaggcacccauccacuaugaugcuguauuuggacaaauugagaagagucacuagauuuuccaguaugaggagagauagcuucagggauauguagagauuggguuuugauuuuauuuuuuuauacuuaaauuguauucauucucuuaguuuuuucuuucauuguuaaucugucuuuuacuauuuucuguuuguaaaauaugucuuugcuauaaauaauggguaauuguuaucagauuuuuuucuuuuuuagagaacaguguuuaggauuugguuugggugugguguguguuuugugugugcaugcaccacacacacgugcauaggacauucuuaggcaucuaguaaaugaaaacuugaagagaaaaaguuauuuaguaaaauaaaaauuuccuggcuucuggugacauuuucauuauuacguuauccuggacccagacuauuuucagaguuuuuuuuagcuugcuuauaaaagcaaaauaaugcugacccaucuuuacauccugaaguuggaaggaaagagauagugugugguggaacuaggauuugagccuagacaaugaaggacuuuaguuagugaucauuuauuaagaauaaagaaauagagacaugaucuaacuuugcagcccugucuggucugaaacucguccugcuggcaugaagcucugucugcuucugccucaggagaagccacggcacccaguggcuuucucuucuuucuguuuuuaaagacuaauuuaucuuuuuaguuuuucaagacuuuuuccucuauagcucuggcugcccuggaacucuguagacuaggcuggcuuugaacucagagauccaauugccucuacugccaugagugcugggauuaaaggggugugccaagauuaauuuuucuauagcccaggcuggcuucaaacucaguuaucucaucuuaugcaggagaguauucaugcuauuguguacagcuuuuuuuuuuuuuuuccuuuuuuuugagacaggguuucucuguguagcucuggcuguccuggaauucacucuguagaccaggcuagccuugaacucagaaauccaccugccuuugccucccgagugcugggauuaaaggcgugcgccaccgagcccggcaauuuauuuauuuuuauuauauguaaguacacugucuucagacgcaccagaagagggcuccagauauuguuacgggugguuguguggcugcugggauuugaacucaggaccuuuggaagagcagucagugcucuuaaccucugagccaucucuccagcccauguacagcucuuuaauagguuuaauaaaugcagcuuuuccuuucuggucacugaaauauaaagacauggcaauaguaagguacagauacagaacguuagagugucauuuuguauuuuuagggaguccuaacuggccuugaacucuuaacagagagugacuuggagcuccugauucuaaugcugcuaauauuaggacauaaacgacaacaacagaaaccacaaaacaagcagaaaagaaaguguguauguguguguguguguguguucaugugcacgggguacauaugaucaucagagcugcagucaccucagcuugucagguuugacagaugcuuuuauccacugagauaucacuuauacaguggaucauugauaccaaacagccguuuaaaugauggccaguuccuuuggcugcaguuuuuucauauuuuaggcuaauaacuuauuuuggaaauguagcaguggauggaagaaguaaacaacugaaaguuggagacagcguuuaaccagcgugauggaaggaagcugcuguuggauggcagggaaaugcccacuuacaucuuuaauugggcaugcucauuacauccuuuucacagcgaugcuuacagacuguaauccuacacuugacaggcugagucaggaggauugugagccccugaacuauguaugaccaggaaacuuugccucagaaaaaaagaaccaaaaauaaacaaaaaauaagcgggugggugccuuaguguauuugugcugcuauaacaaaauauuugauaaggauacuuuauaaguaguaguaguaguacaaauucuuuuuaaauugucaaagcuggcaauuguagauuagacucuccuggguuuccugucuuacaagggcaagcuaggucucuauacucaaguauagaguaguagaaggagaucuagacuccuaggagauaagaauaagagaaagagccuguguguguggggggggggagggaggagagagagagagagggaggaagaagagggggaggaggagggggaaggagggagggagggagagagggagagaaaaggagagagcagggagcccaaauugucuggguuggaaaauuuaagguugggggcagggugugcuagguagggacugaaggaugcugggagaaccuggagaccaggucugcuuugauauguaaaauaugcaccccagucccuugucccagugguguauaaccaaacagguuuaaauucaguacuauuugggaucauacauguuuauuuaaaauaauugucuccauccuuaauguuagcauuacauuuaauuuaccaaacguguagcagggcuaaaucucuauacuucagaagaaaguaacgcaacuuuuuuguuuuugaugcuuuuauuuuuauuuuauauacauugauugguauuuugcuugcacauguccgcgggugucagucagauccccuguuuuuguaagaugccacauggguucugaguguccuggaagagcagccagugcucuuaacugcugagucauaucuucagcccuacugucuuuauuuuuaauuaauuauuuuuuguuuuguuuuucaagacggguuuuuucucuguuuagccuuggcuguccugcaacucaauuuacagauuaggcuggcuuggaacacagagauacaccaccacugcccagcuugguuuauauuuuugagacaaagucucacaauauauauauauauauauauguagacuagucuggccuugagcucauaggcuagacuaucucugcuucucuagugcugggauuaaaggcaucaauucauugggaaaaaaaaaagguuguuuuuuuuuuuuuuuuuuuuuuuuuuuuuuggauagcuucuuauucuguagcccaggcuggacaggcaccuaggcuggcuuugaacuucucugagcugacacucuuucucucccaacuuucugaaugcugggauuaagccauaccugauuuagcuagcugacuuguuuuuguuggagaauacacacacacacacacacacacacacacacacacacuuggcagugcuuguaaccacucagucaucucucagucccugguuuaugcauuuuauauauuuuauuuguuuuaguuuuuccagacaggauuucucuguguagcccuagcuguccuggaacugggacuugaacuccuccuguuucuauuaccaaguaguaggauuaaaggccugccaccuuuaaaaaaaaauuuuuuuuuuaaauucuuguacaugaagugcuucuccuuaaggcagaguucaagagaucagcauugaaaaugaggaagacaaggauuuuuuuuuuaaagcucagggguaagggguuuccgaauggaaaauaggaaauaggggauuuggcaggcaaauagguuguguuaccugggcagagcauuggguauaaaaaguuaguuucaacgaccuccugaacaaagacaugauugcacaguaggcgugaugcacagcauagcaagguggucacagaaccuuugaaauaaagaaaggguugcaagaugguuaugaacaacguuguaaaacaaagacaugauugcuauuccuggaacaggcaaguacagaaccguuuguaguuaaggguuacaguagggcauagcccaauucuugagaaacauguuuaauuauaaacagguaugaaccuaguuugucuuuuguuuuguuuuguguguuuuuuuuuuuuuuuuuuuuuuuuuuuugguuuuuuucuuuugagacaggguuucucuguauagcagaccaggcuggccucgaacucaaaucuaccugccucugcuuuucaagugcugggauuaaaggugugcgccaccacugccuggcuaguuugucuuuacgauggcuuuucaguuuaggauggaggcaggugcuucuucaaagagcagcuaucaagcaggagucaguggugacaugggucucucuugguuuuuucugcaguguauuccaggguagcucaccuaacaaaggggcaauuccccugucuuuaccuuccaucucugugcagggaugcugagucacaaaugugugccaccuucuccagccuuggguuccuuggguuguauuucgguuguuagguuuguauagcaugcacacuuaccaucuucccuaaauguucuuugagacugaaguuguuuaaagcugaagguuuugggccucagugaauaaggcuaucugucaccaagccuggcaauuugaguucaauucccagaacccaaacaauggaaggagagaaugggauccuucuugcccauuauuuccugaguguucaagaaaaccaaacugguggcuuguugacucacuguauguaaucuuugcauucuagaggccaaggcaagaguauuauugaguucauacucagucugggcuugauauugagacuuaaagcaaaacaaacaggaaaguuggcuuuccugggcauauccuauuaauuuguacauuuuauuuuugcacugcuaaggauuggacuccaggucuuuugaaugcgugguaaacugcauucucugcauucucccauauuuggauuguauuuccuuccuuccuuccuucccuugccuccuucccucccucccucccucccucccucccucccucccucccucccucccucccucccuuccuucuuucuuuuuuugagacaggguuucucuguguagcccuugcuguccuggaacucacuuuguagaccaggcuggucuugaacucagaaauccaccugccucugccucccgagugcugggauuaaagacgugagccaccacgcccggcuuuuuuuuuuuucccccuuuuggagacagcgcuuuacuauguagcucagauugucuuugaaguugugauaguucuuauacuucaguucuccagugauggguauauaacaccaguuuaugaguuagaauucuguuguugacaggaucucaugaagcucaagcugaccuugaacuucuuccuguguugcagagguugaucuaaauuccaguguugggguuacaggcaugugccacacuacuccuaguuuuagguuuuuuugcuuguuuuuuuuuuuuuuuuaaauaguugucuucuguuugugcuucucaaguccuuaugguaauuugugucaccccagcugaaaggauugcuagucuagcuuaaaauacucccuaaaacagauuucuuuggaucuuaacaauuuuguucugaaguuuuguguuaauuuuuaaaaccuauaaacuguaagaauauagauuuaggcaucugcucuuccaucugcuggcauuggauuguaauccugugaauacauaauucugaugaugaaaaugagauuaauauauaaguaaguaaaugcaaagaaaaaaaucaaacaccuuccauaaucuggaugacaguuucauagaguacaauuagaacaauguuucaguccuuaauguuauuuuuuguacuguuagcaaauuaauaagaauacgcucuuauucugauaaguuuuaaaauuuauaaucauuauuaccaucaucaccauugucagcuuuuugagaccguauuucucuguguuguccuugaacucacucuguaaaccagucuggccuuaaacugccuaccucugccuacuugagugcuaggauuaaaggcacaagccacuaacaccuggucaaauuuucuuaauaucauauguucugauuauauucuuucccuccuuaacuuuucucagaucuuuuccaccucccucccaccuaacuugauguucucucucuucucucuagcucucaaagaaaaaaaaaaccaaguaagacaacaacaaaacccaaaauaaaaccaaaaccuaguccccaaauacccgccaaaccugggccuaggguuugccuugauguaaggucaguagcucaugacauuagcugcagaaaaugggcucuccucuccaagcacauaucgaugcacagagcuucuuggcuuaggggucagcuuuuuuuuuuuuuuuuuuuuuuuugucccacuucccuaucucaugcugggauuuugucugguuugcugaggugccugugagcucuucuguguagcauccugcuguguuugggaggcucuacuucuggauucauucucuacuucuggcucuuaggaucuucccaccuuuucuuccuuuauagauuucuugugagaaggguuugaguuagacauuccuuuuuggacucggauacgugcuccaaacccucuuacacuucaggccgucccgcuguggucccaggguuaauuacugucugcugacagaagcuucucugaguugagccaaugucccuaccugguguggccacugugagucauagacucacagagacuggcucugagggucuggcaggaaggaggcagaaagcauggagauguccuagaagaaaggaaccaggagaagccuaggucuguccaggaggcugcaaggcagccuccucaagaauggucuguugacaccaaguuuuuaguugguuugccuucagggcucagaacacuaaauuguguagcuucuauugagcauacuuucucauuuugcuaauuauuagaccucaaaaugacgacagacuuucuguaauuaaaaacaucuaauauguuaaauauauguuaaauauauggauacuaauaguugguuaucucuugugggcuaauuuuugcuuuugaaccguuacaguuaaaugugccuuaagugguuguugcuaaguuaguacuaaggaagauguuuacuugcuuuucaguccucucucaggaccuucagucuucagcuguuugucuucccaaggaauacauuucugacugcuaaggaaaauaauugagccuuuuaauaauacaauucucauaauuucuguuuugaaagaguuaaagcuuuuaucggguggugguggugcacuccuuuaaucccagcacuccaagaugcaaucagguacagguggaucugugaguucaaggccagccuggacuacagagugaauuccagaaacccagggcuauacagggaaaccugucucaaaaaacuaaccaaucaaccaaccaaccaaccaaccaaccaaccaaccagauaaacuuguaaaaguaaaggaaaugacaauaaaucucagcaggauauuuauguagaacugccuuuuguagucuauaaauuguuuuauuuuacuuuaaagaaauauuauuuaauguauaugaguacaccauugcucucuucagagacagcagaagagggcguuggauggcauugcagaugguugugagcuaccaugugguagcugggaauugaacucaugaccucuggaagaacagucagugcucuugcucuuaaaagagcagucagugcucuuaacuguuaagcccucucuccaguccuuauuucacuuuuuuugagacaggguaaugguuuguauucccgccaggccuaguacucauguauagucuagcuugggcucaaacucacaagauaucuauccuccagccucagccucccaaaugcuggcaugggauugagccauauuaucccuggcuuacuauaaauaaacuccuauuguuacucauccuugcaauaggaguucuguuauucuguguaagagugaguuaugauccacauuuugguaggggauaaaaauuuuaccuuuuuuguuagauuaccuagacuuugucagauaugucuucguucucuugauaguugaguaccuaaauaguguguaguuugaauuuuaggucagguaugguagugcaugccuccaauugcagcagaggcaggaagaccacugacuuaaggucuauauacauagcauuccaggucagucagggcuacacagugagauucuguuucaaaaacaagaaccaaaaaaaucaaccaaccauccaaaagaacccccauaaacacuauuaagugccuuuuuauaaugauuuccuuucuauaaaguauauuuuuauuuauaugacugugguaaguuaagaggauaacuuuuggagucuuuuuuuuuuuaagauuaaaacacaacaaaacaaaauguguguguugguguugacagaagccagaagaggcagucagauuuccuggaacuggaauuacagaugguugugagcugccauguagaugcugggaauugaacucacauauucugcaagaguagcacgugcuuuuaaccacuggaaauucucuuccacccuucauucuuuccuucuaccauggugcuagggcucaaacucagcuuaucaggcugugccaugagcauuucuacaagcugaaauauuuugccagccuguaacuucacaauuuuuccacuuucucauuuaaaacagucauaccagaggccagacuuugccaaggaugauuuaguucuuuaugcguaucugaauacguauuuauuuauuuauuuauuuauuuauuuauuuauuuauuuauuugagauaaggucucucuauguaguccuggcuguccuggaacaauauagaccugcauugccuugaacucauaaaagucuaccugccucuucuccuccugagcgcugggaauuaaagguuugugccaccauacgagggccuuguuuguacuugacauugacguaccauuuugcuugaucucucuucucugucuaucugucugucugucugucugucugucugucugucucuguagcuacaaaagguuugaagugauugguauugaugaaaaauggucuuaagcuauuuuauaagaacaccugcuacucuuuuuuuuuuuaaagauuuauuuauuuauuauauguaaguauacuguagcugucuucagacacuccagaagagggcgucagaucucauuacggaugguugugagccaccaugugguugcugggauuugaacuugggaccuucggaagagcagucggcgcuguuaaccacugagccaucuugccagccccuuaagcuauuuuuuaucucucuucuaaucaucuuggcaacuuaauguuuuccuuuugauaugucauuuugagaauuaauuuuauuugaaucugcaaacuaagccugcauaauacaugcuuaugaaacuuuaucguguguguguguguguguguguguguguguguguguguguguuucugugcacgugcaguguguacuccuguacuucuguggaggucagaggauaacuuuggagaaucaauacuuuuccuucuguguacccagaaacuaaacucaggcauucaaggcuugugugacaaaugguuuuaccuacugagccaucucugggccacauaaaacaacuuuuauauguuucugagaacauaaucuccucaccccuccucagcauuucuuauagcagaggcuggccuugcccaacccugaucguccuaccugugugccacaggagugcagugccauaccacaggaauaggacauuuccacaucuuuauguuuuaggauaggaaagcaugucaggaggcuggccagucagcgaauaaccugucuauugucuuuaguucuuaguguauacaaguuucagaccacaaggacagaacaugguucucugugcugggaaggugacucagcagguaaagacacuagcugccaggcuugaugaccugaguuccacucucaggacccauaugucuuagcuuuucugauacauuaucuguuauguuuugaacuuaaccuuuaacugugaccaguuccuccuuuccucccccauucuucccucccucccucccucccugccucccucucucucucccugccucccuccauagguucccuccucacuacuuaacugggguugaaucuggaaccucagguaaaccaggugaguguugugccacuguacccagcccagcccuaguccuuucugaaagccaguagcuuuuguaaaguacaagagagcaaagcucugaacacgucuuucucuuacuucgacacugugcaucaagaagcaguguguuucccccccccccaugacaucuuguucuguauaauuuaacacaucaguaucuaaacauaaacuuuaaucucuuugauucaauggaguauuuucuguuuuuuuucccccuacccagaaagaauuuugcuauguaguucaggcugguuuagaauuuguugccuucuuauggaagccuauugagcacuuauguuuauggucaugcuggcacaccugggcauggaauacuuugugguuuugauagggucucaccccaggcuggccuuugcugaagaugaccaugaacuucugauucucuuuguacuucccaggugcugggauuauagaggucaucaccaugccuauuuuauuguuaugcaguguaugcuggacuuguaugugugcugugugcuugcuggugcaggcuucucuggagacaaguuugcacugagaugacuucugggaucugccucucaucacagggguuacaaucaggguaacugugcucagcuguguucuuuuuucuuuuuucuuuuuuuuuuuuuaaauucacuuuacauuuugaucgaugccuccuucucccaguccucccucauuucuccuucuccucugagagggggaaagaccccauccuguguaccacuccacccuggcacaucaagucuucaggaagagucucaggaggcagaggguacaaggcgcucaggagaacuggauccauagacagacaacagaguuaggaauggcaucuacuccaguuguuuguugggggaccuccgagcugcacaucuguaguucagcccauguaugcucuuugauugguccccuuuuaggggaucccccaagcauccccagcuuuuggcucgacucccgaggguccagauuaguugacucuggucuuccuauggaguuccuauccccuccaggucccucagucuuccccccagcauuuucccaguggugggcugugggucucugcaucucuuucagucagcuaguggguggaaccucucucaggacaguuauccuaggcuccuggcugcaagcauaacagaguaacuaucauuacucaugucagggauuggugcuugcccaugggaugggucuuaaguuguugccagccauugguuggccauucucgcagucucuguucuguuuuugucccuauauuucuuguaggcaggacaaauuuuggguugaggguuuugugggugaaucggugucuuuuauccacugggaguucucccugaccacaggagguggccacuucaggaugcauaucccccacugcugggagucuagcuagagucacccuaauagcugucccccaucucaggucucugcaacauccuagagacucaccccagccacugaucagcucucuggcccccuggccuucucuccugucccucccuacaccugauccugaguucccccaacaucccccaucccccuuccauccccuuccccacccaguucccuuccucccucugucuccaaaggcuauuuuauucccccuucuaagugagauucaagcauugaaucucaugggccuuccuuccuucuuguuuaacuucuuugcaucugugggguauaucaugggcauucuguacuuuauggcuaauauucacuuauagugaguacauaccuugcauguccucugggccuguguguccagcuuuuauguggguucuggguaucugaacucggguucucacagcugcagcacaguaagcacuuugcagggaacuacuuaccagcugcuccagccuagauuuuaugucaugguggggauuaaagccaugucucucucugugguugcgcgugugugugugugugugugugugugugugugugugugugugagagagagagagagagagagagagagagaugguugguuagucuuaguugucaaacugaaaaucaccuguaugauaggacucuaggcaugcauggggguggguuaucuuacauuaaguggggaaaaaccaucuuaauuguggguaggaccauccccugagguaaaucuuggacuguauacagugagaaagugaacugaguagugggcugcauuaauuucucucugcaaacaggauguggugaccagcugcuucaagcuccugcugcuuguacuuagggccuauacucauaaauuguggguugaugaguggaguggggugggaugggggaaugcgugucuccugcaugugcagacuucucagaauuggacuucggaccucccaguuggauuugugggucuacaggaacuuccaguuuguucugggugcugggaucuaugcuuaauccuuaugauuccacugcaagcaagcauucuuaagugcugagucaucucucuaguccaagaguauuuuauugaagcagcaggacaguaaaguaagcucgacaggagugagcacuucaccaucugagacacauccccagcuugaacacaccucuguguaggaaauuagaggguaggcugugaaucuccuugaguuaacauucucauaaucuaauauacuauuuaaguauuuuggauuguauuuaaaucaaguaaagaagaaaaauuaccagucuuucuuucccugucaauaaaagucuaucuuacacuguuugucuuuccuugccaguuaaaguacacacuguaaaaaucacuguagccaccaagugcaugaguuuugagccuuggugcuuaaggcugugugcaugcacagucacugucuagagcuuucacuauuccaaagugaaguccgaaaacagcauuuuauccuuucaggugcacccuuauuuuagguauuaaaguuaucuuccuguuucuuucacauuuagggaauaauuuauacauaauuuucuuuuaaugggcugcacucagcaucuucccacauuaagcaaacauucuaucaccaagccacacccucccuuuuuauuuauuuauauuuauuuauuuauuucuggcuuuaccagacaggguuucucuguaugucccuggcuguccugaaacucacuuuguagaccaggcuggccucgaaaucggccugucucugccucccgagugcugggauuaaaggugugugccaccacgcccuagguaccuuccaucauucucuacauuuuaaaaaacgaucuguuuaguauuuauaugugggugugguugcaugcaggccaccguucauguguggaaguccauccucuccuccucuaucuaccgcaugguauauaaagaccaaacucaaguuuucaggcuuggugguaagcaccuuuacccacugagccaucucgccagucccucuacuuaaguuuuaagguggucucuuacuggaugugaggcuaaucaaguacacuaguuggccauugcauuccaccuuccucugcugccccugcugucguuguguagacacacacaugcuugucuguuucuaggggucugaacccauguugaaaagucgccaacuuagguaaaaaugauucugaaguaucucuacaaaacaguauaaugccaaaauauuaugccggauguaccagugucuuggguggauuuacauacuugucauuuucuuguagaaaacugcaccacucuuacauuuuguuugauaauuuguuaaauaauuucaaguguuaaguaauuauaucuaauagcucuugcuuuccccuaggauuggcagccaccauucgcuugugaugucgauaaacuucauuucaccccgcggauccagaggcugaaugagcuggagguagguugugucuguguuccauucuuugaugaugagucugccacuaacuaaugucacagucuuagugaaaugagaacaugguccauaaugauaaucauggcacagaaagcuggcaguauguagcaagccaaaucucauuaaagguacugacuuaugucugucuccucuugucugcuaaguaauacauaugaguuaucguaucuuuagauuauaaucaauggaauuuuaaguuuugaaaauaacuuuuugaaaagaauguaguaggacagguuuuauaucccuaauuuucuuuuacacuuaaaacuuucguuuaauuuuuaauuuuuaagcauuuuauuuauguuuauggauguuuugucugcauguauaucuguaccauagcaugccuggugcccuuggaggucagaagguaacaucacauucguugaguuacaaaugguugucagcagcccagagaagauuguggccuaauuacacugcuuuagagugcacauacaguuuuugcucuuguauuuuaacuuuuugguuucuauacuguagaaagugguuuuuuuaaaugauuucuuucuuuauacuuuaugugcacuggucuuuuccuugcacauauauuaagagccugaagcuggaguaguuacugaguuacuggcaggugugaggugccaugugggugccgggaaucaaaccucaguccucuggaagagcagccagugcucucuaacugccaagcaaucucuccagccuacagaaaguuuuaaagugcagaugguuuaacugucacagcauuucuuuuucuugcagaggacucugguucauuuucuuuuucuuuucuuuuuaaaaaguuuuauuuauuuauuuuauguauaugagaacaguguagcuaucuucaggcacaccagaagagggcauuagaucccauuucagaugguugugaaccaccaugugguugcugggaauugaacucaggagcuguggaagagcaguuggugcucuuaaccacugagccaucucuccagccccucugguucguuuucuaacuauuuauaacuccaguucaagagaaucuugaugcucucauguccuucaaggcauuuggcaugcauguuguacacauuuauauaugcaaacaaaacauucacacacauaaaauaaauauuaaaaauagcacaagcuagaaaauacuagguuuuugauaacagagucugucuaugucaauguuuuacacauuccuuuuucauuuuuaauuuuugagacauguagccuaggcuugcaugagauuuacuauauaguauauagucuaauccagcuucuaaacuggccauccuccugccuuaaguuugaaagugcugggauuacaaguaagaaccuuucaccucugguuuuguuuuuuuuuguuuuuguuuuuuguuuuuuugagacaagguuucucuguguagcccuggcuguccuggaacucacuuuguagaccaggcuggccuugaacucagaaaucugccugccucugccucccgagugcugggauuaaaggcgugugccaccaccgcccggauguggagcugaugauuaaaaccaaggccuuuacaugguagggaagugccucuaccaguugaacuucaugucugucugucugucugucuuuuucucuuucuuucucuuucucucucucucuuucucuuuuaauuaauuuauuuuaugcauaugaguacaucaccauuucucuccucagacacacagagggcauugggauucauuacagaugguugugagccaccaugugguugcugggaauugaacucaggaccuguauaagagcagucagugcucuuaccacugaacuaucucuccaaccccuugaacuucauuucugucccuuaagcauuuuauuuuagccuauuuucaaauuuguaguugcauguaaagguauagguauuauucaggugugguaccagcuuuagaggacauagagguauagaggacagcucgaucuauguagugaguuccagggauugccauugggauuugaauaugaaugaaacgugccauuuuuucugugauuuuuuuuuuuuuuuaaaugccauagcaguaguaguugggucuggugguggcacacacuuuuaauuccagcgcuugaaaggcagagacaggaggaucucuugaguuuaaggcuagucuggucuauaggccugcaaggacuugaggggaaauaaaaggucacuacaagccauuucuuauuuuaaccaauagcauuaaauugugccuauagugauucuuaguugagacauuguucagaaugacuucauucuguaugcuuuugccuaugucuguguuguaugcauuaaauauuuugagugacaaucuuuuaguaauuauauuuuuuccacagaauaauaaaauauaggaaucuuaagcaguguauguaacaauauuuuccuuagacgcagacagcacauacuuuuaaaauacaacuuaggcaagcaaacacuuuuguacuuaauaauuuaaugaauagaaguuaguuuuguuuuuagucuuaagggugaaaagguaacucaggcuuuaaagcaagacagcaccaagugcagagcugugaugugccagcaguguaaccucucccccacccccuucggaugaccuuguucacggccacagggaaagccuuaggugagguuaaaaugcuuuucuuugacauuuaggcccaaacacguguaaaauugaauuuccuggaccagauugcaaaguauugggagcuacaaggaaguacucugaagauuccccacguggagagaaagaucuuagacuuguuccagcuaaauaaggcaagugcuggggcagcuauuucuuuuuauuuuuuuuauuuuucuuaacaaccuuagaaagaagcuacuuguuugaaauugguaaaaugagauuuuuuucuuguuguuguuauaaguaucagagcuuuaccuauguaguuuguaagcuuucuuuuauagaagaguuuguuacaauuuaucuuucacugcaaaggguccuucccauuuuaguuuaaaucaggaagaaccuaaagcucagggaaguugaaaagacguuagcugcaaaggcugagccucaguccaguucuggguuccacuucauuuuaccacacacgauggcauucuugcugccuuuuuuuuuuaaauagagacuuuuuaaggguaacaaggcaggaccaaauaugggggcuguccuuaguucagauguaauugucagacaucgucuucucugggaagugagaaggggcuuugagaaccagugagugacucuggacugaccacacugucaaaggugcuguucuuauuauuuaccuucaaauuaauagcuuagcuggaaguuuguuguguguuuuguuuucuuucuuuugaccuaagaaguaaaaaacaaaaaacaaaaaacaaagcaacuauaacaaaaguauagcugggaguuuuguucuuagaaucuuaccuaggugugagggaauuagaaguaaauuucucuaauuucuucuucuuucuaauuuuuauuuauuuuuuugcuauuauuaacaguuagucgcagaagaagguggguuugcaguuguuugcaaggauagaaaauggaccaaaauugccaccaagauggguuuugcuccugguaaagcugugggcucacauaucaggggacauuaugagcgaauacucaauccauacaauuuguuccugucuggagacagucugagggugaguauuggagcuaccuucuccuguuuuauuuagcugcuuauuuauugguacauugucuuugcaauguuuagaaaaacauuguuaaaugauuuuuuuuugagaaaaaaaauccuaggacuuugguuuggggagcaacuguauuuaaaaguuuguaucagaaugaauaagauuauaaaggaaauaccuuuuuacggucaaauacagcuaaaaucuguauuuaaaucacuacagaaugaaauacucuauuaaaagcaucucucccugguugucacaugaaaguguaaccugggaauuaacuggcccaacauuugucuauugagauuuccaaggaaguugucagauagaauauuuaauaaaggggaagaacuuagugcugcaaagcacgguccucucccagcuguuccuaucugcaagccucuuuguuugcaggcagaugcucuaaagcccucccauauuuuucaaggcucugguagaaaggagugucuuaauccauucuuuugagauacucuaaauacugggguaauaaguccuguaacuucauuucugugcuguggaaagauugaggauacaguuucucaggucaaaacaaacaugaaaauuguacccuaauacuauaaacuggcaacagugcaaugcuaaaucuuaaaucauggcguuuuuuguuuucuuuugaaaccuucuugaaauucuuuuuuauuugcuuacugguuaucaaacugaaguucuaccacugacuguaucacccagucuucaaauuggaauguuguuuguguguagcccuggccauuuuauauuugucauuuaagcuaaacuggccaugaacacacaagagaugucugucucugucuccuaagugaugauuguagguguggcuuuguuuggacagggucuuaugcagcacagacuggccucaacuuguuguauaccuugaugaccuugaacuucuacucaucuugcuucucccucccaagugaugggaucacagccugcaccaucaccaugcucaguucauacaaaagacccaggacuuuuguacaucugagccaaguacuuugccaacaggccuacaccuucaucccucuccccucuauaaaaugcauguuaguguuuagugagccauggaugaugucauucauuugagacaguguuuugcuguaugaguucuugugaguuuauauaguccaugauggcagggaagcacggugucagaagcaugauggagagguggucauguuguguuugcaggcaagaggcagagagaacuaaaugcuccugcuuauuuugugcuuucucuuuauggguuguaguaucacaguuccuggaauggugcuauccacaauuaguguagcucuaccuuaauuaaucuagacaauuccuuauggguuggaaugcagcgugucucuuaggugauucuaaaucccgucaaagugacuuuauuaaccaucacagugugcauccugggcugcccuugaacaugugcuucuccugccucagccuccuaaguuuuggauuacaguuguggaccacauacuagauuuugcucucuguuuuauaguuacacccuauaaguauuuaguugccuauauagguauagaauaaaacuuaccuuuugaauucuucuaucuauggagauuauagugaguaaggaaagcaaagaucuuuccugauuuaugagucgcagccuuuuagaaccuugucaguugccuagggagccaucguagucaaaaaacaaaacgaacaaaaaaaaaaaccacuugguagagcccaagcuuauauaguaagguccacucgcaggcaaauaagggguagagauuauuauguugagacuuaguggauaccaguaucuucuaagcacugguacauuuuccuuguagaaaguuuuuaaagggacugagaauguaacucaugugcugugcacagggcccuggauuuaaccuguagcacagacuggucauggugguacacuccuuuaaucccggggacucaaaaggcagaggcaggcggauccaggguuauuguuggcuacacagugaacucaaggccaaccuggacuacaugagacugucugaaccguguacuggcauaauggaacacaggcuuacucuugcaucacccauguuuucugaaugccccgaaggaggacaguggucucugugggaugaggcgauuaugguauaaugaucucuuugcaagaagagguuaaaguccauauuaguaaguaauaagccuugggcuuguguuuugaauuauuguuuggaacaaaagauagauuucuuuauucuaaaauguugcuaagauugguuucugcccaguguguaaggucuuuagaguccugaauauagaugauagaaccaguaagagcaguggaaauagacacuaaauuugugauagaauaugugaauucggucauuacuauuugucugguuccauauaauuuuaaccucaaauaaauucauauaauuuuuguuucacaaaggucauagaguguauaaaaaguauuacaaauuuuuugauuuuguuuuuggaagacaagaucucauguguccuaggcuaaccucuaauuuuaacgguauagccaaggauaguucugaccauucugauccuucuggccucgccuccugggaacuaggcuuauagguguggccaccacauccaguccaugguugcuggggauugagcucagcaauucaugccugcuguguaagcacucggccaacugagagcugcacccucugccccacgcugucuucugccuuuuagaaauguguacucauagaaguuuauugagcuacaucccuaguuagcuucauguaucccaugccaagcguaaaugaugugccauaccccagauggacuuuagauaauugcauuguggauccuacuuucaaaaaugcuucccaugggggcugaagagguggaucaguggauaagagcacuugcugcucuugcagacuaccugaguuuggaucucagaacccauacaguggcuuacaaccaacuguauguccaauuccagggaaccugaugcccucuucuggcuuccucugucauuagacuuauacacaaugugcaugcucacauguaggcaaaugcucauccaaaacagaucuuaaaaaagauccuucucauaaauuuauuguccucuuacaaaauagaagugcauaauugagaaauucacguuagcuucaguaauaauaauuuguguuauguuuugccauuaaauauugucuuugucagcuuagugaauuauuccccuuaaugaaauugaggggaaaaaaagggaaaaggaaauuuuccugauaagaaccauaucacuuuucuugucccugugacugaacaccuaacaguaagcaaaggcaggaaggauugaguucgguucacagugugaggguacagucauugcauccuggcuggaagcaugguguggcucauggcauugaggugguguggcagggacuccucacaugguggaacagagggcaagauuauaaugagaccaggccuagaaccgauggggacguuuuuaugucuaccauuauauaaauaacuuuucaguucugaaacaguuucuaugaagguuggauggccuggaacuccuggaguuuacuccuaggcuugguugaccaccugccucugcuucccaacugcugggauaagguuugcaucaccaugccuugcagagaacuagcaauuuucugugaaguacuuauuacucuuuguuacauagucagaggaccuauuuucucaagucaggacauuuuugauuauagcacuauuaguuauaucagaauccgcaggauuguacauucaugaaguaauucauuuugcuuuuuauguuugagacagcuucucacuauauaagccaggucagcuucucgaguguuccggguuacagauaugcaucuccaugccuggccuaccauggcuuuuuaaaacccgaggagauaagcacuugaauaaauauaaauuaaaaaucaucuuccugucaguuuaggauuaaauuuuaaaaagaaaagaaaaaagcaaaggaaacaauguuaaaaaaauuuaagguacaaaaaagauuagacaaacuguaaauguuuuuagauuugauuuuguuuuuuuuuuuuuaagauuuauuucauguaugugaguaugugguuauugucuucaggcacaccagaagagggcauuggauuccuauuacagaugguuuugagcuaccaugugguugcuggaaauugaacuugggaccuuuggaagagcagcuaguguucuuaaccacugagccaucucuucaguccccauucuuuagauuuuuaaaaagauguuuuguuaacuauauaaguaauuauacgggaaagagaauucauugguccaaccguuuucuuuuuagugucuucagaagccuaaccugaccuccgacacaaaggacaaggaguacaaaccccaugauauuccccagaggcagucugugcagcccgcagaaaccuguccuccggcccgccgagcaaagcgcaugagagcagaggugaguauuuuauuggauccugaauguaagugcuggaagcaugguggcucauggcagugagcugcuguggcuaggacucuucacaugguggaccagggaguagagggcaagauuauaaugaugagaccaggccuagagcucauaugguucaccccugauguggaggccccaacuacuaaaggcuaauuuauacuaauacuaauuuauaauaauaaauuuuuauuauuauguauuuugcuugaaugucugugugcaaggaaaauguaccagugcuuagaauauacugguauauaguaauucuaaacauaauaaucccucccuuuauuugcuuaagagugguccuuaaaaagccugggcuuuacaaaaacuucuaguguucuaccaagugguuuuuuguuuguuuguucauuuuguuuuuugacuacacuggcucccuaggcaacugacaauaguuuugagccuugguacucucauaagggaauaugccacacugcucuguguuuaugguggugucuguaaaggggaaggaauggaagagcgccuucuggguugccugaaagaugcuuaguuuacagucaaaaccagaaaaaguauugucauucucgggcuccuauuuaagggcggacagggucuuggucccuaaguguggagucaggaauguauauaccgugaguguugacaggcuaucaaucgggaauguauagaccgugaguguugacaggcuaucaagaugccuugcuuuaggauuuuucuguauucagaaagaagagucuucuucauacucuguucccuucgagaggcauaaagacuugauaggauguaaguuuuagggaacagcuuaaugccaaggagccucagggcagaaucaggcuucagagucaauccuugacuauuuaaugaucuuugacaaauuuuuuuacauuauguagaauuuagagauuccauauuucucaagaaaagaaaguaaccauauaggaaauuaugauuauuuaaaguacauguuuaaaacucauuaauuuaaaaccugauacuuauuuuuuugagcauauuguuuugacuuuugugacaggguuacacuguauagcccaagcuagccuugaauuuccuaugauccucuuuccucagccuuccaguugcuaggaauacaggugugucccacaguguaugacuuauucuggaccuuuauagauguaagguguucccuagugcuguggaggccugaggucugcauugaugauaccaaauguaaugcuaaugcccacagaaaaaauacauuuggcugugaacacacggguaaauucauaaauaguccuacuaacauuucaguguuauagaucacaaagugguuuuguuuaucaguaaauaucauucucaggagcaagaggacugagccugacucagugagaauuaagguguucuacagcuuugugauguuagauauagaacuuacucuugagauuuaaaauuuuuauuuuuaugucuuuugcuugaaugucuguaugccauaugaguauacaguccccauggaggccaaagagagugucagauucccugggauugcaguuaaagagaguuguuagcaggcaugugguugcugggaaucaaacccagguccucuggaagacagccagugcugcauuucuucagccccagagguauaauaacaguaacgaagcuagagaggugaguguagcagcuacauuaggcagcucacaauccuguguuuccagcuccagagaagcuguggggggcauguagaaaccccuccacacaaacauaaauaaaaaguaaaaucuuuugauuuuauuuguuuaagaaaaaaaaaaaaaggcaaagccugguguggugguacaagccuuuaauucaguacccaggaagcagagugaagcagauuugaguuugaggccagcauggacuacagagcaagguccaagcuagcccaggacacccuguauuuuaaagaaaaaagucauugaagauuguggaagccagauuuacacaaguacugcuagaccuuugaagagcuuggcaaaaguuuagauuucagaauuaacgaaaaugcgauguuuuuauaauuguuuugaguuuaguaauaauuaaagcaaaauuucuagaggaaaauaaaggccuuguuauguccauuuuggguguuaauacgacuuuuaaguugauccagugucugcuuuuuucucucaaaaguuauguuauuagagaauacucuacuaguuuguaauuuuaaaaaugcgaucugcuaagaaaagaauaaagugucuuaugaauuacuaaguaaaaacagaaagaagagaauauucaugucuaugacaauauauuuuuaggcuaugaauauuaaaauugagccagaagaggcaacagaagccaggacucauaaucugagacgccgaauggguugcacaacuccaaaaugggaaaaugguaagagauuuuuacauuaaugagaaaaaguaaaugaugauagcaauuguuauuucuuggucacuugguaggguuugagaaauaaaauacauccgucuuuauucucgcaauuaacaggugguaggacaaaacuggaaaaugcauauuuggaauguaggagaauuucucgguuucaucuggcgucugcuuugaaauuuaguucaguaaaucacuuaaaaggugauucaaaaaguauauagguuccuuuuuauuucaaagcaggcagaaacugauaacaguugauaaugcuugaguguauugugguugucccuguuuuccucccuccauucucucuuccuuucuuccuguguauucuuguugucuucuacguguugacaguaugggcaugugccagcaugccuggccagaggucaguuugcaguugaccuggaguaaguacuauauaccaugagcacagggcaucugcuaggccuucauguguuagugcgagggcaacaugguguaguggggagugaaccuuugagucucaguccuggcucaaccacuaacgaguuguaagacuacagagaagauucuaaccuucuuugaggaucauguuccucgagguaguuuuguuaugaacgagucacaugaaccagagcaucaucuuagauaauggagagaugguguauaaugugguagagauacagcuggugaguugguggcaucccuguccuuagcaagagaaacauacaugucuuguucuuuuucauuuuuucuuugagauacaguuucaguauguagcucugacuguucuggaccucacaggccacacacacacacacacacacacacacacacacacacacacacacacacacacaguguugggauuaaauguauaugcuccuugggccuggcgcaugccuuauucuuuuuugguuuuucaagacaguguuucucugucuagcucugacuguccuggaacucacuuuguagaccaggcuggccucgaacucagaaauccuccugccucugccucccgcgugcugggauuaaaggcgugcgccaccaugcccggcgccuuauucuuuuuuuauuuguuuguuuguuuuuuaaaaaagauuuauuuacuauuauaucuaaguacacuguagcugucuucagauguaccagaagagggagucagaucucuuuauggaugguugugagccaccaugugguugcugggauuugaacucaggaccuguggaaaagcaguugguguucuuaaccacugagccaucucucgagcccuacuuguuuguuuuuuagcaacagugucucucuauguaguccuggcuguccuggaauucacuauguagaccaggcuggcucugccuccggagugcugggauuaaaggcgugugccaccacugcccaacugacauguccucuuaauuaaagaagacuuuuuagcucccguuuugaagacuuaggcuauucauaauagcacucacaugcuaacauuuaauagagguuguuuuuaucagucagcauugaguucuuguaccuaguaacacuagguguuaauaaaaugagaauaaacggggaaugguauuuguguuugguugucaguuagaggggaggaagacaaugagguaaaacaggaaacagagauaagcagagugcauacagaaagaacuaacuuuggauugcuuccugcagagaaagaaaugaaaagcaccaucaagcaagagcccacugagaagaaagacugcgaguuagaaagugagaaggagaagcccaagagccgggccaagaaaacggccacugcggugaguggacacugccugugaucacuccauguccuuauuuaacacccucaaucacucuaaacaggaucucucccuaugccagucccagccuccugaguuguccacccuuccuuccucuuuuucuuccucucguacauacauccuaggcucgaacuucaccauguucagcucugggaaaugagcagaguauuuuuuuuuaaacacgugcucugcaguugagacccuagccuauccucuuccugauagcaccacugguaacaccauuaccgauaagcauaugcuuaugugcauuacuuaguauuaacaaaggaaagauauuuuaagggcuguuuaugucaguuuagaaguaaggaacuaccugcaucuaguaagcaucaucaaugauuuuuuucuuuguagaccaggcuugccucagauuuagagaugcauuugucucuguggcuuuguuuucgcauuugcucuucugugaugaggcuggcauuucaggcuaguagcucuucugcccgaguuugcuacugcugugauuacaggcagcugccacuacaccugccuccagaauauuugcuuaauguaguagugauuuggcuaauaauuuauuauuuaugaggauuaucuuuuuacgauuuauuuauuauguauacaguauucugcauaccagaagagguuacuagauuucauuguagauaguugugagccaccaugugcuugcugggaauugaacucaggaccucuggaagagcagccagcacucuuaaccucugagccauccccucucuccaaccuggaggauuauuauuauuuuuuuuaaguuuauuuuauguauaugaguauacugucaccaucuucaagacacagcagaagagggcaccauaccccacuacagaugguugugagccaccaugugguugcugggaauugcuucuggaagagcaguuggugcucuuaaccaacugagccaucucucugcucugacauuuuuuccuuuauauuauauaugggcuguagagauggauuauuauuagguaaagacacucaaugccaaacuucauggucagacuucaaucucuggaacucugguagaaggugagacuucugauuuggacauuuaagguauauaauuuuucccacuccuguuguuucuggggguuggcgcauguuaaacaccugccuagcuuuacuagcacccggaaagccggguauuggggcugccugccagugcuuagauggucaaggucuaaggucauccuccacuaagcgauuaagaggcuaccugcucacaugaagacccugucagaacaagagaagacaaaaugaaaacagaaacucacaaaaugaaguaacaauucaaacucuucugcucucuguagguggaccuguaugugugccucuuauguggaaguggcaaugacgaggaccgacuccuacugugugacggcugugaugacaguuaccacaccuucugccugguucccccucuccaugacguucccaagggagacuggagguguccuaaguguuuggcucaaguaaguauuaaugacugagagggagaacuacuuugggaagauuuuccuuugccuguggguuuuagauucaucgauaauaaguccaugaacaaaacaaggcuuggaagugaaugggaaaggaaucuuuccaaguuccucaguguauauauguucuucagauacauuuuacuccuuuaaucaccauguuaucaaaugcaauuuuuuaacgcauguucuuuguaggaauuuaugagcacuuaaaaaacuuggaugauuucauaugacauagaaaccguauuaauguuguagugugaauucaugcagauuuuuuuuuccauuucuugcuccaugugugugucugugucugucugugagucuaugguuugaguugcaggaccuuugaaucugucacagugcauguauaugugcguuccucugugacagggucucugauucugaagcugucacauucauauggugacagcuaugcuucagcuaucucccuaucuccccuacccaucaagcgcuaguggcccugccuuugaguuccuugauacaaacucuuaaugcuucuguggcggguacuuuaucuuccuagcucccgacauuuuuuuuuccuauuuuaaacgaauauuagacaauuagacaauuuuagaaauauacuuuuuuacccuacguauuuucaguguaguguauauagugcugauauuaauacaguguagcaaaauuugcuguuuccuauauaaggaagugcucagucauuggaauauuacauuuguguuagaauuagguuauaccacuaagaaagcuuuuauguuuucuguauagcuauaguguaacaugagaagaccacacaaggacagguuauuauggaagucagauagcuuccaugguguuagauaaauauuaauauuuaaauguuuaaguauuuaauaccuguguagagaugaccuccucguuaaauggucugaauaugcaaaccuauuugacuccauuguguuggcgaguuuuauagugcaucuguaaccucuuaguguuuugguuauuccuuucgguagcauuauuuggcuaucauuaaauguuucauucugagagcuauaauauuucaucuacuuacuaauuuuuauuuugguaaguuuaaguugauuuuuauaguuuaaacucuugaacauuaucaauccccuuguuuucaguaaugaagacauuugaucaugaaaauaaaugaagguuaaaaaauuguauuugauaaaauguauuuuauuuguaccacuggaauaaucucauucuucagacauauuugauuuuucuuauguagacugaauuuaaugaaaaagaucuuaaaaaucuuuuuaaaaauugcuuuugugacuguuggcuagauagauuagucauuugaaagugucaccuggaaaacagcuuuucuucuucccaugcaggaauguaauaagccacaagaagcuuuugguuuugaacaagcagcaagggacuauacacuucguacauuuggagaaauggcagaugcauucaaaucugauuacuucaacaugccaguccauguacguagauugauuuagaccuuaaacauuuuuuuguuauauguguguagcgggugcucaggcaacacugaacauguagaaaucaaagacaccguguagaaguugguucuuuucugcuguguggguucuugggauuggacuagagacauuugcccaucuguaacuuacguuuuauuuuauguuacuuuuuugcgaucagacaucauuuauguagccgcagucagccuggaauucacucugugaaccaagccagccuacagggccacuagcacacauggacuaauuacaccuuuuguuuguuugcuuguuuuuuguuuuaaacgagguagcuggugaggaaagaguuaauauggauaguguauagacaguuucucugcaacuccauuacuggauaaagaaaagcuucauuuuaauaacagcaaacaccaauaugaaguccuacaguuccuguaguccagcaguugcaacuuaaagaaagacaguaucacaacacugguggaaagcucgcuguguaucaaguaaugcagcgugugcugugucuugcacccuugcugugucuggugcacucuguugucuaaucuuagacuguaaauuuuacuauaagacuccaugguuacuccuuguuuauuuagaaacauaagcauaucaauauucuaucaaauaagucaaaauuaaaugguuuccagcgugauucuggagauuugagaugugauuuuucucaugugugccauagcagacagcucaugcaugagauuacggacauuagauaggaguuuugaucccuguggaauuccagaaauacauagucuuuuaugucauggacaucagcuuuuacuuaccuaaauauuugcuuuuuaaugccuauuccacuugaaauuuuauuuugacucuucaugcauuuuaguauuuucucauauuugcacaaucagucauguuuaacugucuuaugauauuucuucucggaugucggaaaacaugaaggguccguacucagagcauuuccugaugccugauagcuuuauauuguuggacacgcugaggcaaaggucuuuuuguucauacucugcaauuuguuuuauguuauuacauuuuuuaaaaaguuuauucauuuuuguuuuugaugcaggagucuuuagccugcauauaugaaugugcaacaugugugugcuuggugcccauaaagggucagaggagagcaguggauccccuggaucuggauuacaggcccacguggguccugggaaucgaacccaggaccucugcaggagcaaucauuuaaaaacccccucaaacuguuauuuuacuuucuuuggccucucuuuguaauuguggcuagguucaugaucagugaacaugaauuuuuaacuuuuugcaagacaggguuucucuguguagucuugguugcucuggaacucucucugaagaccaggcuggcuuugaacucaaagauaccccugccucugccucccaagugcuaggaucaaaggcgagcaucaccacugcucagcuaauuacaguucuuaacuuuaaaauuuauuauagaaaauggaguuguugccuggauagaguuauucaccugugggaaauuaugaacagauuuuuuugcuuagaaguuuauucugugauuuccaucucuuaacuaguuaaacaguuugugaaugaaaaaauuccucuuuuaauuuccuuguacuugcagaugguucccacagagcugguggagaaggaguuuuggcggcucguaagcacuauugaagaagacgucacgguggaguauggagcugauauugcuucaaaagaguuuggcaguggcuuuccuguucgagaugggaaaaucaagauuucuccugaggaagagguaggcuccagcuuucaggacuugugugagguggagcucugugucgaaagcacagccuuggacucgugacauccucacuaagaacagcagccuugaggauuguuagugaaauucuguuuggcuagcuugaaguuuguuguuguuguuguuguuguuguuuuuuuuuuaauuuuugaguacacgguugcugucuucaaacacacuugagggggcauuggaccccauuacagauggcugugaaccaccaugcaguugcugggaauugaacucaggacuucugguagagcagucagugcucuugauugcugagccagcuccccacccccugaaguauuuaauuaaaauuacuuucagcacagccuuaacuacuaaauuuauuuguuuguuuguuuguuuguuucaagacaggguuucucuauguagcccuggcuguccuggaacucacucuauagaccaggcuggccucgaacccagaaauccgccugccucuggcucccgagugcugggauuaaaggugugcgucaccaccgcuuauuuauuuuugaucauuauuauuuuuauuuuuuauuauuuauuuuauuuuuuauuucagguuugggagaauauuugauuuguugaaaaauuugccucaaugccuauauauauguauauauguauuucccuuagaaaauauauugcauuuauauaaguagaacaacaaugguuaaguuucuucuaauucauaccacucauucaccuaaagugggggguaugucaaagauggcuauuuauuucauuuaauuuacaggugugcguuauuuuaaacaaaugacaucacuuguguuuacaaguauaaucuguaugucuucacuggcauggcugauucugauggauauuacuacuuuuaucugacuaggagaguagaacaucuuuauuuuucuuuuauuagauauucuuaauugaauuuauuaacuucaagaaaaauuaaguucucaaaaacccuuaguccgggcuggugagauggcucagcgguuaagagcaccgacugcucuuccgaaguuccugaguucaaaucccagcaaccacaugguggcucacaaccaucuguaacaagaucugacgcccucuucuggugugucugaagacagcuacaguguacuuauauauaauaaaaauaaaauagauaaaucauuaaaaaaaauaaaaacccuuaguccuggucaugcucuuuacugagguggugaggcaaagccacugcugcccuuucagguuucaaguuugaccucuuuuaaaaaagaucagucaaggccuuauuuaauuuucauaauuguaaguguccugcuuuucaugcagcuggcuuccugaacccacacgauucugucugguuuuggacagucauauuuacuuuguauaugucugugguguucauuuuaagccuuacauccauauagagaaguguauacacgugugcagcuugaucaguccucacacacggaacagccacacgcucgcucauacccagcucuagaagaggaaggcuaagcccuucauuuuauuuugaaggaguucuguagacaacuuacauggaauucuagggccuggagaaauggcacagcaguuuuaagagcacuugauucucuuccuuaggaccccagcuguuuccuagaccagacugcucacagcuucugucucuagugcccccuucugaccuccuuauacuuguccacaugaaccacccccaaguaaauacaguaaaaaaaaaaagguacaaaaccauguuucugaacuguuaguaugauauagcuaaaacuuuaucuuuuuuuuuuuuuuuuuuuuuuuucugacucauuuuaggaauaccuggauaguggcuggaauuugaacaacaugccagugauggagcagucuguccuugcucauauuacugcugauauauguggcaugaaacuccccugguuguaugugggcaugugcuuuucuucauucuguuggcacauugaagaccacuggagcuauucaaucaacuaccuacacuggugagaauucuuuauggagucugugaggacuaucuaagcugggcaggaaagaaaacuuuuucuuucagaaauguguucaugacugagaauuucaaguuccauuuguuuuagcuucuguuaccuuagguuuccuaucugauuaggucacuugacuucuacauaguccucugaaaucauacacuauuuugcaaguauaggauguuucuaggaauaguauuuaugaacaaguuacacacacacacacacacacacacacacacacacacacacacacacacaccgcugucuaccagaauucucauuugaugucaugguaaccucuauaucccuuuggggaggagcauggacuugggacuaucaguuuccuuuuguugugcugauuuuuugacaucauaacacuuagaauaccucucaaaucugugcagacauuuauuacuuuauuaucuaaacuuuucaccuaaagccuuuuuuucccuacagcuguaauacccucaccuuauuucuucuacuuucacaugcaaaaguauuuuaaaauuccuaacucacuugaauccuacagaaaauguaccacaagaacgagagcuggcacuuggauggucaacaugauugugcuuccccuggcauuacccagcuguaacaggaagaugauguuuuauauaccucacagagauggcacugauuaauugguuaacaauuuaaaguguuuugaagaauaaggguuguuuagaaauaauugccuuauucguauuugauguaagcuuuuuuuuucaccagaaugggcaaggaaaaagaagauggaaguugcaggccuucuugguugcuguagggagggagcuguaguaacugugcugagucaaaugugauuccuuaucuuuuuagaaacucuaaauucucccauguuuguagaguaggaucugggaggaccucaaucccaucuucgcaguggugggaaaugcacugaguguuccacuccugcuuguccugauacuuguuugauuugaacguuuguuuguaggucagaagaauaugaucuaguuaacuguugcuguguguuaugcuacaaauuaauggauucugaucuuuuucuaggggugagccaaaaaccugguauggaguuccaggcuacgcugcugagcagcuagaaaacgugaugaagaagcucgcuccugagcucuuugugucccagccggaccugcuccaccagcuggugaccaucaugaaccccaacacucugaugacucaugaagugccuguaugucgugcugaccuucuugccgccccacccaccgugcacagcuucccuagcaccccugcuuuucuucuuaaaguuauuugguguuuucccccccauaauauaacuugauaacagaagcagcugcugggugcuuuauagcagucucccagugggccagaugcguagaaacucuaaacuccuacauuacuaaugacuugcucggcagaugaguaacacucacuuuagucuaccggucagugagugggagacuguauagccauggccacuaaugguuucuguucuguaaggguuuuuuuuuuuuuuuuuugguuuaagauuuauuuacuuguuuuauguaaguacacugucacugucuucaucuucacacaccagaacagggcaucagauuucaucaaugaugguucucuccagccccuguaaguuuuguuuauaaguuuaguaaacaaaagauaaaaagugaccugucaaauggaaaugagaauuuacuaugagaauggcuagcuaguuacaguuagagcuaagcucagguuuuaaaaucuuuaauauuacaaauuuauaaagcuuaugaauauaaaaauauaaauuuauaaagugcucuugacugagccauuuuuccaguucuuggugucagucuucuaugccuuuuuccgcucuaaaagaggaaguuuaguagggauguuugugagugcuuaucuaauaagaacaggcccuggauuucauuuccaauacagcauaaagaagugacagugaggguuggagagauggcucagugguuaagagcgcugacugcucuucugaaggucuugaguucaaauuccagcaaccacaugauggcucacaaacauccauaaugagaucugaugcccucuucugggaugucugaagacagcuauaguguaauaauaaauccaucaaaaaaaaaaaagaagugacagugaauugugggaucucgugauuaaccaaaauggaaugcuccccaugacucauucugacgguggugcugggaauugaaccgagagccuuagaauugagauacuagguuuacauuuuguccuggugcugcuucguugccagagcuguuuuacauugcuuacugaguccuccacccccucaaccccccuuccucacucaccuacgguguugugugugugugucugcauuuggcuguuguuccucggggaucauccaucuugauauuucagacagaaucucugaggacuuuauggagggccauuaagaguguauuuguggaccauaaaguaaugacaaaagaacaaaacauucacuaugucuucauuguuaacauuucucuuugauuuuucaaguuugucaauauuggaauaaaauguaggggcuagauuuagggcuuugggaaaucaauggauugauuuuucauuccuggucuggaacuugcuaugaagucuagauuguccuccaacucaagagauccucuugucucugcuucacuuacggcugaaccuugggagauuccugauuguaucuguaaaaaaagauguuucuugccucuuagaugguuucuuauuuuugugguaagagcacugacuucaguucagaggcuauuuaguucuguuagugugguauaccacuccaucuuguggcagaaaccagaugauucuaacaguaauuuuuucccccucaguuuugauauaagguguguguguguguguguguguguguguguguguaguccuguccuauuugucuagagaaaucaucugauaguuuaugucuaaauugccuuugagaauguuacuguaaaaccuuaauugcucauuccugucucuguagguuuaucgaacgaaucagugugcuggggaguuuguaauuacguuuccaagagccuaccacaguggcuucaaccaagguuuuaauuuugccgaggcuguuaacuucugcacuguugauuggguauguguuauguauuugagcuuucucaaaucuuaccauuuuuuuguggaaauagcauaaaaugcuuuaaaaacugucacauauccuugcuacucaucuggauuccaugcaaaaucuuuuccauuuuacagugagauaagacacuggauaacacagugugugacaacucagacaugcacugugugcaugccuaugugcaugcacaugccuuuggccagagaauuauagauagcugugaguagccugacauagguacugagaaguaugcuuugaaucucucuaaaaaucagcacuugcucuuaagugcugagccaccucucucaagauacuucuuuuaaauuguacaaauuguuaaugaaauuuuaggggauagagcagugcuuugccuuuuuuuuuuuuucccccaguguugccauggcuaguccugaguucuuuauuguaaaccacccugcuucagcagguuuugggaaaccuaauuuguagcaagagucuuccugaagugucuuuuaaaauggcuaaagauuuuuuuaaaaaaauauuuauuuauuauauguaaguacucuguagcugucuucagacacaccagaagaaggugucaaucccuuuacagauugguugcugggauuugaacucaggaccuucagcaaagaauagucaaguguccuuaaccguuaagccaucuuuccagcccaaggcugaagcuuauuaaagcuugcaaacuaguaacaaauauuccagccuuaaaacuugguaggguuucagguuagcacuguuguuugaggaauaguacuaacauuaccaguuaaacuccacauuacucgguaacucauuaucaauauaucuuuuuccuaaaccaguuuucaaauaaguuaccuaaugugauagaccuuuagagcacaacaauagacccagggcucugggaaucugagucuaauuuaggguugauaagugauagguguuuugaccuauauuguauuauuugguaauaugauauuguaagucagaagucuuuagaaauuaaaaaagacuaugucauuuucuugugcccuguguacagcugccauugggccgccaguguguggagcauuaucgcuugcugcaccguuauugugucuuuucccacgaugaaaugauaugcaaaauggcuucuaaggcugauguauuagacguugugguagcgucaacuguucagaaggacauggccaucaugaucgaggacgagaaagcuuuaagggaaacuguucggaaauugguaagauuucuggaaguccaauuccaugucauuaacugugauuuucuaagucaaguuguguuuucuacuacuguuuuaagaagcuuuuccacguuguauuuaauggcuacagagcugccgggagcccuccuccggccuggagaggguagugguauagucacagaguaggacucuggugauggcuuuaaagucugagggccccgggcuuucaagcucuuuaacuguacugaaaagcuaaaaacuuucuugcucuuucucaggguaaaaagacugcuggcuaaggugauuaacacuuacagccuaacaaaggauuaagcaguguggccuuuguucuagcucagcaagaacugcugggcucuaacugcugggccugcuaguaggaaguugcuggaagaaauugggacacuuagagaggugguuauagaguuuauacuaaguuguaaaaaguuuccuaugaaaacuaaggggaaagccaaaaagauccuaagcggggacuaaguguggaaaggcaaaaaauucucucucuccuuguccucagcacuuauacaucuuucagaauacaugaucacaugguacaaaguucaucacaaguucacacaaaaagaucaaaucauaaauugaaauagaaguuuacagcagagaauguuuacauucauauccauuaggaguaauuaucuggcuaaacauuuaucaccugucucagaucuacagguucacugaagguuuaaaaccauaacuaauuuauuagugaaguuuuguauaaauaaacccagucaauauuuuaucuuuugucguagcaucuauaauaaauagcuauuucccuuuuuaugaccuuugguuaauuguuuuacaaccucuuggaaugugcucugaguaggagaaagucugguuacuaagagcaauuaacuggugacacuugggagacuggcagaguucucauugcaguuuugacucucagaagaggaacuaauagccgucccucuauagaagagcuuuaaucacagacauaauguuaggaauucuuaaggaucaucauuaagacuuaagucaucuauuugucuauauagcauuaguacaaaacaguaaauuuuuguggaucugcagagaucugcuccaaaggggugugcuacuacuuagugauuguuauauauguuuaauaauaacaggaaaagcauauuaauugcaggaaucuuuccuaaaaugaaucccuuacagccuugcuuaauaagggugcgccuaucacagaucauauaauauccaaagcaggccauuucaggauauucaccugcuaguuauuagcuugucccauuaugacucuugacaaaaagcaauucuaauugacguguaguaauacuuuauuuuauuuauauugaccuuauuuuaucccuuguaucaguuucuguaaaauaucucuucacaugguuugucuguuuuaauuauaaaauuauauuauuucacuagugcugcuuuccgucuguccccucccucuuuccaucccucccuuccucuccucuaauaguguuucauguauccuccugcuucuacuuucuaaguacuagauuacaagcuugccucuuuuaaguuuuguuuauuauguguccuacuuaagacauugugcauaauaaagaagcagagucacaaggauuuucuccaguaucucacacuuuuauaauaugaauggccucgggaucauuuuaaguaacuuuuauuuguauuagacacaagucuaaaguguuguuuuuguuuauuuuugcauauggaugucuaguugccccuucauuaugucuuaaaaacuucucucugaauugccuuaguaccuugguuuaagaccugcaaauuuaacuuguugcuaguacuaaauugcuagugauuacuuuuauaauauucucucucccucucccucccucccaaccucccacccuccuuucucuccugucuccucuguccguucguguguuguguguguguugugugugugugugugugugugucccaguuaagaaugggaugucaaguauaaguuacaacagugguaagcucaguaacaggagugcugggcgcugaucuuguguccuugaugugcacacuuaucauugcuuucgcuccagcccucuaaaaggcuuugacaaaucuuuacguagacaagaauguccuugaauucugaccuuccugcccaguuuuagaauuacagguaugcuagaauucucaguuuuauucaguucugaaauggaaugcagggcuuggaacagcacauaaggcaagcauucuaccaacugagcuauaauccuaacgccuagcuuuguccuuuauuuuaaaaauuauuuuuaugucuuuuaguucguuugcauuuuccuguuaugauuuugauuuaguagguuuuugguuuuguuuuugauucuuuugggucaaccacauauguaaauaaucauuucuuuuuauaugccacuguguauagaggacuggaauguugucuauugggagcucauuauggaccaccagcaggauaucuauuguccccugauauuuuauuguuggagaaagcagugccuaguagauuuuaagugaccugccaaggucuacaucaauaaugguagcuagugauuaucuguagaauaccugccuggcgguguagguuccugcucuagcugaacuucuuuuagcagcugauagcugcuggaggaggucaaguagcuuuucuuaggugcugugccagcgagagguugcccuguccuguccuccacucauggccccacacucuugggcaugugggagugacuaaaaacaaaacaaacaauggacauaaaccuuggaaagguauguugggaggagguuguaguagggguagauguaauuaaaauacacugguagccaggugugguggugcacgccuuuaaucccagcacuugggagucaaagagaggcggauuucugaguucgaggccagccuggucuacagagugaguuccaggacagccagggcuacacagagaaacccugucucgaaaaaccaaaaaagaaaaaaaaaaaaaagauaaaauacauuggugcaaaauucucaauaauaaugguagcuaauuucugcaacuugaaaaacuauucuugaccuguggaauguggaauuuacaaguuaaaauuguguauaaacuauauguuuuccauucucagcaaauucagaguugguauuuggucuucuuuaaccucaacucuuuccagaccacagaaguccuuuucagugaucaugauuaaaaugaaaaaucuguucauuagcauuuuuuacuuugucuugucauuguugauuuaacguguaauugucagaaauuauuaaaauauuaauguaaaaccaaccaaccuuccuucccucccucucucccucucuuccuuuguccccuuccucccucccucccuuucccauuuuuacuuuguuuguaaaguauguguguugguagaaggccuuagaucucugguggcagcgacagguacagguggcugugagcuaaggucaucugcaagagcuguguucauucuucuuaauccuagagucaucuuucaagugccucuauguaugugucuugaagaugcuagggaucaaauccagggcucucucugugcauuguaggcaagugugccaguguuuuuacuuuuccuuugugauagaaagcaugugucuuuagcucuuccucucugugccccaaucuuucuguaagguaaguuugguguaagguugcuaacuucagcaguauucauuuaucaacaauuuuauuaaugcucaaauagaaauaagugguuagacuugaggaccugccucauccaaagaaggauucuccuuggacaaguagaauaaugugcuauuauuauuuuuagauuauuuaguucuuuuuuuuuuucauguaugugaguauacuguuucugucuucagauacgcuagaagagggcaucacauuacagaugguugucagcaaccauauaguugcugagaauugaacucaggaccucuggaagagcaguaagugcucuuaucugcugagccaucucuccagcccgguuauauaguucuaaauaguacauauuuucuugggucuuuuagauuguauuauccuuucaaauccucuaauauagauuuuguuuuagggaguaauugauucugaaagaauggauuuugagcuguugccagaugaugagcggcaguguauaaaaugcaaaacuacaugcuucaugucugccaucuccugcucuuguaaaccuggccuacuuguuugccuacaucaugugaaagaauuguguucuugccccccguauaaguauaaccugcgguaaguaaggaugaguuuuuuuccuuugggaaagcauccaaucauuuauuuugagugugcaugugcauaagugucuuuuugaugcccuggcuugagugcacauguaugcacgugugugaucauauuuaugugugaaugugguuauauauccaaaggcagaaggaagagagagacacugggccuuucuugagcaauugaaacaccaaaguccagucccacugacacacuuucaucaaggauucaccucugauucccucucaagucacaccacuccaugaugauuaagcacucaaauauuugagccuaugggggcccuuccuaauuagaucaccaccacacauagguuuuggggauugaaacucagguucuuguucuuguaaguaaauugcucuaccaauugagccgucuucccagcccacacugagucuuuaguuauuauaggucucugaauguugaggauauaacguccaguuuuuuccacuggcccgucucauugcuguuuguguucuguguccagguauagauacacucuggaugaucucuauccaaugaugaaugcauuaaagcuucgagcagagucuuacaaugaaugggccuuaaaugugaaugaagccuuggaagcaaagaucaauaagaagaaaaguaaguaaugcagaaagugguacucaagcugcaaagucuaguuggauuuuguugcagccaacguuuugaaacagccuaauuuccugcuuaaucuuacauccagguccuuggcagaagguucuagccaagauggaugaggcagauggccucaacaucucagugaagccuggguauauagguuauacaagaugguuuuggggccagcgagguggcucaguauacaugccucucgggcccaaugaucuuggauuagguuccuggaacccaugugacaucugaaccaguucaccucugaccuccauauguacaccauggcucacauuuccccacuuugacgccccacccccuguagugaaaagaaagaaaggaacaaacuaaacuucuuuaaaaaaaaacaaaaacaaauagaaagcagggccgugguggcgcacaccuuuaauccuaccacuugggaggcagaggcaggcagauuucugaguuugaggccagccuggucuacagagugaguuccaggacagcuagggcuauacagagaaacccuaacaaaaaacaaaaaaacaaaaaacaaauugggggggggggcgacccagaaaaccaaaauagagcuggaaaguuggcucagagguuaagaguacuguuugcucuuucagaagaccgggguucaauuccagucauucacgugguggcucauaacuaucuauaacuacagucagucagaggguguauagugcuuccucuguccuccccagccacuacauacauaugguguauagagauauauguaggcaaaacaccauacacauaaaaauaaauaaaucaagccggaugugguagcacgcaccuuuaaacccagcacucaggaggcagaggcagguagucuggccuacagggugaguuacaggacagccagggcuacagaguaacccugucuugaaaaccaaaauaaauagauaaaugaauaaauuuaaaaaucuuaagaauauaauagcaacuuuauguauuuuguuaaaauggauucuuugaaaugcaguauaauacuaaaauguuggugaaauguuggcuuaacauuuccuaguucuaaucaaaauuuagugucccuggcacuuaucauuauuuuuuucucucuucuauauguguguguuuugccugcauguaugugugugcguguguaucugagccuacucuguugugugccugauaaacccugaggucagaacagggcugggcuugaggaugauugugaguugcucugugggugcuguaacugaaccugaguccucuuuaauaacaaguacucuuagcggcuggguuaccuccagccauucucccuccuuuaugguguguguguguguguguguguguguguguguguguguguuuguaugggugcuuagagaggucagaagagagcucugggucccugggucugggguuauaugcuccugagucauuaugcggguccugggauccaagccuggcccuccucgggaacagugagggcuuuuagcugcugagccugcccuccaccauucccuccagacucaguucucugcacucuguacaucagcaggucccucccucccuuuucauggaggggaagggagcaccaccaccaguuucuugucaacuauacagugaaguaaagaccacaaaguggguuaaaccacaguagaucucuauuacuuuucuuucacaaaucagcagauuuucacuuaaaaaaaauucuaaacuuauauccugaagacccaacucuauaaguacccuuugucagacuauuccccauccccccaaucagauaaacauugcuuguguuacauuucuggguaagaauggacagaaagucuucucugcucuguaauagugauuaugagcuugaucacaggaaagaugacuuguucuguuuuaggucuugucagcuuuaaagcuuugauugaagaaucagaaaugaaaaaauucccagacaaugaucuuuugcgucaccuucgacuagucacgcaggaugcagaaaagugugccucuguugcccagcaguugcuuaauggcaaaaggcaaacaagguaucuauuucugacuguaugagaauggacucugaggcaccugaaccuaggaacccauuggcaucuccgaguaaugaaugcacgugucuucauggcuuucuccggcccuugucuuuguagguaucgaucugguggaggaaagucucagaaucagcugacggugaaugaacuuagacaguuugugacucagcuguaugcucugccgugcguccuuagucagacaccguugcuaaagguaaccauauaaagaucuguaggacuucagguauauuuauauacucaauugacaucauuaaguuggucaguuggcucuuuggugguuaauuuguuauuguguguguguguguuucugcagaagccaaaggagagcaucagauauauuaaaucuggaauuaacaaugguugugagccaccuguuauggggggcugggaacugcugcucuguccucuugaagaguggcaagugcuccugaccugagccaauaauucacaaauauuugaauuuuuguuuguggaauagugggugguuauaaggagauucuauuaaaaggaagauaaaguugagauuuuuauugugaaagugaccacugagucuagcauggugaaccacacuuaaaauuucaacauuuagaucccaaggcaggagaacugccauaaguaugaaggcagucugggcuccauaguaaguccggagcuggagagaugguucugagcucuugcuacacaaucaguaugaccagagguugaauuuucugugcauguuccaguuccacuggggcccagagcaggauuauggcuaaggcguguuggcuuccuagcugaaaaaauugugagggccauguggcucagggagggagccugcuuuggagaaauagggaacucuuuuuuuauuuuuuuuuuuaagauuuauuuuauuaauauauguaaguacacuguagcugucuucagacacuccagaagagggagucagaucuuguuguugucuuggaugguugugagccaccaugugguugcugggauuugaacuuuggaccuucggaagagcagucgggugcucuuacccacuaagccaucucaccagcccggagaaauagggaacucuuaaugcccucuucugcucaucacaagcaugaaugccugaaggugcagauacccucugaaugcacaugcacauaaacucacauagacugauacacagaaaaaaaaaaacaaaacuaaaguaagaaaaagugacuaccagccaguucuucucauugguauaaauuuuauguuaugaccuccuauuugggcucucaggugucauuuacguugcuuuguuuacucacauuauuacugacauaacaugguuugguaaagaaaguuacaccucuuuuuccuuuuucuauuuucuuuauuauuccucuuuuuuuucuuuuuuucuucucuuuuuuuuuucuuuuugguuuucugagacaggguuuuucuguguagcugucuggaacuugcucuauaaaccaggcuggccucaaacucagccugccucugccuguugaggccugggauuaaaguugcccaccaccacuacccugcugaacuuguauucugaugguaugacuuugauuguuugccuuugucuucuuuuaggaucucuugaaucguguggaagauuuccaacagcaaagccaaaaacuacugucugaggaaaugccuagcgcugccgagcuacaggaguugcuggaugucagcuuugaauuugauguugagcuuccacagcucacugagaugcgcauucgcuuagagcaggcccgcuggcuggaagagguucagcaggcuugccuggacuccagcucccuuucuuuggaugauaugagacgacucauagacuuagggguggggcuggcuccauauucugcuguggagaaagcuauggcccgccugcaggagcugcuaacagugucagaacacugggacgacaaagccaagagucuccucagagcaagguagacaaacacaaggcagucucuagagcuuuggauaauagaugaaccuuuaaguguaggacagagagaagccacuauuuggcaagugcuuauaaacguuugcuguccuuauagaauacuugugcaaaaagcugaucuguuugggcuugauuugaacaugaguaaugaaaauuacaggguuugugauauacacuuuuaaucccagcacuugggaggcagaggcagguggauugcugugagugugaggucagccuggccacauagugagauccuguuucagaagagagaaaaaucuuaguuauuuuaaugcuuaugaaauaaauuauuaaauggaaaugaucauuguaaagauaagguugaaugagauuuuccuauagucucuaauaauacuaucuuugaaagaagaaaaaguuuacaaaauaaauaaguagauaaauaaaugcaaaauaaauagaaucuagagucaugaaagacaaaucaaaugucugagaguugacgcguucauucugugcaaugauguaauacagaauauuuuaaguagaaauuacuauuuuuccucuugcuugguaggucuggaugcuucauuuguuuuauaccuuuggacagaggugugauaggcgucugugcugggggugaaaaugaagucauuuccuaacccuucuuucucuguggcaaaucuuuauugguucgguaggcaacauaggcaguaaaaagucuagguuacagauacuguuuugcauucuuaagauaguggucauugagcugagagggugugaaauuuuuugccauuguguuuugaguguguuaauguuuuagagaauuuaaauuuucuuaguuuuucugauucuuaacauuuuauuuggcuuaacauagaagaaacuaccaguuaguaacuaguauuaguaagcuacuuuuugcauuagaacuuuauuucauaaaaucaggaacauguagaacuaauuauguuucuagacucugggaauuuaagagauggcucagcuagcugcuaaaagugccccugcucuguuguagggcacaagcuccagagcugccugugcccucucugcaaggcauuucugcaugugcacguacaaugaugaaagccauaccugcuuucaauaacuugaucauuugaaaugagugaacuugauaugcagugauuagugccauuacgguuuuuuuauuguuguggugaauuucuuccuagaaaugaucuuccuagucuuuuggcaucuauaagaaaaaugcaguuuguggcuggagagauggcucuguaguuaggagcacuggcugcuucucuagagaucccaguacccaugugccaguucaccacugucuguaacuccaagggauccaugacaccaggcaggcauguggugcacauacaugugcgugcaggcaaaauacucauacacauaaaguaaaauaaaucuuaaaaauaagagagagaaaaggaaaaugcaguugugaaaugucugugcaguuggaaaugucucuguuuugcuuucacagaccacggcauucuuugaguagccuugcuacagcagucaaagagauggaggagauccccgccuaccugcccaaugguacaguccugaaggauucugugcaaagagccagagacuggguucaggauguggaugcauugcagguagguugaaaaagaaaaacaacauccugagucugucugugcuguuagugugauuuccuccuaccuggacaggccuggguaaggcuuucagaguuugacagcagugagcagaagaauaggcaggcggaagcaggagcaggaggcuguaguccucccaaccuggugucuguggcccuugaugcuaaagguucaguagcucucagucaugugcagucucggccugcaagcuggcuucuuagagcuguugucccucaucucuguguuguuuuuggcugagauguuuggugugugauuguugugugugugguuauuuuucuugaguguguucacuugucauuuaguucauaaauguauuaaagccuuuuuaagauuuguucaucauguguaugacuguugugcccuuaugugugucugugugucauauggaugccugguuccugaggaauucagaagaggguguuggguccccugggacuacacuuacauguggggccugggaaucaagccuggguccucugagccaccuccccaaggacaguuauauaaaucuuucuuugacaauuuccccaacuucuucucccacuccuuagacaccucuaguggguccccucucuuuuauuucuaacccauagaccuauucgugacuuacugaaucagaaugucugggaugagaaccaggaaacuguguauaaguaaaugggcuuuccacaugauucuuauaugugcugauguuuuaagaaacauuggguuuucuagcuuauauuuuaauuuccugaguaauuuguacugacuuguuuuaggaagucacuagugacaagugaauuggaauaaaauauuaucuuuaaaagaaugcaagucaaacucacucuaguacaaauauuucuguugagauaaauuucuuugauacuguucauagaaaccaaugugagagaccuuauagguauaaaaaauuuauagauggauauaaauaaacagauaaaagagauaauugugucacuuuuuuuauccuuuggagccuagcauuaaguguuugcccacccuugcugaauuuaacauguuuuagucauggagucauugaccaugagcuacacugaaguauacuuuuccuauuuuauguagaaguauccuuuucuuaauuuauuaggcaggaggacgugugccaguguuagagacacucauugaacuuguugcaagaggccgaucuaucccaguacaucucaauucuuuaccaagauuggaaauguuaguagcugaaguucaugcauggaaagaaugugcugcuaaaacauucuugccugagaauucuacauauucucuguuagagguaaguuugcaaugagcuugugugcaggaacuuugaucucuaguuugaaugaguuuauagcaagcaaaagugaccucauuggaucuaauugugaguaguuuuuaagcaaccuuugaauguuuucuggcuucauuuaggauauaguugagaacauuuuuuucauuagguuuuguguauguguguaagauaagucucucuguucucagggauucuugaauuguggcagucuucugcccugccucuucaguucagggcuugcaggugugugcaccuccgcagcuggcuguguaacaguuucuauuuaugcucaaauuagacuccaguccuggcuaugauucaccaccuuuguuucauguguauggcuggcuugccugcauguaugucuggguaccauuuguguucagugcccauggaaucuaaaguuugucccuuagaauuggaguuugauagcugugaaccuuaugggugcugggaauuggaaucuggaagacaguugaugcucuuaagcacugagccaucucuagcccuacugcccgcauuuuuaguaaaccugagaugugaccucacugaguuuucauaaaaagcuuaagaguauuuuuauauuuuuuguaagcuguccauuaucauuggaaucaguauauccuuuuaaccgauuucauuaaaucuggaacaaaaggcuauguuuuuggagccugcuuuuccuccugucacuuuuucucuuguuuaaucauuggugugugugugugugugucuguguguguguguuguacaugccugucuaugaguagaguuuuuagaggcagcaugcuucaaagaaaauggacugugagaaacauucauguacugcucaggccuuuaauuugguuaaucugaagucuguuucaccauuggcucuguuuucucuuacauuagguucuuugcccucggugugacauuggccuuuuggggcugaaaaggaaacagagaaaguugaaggagcccuugccgaguggaaagaagagaagcaccaaguuagagagccugagcgaucuggagagggcucugauggagagcaaagagacugcggcagcugugcguacaggguuucuucugcucuaucuugggggaggguaguuccuuacuuuuucaggacuagguaggaauagcagcaugguuagcagacagcauaacuugaaaaaugcuuguguuugccaaaagaauuuuugaaaauugugaaguuuaaggauagaguuggugagguauguuucagugguaaagcccuugccuggcauuaaugagugccugaauucugcaaaauuauaagacacaaaacauccccacaggugcauaaaauuugcaguaacccugguugucuuggaacucacuauguagaccauaauguccuugagcuugccucugccuccuaagugcugggauuaaggugugugucaccaugccuagcucagucugagccuugaauauugagagugcuuauggauuaucuagaaguacuagcuaaggcaaucaaggcugccaggaaggucaaacugcaaaguuaacuuguuaacuugccacaggaaacacaucaaaagcaucuaggagcuggguaggguggcuagcgcucaggaggcagaggcagauggaucugaguugcaggccagcgcuacaggacgagacgcuaucucaaaacaguuaaggaaaaaaaguuaugcugaauaauugaguccuugcccacguuuuguaagcauuguugauucaagauagugcccaagaagguucagcaguaucuggcugacauuuaaugagcagagucuuggugaaaggacccagcugugugaucgcugggcugcugagcuggaucagugggugaaggcccuugccacaauguggagcauaacuaaggauagaguuaagugucacagaucagugggacacauucuggggaauguguuguugguggguuuagucauugucauaccaacucaaacuagucuguaucaaauagucugcauggugguagacaguacagugucaccaggaucucuggauuauacugugcauggugaccgagacaugagugcacagcauguacugaacuugacuguggggcuaacugaaugggcucgucuuugggcagugcaguguuucucuaguagcuaccugacaugacauaaaauugccuugguuuauuuauaaauuuugaaaccuagaaucuguucuuuauaaaaagacagucaaauuuauggaaagucuguuuuuuguuuuuuucccccuuauaguauguuuguaugugucugcuacuugaguacuguucaggcaguuuauuuuaugaagacuucauagaaaguggugguucucuccuugaaauacacaaauaccuaugccggcuuugcaugcguuaucuuucauagacucuagugucuguguguacgcaggcuaugaguaugcuaugguccucauuugcuuuccauugcugagcugagggaggggaccuuguaaaugcauaacauauacauacaugcauaucuauuuauaugaacauuacauucaacaagaauagauguuauuuuaauaucccuuaagucuguuaugguuuacuucuacaccuguucccccuccaaaaacaaacaaacuucuuuauuugugugucuacugaaaaucugaaaagagguaauggagaauuccuucuauccuuaugacucagacaucucaccugaugaaucaagauugaucugcuuugguucuuaaagaauauguuucaucuguucucuccuggugcuuucccuugagacaguuggccaguuaaucuggacagaucccuagugucuagagaaaauguguuuaaaauaucauacagucuuaagacugaaguugauccugucuauguauuuucaggccucuuuauaagguuaagaggcaugugcuaccauguccaguuaauuuaugaagugcuaggaauggacuacagugcuucaugcaugcgagggaagagcucuuuagcuacaucccagcuccaggugguuuucuauuuaaggauuuuuuuaaauuauuuuuauuuuuuuauuuuauuuuuugucagauacuaauuucauagccuauuauugcuguguucaucaccucuaggugcuuuaccagugaaccacaguaagacauagaucagcuacugugcaguggcuucuugagccccacucacccccgacccauuguaguugaggcucgauugaagcucaggcugcacucaguccucuugccuuugccuccugauugccacgcuuucagucuugagcuaccacuccuuuucuagaagagcacagaaucuaagggaauggaucuaguagagaagguccgaagugagcagacauagucuuuucagcgagguaaauauucuaggcaauauaugucuacagguuggacuuuaagagguggugcaacauguuaaguaauugcugaguaaauaguuguauuuacuaugugcagaacagaguguugugucucaucucaguagggucucaccauagaccuuguuggcuugcaucuugcuguccuguucauuuagccauaguagauuguaacuuagccagaggcagagcuugcuuuggacuggaaugcagauagguucuacucuguaaccuaucuaauuagcuuuuuaggaucaugaguugugaaggaagggauaguucugugacagugucuuuguuggccuuuucagauggcaacucuuggggaagcucgccuacgagagauggaagcuuugcagucucucagauuugccaaugaagagaaauugcugucaccuguccaagacuuagagaugaaagucugcuugugucagaagacuccagccacucccaugauucagugugaacucugcagggaugcuuuccauacuaguuguguggcagcacccaguauuucacaaagcucccgaaucuggcuuuguccucacugucggaggucagagaagccuccauuagagaaaauucugccucugcuggccucccuacagcguauacgaguucgucuuccugaaggagaugcacuccgauacaugauugaaagaaccgugaacuggcaacauagagcccagcagcugcuuucuucagggaaucuaaaacuugugcaagaccaaguggguucuggacuguugucuagcagauggccagccucagcaggacaggcaucagcaacagacaaggugagccugcacuuugugggauacuguggucugcauagcucugugguucugucugguguggccauuccugagaccauccccuaccggccccagcauucacgacacuggccucuccuuuuaccuuaccuggguucugaggaaauccgaucaucaggcuuaggcagcacaccaucuugcuagcccugcuuuuccuguuuugagcagaagucucagcuggcccagaaugguuuuugaauuuacuguaugugaucuucagcuacuguccugccucuaugcuggggcuaugggcggcaugugagacuguuuaguucuggggccugaaaguaggacuucaugcaucagacacuugaggaagccaaccgaauugcacccccacacugaggagucugucucagacaugcuauuucuguuguaccucuucugcauauaauucuacuucauuaucuguaaguguaugcaugguuaguuuaugcauauacauuuuugcuugguugaauuuucuuuuuccuuucauguaagucccgggcuggaaagggaaaccgccacaugccuguccuuuaagggagaauaaugugugcagaguucagaugcguuuacacgcuugugugcguaggccucuguggagcugucuacuuugguuuuuugagucgggguuucuucacuaaaauccaaggcugaccgaccagugagcuccaaggaccugcuuguccccuauuccaucgugcugggacuaagaacauaugcuaccauaccgagcuuacuguuuuugucugcuugcuugcuucaguguaggugcuggaaaucaaacucagguguuucaugcuuaugcaugaggaacacauuauaaauugaaaugucuucccuguucacgaucuucuuauggagagguagaaccuucuaccaguuacccugcagguggucagguucccuuggcuccugugugggggcugcaggaagaguggugguaaggagagugcaguuagaauggcaguagucaguucccuccuuuuucuuuagauuuguuauuuauguguaugcauguuugccacaugugugccugguacugacagaggucagaagaggacacuggauccccuggaacugggugcugggaauugaacccaggacucuacuggaagaagugcucuuaacucugagccaaccccuacagccccuuuaauuuuuuaaacaguuccuuugauccugugaguccugguuauugaacucaagucauuaaguuuaacggcaagcaccuuucucucuuuaucugcugagccauuuugauggcccccuaucccaauauauuuucuguaacagauauuuacaaacuggguauagugcuauucaccugcacccuuagcuauucugcagggugaggucacuugagcacaggaguuuagaccaggcugucccugcaucucucuaaacagcuugaggacagauaagucuaguauguuugccuggggucugaccccagcaaagcaucacaaagguggugaaagguucaggauucccaugccuggcugaugacagcuccagaauugggugauucccagggcacagguguagggacuggaaacagccuguccuacuugagcuuuuccucugcuggcaucugaguagcagcaccugaugaaauauugcagaguuccgugcacuucuugaccagggguguucugagagguuaauuugauugauuauaaagggaaaggacaaaguugugacugguuucugagacaggguuucauagaaccauggauguccucaaccuccugauucuccugcuguucccucccaagugcuaggauuacaggggugugccaccauguccagcucaugacgguuacacgccggcugaguaauuugucguaaaguuacacaagcacugaaaggugguaggaucuucucucucuggggucaggcugaguuaacuuggaaaguuggauggcuuuguuuccaugagaguggguuuggcuggguuuuaggugcuagaggagacuuacugaaaaaaagaaaaaaagaaaaaaaaaacccaaagccuccuacuaagguguuugucuuccaucaggugucucagccuccuggcacaacauccuuuucauugcccgaugacugggacaacagaaccucauauuuacacucucccuucucuacuggacagaguugucucccccuccaugguuuguauuuuauuuuguacuauuccuagaugauacaaggccaucuggccuaggguuuuauaauagaugaucuggcauccuaaagagcaaguaugguuuuacauguguguaccaugagcauuguggaggcagaggcgggauuugggcuacaaagcaaggaagacauauuacuguacauuuucuaauguugaucauauuugaagaucuauaaacacaaaggauaccuauucugauuuauuuugacuacauuuaaguuaguccugugccaucuagcaccaagcaccguguauucagggcagaugcuaagucauggacgaccuuguuugcgauucuggaggauauugaaagucauucauauuuuaaaucuaccucuuuccauucccuuauggguggccuuaaauuuaaucuuuagucaaaauuaucucuuuuuuaaacauuuguuuuuuauuuuaauuuuguguguauggguguuuugccuaccuguaugucuguaccauguguauguggugucuguagacugucagaucuccuggggguggaauuacagacaguugugagccaccauguuagugcuaugaauugaacccagguccucuggaagagcagccagugcucuuuaauuucuaagccaucucuccggcccuggaaaaugaucuuaaaguucugguccaugcuccuguugccaagugcugagaugacaggugugagcuaucacaccuggcuuuuuccucugugugcgugcgugugugcaugcgugugugugaugagguuagcuaauguuggucacaaacuccuauguagcugaacuccugauccuccuauuucuaauucugaagugcugggauuaugagucuguaccaccaaucauaauccucaauucuuagaauuuugccuaguuucaacuggaaucuacauccucagccuucuuaccucaggguguucauggucagucucauggucugagcuccuugcuguccuccaugcucuaggagauagugaaaugugucaguugugauggaguggguguuuccccuguaacgcaguagggaaucugcguuagcccugcucugguuuaggggcauuaagaccuaacaaaccgacugcaguuaaaggaggaaugguggaaggcggaguggaggugguuuucugucccugacaggcuuaccagugcuuguauuaaaugucuccguuccuauucugauugucuguggucguuaacagguuugaguccagaagugaaugaauugcugauggaagcccagcugcuccagguaucccuuccugaaauucaggagcuuuaucagacucuacuuacuaagccaagcucuguucagcaagcugaccgaaguucaccaguuagauccagcagugagaaggugagugagucgaagauguauagcuugugcuugccaguguccuucucacuaauuauuuugcaaaggggguggcugugucuuugagccacgagagcacacaaacugucugccucacagcuauguucuacaaaaggacagacacuggcaccacugguagcaauuugggugucacagcuuagauuucagucauggauuuuuacaucuacauuuuucuuuuuucuuuuuaaggaacucuucuuauugcucccaaaugguaauauugagaaguagaccuauuuuccucuauagaagcauugcuauaaagaugaaaauacaauuauagcugaaagggcuuuuuguuaauaaauguuuuaagaaugcuagcgagcagacgcuucucaucucuguaggucagagaucaguguagccagagcugcggcuguggaggcugagcugcuuauccuagaccugacagacacuggaaugucugcugggccccuuucauucauguugcagguuuuguuuuuguuucaagacaggguuucucuguguagcccuggcuguccuggagcucacucuguagaccaggcucgccuugaacucagaaaucugccugccuuugccucccaagugcugggauuaaaggcgugcgccaccacugcucggcucguguguauuuuugugugguauguuuauacuuucacauguguauguacaggugugcgcgcacacacacacacauaugcuugugaugcaguuccugguguuaauguguagaauuguggauugcucuccaccugauucauugagauuagaucucugaauuggacucagagauagcagaugacuaacuuuuuucaggaaucccuuaucucugccuugcaaggcugaaaccacagacgagccaccacagccucagagcauugacauugacauuugggguccucuugcuuuuauggcagaggacacauuaaccgcugagucaccuccccaggcccuguagcauccccucucucagcacuguuaagaagcuucugcucguagggcgugguggcgcacgccuuuaaucccagcacugaggcagaggcaggcggauuucugaguucgaggccagccuggucuacaaagugaguuccaggacagccagggcuauacagagaaacccugucuugaaaaacaaaaaaacaaaacaaaacaaaacaaccaaagcagcagcagcagcagcuucugcucgguugugcucugcgcagagccgucaccaguguccccaagaguguaaucaggaugaaacacaccagggaagacugagucacagggaacaagaucugggugaaagguacccuaaaauugaccacagccaaccuagucgucacuccugugagguugcgauagauagccuucacaaaugcuuacucaccuaaggauuugguaaaauggacggucuguguaugucuuuucucugcuguuacuagcaggccgcauugaaguuugguauccccagcucgccaacagugcugagcgaagggaguuaagcuggcuguggagacugaagcuguggagaugguagcagcgguuaggaugcaggguucucauuugcacguuuuucuuuaguucaguuuugguaaugggcaaauuucuuuaguucaguuuugguaacgggcaaacugagagcuaacacugaauuugccaucucccacacagaacgauugccuucgagggaaacgagaugcaaucaacaguccugagaggaaacugaaaaggcgcccagaaagagaaggccuuccuagcgagcggugggaucgaguuaaacacaugcggaccccccaaaagaagaaaaucaaacugagucaccccaaggacauggacaguuucaaguuagaaagagagcguagcuaugacuuagugcguaaugcugaaacucauucccugcccucagacacauccuacuccgaacaggaggacucugaggaugaagaugccaucuguccagcugugagcugccugcagccagaaggagaugaggucagugagguuugggccauagaggacgcgcuuuccccuaacucagaaacccuguaagcuagaccucgucuccuugggucuuucucuucugcuugucugcuuugagcugaucugaguggauugcucaguucuccccuccugauaaucucugcuuuuaacaucguccugggucuccuccuuuucuugaagaaacucucguucuuccuuuuauccuucucucgcuccuccagcuuucaccgucccggcgcucagaaggugggagggaugcugauggagugagugcccuuuugcuuacugucacagggcagcacugucuaccccaaagcaggcacaaccugaagagugacucugccucccagcuacacuccugugguuagcuguugugccagaggccccagugcggggacaguggcaaacggccugcccgauuuugaauggcauuguuuccucugaaccccccaucucccugcucuuuguaaccagguggacuggguccagugugauggcagcugcaaucagugguuucaccaggucuguguuggugucucuccagagauggcagagaaggaagacuacaucugugugcgcuguacugggaaggacgcaccaagccgaaaguaaaaacaaaacacacacucacuucauguaauucaggacuccaauaaagaagauuuccucaaucucagcaaagcuacaggacuggggucgagccagccuguacacggugcuauuucuauuccuuaugggaucauuuuuccagaacucuuugaaaaaaagaaaaaacaacuaaaaaaauuuugacacuuuuuuguaauuuuuuuccuuaaaagcuguuugugguuguugaaguuuaaaaugcugacuguuuuuugcaggggucucuacugauuacgaagguauuggaguuugcaccuuuuuguguacagcaaaacauuguacuucugccugggauaugccggcuuaagaguccaacucaguuucagagcccagcaggggcaccagaauuccaguaacccucacagagcagccgcgcuccuuugucugucaccacauuggggggauuuuaaguuuuuacuuugggguuuuuguuccuuucuuucuccccuuuuccuuucugguaggcuagguuuauuuaucucagcaauaacuucuauguugguuucaguggcuggaauuaaaacaaaacaaacuucuaaacaguguguuggugcuuuagcauuuggcucauguacagaaagcaaaugucuaguuucuggugucacugcacuagugauuuaggaagagacugcgcuguaaguaaucgcccgccacggcuguauuuuggcuuucucccuacucagucccccacccccacccuuuuuuuuuuuuuuuuuuuuugguagaauguaucaaauguugcaguuuauauuguggaauaauaaauccuugguccuauucuaacacuagacuacagcuucuucugcccuuccaccucgugggccugcagaaccagaaggguugcuugcuucugcuucuucccaggcaggcagccgcagaaguguguuugcucuaggagacucuguagccuuauucucugggugggccugugccuucaugccccacuaauaaagaaucccugucuuuaaagaccagagccaguccuuuaagccauguucuuuuucaguaagcccucagaauauuggagugguccccaaaucacuccagacuguaagacagcucuccuauggaaugcuuuuauugucauugaauugacagggaaguuugguugagaugugguccaucaucuuagaggcucagaucuguuguaucaguugagggggaccuugggccugccugggauuucucugccaucuauguaauuucaucagucucucugguuguggacagccgauaccaguuuccccugaucugcagagaggaagacuuccagugagcagaacaggcucuugcucacuuuucuccuaaguuguugcaagcucuuguuuuccucacugucuguagccauaagccugauggugggcagaguuagcagaccuuuaauaaaacaucaaaaagcaguuugugaaauagcgaaaauuuaaauguacuguccccuaugcaauccagguaauuaaaucuguuuaagaauaacccaguggucugcaguguccugcagugcugugaugucucuucuugucuggggaugaaaguaagcuuugaagagggcauuacugagccuggggugcaccuuagugggagagcacaagcaagacucugcuuccuaugcguggcacuguccaaggaaguaaauaugugucaaagaagaugggaugcugcugaaacccagucugauggcugagaacuuucacccauugagaugagcccucuguguaggccuggcuguccuggaacucacucugcagaccaggcuggccucucacuuagagauccaccugccucugccuccugagugcugagauuaaagccauguuccaccaccaccaccgaguucccucugggucuuaaugguuguuuugcuuauucauuugaauuuuaaugggguccaaucuagcucuguagccaagagugaccuugaacuucugaauucguucugaauucuucugacgauguuuuuaauucuguagcuaaaacgugugcaucacugugcccaauuucuguggugucagggaucaaaugugagggccuugugcaugccaggcaagcacucugccaaguggacuauauaugcgcccucaccagcuuuucuuuguguaagccuuguguaucauguguaucugauauuagcagauuugcugauaugauaggagauagaaccauccccuucccaagugggaaucaugguuuguuuguauguguugauaccaagucugaaaugucagcuguguaaaaugaaaugaacccugggauugcuucagcuuugccagugcauccuacccugugcaguaccaacacugcacacacugaagacauccaguuucaacucaggccacccgugugccugacagaagcuaagguuuuauaaaaagaacacauuuuacuauguuagcuuugaagcuugcugauaccuuagaguagugguucuuaaugaguuggucacaaccccuuuggcaaaccagucuccaaaaauacaauacaaaaauacaaacagaagcaagguuacaguuaugaaguagcaguggaauaaauaacuuuauggucaggaaucaccgcaaccugaggaacuguguuaaagagucacagcguuaggaaggcugagaaccacugccauggaggaaugcuggauaaauggagaaagaagguaaaguaaaauagccacugaguuucuaccuuaagaggcccugcaggagagaggacuggaguuagcaccugagucaggaagacgauggcagauugggcagauagacuagagaagucuacuagcuagaccagagagagugaaguuccaguuuuaauggcggacaaaacuacaaaccuucauucugucacugagcauggaaucccggauuuugccucaguugaagguccacuuggauuaaguagcaugagccuauauaaaaaucaaaacacggaaagagagggguuaauagcuucugguuugguagaaugacuaagauacauccaggcugcccaccgcugaaagugggguuguaaucccagcaccuaggaugcugggucaagaggacuguggggccgcagccauccugggggacaaagugcaaacaguguuggugggugauuagugugugauuagcugaauaaacaguauucauuucuguggccgugguagaaacugggccucucagcagggccguaccauaaguaaaagucccguggacucuauuaucucccacccuaaccaggcuucugcaacaagcaccuuuccccacgagccauugccagcccugaggccuugugcaauggauauuuggcagacuuagaagaccugcuugugucuugggauggacauggagaaguuuuuggugcccauggauguuuuacugggcccaguccugccuaggguuguucauguaauuugacucuuaauagauuccuauauacaugaaacaggagguguauuggacagcagguauuuuaaaugggcacaaagcaugaagccagagcugagcaguaguagcugacauaagcuagucagcauauauuaaaauguucuguugagcugggaugaaacucgggaaaaccacuugccaaggaccagagagaggccuuagguuugguuuccagaaacaucagaagaaaagguuuccuucugccacaaugcugcagaaauagaaucuggaauauugcuuguugaagaguuucggaagagagcauugaagaccccaucgucagcauguuaugggcuggcugcauuuggagccauccuuccucaacgugacugaaacaccggaguuuauggcuucuccccguuugggccuucuguccucaguccuuugccuguggcccaaguuucucaacuucgagagauuucauguguaacuuguaaagaaaaugcugcuuaaaacauucuaagca

SEQ ID NO: 384 - RNA, 11619 nt, Mus musculus
caacggucuccgcgguuccgcgugagcacagcagaggcgcgccgcgguaaguggggcugcugacgggugcugcgagugccaccugagggaacgagcccgaggucacggagagucuggggaaggagucccguuucuacccgagcggcccugggaggaacacggcggggagagcgaaccgcccugggcgcgccaaggcuaccuccagcaucugccaccuacccagguucugugcauugauuauuuauuuaccucaggccugggacacaaagaauuuuacgaagagucagugcaguuguaaaaagcuuacguuugcggggagugguuacuggaaaagaggcuaacaacgccgguuuaaaaaaaauuaaaaggaaaauaucuuuugaagccguaguguaaggaacucuguuaugguuguuugguugaggguuucguuuuguuugugagacaggugucgcuguagcccaggcugaccuggaacugacuucuaccuaggcgccuccagugucuaugcccccaagccccggcucugugaaaacccuuuauauucauaaaauacaugauaacacauggcuuuuauaccaaaggacuuuuuaauuuuuuauuuacuuuucuuguauaugaguguuugucugcauguauguauacacaccacggguaugccuggugcccucggaggcacaggacgguguuaguuaugagaugucagauggauguugggaauugaaucuggguccucuggaagagcugccagugcucuuaacagcuaagccaucucucacccgagaagacuuuguauauaccaauuguuaucauagucucauggcuucuuugagagaaacugccuuuuucccccucguucuaauuugauuagcaugccuuuccacuauguucuuauuuuauauaaagauacaguuuacaguuguagguaguuuuauuguaauugauugcccaaagacaacuuugaggagagcguucucuccuacuguggauugcugggauugaaucaaguugucaggccugugcagcaagggcuuuaacccgcugaacuguuuuucuaguccccuguauuuacaagaguuuuguuucguuuuacugaaaauaguccuucagauuucuguauaaaauagcaaugcuuuggcugaacaagucauggggagaaagucaguaagcagcagcccucuguggccucugcaucagcuccugccuccagguuccuguccuguuuaaguuccuggccugccuucuuccuucagcaguauacugugauguagaaguguaagccaaauacugcccccccacccaacacacacaaugcuucccucaccccacccccaauaacaaggcuucauuaggcuuaaaacgauagaggcugagcacauggcuuaaaucccagcagaggcgagcaaaucuuuaaguuugaggucagccuggucuacaaauugaguuccaggacaacuagggcuacaaaaagaaacccuaucuuagagagacagagagaguuaagaaucaaaacacuguaaauuaaguuauuaaguuauuuugagauuuuucucugguauggaaggggagucaaaggacccguuaauuuuauuuuuauguuguauuaugaauguuuugcauacaugcauguaugugcaccacauacaugguuaugagacaccauaugaguguuggggaucaaacccagguccucugcaaaaacagcaaaugcucuuaaucaguggcccugcuccagcacccucuuauuuuuauuuuauuuuuauuuuucugacaggaucuuauauguaccccuggcuggucuagaauuugccuuguagaccaggcugguauagaauuuucaguaguccuccccuuuauuugggggggggguaaugggguguagcugaggagauauuuuguuuugcauuuaauaauuagauuuuuguauauauaaucaauacauuuuuuuauuucauuauuauuauguguaugugucacaguacagcaaaugugggaaggucaaaggacaaguuaacaagaguuauuugucuucucucuccccuaaccaagugcugggauuauacucaugcaccuucucacaccacuuuuuuauuuuaauuuauuuauuuauuauagcucucucuggccucacucucuccaaagauugauugauuauauugauuauauguaaguacacuguagcugucuucagaggcaccacaagagagcaucagaucucauuauggaugguugugagccaccaugugguugcugggauuugaacucaggaccuucagaagagcagucagugcucuuaacuucugagccaucucucagccccccucacaccacuuuuuaugugguuucugaauuaaacucaggucugcaaaauauauaucaagcauuuuaacaacuggauugucucccuuuuuaagcacacauaggacauucugagcaagacucaacaguuuuaaaggauauaaauaauaugucagaaaccaauaacacagucagaaaccaauaaacaggacugggcgugauggacuuuuaguauacaggguugggggguuguugucgcugaggcagaagaauaugggaccggauuuggguuuuuuuuuuuuuguuuuuuggguuuuuuuuuuuuugacaggguuuccucaguguaucccuggcugcccuggaauucacucuguagaccaggcugaccucaaacucagaaauucgccuggcucugccucccaagugcugggauuaaaggugugcaccaccaugccuggccaagcccaacucuuauaaaaggaaaacauuucauuggggcugguuuacaguuucagagguucaguccauuauccugauggcaucaucaugcaggcagacuuagugcuggaagagccgagaauucuacaucuugauccgaaggcagcagugggagagucuucugcagguagccaagaggagacuggaauuccacacuagguggagcuuaagcauuggagaccucaaaacccacucccacagugacacacuuccuucaacaaagccacaccaccuaauagugccauuuccugagagccaagcauucaaacacaagagccuguggaggccaaagcuauucauaccacuacagggugagaugguuaauauugucaacugaaguauaggcuauagaaucaucuaggagacagacuucugggccugucuguaaaggacauaccuagauugacuuaguuaaggugggaagaguaaccauaaauauaggugggaucaaacagacaguggucccagacugaguaaaaagaaaaacguggcugccugacugaagcaggugcagggugaccagcugccuccuaguccugcagucuugccagcuccacuacccuggacuguauccccggacuaugagccaaaauagacacuaccuuuucuugagucuccugugucauggauuuuguuauagcaaggagaaaacugacuaauacagaggaacaccacccuguggcccaggcugaccucagacuuagaguaauccuccuccuucaguuugcuuuaaguacacaaguucucauacacuacuggccucaaacuauauagucauggauggcaguguguugcugaucuuccugccucagccuuccaauugaugagauuauuguuguguccugcccaugcccagcauaauaugugcaauaucaccuagugacugguuugcucugcagcccucuccuaccccucacauacaucuaguagugcagggucuugcucauacuaggcaaauguucuuccgcuaaguuauauccccagccccugaacugaagacaauuuacauuaaaaaugaaauaagcuaagguaacuggaacauuaggguuugauucagaauauccaagcugaugaauggaacaaaucuggaagacucaacagauccacauguuugaaaguuaauuuaugauaauauuagaagauuuggaguuuccuuuuuuuucuucuuuuuuuuaauggugcuaggacaguugguuacucauuuguguguugggggggauuaaaguuggaccuucuaccccuuacuacgcacaaaaaacaguuacugauagccaaaauauuuaaguaaaaagaacaaaauuuuguuuuuuaguuauuuuuauuuuauguguuuggccugcauguaugucuauguaccacaugcaugccuggcaccugagguuuuaugggugguugugagcugccacaugggugcugggaaucaaacccagguccucuggaagagcaaccagugguuauaaccacuggaccaucucuccagcccaaaaguuauguuuuuuuuuuaauguaaagaauauguaggaaaacaacuuuaaaugugagaguaugggaaagauuuuaaauggauuaacauuaagaauauauucauuagcuggacuugacccagacuucuaaucccaacuacuuuguaggcugagguaggaaaaucacaaguuucugggcuuacuagagugaguucaaggucagccugggcaaaagcugagguaaaacuuaugaacgaggcucucagccagcacugcaaaacgaaaggaagauguguucaucuaaacuguagcaaaguaagcuauaaugugugaugcuauaucuguaauguacaucaaaauaggauucuauagacggcugcugguugaguggauauguuuguagguguuacuuaggugagagagacuucauagaaagauuagaauacuagagcaagaugggcugauugacagggugagcucccugaagaauuaggagaaugcagaguccauaauauauggaaagaaugccagucacuuaaacccuagcuuacaaguaucuccaaauguuggcugcucucuucuugcucucacaaagcauauaggcugcacacagcuccugucuucccaguccuucccugcccaggcacacuuggauauauuugugagcacaauuggacccagacucucuucuuauaacuugauaauuuauuaauggaaacagacauucauuuuaaacuuuuacaguuauuauuuguaugaguagaccaaaaguucaugcagaaauggaaaagucaggcucccuuugucacagagaguaauaagaaucuguucuucauuaaauugaagcugugcuaaaaacgcuagucagcauggcuauuucaugguugcuucuuuucuuuuccaguacacccccgccagaccucaguguggaacagugaacuguuucugguuccuuucacuugagaucaugcagagagccucacgccugaagaaggaacugcacaugcuagccaucgaaccucccccgggcaucacgugcuggcaggaaaaggaucaaguggcugauuugcgagcucguagguagcccuaucgaaaacuguccuaauuucacacggugauagauauuaaaguagugcguaguaaggugaaagggcccugcccucucuuccuuaguuggguugcuuggcguuuccuaauugacuucuuauaucuuguacugguuuguuugucuuuuuuuuuuuuuuuuaauguauuuauuaucuaccccugcaugccagaagagggcaucagaucccaucacagaugguugugagccaccaugugguugcugggauuugaacucaugaccuccagaagaccaguuagugcucuuaaccgcugagccuuuguacugggcuccagcccuuguacuggguuguaauuaagguugacagcugaguguugguagcacaugucuacaaucccgggauucuggaggcugaggcaagagaaagaggauuacuucaaguuugaaaccagcuagauuacagagcgagaucuuaucucaauaaagauuuuguuagggggugggcaugggaguaagaugucuugugaguagggacacuugucaccaagccuaacucguuuaaucuccaguauccacaugguaaaaggcgcaaaccagcuccuauagguuuuccucugaccgccacauacaugccauagcauguguguacacauucacacacacacaauaauuauaauuuuaaaaagaaaaaaaaagacagauuuagguaguagcagugcagcaguuuuugaggccaggugggcagacaagaaacacugcauggagacacaguuaaagccuuaacagaauugcugacuuacacccacuuccuuuuuuccccuuucguuuguuuguuuagauuugauucauguguguguaugaauacaugcacacauguacaggugccuaaaagagccagaagagggcaucagauccucucgaguuagagaucuaagcaguaguuguaagcuaccugguaugggugucaagauugaaacucugguccuuuggaagaacacugagcacugagcaccucucuagcccuuauaccuagaacuacagaccuuauuagguucauuugauacaguuucuguuguuguuugccuuuugagaaagggucucauguagccuagguuggccucaaacuuugaauauaacuaggaugaccuugacauuauaauucuccugucuccgccuuuggaguauuaggauuucaaccuaugccaccauguucauauacuguuuccugcugaacuugggguuuauauaugcuagguccaugcuuuacugaguugcauccucaacccuuuguauggugauuaaaucaucugguucucuuaacuuuucuuccuuccuuccuuucuuuuuucaagaaauacuagguggagcuaauacaccuuaugagaaagguguuuucacacuggaaguuaucauuccugagaggugaguaugaauuagagucagcuuauaauguaaggcacagccauugaaagacagacaguauacuauuuagagcauuaaauauagcaguuaagagccaguguuuugauacuaguuuuaccauaacuaggaaugugguaaguuguuuuugucucuuuggaguucaguuuucuucucuaaaauaauagaccacauuagaaccgagccccaccccucccccaaaaaugugguaaauauauuuuucauauaauauaaaauugacccuuauagccauuugaggcguaaauuucacauuauugugcuuuuuguauguuugauugguuuugguuuugguuuuggauuuuagagucaggauuucucuguguagcuuuggcuguccuagaacuuauucuguagaccaggcuggccucuaauccagagauccgccugccucugccucccaagugcugggauuaaaagugaugccaccaccaucuagcauguugugcaacuauuaauauuuuaucuccagaacuuuuucauccucccaaacuguaacuucauacccauuaaaaauccacccccucccaguguucccugauaccuacccuugguucucuccaccuuagugugaggccccuucagucaagugucucguaaggcuccagucagaugaguuguagcucuaguuuuguguagagugagugucuuaacuauuaaaacuggacauuucuguaccaugguggggccuggacaaacuuguuaaaccugaaugaguagcuuaauaauuaugucacaucaauucugaaaauagacuggagcuuugcaagguuuguuugucacugaagagauaugguaacuaaauccaauguguaagucuaauuggagccuguuugaagaacacagcuguaaaaauauuuggagacaagagcuggaaaaauggcuuaauggcuguacuuacagaggaucugaguucaguucccagcacccacauggcagcuggcaacugccuauaaccccaguuccaggggaucauacacaccuacuucuggccucugagcaccaggcauguuagugauauacaggcacacauauguguagguaaccacacauaaaaguaaauaaauaaaucuaucuuuuguuuuguuuuguuuuguuguuuuuuugagacaggguuucgcuguguagcccuggcuguccuggagcucacuuuguagaccaggcuggccucgaacucagaaauccaccugccucugccucucgagugcuaggauuaaaggcgugugcccccaagccuggcgcaacaagggauucuuuuuaaaaacguuucaaagauauaaugguaucucaguaggacaguguucuuaugcuuuggagauacuuggaaggguuuagaagguggugggggaucuuaguguuuuuaguacuguuauuucaacuuuuuuuuuuguuuuguuuuuuguuuuuuggagacaggguuucccuguguagcccuggcuguccuggaacucacuuuguagaccaggcuggccucgaacucaaaaauccgccugccucugcccccccccaccuccaaggcugggauuaaaggugugcaccaccaugccuggcuauuucaacucuuugauugcuaguaauuuugauuguuggcauguuuggggaagaucugccucccaaaugcugucuuucuaacauuuuucuaauccaucauuauuuuagauagcuacuagugaccaagaaaugacuuaaguuguagaaugagcccccaccccuaacugaggugcugauaaaacugacaacaguugauagcucaugggggaugaagagucuguuuucuuuaaggccucucuuaguuacccaugcucuggugcauggcuccauaacuguaaggcucaguguggugaugcaugccuuuaaucaagaagcagcacgaagauaauuuuuuccucucacacauucacagguacccauuugaaccuccacagguccgauuucuaacuccaaucuaucauccaaacauugauucuaguggaaggauuugucuagauauucucaaauugccaccaaaggugaguaaaguuaaagaauugacucugacaucuguuuucuuagcauugaaaaggggaagcaaaccgggcauggcagucaugacuuuguucccagcacucugggagguggagcucugugaguuccaggacagccagaggaacccugucucaacaaggaaaggaaggaaggaaagaaauuaagugaaacauuaaagaaagggagggagggagggagggagggagggagggagggagggagggagggaggugggggggaagcaggaggauuaggaauuaaaggucguccucauuggcauagcacguucaaggccggccugaguuacauaaaacucugucucaaacaggcaaacaaaaaguccuuagguuacauacaaugucacauucuuuuugauuuuuugagacaguuucaccuagccaaggauggccucaaacuccuggucuuccuaccucuacccuauaagugcugagauuacaggcaugagucaccgugccugacucaacaaugucacauugucacacaaaagcaauuguucauuuguauauagggugcauggagaccaucccucaacauugccacuguauugaccucuauucagcugcucauggcagaacccaauccugaugacccacuaauggcugacauuguacguaucgcuggcaauagccuacuuuaucuguaccuuuaauauuucaggcuggugcucaucauagcaaauuaguuucucuguuuuaacucugacuuuauuucagucuucagaauuuaaauauaacaagauagcuuuucucaagaaagccaagcaguggacagaggcucaugcaagacagaaacaaaagguaugauauuugcuaauauucucaguuugaguauuauaccuauggggaugggagggacucgugagcucucauccuugacugaggcacuaauaaacucuucaguugauagcucugggggauggagagucacuuagguuaacaugcucuguugacuccacacccauaugaguauuauaugggcaguacaauuuggucuugguggauuaguaaaaaaauuaggcccaauauggugauacacaucuuuaaucaucucacucaggaugcagaagaagguagauuucuaaguuggaggccagccugaucuauauaguagacccaucccagucagaaaaaauuuuaaucaaaaauaaaaagaggacuuaauauuggagaaagauaggggguggaucugggaggagguggggaugaaguagggaauaaaugucaucaaaauacauuguaugaaauucucacagaauuaauaaaauauaauauauacacacgcuuauacauauuacaauguauguccuggggcuggagagacagcauaaugguuaggagggcaugcuccucuuuuccugacuaagucagcacccagcauuccugucagaaggcucacaacugccucucacuccagcucuuaggaaccugacacccacuucuggacuccacagguaccuacacuccuguguacauaaacacacacacacauaaacacauaauuaaaaccaaaauauaucuuuuaaaaaaaaaaaauacagaucuguaucccagauuaagcacuuagauaaaaauagaguacaugucuaaauaauauuuauuaaauuuucuaaauccauacugugcuuuagaauggcuaauuggauucuuucuccugcugcagccaucuaaaaauuauucagcaaaaugcuuagcugcucauuuaacaguugucauccucugacaacacuagagggcaggcagcgucugcuugauaguuuucuguucuugugaguagcaaggagagaaggaaggugaucaaguuuuucugauuuuuuuuccuuuucaauauugagccagggauuaguuaaaaaauaaugagaagguaggccuagagggaaaguuuuauuucuuaugggaccacauucauagaaaaagagguguuuaaguugauaguguuuuguuuucuucuugagacgaggguuuuuuguuuuuuguuuguuuguuuguuuguugaacuuacuaugugcuggccuaaaacucaguaguccucuuaccugagccucuuguuuauuguuguugguuuuuuuguuuguuuguuuguuucaguuucuuugagacagaguuugucuguguagcugugguugccauggaacucaauuuguaaaccaggaugaccuugaacucagagaucugccugcuucugcuccugagugcuaggauuaaaggagugugucacuaccgcccgacaccuuuugauuguuguaggcauacaucauugugccuaguuuuuuaaaauuugacaaggauacuuuugaaagaaacacaugcccacuaaaaucuuaaaacaaagaauaucuggacguagcaguacagagcuacuuuuuccauugacgauguagauguuguguuucacccucucuccuuugcaggcugaugaagaggagcuaggcaccucaucagaaguuggugacucugaggaaagccauuccacacagaaaaggaaggccaggccauuaggaggaauggaaaaaaaguuuuccccugacguucagagagucuauccuggucccucuuaguuacggcagucugugucaagguggucucuuuugcuugcuucuuuuaaauguuuuccuuuguauuugaugacaaauguuuguauccuuacaaaagaccuuguauguuuacgaauucugccaugcagcgauucuuuaaggauaguuuguuuuauuuaucuuguacauauguauuuagaaaacuuuuaaacuugaaaaauaaauaauacuuaauguuaaguguguguuuauaugaaacg

SEQ ID NO: 385 - RNA, 4420 nt, Mus musculus
ugacggcagacaccuguaauuccagcauauuggaaacugagucaagagaauugggaguucgaggacagcuuggaguacaucauaaaucacugucucuagaaaacaaaguuacuccaggguuaguggggaggggcuggguagacuguuucuagcaugucgggaaucuuacauucccacgcauguuuuucucacccguuccgagugggacaugggugguggcaguguccuucaggucacccuccaggaccacaguuccuguaggucauagaugaucauaaccgcugcugaauguuugaugggcccggcuggccaagacacucugguaacaugccccuacccugcacccacaccuuagggcuauagccacccacaggagaucauugccacccaggggccucucaaaaagacgcucgaggacuucuggcgguuggugugggagcagcaaguccacgugaucaucaugcuaacugugggcauggagaaugggcgggugagugcccugcagcuucccagaaucaccaccagguggcauauguccuccucgcaggagugcccuccuccucgaucuuggggcaggugggcaaguugggaguugguaaaggauucugagaaucaccuaagaggaggaaguggggcgaggagacaaauggguucauaaguuccugguuugauuuaguuccuccuggucacuuauucuaggcagugcaggggcaaggaaggcucuccucugacagcccaaggccaccuucucugugcugugcauggacaaggcuggcguagagcaaacagagguggcugaguguguccuccuguugaagcaaugaggaaaggccagacucucccuaagucagggcuaucuagcuucccaagggagccaaagccaacgcagagcccuaaggggguuauaagggcauuggagcauagguaggggagggaagcuucugaaagagauggucucacaucuagguggaggcaaagaaaggaauuucauuagaauggcagggaccaaaaauauugagaccagauacaguagggaacagcucuaacaagcacccccuuacuccuagguacugugugagcacuacuggccagucaacuccacgccugucacccacggucacaucaccacccaccuccuggcagaggaaucugaggaugaguggaccaggagggaauuccagcugcagcacgugugugcccaggggacagggcuggugggaggggcacuaaagcugagacuccccuccuguuccacaugaccugcuccugaugggggccauaugcucuugggcacaggaugggauagcauguggggagggggucagaagacacagcgaaggcuaaaggcugagccaagaucacacugauggaaagaaagagcggguccuucuaccuuaugcugggcucaaagauccucauucccucuaaccuccuucuuguucccacaugcugugaccucuuagaaccagaaaagccagagacaagaauagccucccugccuggccaucuuugggagguagagauacaccaagagacuagaggaggaucagagguccacaccagggcaagggcaugggcuaaugucccguacugugaagcaggagcuugccucugcccuuaaagaguuggugaggggcuggugagauggcucagcggguaagagcacccgacugcucuuccgaagguccggaguucaaaucccagcaaccacaugguggcucacaaccacccguaaugagaucuggcucccucuucuggagugucugaagacagcuacaguguacuuacauauaauaaauaaaucuuuaaaaaaaaaaaaaaaaaaaaaaaaaaagaguuggugaggaagguuucugagguuaguaagaggcccuggcauucagaaaaugagcacagcccuuucaccacccuccccagggugcagagcaaaaacagaggcacgugaagcagcugcaguucacgaccuggccagaccacaguguccccgaggcucccagcucucugcuugcuuuuguggaacuggugcaggaggaggugaaggcaacucagggcaaggggcccauccuggugcauugcaggugaggaccagcggcaggggugagguggagggucccggcuggccuugggcaggggaagggaucuggguuucuaggagcccuucccuucccaugcuuaguguucaugggcugucccuacagugcgggugugggcaggacaggcaccuuuguggcucucuuacgccuguugcgacaacuagaggaagaacagguggucgauguguucaacacuguguacauacuccggcugcaccggccccucaugauccagaccuuggugagggccccauguauuggucugggcggcuuagacccaaaggagugggagaggguaggcagcuucacgagagcgggaaaaguugcucaugggagcauguggaagagcaaggggugagggucacaccuaggcuaucaucuuacccugacugccacccgccuuucuguaaaaggagagaagguauuggcccccgacacccuugacacuguagacagacagcucaggacucuccagccccacuugcuacacuccugccuguggguugggaccagggcuacuucccaccgggacggaggccacuuagcacgucagugcccucuuucugcagagucaauacaucuuccugcacagcugccugcugaacaagauucuggaagggcccucugacgccucagaguaagucagcuacccuuagguccaggcaggugggcacugguguccugugcuucccgcuaggcucugagcuccuaagcacuagacccagcagagaggcccggaagcaggggcuagacaaccaagugcuuucucucuccucccuccuccagcuccggccccaucccugugaugaauuuugcacaagcuugugccaagagggcagccaaugccaaugccgguuucuugaaggaguacaggguauacuuugagcugaggagugaguaaccauggaacaguucucccugcccaaccuuaccauguccauccaucucuuucccagcuccugaagcaggccaucaaggaugagacuggcucucugcugcccucuccugacuauaaucagaacagcaucgccuccugugagucucacgggauacaacguugauugggguggagcaaaugccgacugugagaccccuggcaacuucauccucuucaucuucucucaggucaucauucucaggagcaguuggcccugguggaggagagcccagcugauaacaugcuggcagccucacucuucccugugagacgaugcugagccugcagcccugcuugauuauuugugcuucccugccugggguuggggcuggguccuaggggcuuauagcacagauggacuauggucaggagacuccuuaaucccugggaaccaacaaacugugcucugcagggugggccgucuggucgcgaccauguggugcugacuggcucggccggaccaaaggaacucugggaaauggugugggaacauggcgccuaugugcuugucucccugggucugccugauaccaaggagaaggugaggcgaguggagggacaguauguguugcuccaggaacggggcggggagaggaguaguauaugguguuguuugcuguucagcuagggcauggguggaaauuuuggaagcugacuguuuugguccuagccacaagacaucuggccaauggagaugcagccuauugucacagacauggugacagugcacagaguggcugagagcaacacagcuggcuggcccaguacccucaucagaguuauacauguagguguugagaucucagggcuuggggcagagggcagugauaugagaaucccaugcugacuucccucugccacccuccuggagcacuaaugcugguauugcccuuccuccagggggacagugggacggaaaggcagguucaaugccugcaguuuccacacugccagacugggagugagcucccagcuaacacccuacugaccuuccuugaugcugugggccagugcugcucccggggcaauagcaagaagccagggacccugcucagucacuccaggugccaucgacaaacgucauguguuaacuuggguuaugggucaaagggucucccaaggcuccgucucuucugcuccauuugcagggauuugguagggcucucucuagccuggcuggccaaucaagugccuagcauuauuuccuaguccuuagaacuaaucuugguuuccccaugugccuggacacuaccccaucuccagaggucccacaucuaacucuaggucacuuacagcaaggucacauaccagcugggcaccuucuuggcuauggaacagcugcuacagcaagcagggaccgagcgcacaguggaugucuucaguguggccc

SEQ ID NO: 386 - RNA, 18318 nt, Mus musculus
cauuccagguaagcagagaaacugggcuguuggcuuccaagaacucggagaaugagcaagaugagauaggaagacauggcgucauagguuccuggugaaucgccauuuggagagacagcucaggaccccaggcccuguuccacagaauaauaacugguggcuggguggaguuccaugguccagcauaugccuaguguauacaaggcccuggacucaauccccagagagagagggacggggagagaggacagaaagagagagaagacagacuucaauuuccugaauuggcaguguaguucaguugguagaauguuacuugucauauaugaggaccuggguuugacccucugcaccaaaacauaaaagcaaaugaaaaaucucuuuuuuaaggugaacuuaaguguguuggagucugaggcagccgauagccauaacuuuaagaccagccuggguuuuauguugaguucaagucaaaacaaacaaaauaaaaaaacuuuggcacgacuauaaccccagcuugggggagguggggauaagagggucuggguagagaagccacccuugguuccagugaguucaaggccaguguguggaggcugcaugagaccuuccuugccucuggaagacagagaaccagaggcaggcugacuucuugauucuucucagaguguugcugugaccucugcugcccagauuagaagcaggacagcaaaaggggcccugagcucauggugaggccucucugaguccugugagcaaugggaaauccuggccaugcuccgaugucagcagggaggugcuacuuccucauagagcagagaagauguccccuacguggcccagacagucccuuaguuagccacaccccuugucgggacaugaacucugaaucacucugguugguuuggcgaagucaguuucagccuugguagcaccuuguccugcaguugguuggaggccuugauuucaaggucaugggucuaaggaauaauaguuaauaauuacugagugcuuacugcacaccaggcaggacgcuaagcuuuuaauguauauuugcucauuuaaucuucgcaacugucaacuaagguagggccuagcacccccauuuuacaaacaacugaggcgccaagagguaaaguaaccugcuuguggcgucccagagccuuuggcagaaccaggauaggaagcuggguggcccaggcuuggucccuggugcuguuaggauagggagaacaggaugcacuugacuacaaagguggcugucaccugaugacagagugcuaauuuuaaagcaaaaaccaguuucacaguagaaacaggcauuguccagucuuacugugagcgccuccagaugccaccccagccaggaccccgcagauggggaaauggggggugcaagcucaggagacucccuggacauguugauuggugggagaguucugacgugccuucuuuucuuugaccuaugagguuuugaguuugaucgauggcugaacaccccuggauggccccccuaccuccccgaccucuccccuggggacucacucaugaagccagcugaagagcuggcagaacugugggugaccucagagccagacaugcaagccauugaagccguggccaucucuaccuggaagaccuaccagcuugucuacuuccuagauaagaucuugcagaagucuccucucccuccugguaaggauaguggguuaccuccuugucacacugaauccaggcuccuugcgugcacagcuucaugucagaggucagagguagauucacauuccggccucuaagugacucccagguagaagggaggcugagacuucacaagacuaugccaucaaaacggugaagguuacacagacaagugccaagaucaaauuaacaaagccuggcaucuaucagggcccugguucugcagggcgcucuguaaacucuguuucuguuaggccauuuaacccccagguagcagagacuguaucagaaaggcaccaguaaccaacacaauuucgaaaggguugggcuaagauuucaaccuagucaccaaaacucuuuuuuauuuaaaaauuacuuuaaagauuuauugauguaugugugugucugacccauguguggguacccacggaggccagaagaggguauugauacccuagagcuguggucgcaggugguuguaagccaucugauauggaugcugggaacugaacugagguccucuggaaaaacagggagcacuccuagccacugaaccaucucccuggccacugauacuuuguuguuccccagucagaaauaauagucauuaaaucccagugagagucaacucuccuggcauaggggguuuucauacuaagaauagguaacugcacauauucagaucucaaagcuggauccaaauuuauuaguauaaugguaggagagaacucgaggagaagaacagagucuggaguaaaauuaaggggagagccuuagaguuaaagugcucguggucugagagcaucaccaugccagacacaugagcagaacgcaugcgagaggugagugguaagggaaccuccugaagguuucugcaagugcuuucggagggaaugagggcagauacucacucaguggccucaagaaugagccuucugggcuuuucagccggccaucaauagcccaucacucucucuuuucuagggaaugugaaaaaacuuggggagacauacccaaagauuuccaaugcucagaaugcugaguuacggcuaagauggggccaaaucauccuuaagaaugacuaccaagaggaauuccagaaagugaaggacuuccugcagagccagguggguaguuacaucccugguccccucaaaggcuggggaccuccauuaucauaccugaagucuuccggcgggagagccacgugggucugugcuucagaggaagugggucuggcuucugagggacccuccuaaucaggcuggugcugguguaacucccgggagcuucauccugcgggaagagaaaguugcagguuuuuggacaucggguuuuuggugaaaccuaagggaugaagcuaguuagagcuaaccagaagcaggaagagagcaauggguaauaugaggacuggucaugccaaagaacaaaggcggggagugaagggcaagguucuugugccagcagaugccugugagagugaaaggcucuccgaugcacugggcauccucaaacccacagcaaggaggaaccaaguggauccaaagccacgacagcuucuucugucugucguggagucuguguggagagggaaagggagaucugugggaggggccuuugaccccucuggcccguggccaagccucuggagcucccaagcuugcccugcagcugccucacagugaugugaauuuuggcuuaauugcaggcggauggaccuuacauggcccuggguuuuggcugucauuguuuuggugacugacugccuccaacuuuccaaaaguuuguagucccauucugucaaccgccauuuguacucguagauggucccucgcuaccgugauuggagguucacacuuaacuuauucccccaggaccguccuccacacccuagaagaugccaaaaucaguccuucucacgggaagcacuucauucccugcucugauccccacacccuucuuguccucagaccauggcugcaguuggaggaggaggggcuggguagacccacugaguaagcuacugaggacgggugucuguuucuuacagggaaagcagaaguacacucugccucuguaccacgccaugauggguggcagugagauggcccggacccuggccaaggacaccuuugccgccacugcuucccagcuccacagcaacgucgucaacuauguccagcagauccuggcgcccaaggacaguuagaggcuucgccuggguggucccugccucagaaaggcuucacaggcuuccugaagaacugcuccuucccaaauucauguucucacuccagugccccggagcuucuguucuuuggguuugggucucugcccugguggcggcuucuggucuagagaguccugagaguccuaggaggccucccaugcucccccuagcccaggcugcagagaguaaaaugucauucuuuuucacuuuaaauaaauguuuuuaagcaagaaguagauaaguuggaguuauagaaugacucauuuauuguuauuuauguuuaagaaaugguguguguguguguguguguguguguguguguguguguguguguguguguugugaugcacacguggaggucagaagacaacuuguggaaguugcuucucuuguaccacuagguggguuccagagaucaagccugggucaccagcuuaguggcaaguauucuuacccggaggccaucucaccagcccuggguuuuugugguuuugugaaacucauuaugcaguccuuucuggccuggaauucacuaugugaaccaggcucagaccuguggugauccuucugccuccugagugcugggguuauaugcaggagccagucaccguugacuuuauccugcuggcgacccucugugucauaugugcacgguugccugcccacacgaggguguucuccucuuccucuguccccccucagaccccuggggcuuugcuaggccuccccugccccagauccucccuaacugugguaaugggucgggacuggcagagucugcugagugacuauagcugaacucugauuuccugguucuacacggagguggaagcagucaucaucuugguuugagaaugggaaugacaagagagcgugcuaagauaaguuuaaguugucuuuccuaaacacaggggacuuugagcugguccccaucuggcuucaccugucccuacacaaagguggagacaaagcugagguuccaucucugacaggugggaagcaugacgaugccucugccucaccaacagaggcagcugugagcuacaggccaaagagggcccagaagugcaggggggggggggagagcugacauucauagccgacuucacagcugaucuuucucaggacugucccauggccccuuccuucccuugccuucacacuuauccugucaguccugagaccugucaauauuuuguuuuuugagauagcuucucuguguaucccuggcugucuuggaacuagcuguguagaccagucuagccucgaacucaagagaucugccugccucugccuacugagugcugggacuaaaggcgugcgccaccacuggugaacuuccacucacgguuuauagcaugggaguuacguguccuguuucaccagcugucuugguucugcuggaauccuauugggucugcuugugcuuuuacaggacugggguugaagcugugcuacugaggauuaaagaggaaaagcaucaggcucccccgccaugcgccaugcucagcacaugcauaggcaggcuaucgcuccgcagcugcucccaucauagucuuggauccuuccaaggcacugaccucacccaauucuuucucacuuuucuccuccauuugacuguggacggaaucaauacucagggggaugcgcuagcucuaagauuucugcagcuuugccucuccugagcggaagccccgugaaggcaagggagcuagcugauggacucuuuguggucuucuuccucuuugcucuggagacccaaccagguguucuuaggggaaggagcacgugaguagccaagaggcuaaaagcugguucucccacauuccaggguaagugacuggguagagggugugucugccucaggcugcuuggaggagguccccugaagggccagagaaaauccuacccagagcccuugguuuuccagcagcccugaccuagaggaaaggagccugucguucugaagaugaagaguggagccuaugggggugggcagauuguguccugggacaaugggguaccuagaagagaaaggaaucuccuuucguuugaggucuaccugggggucgugugucuguaaaugggguggagagaggagaagacacagaucuuauaacguagaugcaggaaaugcugacaguucaguguagagaacuuacucaauucauauagccuccgaagcuaucuccucaggcaacgcaaaacaaaccaguuggagccgcaagacaucuaauggcuuaucgagucccacacccucgauucuuugcuaauuuuaugguuuugcuuuugagacaaucuacuguagccuaagauagccccaaacucaaauguagcugagacugacugacccugagcgcuggaauuccagacacaugcauaucuuuugcuaggcaauaaucgcucuaccagcuguacucccacauuccaggguaagugacuggaauucucacuuacuauaucccuuuaaaaauucccugagugggaugguuguagccagagggaaaaggcaccaacaacugcuugucacuuuccaaauuugguagccugaacaaaccacuuaucaagacaacaacuauauaucauuucuuuucuucucucucucucucucucucucucucucucucacucucucucucucucucucuuuugaaagagucucacuacuauguagcccuugauaaccuagaacucacuauguaguccaggcuuggccuucagcucgcagagguccacuugccuugggaguugagagauuaaagggaugcaucuccacauguguccaacagugcuuuuuaaaaauauuuuuaaaaccaugcuuacagccaggcauagugggcgugccuuuaaucccaguacuggggaggcagagguagguagaguucugaguuggaggcuagccacauaguaagucccaggauagcuagaacuauguaaagaccaugucucaaaaaagaugcaaacauguguguguguauauguguguguguguguguauaucuuguuuguuuaguguguauguguguguacacuugcacauaaaggucagaguaccacauuacaggagucaguuuucuccuuuuaucauguauggauggaacacggguccauccauagcauccuuagcagcagguauccuuauccacugagcuaucucagcagccccacauugcuuauuggauguuuuuggaugaggauaguuauauuaaaaagguuucugguguuggucuggguaguuacccuuuaacccaucucuagagccugucucuugaguuugaggccagccugguauauguagcuagacaaaguuucaaaaaugaacagaauccugggacuagaacccauuuguagaaugcuugcauaagaagcucuggguucaauuuccugcaucuccagagggauuuuguucuguaguuuuaguuuuucaagacagaguuucucuguguagcccuggcuguccuggaacucacucuguagacaaggcuggccucgaacucagaaauccuucuaccucuacuucaggagugcugggauuaaagaugugcgcugcccuccuccaccccaauuuguuuuuguuuuuuaagggccccgguaaacaguaaauuaacaugugcauccuguuugucuuuguaaugacucaaauguugggcuucugaccacuagagggcagcaggcagauacuaauggagugggcggagagaaggguaaucaggagcagaccagacucgcggauaaaccaaacagcaccgccagccgacccuaggcgaggagagcgccacaggcaccaagggaagacuugaaguagugucugaucucuaccgcuucagcaaccaucgcguuugggugggcuccagacaggcaaagugccagcaaauggucucuguagcugacuagacagacuaucagacccaaaccaccacuggaccgugaauguugcccaguguguugccuagccgcuuucagaaucccagcuucuggguguuguggaggaaaccccuuagccucgguaacuuucaccaggcccuucuugucucuagaccucuagacaguuggaagcaucagucuugacccagccaccgguucagauuccuugccuugcuuucuccuccccaguucagcccuggccaggcccccaggaagaauuuccagggccagagggcagccuaaggcacagaugcccaccccugcaauguucccgccaccugcccaguucaguacccagggcccaaccccagagggugcggaaugacagauucugacaaucauuaaaccagccaggccugauuucccagcaccgccugcuaggaucugggccaaguggcacggaauaugcaaaucaccugggacagggagcccagucugaaggccaggaaauccccagcauccaaugagccaccagcucagguuacaaccggggacguacgccgaagaccuggaggggaggagcuccugcuuugcucuauuuagagcgggugggggcagcgcccuggccacacucaucacugcuaccugcggagccuucgaccgcuuagauuucuucccuuccuguggccucagaagccugcucacccgccugccacaccgaacccugacacaccucgguacggucacauucccuaacucuggcuucaggaaccguccaguggauuuacaguucugaacuuaaucacucaggcuuggagguuccuagcuggaguguuggggcuacuguggguguauucugggacuggucagagaccagaucggugucuuggagggacaggguggcuucuuugguucaggagcccacgugauuuguggagagagccccagaagaauuuguaucauggucccacccgcuuugagauuauuuuuauuuuucggagccgaauuucccaguuuggcgccagcuggccugacccuucuaggcucaagagagcauccaaccucagcuuccccaaguagcuggcucuugguggugaugguggugguggugguggugguggugguggugguggugguguguguguguuugugugugugugguggaggggggggguguugaagagagaaugucuacagcaacacugaacuuccugccucucggcuguugcugcccaggcuuugccagacagaaauggaaguguacccugaccuguacccuccccaccuugucuccucuucccaggggcccucauggcugccaccugugagaucagcaacguuuuuaguaacuacuucaacgccauguacagcucagaagaccccacccuggcuccugcuccuccgacuaccuuuggcacugaagacuugguguugacccugaacaaccaacagaugacacuggaagguccaggugagugcuguguaaaaucuuuacagacaggacaccaaugaucugagaggcucuuagaugauaaauggacagggaggaaggguauccuggaguuaguggcuggggaggauuuauucauucauauguuuguguaguacuggggaaagaacccaaacaagaccuuauuuaugcuagacuguguuccuagucccgagaagacuguaguggcugagguggugggaauauaagaacuguggugacagauuaagggaggaugaacuugagaacuagccauguugugauuguggauauguaucugucccucuccgccccuccucggguuguguaggaccucagacaagaucccaaagggacaggacugauccucuggcuguacuccaccuugcagagaaggcaagcuggacuagcgagcggccccaguucuggucgaagacccagguucuggaguggaucagcuaccaaguggagaagaacaaguaugacgccagcuccaucgacuucucccgcugcgacauggacggagccacccucugcagcugugcgcuggaggagcugcggcuagucuuuggaccucugggagaccagcuccaugcccagcuucgggaccucaguaagucuaggcugggagccacagggccuagagagugagcgagguggcugggacuugggcaggagggugcagccaucgagccccugccggaaccauggucagugacgcucucccucccugccuccgccagccuccaacucuucugaugaacucagcuggaucaucgagcugcuggagaaggauggcauguccuuccaagagagccuaggcgacucgggccccuuuggugagaacccauuuucucccuuuuuccucccuagcuugucuugucccaucuguaacuccuccagagugcuagagauauucucucccaacuugaaaauaaguccauagucauuucuguggucccuggagggucgugccuguccuugcugguauccugggccucucuaagcucuuaacuucuuuucucagaucagggaaguccuuuugcccaggaacuccuggaugauggccgccaggccagucccuacuacugcaguaccuauggcccuggagcgcccucccccggcagcucugaugucuccacugcaaguaaguccugcccuugccacagccugccuucuccaagugcccuagagugcaucgaguucuuagaauacucauucaguaucugaagucuggguaggcagugacuggguaggcuggcccuggcauugaagugguauuuuucaccccuagggaccgcuacuccccagaguucccaugcuucugacuccgguggaagugauguggaccuggaccucaccgagagcaaggucuucccuagaggugaguugagggcuguucuuggggguccuguccauggggucuagccacuccccucugcccuauggcugcaguuucuguagcaaggcucccuguugacacccugcccuuaccuucucuugaccuuccaacccccuucccauagauggcuuuccugacuauaagaagggggaacccaagcacgggaagaggaaacgggggcgucccagaaagcugagcaaggaauacugggacugucuggagggcaagaagagcaagcacgguaagcucuaagggcugccaggccugugggcggagggauacuauuccuucagcuuccacuggccucucacagccgcuggaacucauugcauugacggggcuccauggcauuuguuacugccucuuuacagaggccugcuuggacuuagagaagaagggaacugaggguccuaggagaggccauggagagaguccagccuucccacacucuuccucuuuaacuaucccuguacuuggccccugucuugccugauggaacuuuccgauggggaggaggcagcuggugggugcucagagccaggcaggcugggguggcugcgacuccaggcacagccugcugaaagagccucgggccuugugugcuccagcugcucugaaccaccuggaggucaccccaaaggucuugccugccgccucuuccauacacacagaccugcacguaugcacuccuggccugcuuuccuucuugucccgaggggacuguuaauuccgggaagcuguuucuuggucccucaggcuauaggcagcucucugaccccaugugugccaaguucucaccaccauugguccccacugaaccaugagcccccucacaaagaagcgugucucugucgcuguccaucuuaaccaguuguuugauccuuaacuggugagagaaucgagcgcucugugcagucggccuagcgcauugcauuuuggggcaggaaaggaagcagccacuauagcaaucacuaagaggacauuucauauacucccauaugccuuggcucuuagccucguugggauaggagaggccaggucgccuagaggagaggggcaccccagacugauaacugaggaaaucuucccuuguagcccccagagguacucaccugugggaguuuauccgagacauccuaauccaccccgagcucaacgaaggccucaugaagugggagaaccggcacgaggguguguucaaguuucuucgcucagaggccguggcccaacucuggggccagaagaagaagaacagcaacaugaccuaugagaagcugagccgagccaugaggugagugugagcgucagggaccucugcuugggcucuacuggcuuccgcuagguuucacaagacaggccugaggcccguauggagaggacaaggacaguguuguggcccuguguaguugguuacgugcagcaugaagaaagcgcugggcagagaucgugagcacacuuagcuuuagcuaacauuucuguguuuccugcagacuuguucuaagaaagacacuugagagaaagaauagaaauugacagcucagcucccuugucucugggccacaaaggugaacuagcucagcguugcuaaaguccccucucccucaguucacgggccuuuaugaaaagccccaggacauagccagaaggcacagagaaguaaauguagaagcaggugcucuggccauaauuacagaucaccgcggccacaacaggugaggagagggaacacucaggcagagagggccagcucagcacacuggggcugggaaccaaugcgaaccucagaccauagcaugccucuugccuacaccucugaccaccuccuucccacgcagguauuacuacaaacgggagauccuggaacggguggauggccgacggcucgucuacaaguuuggcaagaacucuaguggcuggaaggaagaagagguuggagagagucggaauuaaggaucggggcuggacccaggaccugacucaggcaugaacuccagaacugaagccuuccuggaaggacaggcaggccugauggcccccuuaacauggauguguucccuguguugcuguagagaggaagaaccuguugggcgugcccucugcagucuccucaagugcagccuuuggccucucuccucgcccucuuggaauuacaagccccaggguuugaaccaacuuguucgauaacucuccagcugugacuccaguucccucccgucccaacauggacugcaaaugagacccaccugcagaugccuggccucagccaaggaggcuggggagacuguggcaggagacugcagggacggaggggacaggguuguguccucgguacuuccuggacugccuuccaccucucugcucaguacucaggcuccacagacgggggucggaucaucccuaauuuaugugcuauaaauauuccagguguauauagagagcuauuuuuucuaaagcauuuccccucccugcucuucuccacugagugcugguggccagacugauuuuuuuuuaggcccccuaacuggaccagcgagaaguagggugauuccaggacccccucuucccccagaggggucuccuggauccccuuuccugugaauggaggcuccaauaaagugccuucugggcuuuuucuaaccuuggccugagcucucuguguacugaaauuugggacucugcauuggauaaggcauggagacagguggaagaagauguuaagcaugaagaaagaugggguggggggggggcuggguguugauguaugcagcuggagggucggcaggaggucgagaaaagagaaaaaaauagguguaggcagcugacaacugaagaaggacccaugacuucauccuagugaggaugugggcuuaggaacaggaccagggcuauccuguugccacuaaccaugugcuuagugagugaccuuggccaaauccaucuucagggcugcuucuuccucuuguacaacaaaaguuugggucugauguccuccaagaagucuagaguugcaagucccgccuugccaauagaugcuuuugcacucuggccaauuuggcugcacgcuaaagaucuguaaccugaauccuagcaucgugacugacaugaaagcacagauaggaucuuguaacugggaguggggguagggaggaagcaaaacaaaaauggaagugagugcuugaagagugcuugaagagugggagcugccaauguuugacagccaaguccucagccaggcucagcuccacucugccucaugcuauccccucccaagaagggagauuaucccagcauagacgcagagagcccauugguguuccacagagcugaagggcccugccccuuacccugugcuugggaauuucuaagcagguuuuugguuguucuuacuuggaaacagggagacaggauuucacaguauacacuagacuggccucgaguuuagagaccccaugaccugucugcaaccccccuccccaguacugggauaaaaggcacaacaccaccuggaucccucugucuuugucucucccucuccuauauauaauuuucuucuuuaacauuucaagaaagaaaauguuuuauugggucuuuucaaaaaagaaaauauuugauugaaauguuaaaggagaaaauuauacguucagacguugagguccuaagccacacagccgccgaggugacacacccauuaauuccagaacucagaaggugggucucugaguucuaggcuagccuggucuacagaguaaguuccaggaaaguccuaauuucuucagaguuucugccgugcugcuugucucuggggcuggaucugaacuguccucggccugagccgugccgcugccagucugcccaugagaagugcuguggggcaggcacggcaguucacuugccuaugacucuagcacuugggaaggagaagcaguguugcuaugaguuuaguuuaguuuaguuuaguuuaugguugguuuguuugguucgguguaguuuuuccagacaggguuucucuguguagcuuuggcuguccuggaacucccucuguagaccaggcuggccuugaacucacagagauccaccugccucugccucccgagugcugggauuaaaggggugcgccgccaccauccuacccacugugcauguguccacuuagcccuagaagcuccgguuggccaaacagugaccucauuuguaugugucguacacuggucguuucucuacagaaccgucucugcagucuguccuuccuuaaaagggaaaaccuccucagguggauaucccugaguuuggggccagccuggucuacaaaguaaguuccuggacagccauacagucagagcuguuaaaauagagaaaggagagcgacagagacagagacaggaagagagggagacagagacaggaagagagggagacagagacaggaagagagggagacagagaaacucuugccucuggagguccccuaaucaaaagcaggaggcuugaggggaaaggucauccuggcugugcuucgcucgguuuucccagcuccaaagaggagagcucugaggugagucucacccgugagguauguguggagcuggagggcugaaaagccugccaaaacuccugcuggagcagcugcacucaaggccugagcagaccuuuggccugcccuccucaguuuaugaggugggucuguaaucccgcuaucacaguggaucuaucccauacccuccgagaagaccaggugucccauuacacggaugggagcugaagcucgcccaagguuacuggucaggugagagcgggaccagaaacccagcauuccggccccggccuggggcagaguccucaggggcaaccuuuuaugauuuaguuucacucuauaaccaaacuggucuugaacuccagccauguuguacuccaagcgugucuugaacgagcauugauccuccugccucagccuuccaaguuuggcauucuugguuguuucgcuuuuaucuuuuugagaaaggcucucacuuuguagaccacacagacuaaacaacccacaguucaauaugaagccugggcuggccucaaaccuucuuguuuuagccucuaaaaggcuaucaugccuagccucuggggaacaucucuuacccacaacauucaccccaauaguucucuugccuuucuauccagaccccuaagcuggcauuucuuaguucuuuguggaaggcagaaaacuuaucccaagucucaccagcccagguccucuauccaguccucugccaccugcccuggguccccuagggcgugccuuggguggggcucuuuauauccugcccugagccggucaccacuuaucaacuucugugggaucauguguguugcugggugggucagagagaggucaacccuccacagcuugggugugcccaaugggcccuggcggggggggggggaggggagggaggggcugggcuagcugcucugccucucuucuuagcuacccugccucuucugaaugguucccagaaucccacagccucacccucccaccauaucugaggcauucuagauuugcagaaugagaggugaagacauggaggguuuuguuugccauuaauuuaaugaaaggauggcuaguucacugaauauuacugggaagagauucucucugucucugucucucuuucucuuucuucuuuguaagacagggauucucuguguagaaacccuuuuucucuccuaguuguccuggaacucucuagccucccgcucagagcuccaccugccccugccuccagagggcugggauuaaaggccugcaccaccauuaccuugcuggaaaagugauuucucuauugacugcugugcugagcccuuugguuuuagccaacaccuugcaacucucaaugcucccaaagcuggaagcuuuguaagggacuuuuauuaguucguugcccauuuguacaucugucccuuuguaccucucuguccuuacccaguugcgguaugucugaacaaguguccucauguccgcaccuagcagacaugagggugcuaaguaacugucacguugcccugcaauugucccugacucaguagccucuaucauacaggagcacaaacacacacuacucauguugaaaagucaacacauucuuacaugcuauaaucacacauacacauaucacacacuccacacuaacauacagacccacacucauacagacaaucccuccuuaucuauacuguaugcacagcaggcacuacauacacucacaguuucuaacauacccuuguguguacugauacauuggggaaagccacacacacacacacacacacacauacgcagaaucaaacugucccccuagcugaggacgugacgagcugguuaaggaugucauuagguacacgggugauguacugagggccagagguuguuagguccaugaguauggaaaggcagacugcucuuccuagucugagggcuugagauggggaccaagagaccccuuuacacucacuaggguguauuccauuguucucuccugagugaucauuuuuugagacaagcucucucuucauagcccuggcaguccuggaacucaguguguagagcaagcuggacuugaacucacagagaaccacugcuucugccucuggaaugcugggacuaaagguguguguacucacgccgacucagguucauuuuugagucaauuuaguacauagcauauuagggguccuuaucacacuagaggaacuguaucaguuauaguguccaaagacaccacuacugucuugcagucuugucucaccuuccugagggaggagauguaguagaaucccaucugacuagacaauagcuugucauagauccuccccacucaucuuuaagcuuuaaccucuuuuuccuuuuuugguuuuuuucgagacaggguuucucuguguagcccugguuguacuggaacucacucuguagaccaggcuggccucgaacucagaaauccaccugccucugccucccacgugcuaagcuuuaaccucuuuagagacguagccaaguaagauagagagccuuggguagaggagcccacggagucuccagucaucucccuaucacuugcaacaagucugcaguauaaggaaaccagcaaaccagagaguuaggagcuagggcuugaaccacgucuccagacuuccccacagccccccccaacugacagcuuugaaaggugcuaagcaaccccuaagcucaguggugcucaguugucucaauuccacuuauaaaagauaggcaguuuaguaaguggucuccugauaaacaaacacaucuaucaugggguagguuuaaaccagacuacucaaggacccuagguaccacccgaaggagaaggagggaacucucgugauagccuuggggcggcugcuccuggggaaugccaucugcuucucacccuacagccccgcugcaggugcugcugcuacgugcagaacuaggcugaggcggcugcggcaauuaagccagcucagcugcccguuacuggaaccagcacuugaacuauggagccgauccaggaagccacgcccagucuccccgcgugacucagucucaccugcccaucuccacaccugccggccucugugacccacgcuacagggcugaugggaaagucc

SEQ ID NO: 387 - RNA, 21732 nt, Mus musculus
ugacggaagaacagcauuacaacuccuguuuuacaauucauucaagaugucacacauguccuaaugacuggccuaguggagagagugagugaaauuucaaacccagagccuuucaauccagguucugguccccugcaucuugcagacugcuuagaagauggggaauccucaagggugaccuggaacuagggugacccaccacaccaccuacuucggucucaggguagcacaggaaccugugugaagcaggaagagggguugugugccacaagggaggggacagccccaggggguuaggggcuguggccgcccgaauuccucggagggcggggcgcaugguggcgcgucgccucgaggcggagccugccaagacccgaggagcgaccgaccuuccuggcgggugagcaaccgcucaggagccauggagagcggcggaccaggcaacuacagcgcggccgcccggcggccacugcacucggcccaagccguggacguggccucggccuccagcuuccgcgccuucgagauccugcaccugcaccuggaccugcgggccgaguucgggccuccgggcccggguccgggaagccgcggauugagcggcacggcgacgcuggagcugcguuguuugcuucccgagggcgccucggagcugcggcucgacucgcacagcugcuuggaggugacggcggcgacgcugcgacggggacagccgggagaccagcaggcgccggcagagcccgugccuuuccacacacagcccuucucgcacuauggccaggcccugugcguggccuuccggcagcccugcggugccgccgaucgcuucgagcuggagcucaccuaccgcgucggggagggacccggggugagugcgcgcggggcgcccgggccaccggccucucucagcccccuuggccagccugcugcuccuaagcagcccagagauggagagcaggaaaucuggcucugcuuccgcagcuuccgcgggagauccccgugccccuacucucuuccccagaagccggcuuuggauuccugccccgugcuccccauuccugggcucgaaccucuccagccggugcuuuguuccuccuacccguccuuccuuccugccuuccuggucucugucgggauuauuugccuuagauugcccugccucaccucugacacacacgugcuggaccgacuuguccgcuagccucugucuuuucaggaugagaaacuugcuucgcaaacuuugcuuuuuguuuuguuuuauaauucuccuugcuggagccuggacaguguugguuaauuagcuggaugcugacaggguccuuucaugugcuagcaagcccuuuugguugcacagguuaaaacagcccgagaagcauuuuuacuuccuccuuugaaauccugcuauugacuuaaaagaauccgagcaaaaaugggaauguguaauuagaguacucuagacuuuauaauaauucagccuucucaauaacgguuggcucuuaagucuuaagguuuucagaguuggaugaauauuggaaguuuagguaacuauucauagcggacauuuguaagagugacagccuuaggcuggguuacaagguucaccaaagcuguuggcagacuauuggagcuugcuuauccagcuaacaguuccccuuuacugacccaaagagcacuugacuuccuccuuugauuggaggaauaagcgagccuugcgauagaacuuguugggaaacugaaagcaccaugguuuaaccuagcaccaaaagcaaagccaaguucccgucggugccugggcggaagcuggacauugggaaauaucuuugguuccucugcuauauuuugaguccuaauuuucagugggagcuagaaauuaaacaggauuggaaaauuaaacccucccuaaauuugcauacucuaaaguugucaaaguuaacaacagaaucuauuuugaguuuguaauccuccugccucagcuuccugggugcugggacuccuggcagugugccaucaugccuggcccguaucaggugccuagguuuagacguucaccggauguugucaaacauuuagacaagugccuugcacaucuuaggaaacccugcucauuauccuuccacuaucuuuuguuuguuuguuugagacaggguuucucuguauagcccuggcuguccuggaacucacuuuguagaccaggcuggccucgagcucagaaauucgccugccucugccucccaagagcugggauuaaagacgugcgccaccaccgcccggcucuuccacuaucuuuaaguuauagagcagaaucaauuauuguccuucaaaacaucauggcugaggccucucucugcuuuccaaaggguugcccuuuggacuacggaggucuucacugaggacauuggcaugcauucuuuucccgauuuugcaaccauucugaugagcgcgcucccucaagcacugcagcgccuucucccagaauucacaugggcgguagugcccagguuuccucguuuccccguucuguuuccuucacaucauuuaagaacaaacgaagcaaaaacaaacaaaacaccguaaacaaagauggcggagggauaauguacaggguuuccuaagauguacaaggcacuugucuaaauacuugacaaaauuuggugaacuuucucucucuauaaacgcccgauaccagcuaggcaugguggcacauugcccgaagucccaguacucaggaagcugaggcaggaggacuacaaauucaaaauaacaaccaaagacagauuaacggcauaacugggcacagcuccucacgcaucuuccacgauuuccauuucccuauuagcaucuggucggucagcgcuggcacacaccagcugucaggcuaacaaggcuccacaggcuuuagcggcaucuuaguuuuuuuaccuacuuccuuuccugauucaugagcccaggcaaagcagcauauuguagcuagcuguguaacugcccaucuuugaguuugucaggcuuuccuuguuuuuuuuuuuuguuuuguuuuguuuguuuguuuuuuauaacuuugacaguuuggaggagugcuggucagguauguuauagaaugcucuucuacuggaaauuuucagauguuuucccaaugacuacaugauuagacuggaauuguacauuguagaggggaaauucacuuggaucacacugaauugagucaguguauuagcaacaugucaucuguauguugagguugaccucggucacuccucuacauuaguauucuucagcuuuuucuacugugccaccuccugccuuccacacuacauuguauuuauuggaagacuaauuacauuuacuauacuugagcaaaagcaggcaaaagaaaaacucaauaucuaaugugacuuucuuauguaucucuagugucuuacuguugcaggaacuauuaaaauagagccacauggccgcacuacugcaggcaacucugcccuggcguguccugccgggcuacucucugcccuccaacucucuggcggggcagagcucccaaguucccuuugaugccaugccaagccccaugcacccgcccacucugucucuagcuagugcgccacggagaccaaucgcuguguucccagcucugguuugcuugucucuggcucugcuaguuccuucucagccauaaacuccuguaaucuggaggggggggggggucccacauaccaguaaccaaguaaaucaaaacucuugaagcuuauaauuagccaaucggauuuauguaucaacaaauucucaauucauaagaugcuaauacaauaauuucagaaucaauugauaaugauaaaagcugcccaccgggcuggagagauggcuuagcgguuaggagaacugacugcucuuccgaagguucugaguuugaaucccagcaaccacaugguggcucacaaccauuuguaaugagaucugacacccuuuucuguugugucugaagucagcuacaguguacuuacauauaauaauaacuaaauaaaucuuuuuaaaagcugcccaccuagauuagacaaacuaucccaauuauucuaaccuuuauaauaucaucguaacuaccuguggcuauuuaaagccaugcugguucagguuuuccuguuugucugccuccaucuuggcuuuuuuuuuccucuccugagaggcuuucuguuucugcaacuccuagcucugccucccuuuucucuguccaauaacaggccuccugcuacauuaauauuuuaacguaauuggacagggaaaauccugucacaucuucugccuacuccuagaggcuaugcaguugguagaaccuucauccaggccugccuuuccucucucaccugcuagagaaaggcuucucucuuuccuucuaacaucugacucuugcuugcccuuaaaggucugaccagacacuuuguucuuuuuaauauuuuauuuauaugaguacacuauaacugucuucaggcacaccagaagagggcaucggaucccauuacagaugguugugagucaccaugugguugcugggaauugaacucaggaccucuggaagaucaggcagugcucuuaaccucugagacaucucuccagcccugaucagacacuuuuauuucaccuaugaauccuucuuggaauaguguaacccauucuucaauuuuaaauggauacauauucauacaaacacacaugaacaguuuuagcuacguuguguauguuuuccuuuugcuacaggcagaaguaaggcuggucucuuuucgugauagagccuugauugucucagugauauacuucaauaccagucauaacccugagcacucagaaaggagaucuagaguaacuaagaaaacuacaguugugucuuggaaacaacuggugguugaaagccagcuuaugacuaauauccuugcacuguagauagguucugguauaucagaaacugagauacaccaagacaucucaccacaccuguacgaaggcaaggucucuguccuccuucuucugggcuuuucuaaagaaucacuggaagaaauaccuuaaaagggagauccagucuacccagcuaugggagagaauaagagucaacuuacaaccugcaagaaagagcuaaucaccucauaaguauucauuacaaaaucacaucaaaucugggcauggcaugugcuacauuaagauccuuucaaaacaaauaaacaagcaaauaucuaacucugguuagaugagaaacggcuacagccagaaggacacagaaucucaguacgagguucugauuugauuccugagauacccaugcgauacagugggaaugcugugucuguccugugaggcgggcaugagaccauagccuguuccagaguagauuaaacacacacuaggacaggacagucagggacagagugauccucagaaaggucuuaaugauuaugauaugucaugaaaaugucccgugucagccagcuccuuucucuguucaugaucugccugcucugaaaugccucucuguucucucuuagguuugcugguuggcuccugagcagacagcaggaaagaagaaacccuuugucuauacccagggucaggcggucuuaaaccgagccuuuuucccuugcuuugacacuccagcagugaaaugcacguauucggcucuuauugaggugaggugaccuaacuugguaugcuugcccuugagauuaugaaugggagauggcuccgcaguugagagcacuucugcucuuccagagcacccacaucaggcgacuuacaacugucuaugacucuuugugcauggggucuagcaccucacgggcaccuucacuuauaugcacauaccuacaugcgcauccacaagcucgugcaugugcacaaacacacacacacacacacacacacaauuaaaacauaauaaaguagaugguuuuuuuuucauguuaaaaagaaaagccagguacaguaguacaugucuauaauccuuaggaggcaaagacauaagaaucaugaguucaaugccaaccuaggccaucgaggcagacccugucucagagagagagagauagagacagaggacguaccuucagacccaucagguccccauuugguugguaacuuacuacacccauccaguagaauccccgaaaagucuucccuuguaaagcucuccaugugcagcuauuguuugagacagcaucuuaccauguagccuuggcuagccuggaacucaugauguagagcaggcuguccucagaugcucagagauccugaguacugguauuaaaggcaugugcuuccaagccucguccauugacagaaauuuuacacaguccaaaucccauccgugugcgcuuuugaagccuuguguucuccaggauggguucugagucaucaccgucacuguucagguuuuugaucauacuauucuucaaguuagacagaggaggccuuuuuuuuuucuuuuuuuucuuuuuuuuuucuuuuuuuuggccaggcaugguuauguaauucaagcagccagaaagaggcagggggaccaucgagaguuccaggucagccugguaugcacagcagguuccagguuaguuagggcugcauagaaacacuuugucucaaaaagagcaaagcagggggcuggagagaugacucagugguuaagagcacugacugcucuuccagagguccugaguucaaaucccagcaaccacaugguggcucacagccaucugaugcccuuuccuagugugucugaagagagcuacaguguacuuaaauauaauaauaaauacauuuaaaaaaaaaaaaagagcaaaguauagacaaacaugcaaagaaggcuucccgggugagguuuccccugggugagguuucuuucccaugcucccucuguugccagguuccagauggcuucacagcugugaugagugcagacaccugggagaagagaggaccaaauaaguucuucuuccagaugagccaucccauccccuccuaucugauagcuuuggccauuggagaucuggcuucagcugagguuggacccagguaagaaacacucgauaggcaagguuggauugaccuccagaggcagugguccugcuaaaauggcucuuagaggcagugugggaucugucuucagaugcccaguagguuggcagagguucuaguuuuucucucuuccuccuccccaccucuccguuuuccuuucuucaugucucagcaaugagacugccgguccugcugguacugcggcaguugcuggagcugcaguggagucucuuggucaagugauguuggugcucagguggacaguuuagaagacugaucuugauuaguagcugaguacuaaguugccacugcauagaccucugugccaaaaccuauuucucuucuucuagcacugaauucugcagauuaacaacuuggaucucauugcauccuuuuaaagggagaaagacuguccuuucugccugcugcagaugccucaaucuacacauaugcugucaugaugcuaggcggguuuaguggaggcaaaaagguauuuuguacuguuucuagagacaagaacuucggccaugagcugggcacaguggcacacaccugcauccccagcuacuagggaugcuaagacagaaagucuuaacuucgaagccacagggcuauaaagaauaaauaauccuaucuaaagccagaauagauuuuucagauuuucauaucaucucucucuuaauccugcugugaaagggucaaaacuuggacugcacggcacaggcgccuuuccuggcucucguguuguuccuuagcucaaguuuuaucacagggcuccaaagaacucuaguagcaucaggaauuaaguuagcuccuagguaucagauagaauaauaagcagaauuccauugguaccugcuucuagcacacacauucaaaacaccacuaguccugaguguuguuauuuuggugugcuuggcaucaaacccaggaccuuaaacaugcuagacaggcacucucacccugagcuauaucccuagugacgugcuaacuuauuccuaauagacagggaguucauuuuugccaccagaggauuuuuccucugauugcaagauaaggaaaggccugugguuugaggguguauuuguccuaacaaucauucuauuugcaaaaguaugaaguagacuaugugguguguacaccuuugaucucagcacucugagggcagaggcaauaggaucucuguuugaggccagccaggacugcacaaugagaacccuaucuucaaauaaaacaagauggaguaugaauuauagucauaugccaucauaauggcaaugggaagaugucagaauccauaccauaugacagaaagcauaccauaaaauauucuuuugaacccuccauaagaaauugacucaagccgggugugguggcgcacgccuuuaaucccagcacucgggaggcagaggcaggcagauuucugaguuugaggccagccuggucuacaaagugaguuccaggacagccagagcuacacagagaaauccugucucgaaaaaccacuuuuaaaaaaaggaaaggaaaggaaaggaaaggaaaggaaaggaaaggaaaggaaaggaaaggaaaggaaaggaaagaaaaaagaaaagaaaagaaaagaaaagaaaagaaaagaaaagaaaagaaaagaaaagaaaagaaaagaauugacucaagggcuuggagagauggcucagugguuaagagcacugacugcucuuccagagguccuaaguucaauucccagcaaccacauggugguucacaaccaucuguaaugggauccaaugcccucuucuggugugucugaagauagcuacaauguacucauauccauaaaauaaauaaaucuuaaaaaaaaaaaagaaaagaaauugacucaaaagcaugucaaacaugguaacacgguccauuuagcugaugaugguuugguggguguagcucaguugauaaaaugcuugccuugcacgcaggaagcuggggugguggcacagugcuguaaucucagcacuuacaacguggaggccagaggaucccaaguucaagguccuccucagccacauagugagguaaagggcagccugaguuaugugaaccccugccucaaaacaaacaaacaaacaaacaaacaaacaaauaaaaaauguaaaaaaaguagugaugacaacuuuuuuuuuaaagauuuauuuauuuauuuauuuauuuauuauauguaagugcacuguagcugucuucagaugcaccagaagagggcgucagaucucauuacagaugguugugagccaccaugugguugcugggauuugaacuucggaccuucugaagagcagucgggugcucuuacccacugagccaucucaccagccccgacaacuucuuuaucccccugucggguggccaucccuuguucacauccaagggcuugugcuguauguuaaacaugagaguuuccuggcacagucugccuccuaucccagguccuggguagaaggcaagaggguggaagccaauagccauugguauaugauuccuccuaauuguuacccagacucagugaggcugauaguauuuguauccucuuguggauaaucaacuauaacuaacuacuuuaugcaaaccccaggugcaggccuuggcuucaggagucccuaauccuggugucagcucauccuuggagucaagugcccuuggccuacucccuggcgcucucagcauugacuuucuguuugaucacaccuuccugauggugguaucauuucucucucuucacuucugauuuccugucuuuagucuuugguugguugguugguugguugguuaguuggacagggucuuccuauguagcccagaauggccuccaacucucaauucuccugccucagccuuccacaugcugggauuacaaggcuccaguaaaacagcucaauggauaaagguacuuggcaccaagcuugauaauguaagcugggucuuacacaguagaacuagacucccccaugcacacacauugugucaugcacacguuugcacaugcacaucauacauucacauaaauaaacauaauaaaaauauauaugcugacaggagccugauacucuccugagaugcucugucagauccugaccaauacggauccagaugcucgcagccaaccaucggacugagcacaggaaccccaauggaggaguuaggggaaggacugaaggagcuaaagaggccuuaucuggcaucagugggaggggaggcccuugguccugugaaggcuugaugccccaguguagaggaaugcuagggcggugaggugggaguggguaggugggugggggagcacccuccuagaagcaagguaagaggggaaugagauaggggguuugcagaggggaaacugggaaaggggauaacauuugaaauguaaauaaauaaaauauccaauuuuaaauauccaauaaaaaauaauaaacauaaagauuuuaaugcugguauuauaaauguguauaccaccuuguuuacuauuucuuaauuuuuaugaaaaagucuaauuauaaaaaguugaagaggccaucuguaaacacaccuguuuugcuauacuaguuuuauuuauacaugggcuuguuuuuguuuguucuagaccauauuuuaauuuuacaugcauguuuauuugugugugugugugugugugugugugugugugugugugugugugcacaugugcauuugcucacacauauuugugcucggugugcauguagagaugagagaauagcuugcagaagucacucuucucuuggcaguaggugggucucagaacucggucaucggguguggcaagaggugcuuuuaacucccgagccaacucacuggcgcugcucuagucucuuaguaagucauacugucccucugaggaccgagucucuuagucauacugucccucugaggaccgagucucuuaguaagucauacugucccucugaggaccgaagcccauucuagcuuuauuaugaaguagggacaauaucuuuugacaccuaaaagaacugucaacuuuuucauuaauauugcuaguuuuaucucagaagacaauuuuuaaaaaagauuuauucacuuauuuuauguaugugauauacuuucccucagaucccuuuacagaugguugugagccgccauguggaugcugggaguugaacucaggaccucuggaagagcagucaguacucuuaaccacugagccaucucuccagccucagaagacaauuuuuaauuccagggauuuuauuaucauuguguguguguguguguguguguguguguguuacaaagucucacuguguagcucuggaacucugcauguagauuuggcugccuggagcucacagaugucuaccugucuuucccuuccaaguggugggauugaagagauacgccaccaccacaccuggccauuaucagaauucuuucauuuauccuauaaauaggaagaaggaaaguaauugugucacuuuaugaagguuucuuacauucugucuuuuuaaauaacuuuguuuuguuugaaauagggucucacuuuauagcccuagcugucuuggaacucacagcaauccuccugcuucagccucuccagggcugagauuacaggccugaguccaggguugaauucaguuuccauggacuucauguggguuuagggccuguuuucuagaguggcuuccuggcaccucccaaaggcaaucuuagguuuucauacccaggugugacgcacagccucuuggggcugagcaaagaaacugaucuugucuucucugugugaguggcuggccacauggccacauuucauuggcucaaauaugggaugaaggcuaguguucuauaugugguucccguggccgaagcagucucugagcacucuucugccucucugugcuuaggagccgggugugggcggagcccugccugauugaagcugccaaggaggaauacaguggggucauagaagaauuucuggcaacaggagagaagcuuuucggacccuauguuuggggaaggugugguaucaauuaauggauguguuuugugaaaccaaguagcucuuuugcacacucccgggccucucucccuuccucugucuccuagagcaaggcuuccucaucccagaaacgcaggaaaggaggaagcaaagaggaagggaugagccaggcuccuugaggcugcuaaagggaucuggaaggaacagguuuuugaagucacuaaaaugcgcugccaggcucgagguggggagagugaagaaaccccagggcuuuuguuaguuagcacaccuuuccucuuggugggaaguuaccuuaaagacuucaagcugcaggcuuggagauacaggcuggucuuuaggaccccaagcuggccucugagguguaagcgugguggagcaugcucacagccaauuugggagaagaacaaaacggggcucagcugccuuucagaggcgagcaugaagguagggauacuuccugaagcacccagaggcccaggcuucaucuucagcaaaagcugucuguuuaguggcugcagcugugggucugaggaggacggggagaugaggucugcucuggagagucaggaccucccugacuucaguuucuuggcagguaugacuugcucuuuaugccaccguccuuuccauuuggaggaauggaaaauccuugccugaccuuugucacuccgugccugcuagcaggggaccgcucguuagccgacguuaucauccaugagaucucccacaguugguuugggaaccuggucaccaaugccaacuggggggaguucuggcucaaugaaggcuucaccauguaugcccagaggaggaucuccaccauccuguuugguaaggugccauccuuccaagcaccuggcuucauucuuagugccaucugcuccuguggucucaucgugugggcaugaagggaggcgggacuuacgcugaaaacuguggguuuuuuucuuuauucauuuuuauugugugcaugcuuugccugcauguauguauguucaacaugugugugccugguccuuguggaugucagaagaugacaucagauccccuggaacaggaguuacaggugcugugagacgcugcguggcugcuggaaucaaagccaggucuucugcaagagcagucagagcucugaaccucugagcuaccucuccagcugcuuuuaauuuuuuuuuuaagauuuauuuauugauuauauguaaguacacuguagcugucuucagacacuccagaagagggagucagaucucguuacggaugguuguaagcuaccaugugguugcugagauuugaacucuggaccuucggaagagcagucgggugcucuuacccacugagccaucucaccagcccuuaauuuuucuuuuguuuauauugcuuguuguuguguugcuugagacagaccucacagaaggccggcccugaauucacuguguagaccaggcuggcccugaauucacacagaucaccugccugccugccuugccuucugaguucugggauggaaguuaugcagccaccaggccagcacuuuggggcuuuuuugagacaggucuugggcugaggauacaguucauuugcucagcuggcaaagugcuuuccuggguucaaucuccaguacugaagggcaggguucaggcaaguucuugcuaugcagguucuucuggucuggaacucacuauauagaucagacuccuauauagccacuauauagccaggucagacuccccgcuccugccucuaccuccuaaaaacucaauuucuguacaugaguaugaaagaucaaauaucuauagguuugguuuguuuguuuuucuuuugagacagguucucacugugcaugccuggcuggccaggaacucacuuuauagaccagagauccaccuaccugucucugccuccugagcccugggauuaaagucauaugcuauaucauuccuugcucucaucaaugguuuuaaacuagcuugacaguaauauuuaaauuuuuuaauucucaagaauaauucaaagcauuaaagaaagaaaagaguuuaaaaacuuuucguuaaauguaauaggguuugagcugguaacauagcccguuagguagagugagugccugaugagcacaaggcugaguacucaguacugaugcucagaacugaggccagggugggguggggaguacuugccuagcaugcaugggucucuggguucuggggcagacauuaaagugggcaugauggugcaugccuguaauucucacauucagaagguagaggcagaaggaucagaaggucgaggcuagugaggccagccugagcuacaggagacccugucucaaaaggaaaaagaaaugcugugacacacacacacacacacacacacacacacacacgucagugcauaccuuaccucagcagauuucaguaaggaagacuauuagaaacaucaucucugcccuggaggugcuggcacauggcuuugauuccagcacucagggggcagaagacugaucucuguggauucaaggcuagccugaucuacagagcaaguuccaggacagccagggcugauagagaaaucuugucuugagaaaacaaaaccagcugggcagugguggcacaugccuuuaaucccagcacuuugaggcagaggcaagcggauuucuguauucaaggccagccuggucuacagagugaguuccaggacagccagagcuauacagagaaacccugucuccaaaaaaaaaaaaaaacaaaaaacaaaaaacaaaaaacaaaaaacaaaaaacaaaaaaaaaacaaaccaaaaaagaaaaacaucaccucugggucugaacaugguaaagauuuucaguguguguuauccuuuccgucccaaauaguuugaucagcgcuguacucuuacucaaagugaacagagcaagauuuuguuucugaaucucuuaaucagccauaagaauccuguggcaaacugggcauagugacucacaguugugaguccuuacuuagcacuggggaacuaaagcaggaaggucacaaguuugggccauccagggucauauaguaggacccugucuuaaaaaaaggaaagacagggcuggagagauggcucagugguuaagagcacugacugcucuccagagguccugaguucaauucccagcaaccacaugguggcucacaaccaucuguaauggggaucugaugcccucuucuggugugucugaagauagugacaguguacucauauaaauaaaauaaauaaaucuuaaaaaauaaaaaaggaaagaccacauccuguagggcauggugccugaacugacuucaaggcuagccuggacuacauagugaguuuagcuuagcagagcuuuaaaguacuagaaucccauagcacacuuuuauuuucccauugggcagaagaaaaaacugaggccaagugaggcucagagucagaacauguagugaguggcagagucgaagugugugucuguaugcacucaccacaguguuuguguuuaagucagagaccagcuuucuggaauggcuuccuuccuuuuauacuaaccuuggugauugauuggaggcacuagggcuuggugccagguuccuuuaccuacugagccacgccacuggcucccaagguacuaucuuuaaagcuagggggaaauguaagggacaguuaaauuuuuuuuuuuucuucuuuugagacaagguuuccuauguagccccggauggccuggagucacuguguagacugaccaaccuuaaacucacagggauccaccugccucugcuccccccugacaauagaugagucaagaccugugccaccacgcccaggcuagguguuuggcauuuuugaaggugacaguuucuuuugcacacaggaucaucugaggaaaacuauuuuaaguuucauagagaccaaguuguuaccuaaaaauaaaaacacauucauuaugguugacaaggaaggguuucccuaguccuugugggacagagacccacagucagguucaccaaacccccgagagcuagggagggguugagucauguucugugucacucugggagguaaugccguugagccucagaccacaagaggacagcacagcgccucugucaggggaaauguagacuuggugaacuugggguuugugguuuguuucuggccaggagcugcuuacacuugcuuggaggcugccacagggagggcucugcugcgucagcacaugaaugucuccggagaggaaaacccacucaacaagcuccgggugaagauugaaccagguccagaaggcuccucugucuuccugucucccugacccucaccccaguaaauuacucuuggagccccaaguuagucugagccacauguuagaaugcuuccuuugaguggugggccacuauaguguucuggccauccccugcucuguaagccaacugaacacaaccauuucggccacuaaguucuuaaugacuuggcuguggcuuuuguauagcugcucuucugucccccuguuccucuuuaucgcugcccaggaacgaggcugguaaaucaugcuagcuucauguuacagaaccaggcagauccagugacuugucagcucugggcuuccugcuuucuagcauuuuucuuuaguuucacgugugacuaaccuaaaacccuuuugggcaacugaagcauguguucucuggugccacugacuguaaaaugaacuucuaguacauuggugauuaguuuaagucuaggacaguuguaaaaacaucggggagguugacuguguagacggugaccaaccggacucaaaagucugagcgugguccgccuuaagagguaguuaaggcccugcccaaggaaaugugcuagccccuuugaaccacuggucuuccugacccugucuuagauccauagauacugacccucugcuaucaccuuugacgugccaugggaaggacuaucgguggccuagaaaccuucgcuguacugggaaagguguagucgggucaauuccaacagucagucuguaaucugaaggcagaggggguguguauaaacacucaguccugucuacucucuccccugucagguguggaccccgaugacaccuacaaugagacccccuacgagaaagguuacugcuuugucucauaccuggcccaccuggugggugaucaggaucaguuugacaaguuucucaagguacagucaacucuccauguggggagaaggacaaggaacagguaaagcagcugggccagagugcuaggguagggguagggggcccaaccacaagagguaaggggucagagagggacugagagaugagggggggaggggggucuguuccccagggcggccagagacaacaacaaccgugucccuccucacaggccuauguagaugaguuuaaauuccaaaguaucuuggcugaagacuuucuggaauucuaccuggaguauuucccugaguugaagaagaagggaguagauuccauuccagguaagcagagaaacugggcuguuggcuuccaagaacucggagaaugagcaagaugagauaggaagacauggcgucauagguuccuggugaaucgccauuuggagagacagcucaggaccccaggcccuguuccacagaauaauaacugguggcuggguggaguuccaugguccagcauaugccuaguguauacaaggcccuggacucaauccccagagagagagggacggggagagaggacagaaagagagagaagacagacuucaauuuccugaauuggcaguguaguucaguugguagaauguuacuugucauauaugaggaccuggguuugacccucugcaccaaaacauaaaagcaaaugaaaaaucucuuuuuuaaggugaacuuaaguguguuggagucugaggcagccgauagccauaacuuuaagaccagccuggguuuuauguugaguucaagucaaaacaaacaaaauaaaaaaacuuuggcacgacuauaaccccagcuugggggagguggggauaagagggucuggguagagaagccacccuugguuccagugaguucaaggccaguguguggaggcugcaugagaccuuccuugccucuggaagacagagaaccagaggcaggcugacuucuugauucuucucagaguguugcugugaccucugcugcccagauuagaagcaggacagcaaaaggggcccugagcucauggugaggccucucugaguccugugagcaaugggaaauccuggccaugcuccgaugucagcagggaggugcuacuuccucauagagcagagaagauguccccuacguggcccagacagucccuuaguuagccacaccccuugucgggacaugaacucugaaucacucugguugguuuggcgaagucaguuucagccuugguagcaccuuguccugcaguugguuggaggccuugauuucaaggucaugggucuaaggaauaauaguuaauaauuacugagugcuuacugcacaccaggcaggacgcuaagcuuuuaauguauauuugcucauuuaaucuucgcaacugucaacuaagguagggccuagcacccccauuuuacaaacaacugaggcgccaagagguaaaguaaccugcuuguggcgucccagagccuuuggcagaaccaggauaggaagcuggguggcccaggcuuggucccuggugcuguuaggauagggagaacaggaugcacuugacuacaaagguggcugucaccugaugacagagugcuaauuuuaaagcaaaaaccaguuucacaguagaaacaggcauuguccagucuuacugugagcgccuccagaugccaccccagccaggaccccgcagauggggaaauggggggugcaagcucaggagacucccuggacauguugauuggugggagaguucugacgugccuucuuuucuuugaccuaugagguuuugaguuugaucgauggcugaacaccccuggauggccccccuaccuccccgaccucuccccuggggacucacucaugaagccagcugaagagcuggcagaacugugggugaccucagagccagacaugcaagccauugaagccguggccaucucuaccuggaagaccuaccagcuugucuacuuccuagauaagaucuugcagaagucuccucucccuccugguaaggauaguggguuaccuccuugucacacugaauccaggcuccuugcgugcacagcuucaugucagaggucagagguagauucacauuccggccucuaagugacucccagguagaagggaggcugagacuucacaagacuaugccaucaaaacggugaagguuacacagacaagugccaagaucaaauuaacaaagccuggcaucuaucagggcccugguucugcagggcgcucuguaaacucuguuucuguuaggccauuuaacccccagguagcagagacuguaucagaaaggcaccaguaaccaacacaauuucgaaaggguugggcuaagauuucaaccuagucaccaaaacucuuuuuuauuuaaaaauuacuuuaaagauuuauugauguaugugugugucugacccauguguggguacccacggaggccagaagaggguauugauacccuagagcuguggucgcaggugguuguaagccaucugauauggaugcugggaacugaacugagguccucuggaaaaacagggagcacuccuagccacugaaccaucucccuggccacugauacuuuguuguuccccagucagaaauaauagucauuaaaucccagugagagucaacucuccuggcauaggggguuuucauacuaagaauagguaacugcacauauucagaucucaaagcuggauccaaauuuauuaguauaaugguaggagagaacucgaggagaagaacagagucuggaguaaaauuaaggggagagccuuagaguuaaagugcucguggucugagagcaucaccaugccagacacaugagcagaacgcaugcgagaggugagugguaagggaaccuccugaagguuucugcaagugcuuucggagggaaugagggcagauacucacucaguggccucaagaaugagccuucugggcuuuucagccggccaucaauagcccaucacucucucuuuucuagggaaugugaaaaaacuuggggagacauacccaaagauuuccaaugcucagaaugcugaguuacggcuaagauggggccaaaucauccuuaagaaugacuaccaagaggaauuccagaaagugaaggacuuccugcagagccagguggguaguuacaucccugguccccucaaaggcuggggaccuccauuaucauaccugaagucuuccggcgggagagccacgugggucugugcuucagaggaagugggucuggcuucugagggacccuccuaaucaggcuggugcugguguaacucccgggagcuucauccugcgggaagagaaaguugcagguuuuuggacaucggguuuuuggugaaaccuaagggaugaagcuaguuagagcuaaccagaagcaggaagagagcaauggguaauaugaggacuggucaugccaaagaacaaaggcggggagugaagggcaagguucuugugccagcagaugccugugagagugaaaggcucuccgaugcacugggcauccucaaacccacagcaaggaggaaccaaguggauccaaagccacgacagcuucuucugucugucguggagucuguguggagagggaaagggagaucugugggaggggccuuugaccccucuggcccguggccaagccucuggagcucccaagcuugcccugcagcugccucacagugaugugaauuuuggcuuaauugcaggcggauggaccuuacauggcccuggguuuuggcugucauuguuuuggugacugacugccuccaacuuuccaaaaguuuguagucccauucugucaaccgccauuuguacucguagauggucccucgcuaccgugauuggagguucacacuuaacuuauucccccaggaccguccuccacacccuagaagaugccaaaaucaguccuucucacgggaagcacuucauucccugcucugauccccacacccuucuuguccucagaccauggcugcaguuggaggaggaggggcuggguagacccacugaguaagcuacugaggacgggugucuguuucuuacagggaaagcagaaguacacucugccucuguaccacgccaugauggguggcagugagauggcccggacccuggccaaggacaccuuugccgccacugcuucccagcuccacagcaacgucgucaacuauguccagcagauccuggcgcccaaggacaguuagaggcuucgccuggguggucccugccucagaaaggcuucacaggcuuccugaagaacugcuccuucccaaauucauguucucacuccagugccccggagcuucuguucuuuggguuugggucucugcccugguggcggcuucuggucuagagaguccugagaguccuaggaggccucccaugcucccccuagcccaggcugcagagaguaaaaugucauucuuuuucacuuuaaauaaauguuuuuaagcaagaaguagauaaguuggaguuau

SEQ ID NO: 388 - RNA, 13106 nt, Mus musculus
cgucgcggggaucaauuuccgcccagcgugccguagacucucgcgcggguuggagccaagauggaggaauacgcgagagagccguggugaguugccgccgccgcccuugucccuuaauuaccuccuccauccgccguggucggagucugaggugcaagcggagcuccgcgcggcucggcgccgagaucugggcagcuguggguaguguggaugagcgugacaaagguggcuuuuuagcgcagugugccaggaccccagcaccccugugaccuuguggugcauugggaggagguccggugcugggcuugguggagcuuuggaaccuccucccuauggcaggugcugucgacuuugugcggggacaauaaugaucccuucugccugcugaggcgaccuugaacacgucccuaagccucgcucugcucaguuucugccucgacgaagggaauguagaucuccgagugccauacccgaggccuuaugccuaugaggacuaaguguccccacgaugaagcauuucaaaugaguagaccacaaauuucacccaacauccaagggggcuggaugagcuccuuguaggcugaagcggccuuuccuauguggaauucccgaagaaaaaagauauaucaguauguggaaaauaggaagagaugagcugcguguguucucugaaaagccaugaauagacauaaauucauuaaguguuuauuaaguaagggcuguaugcuuggcucaagguguaaacaagaguaaaucaggcauagcuguuugcaguaaauuaauguaauagcugucgagucucaacaguuguuugaauaaagccucaggugucacaagcuaauagaucuugguauucuggguuuuuguuuguaaugagcgucaggguauuauccucaaauagugugucugcccaggauuuuaaauuauuauuugguggcacucccaaaaguaugcuucagccuucuguccucagaggagguuaucuccauguguugggguuggauaugcaggguuuagcuggacuguauaaauugguacuagaugccguauaaugacacagauuagcaggagggguaauuuugauacauuugaguuuuccccaggucagguggcacaggccucaugagguagaagcaggagagccagcaaguuuaaggacagccugggcuccauagcaaguucuagggcagcugggguuagaccuugugucagacauauuuucaucagagugcacugugcaugcugguaaucucagcacuuagguucuaggcuagcccaggauacauagcaaggccaugucuugauguuugauaaguuacuggacauuccuuuuuuuucuugguguguucugaggccagcgcugucugaaacaguagaugguuuaaucauugucauaauacuucuuuguugcuuucucggagugcuuuaggaucuauaaauagaguggacagaguuugcgggggguuggaguaccaacuuuugugcuuaaguuggcuguucuaguuauuuauuccaucuggggcaggcuacuuaacuucugugugagccuucguucauuuguaaaauacagaggagauagucccagucuuuuuaucaaguuagaagauuaugaauucuaaagggaaauuagucauuauuuagauucuagugagcaauaauggcaaguuuaaaagcauacuguugccgggcggugguggcgcacgccuuuaaucccagcacuugggaggcagaggcaggcggauuucugaguucaaggccagccuggucuacagagugaguuccaggacaacaggacuacacagagaaacccugucucaaaaaaaaaaaaaaaaaaaaaacccaaaauaaauaaauaaauaaaauauacuacuguuauagugauggaccaggugcuggcuuacuauagcgcuugucuuuuauagggagggaccauaguuuggggguuaagauagaguuuuaccauguagccuaggcuggucucugucucuuucucccaaguacauaucucuugagacugugugacacacugagaaauuucuucuacuucuaauggacauacuacuuacaaacgacuucuuguuguuguugcuaacuuuagacuucguuguaaaauuguuuauaagcccaaguaaaccucucugugcuugcccaggcagcaugugugugggaaccaggaucaaggagugggugaggaggcggagucacuaaccuggccaaacagauuccaaaggccagcauugaggugcagagcuacuguauugcacagcagccaggguuuuuauacagccuuuggacugauggagaguugacaggagcucuggaguagccaaccauuccauugucacuggggcggugccaggcugacagagccuggggggacgucugugaagacaggaagcagccagugcccuguuucgggcccauucccacucauuugcuagggucuucuguuuugugucacaugcugugccaguggacgcuuguacuccagagcggugaagccucccucacuuccuccaccccauugauagacgacagcaucuauacacaagaacacuauagaaacaacaguuuuaauguuuguuucacagaauuccuuuagguuagaaacaugguggaugaugugugccagcagugcacuagacucccagcuucuuauuuggaaggagauggugguagagaauuacaacucugcugagaguugcuugaaacagaauuuacccuguacuguggggguagggcguggggugaucguguguguguguguguguguguguguguguguaggcuuugugugauaacaaaagagaagcuuacauaaauccuuacagaaacacaguugacuuaacaaggcuggagaugcugugugucagguccuggagucuuauuagccggauccuagaggagugagugguuuuacucgcauggauuacucagguuucaguauugucuauuuuagggggcugcauuuggaugguggguuuacaaguuuaacuucuaauugucaaauauucaagugugguuuuuuuguuuuuuguuuuuuguuuuuguuuuuuuuuuuuuuuuuuuuuuuuuuuuuuuugguuuuuugagacaggguuucucuguguagcccuggcuguccuggaacucacucuguacaccaggcuggccucgaacucagaaauccgccugccuuugccucccaagugcugggauuaaaggcgugcaccaccacacccggcuuauucaaguguguuaaauggaucuaaugcaaaacuuaagcuuaaaaugcuauuuugaacuuccuuuuuuuucuucucgagacaggguuucucuguguagcccuggcuguccuggaacucacuuuguagaccaggcuggccuugaacucagaaauccaccugccucuuccucccaagugcugggauuaaaggcgugcaccaccacgucuggcugacauuagacuuuuaaaagaucauccacugauuucuagaagcugaaucaauauuguugauuacaguuccuucugcuuuauuucuguuuauuugcuuuuuauagugcucaucuuggaacagacuuaagauagguuacugugagugacugaagugcuggguguggcgguguggacuguagugccaacacacagggggaugaggcagcaauaggaggcaggugguggcaagacauggcccacaccaugcugccauucuuuuaaagaaggacacaacuguuaaagccucuggcuuuggaggcuugaauggcuguggaugagugcaguacccuuaccccuguuuuacaagcuaaguuuauuggucacagugggcuccacauuggaaccuguugcauccuuuuauauauuaaacaaaaaaaaaaguugugguuuaugaauaagaacuaaggucaucuuuucuuccuuccuguguuuagccccuggcgaauuguagaugacuguggcggugcguuuaccaugggcaccauaggugguggcaucuuccaggccuucaaagguuuucgaaauucuccaguggugagugagugauuggucucauuuuauauucacuggaagccaggguugguugauauuauugaugaucacaucaguggauuagaaauagauuacacuugcagucuaauauacauacauacauauauauauauauuauuauuacuacuacuacuauuauugugggggggcuguuuugcuaugcaauacuuggugugugguauccauggaucaaaucccuggaacuggaguuacaguugugagcugccaugugagugccgggaauugaaccuggguccuuugggagaguaaguaguaaauguucuuaaccucugagcgaucucuucagcccuauuuuaguuuauguaucgggauguuuugucugcauguuugucugugcaccuugugcauagaggccagaagacgacauugggucuucaagaauugaaguuacaggcuauuaugaguuaauaugugggugcugggaaucaaaccuggguccucugggagugcagcaagugcucuuaaccacugaggcaccucuccagucccugaucuauuacauuuuaaacuacuuccuuuugguuuuguuacagggaauaaaccacagacuccgaggaaguuugacagcuauuaaaaccagggcuccacaguugggagguaagagggaugucuccauuuauacuuuucagcuacgcuuuugcugcuuuccuggacuuagggcucucccuaucugucugccuguccucccuccucugucugcccgucccucccuccuuccuuuuccucacuggucaccagacuggacuccacucaagagcuucuugaaugcugagauuacaggaguuuagccagcaaauuguauguuuuccucuuuuuauauuagcgauuuugauuugcucugcuugccuagugucccugugaguucucuuugauugaugcuuugaaaaguugaguuggauuauuguauccuuuuaaaaaucuuguuucugucauucggguauccaauguuuguuuuguuuuaacuugucuuaguuaggguuucucuugcuacaacugaacauuacagccacaaagcaagcugaggaagcagggguuuauuuggcuuauauccauauuauuguucaucaucaaaggaagucaggacaggaacucaagcagaaggaaccuggaggcaagagcugaugcagaggucauggaggggugcugccuacuggcuugcuccccauggcuugcucagccugcuuucccuuuguuuuguguuuacaaaacagggcuuuucuguguaccucuggcuagaucaggcuagccuugaacucagaugcaccugccucgccuccugagugcugagguaagggcaugggccaccacacacagccaggguuuuuggggggagaggggguuagggguuuuguuuuugagacaggguuacacugugaagcccugccuguucuagaauucacaguguagaccaggugggccuugaacucacagaaauucaccuacuucugccucugagcuaagauuaaagcugugggccaccacauuuggccuuuagccuacuuucuuauagaacccaggaucacuagcccagggguggcaccacccacaauggacugggccugcccccaucaaucacuaauuaagaaaaugcauuucagccgggccuuagggaggcauuuucucuccugagauucccuccauucagauaacucuaguuuguaucaaguugauauaagacuagucaagacacuaccacccccuuuuccagaaggaacgcuauguucaaagcucagauuuggagggcggaaaugguaguuucuagaguaacauuaugcugaagagaauguaauguaaaggaucagagagaccaauuaagcagguuggguucuccaggguuaacuuuaaaacauuguacagaaaccagugcaaaauaucaggcgauuauaaaaacacauaacuauaaaacuuaucaccugagccaucucacuggacacauuucuuaggaacaaguguuguccuagcaagcacucugacucagaugauaagucuuggguuuugguuuguaguuguuuuguuuuguuuuuguuuuuuguguguuuugcuugcauguguguauuauacuacuuaugugccugguacccacagagccagaagcaggccuaggucuucuagagcugaauuaagagaugggcuugagccgcucuuuuuaacucccuguuuccuacccuguuaagaacgguugucaaccuuccuagugcugcaacccuuuaauacaguucuucauguuguggugacucccagccauaaaauuauuuucauuacuacuucauaacuguaauuuugcuccuguuaugaauuguaacuuaaauauccgauauuucugauggucuugggugauccccgugaaagagucacucaacagcagcucacacauaaggggugguguugcaaguagcuuuuggcuucaccccccugugcuccaggaaugggccaagcuaccagucccuaccaagcuucccuuaaauccauggauaaacgcgcgcgcgcgcgugugugugugugugugugugugugugugcgcgcacacacacacacacaugcacacagaguugcucauuuucaacuugucuucuuggcacaauugcugggcauuacuaucucccaccuggaaaacguacccuuaucaaucaauacucuuaguuccucuccucccaccugcccuaacuuuaguugaucaguugaauuuaguuccugcuaaacaucuuugauacuggccuguaggagcggccuguguggccacuccguuuuaagaccucacguggcuggucaacuuuucuccaucagaagcccggcgaacucugucucuccuuccuacuccagggacgcagaagucccgccuguaccuaccucucagccucaauuggcucuucucuuuucuuuucuuuucuuuucuuuucuuuucuuuucuuuucuuuucuuuucuuuucuuuucuuuucgggggggggguuguguuggguuuuuggauuuuucgagacaggguuucucuguauagcccuggcugucuuggaacucacucuguagaccaggcuggucuagaacucagaaauccggccugccucugccucugccuccugagugcugggaucaaaggcgugugccaccacgcccggcucaaaauaauuuuuuuuuaaaagauuuauuuucauuuauguugugugcauuccgguguaucugccacauguacguaggucccauggcagccagaagagaguuugaggucccuggagcugggcuugcaggugguugugagcuaauggaugugggugcuggaacugaacucaaucuucugcaggagcggcaagcacuucucgccacugagccacgcgagcauaaagcacaguguucaguaggaagggaggcucccugauggcuuucacgucucucucuucuuugugaugggcucaguagauagcccaggcuagcuccaaagcaaacuuacuuaacuguauuuuaauguaaggcaaaaaagacauuuagguugguuguuuuucacucguuuugugucugaaacagguagcuuugcaguuuggggaggacuguuuuccacgauugacugcaguaugguucaaauacgaggcaaagaagaccccuggaacuccaucacuagcggugccuuaacaggagccauccuggcagcaagaaguaagugagcacugcuuguugugugugcuuuggcuuuuguaauacugagguugaaccugggccuuggacguggugagcaggcccuuacacuaauaccguuacguagaucaucauuuggacauauugucuaagcccguugcuuaggaggaccuaucugccuuuaaguaaugaaacuugucuugaaugccagcacucaggaggcagagauagacagaucucugaguucaaggccagccuggucuaagaagcaaguucuagaacagccagggcugcacagagaaacaaucaaaauauggaaccuguaaucuaugagucugagcauugcuuuauuugguauagaaugaauauggugcucugaaaaguuaguaagaauaaaaaaguaugggauugguggguuuuuaaaaaauguauuacuauuacauuauguauguaauacauagcucagaugaccuugaauaccuuauccuccugccucugcuccucuguacugggauggacaggcgagcgagugccccuuagagaaugugcauuucugcagugguuagagcaauggccauuuauuaccuugguaacugauagaaugccaaacucuuuguauguaguuuucuaaguucuccaccguguucagcuguuaggaauaaagauccucuggaucuuaagggcagagugcaaaccagaaugccuuugggcuuagacuagaagucuacauuuuuuucucguaaaagaccagacauuaauaguaagcuaauuucgucuauuauaugaauuuaaugugugugugcacagcauacagaaaucagaggacaacuugugcagugguucucuacuuuugccuugugggacccaggacugagcuggggucauuacgcuuggagaaaaacaucuuucccuauugaaccaucugggugguccagaaauaauauuuaaaacuuauggaccuuguaaucuuguuggucguuugguuuuugagacagccuuaccauuuaaccuugguuuuccuggaaccaagacuguagaccaagcuggccucaaaugccugacucugugucucagugcuggguucauaggccugugacacucugccaaggggcuaugugauccagugcuauuaaggaaugcaagcauaccucaguaaugcauacaugcaagaacauggcuguaguccaguauagcuuuuauauugguuccuuucuguugcuuugauaagacacuacgaucaaagcaauauauagaagaaaguuuauuuggggcuuacaguuucagagccugcccaccucaaaugaccuccaagcagaucacaccaccuaauccuuuccaaagaguuccacccucuggggacagagaauucaagcacaugaguaugugggguccucucaugcaaaccaucuuagcuuuguuuaaaaaaauaggcgguggcuggaauggaccccucagccauugucuguggcugugggucuugaagaguggaagaagaaguuugagaaugagagaacauaacucuauggauagcccuuuccuuuaaagcagucuuuuuauuaaugucuucagauggaccgguagccaugguuggguccgcugcgaugggcggcauucuccuagcuuuaauugaaggagcugguaucuugcugacaagauuugccucugcacaguuucccaaugguaagaccucuuucucuugaguguucuaaguucauacacgagggaacaguucucugacguuaagaaagaauauguuuuauuugguaaaacggagugguuugugauucuuacuuuagguaucaauauauuauuuauauuuuugagucuaugaugaccucaaaagcuaguguaaaaguagugggugggggcuggagagaaggcacccuucuugugagugcaggcugcuuuuguagaggaucccagguucuguucccagcacccacuucggucauucccagcuaccuguaacuccucuccaguuccaagcagaucucgugaccucuuggccuccacgagcacuacacaaguguggcacacacaagcaggcccaugccauacacauaaauaaaacuaaaguuuuuaaaaguagcaguccggggcuggcgagauggcucagcaguuaagagcgcgcugacugcucuuccgaagguccugaguucaaaucccagcaaccacaugguggcucacaaccacccguaaugaaaucugaugccuccuccaucaggcaaugguggcguaugccuucgggugugucugaagacagcuacaguguacuuacauauaauaaauaaauaaauaaaucuuuaaaaaaaaguagcaagccuauaauuaccauuuuuagcuagccacaauuuggcaacugaauauuuuggugacucuagcuuuuaucuuuuuuuguuuguuuguuuuugcuuuucgagacaagguuucucuguguagaccaggcuggccuugaacucagaaauucaccuaccuuugccucccagcugcugggauugaagugccaccacugcccggccucugccugccugccugccugccuuccuuccuuccuuucuuucuuuuuuucuuucuuucucuagcuuuuaucaaguugacauaaaaccagcuaagacagguacauagcaaauuuagagccuaggcugggcuauaugaaauuuaguuucaacaaacauuuuugguuuguuuguuaacucuuggaaauaaaguuguaaaguuuuguucugugacaaguuacaaggcagcuuccuaucuccgagauugcuucauugguuuuggucuuuguuuuugagaagauucucacacauuguuuauuuaaacuggguuaguggauucuuuuaaacauaaccaagggguuguagcuuaaugguaaaggacuugcauagcuuugaagaggcccugguuuuuaucucuuguacucccaaaacaacaacaaaaauauacauaaugucauuuuaaguucugugaacauaauuuuaaauggauaccaagauaugggucaaggggaacuggagaggugacuuacugguucagaguacuugcuguucucugagaggacccaaugucagugucucauucacauugaguggcucucagcuuccucugacucuagccccagggcauccagcacccucuucuugcuuccauggaaccugcgggcaccuacacagacaaacauacagauaaauuuaaaaauguuaaaccuuuuuaaugauuaagagcucuuaauugcucuugcaguaaagauucaaucucaguacacacauggcagcucacagccuccuggaacuccagccuuuguggcuuccacaguggugugcacacauacacuugcacacauauuaguaaaacuguaggggcuggagagauggcuuagcaguuaaaaagaccagcuucacuucagaggaccaggguucaaguccuagcacccacaugacagcucauaucuaucuguaacuccaguuccaggggaucugacaccuuuacacagagacacauucaggcaaaacaucaaugcacauaaaaauaaauaaauauaauaaaauuuuuuuaaaaaauguauuaagaaauaggagaauuuuguuuuguuuuuguuuuccagucuugauccagaggaacuuauuuuggcaauuccuuuaaacacuacuaccuccaggccugagaauauaguucuguuggaguuguuagaguauuuggguagcaugcacaaagcccuggguuccucucaagcaacaacuaagcugggcugguugguguacacaccuaugauccuaguacuuagaaaguggagacaggagggccagcaguucaaggccagccugauucuaagucagaccaagucucagaacaagaacaaaccuauuacuuguucugugauagauccaucuagcuguccauucugagauaccuggggagccaguccgcccugugauaaaucugaaggcucuccaggccucugguggacauugggcagaucuuuaugaagaaauugagacuaccgcuauaguguaacagaaacauuuaagcugguugguuccuuuucuacauaugcgcacuuuaaguuggaugcuggucucuuacugagccuuuuuccaucuuccuugcaggcccucaguucacugaagaucacucccaguugccuuccagccaguugccauccucgccguuuggagacuaccgacaguaucaguaggacuugguucccaggauuccuggaaccggguggacuguaguucgguaggauuucagaagaucaaguuacagucuguuuaaagccuuaggugggacaucagcggccaagcgggccauaaagagacauuuagcacauuuuucuauuuaaaagagacucagagggugaaaaauauauugaguuuauuuauucuugcuuggauugcaucugugaucaaaauaaaugucuaauaccauuuaaagaauguauaugagcuuagaagauaaaggaccaaaggccaaauaacagugacacuccaccaucauuccuucgggacuucucugccugguguuuuguguacaguuauucagacaauaaaaggcuucugggacuuaaccuuuccuuugaaaguuagaguucugccuuucauaccacgcguacuucagguagugcauguuuaugccagucccuccacucaguugaaaugaguuauaugaaucagcagcaaccauuacacagcaucuuaaggacugaaagauaagccucuugcucuuguucauccuuugcuuuggaagcaaacugcugucuugguuuagcagaugcuggauagcuggccauagagcacaccuuuaaucccagagccagaggcagguggaucucugaguuccaggccagccugggcuacauggagaaacccugucuccaaaaaaaaaaaaaaaaaaaaagauaauggauuuaaaacucuuguagagcugccuuuucuugauuccuggucaucaaaauaacuucuuucuaauauacccaauucuguaugagaauaauuuguacaagaaauuugagguauaguauauuguuuugcuugaaaauacagaagauaggcaugaaagcucacaccuuuaaucccaucacuugggaggccgaggcaggaggaaaggcaaaauugacagcagucgcaaaaaaucaaaagagagaagaaaguacgugcugugauuguuucagguccccaaagcugaucugagagcccugcugugggguuugguggggcuagaauuuacccagccuuacugagcagaguagugcacaguuacgguuguguuagggugacagggccuucagaaggcaagucaccugccugucagcucaaggcuguacauguagugagugcuuaauugcucguugucguuucauuauuugagggugucuucuaauugugacaagauggguauaaaauaguauuuaucauugugacauuuguacauguguuuugg

SEQ ID NO: 389 - RNA, 3056 nt, Mus musculus
cagcgugguuacugcccacgaacugggccucuucauucuggaauaagcaugaaaugguaaagggccaacccuuaccccacccccacccccuccaggcccaacaccgaagugaggagagggcaacaggggugagggaagaagugugcaaagaaaggguacagaugggcgggggggucccaaaaggaccuaagcagcaggagaccccccccaggcacaggacuccagcccagcagaccccccuccacaagcugaguccaguggcuguccuaagguaagguggucaucuucuggaccccaggcuggccuccugaguucugaggcacuggcuuagcacgccaugaagaacagccagcccuucuuugggcaugucucaaagccagaggucaaacagcagucugcagaacccagaaccaagggcuggaccagguaaggcccaagucaugauacuggaggccaggccuguggcucgcaagucugagcuggauauaacaacagucuuaguguccaggaacugaaucuucaugcucagccccuacuggcuucugcucuccgucucuggcugguuggcuccuuccaugaugauagguuuaucuuccucauguugauagcuucuggcucaucacauguagccaggucccaaccaaccaaaguggacagagaagcuggaaagcaagaacagugguuaggaugguugguuuauugcaugccucacaccaggucuucucaaccugucuacaccagaacagaaggaaauaaugugaccacuccuguuauccacagggaacagguuccauccaggucaugccacagacacuaaaauccgggggcuucuuucucuaaccggguguaguuuugcauauaaccuaugcaaaccucccauaugcuugcagucaucccuguauuauuguuaauaccuaacacaauguaauguuauauaaauugucauuaaacuauacuguuugggaaaugauugacaagaaaaaaaaaaggucugugaguguuagggaaacauuuuuucccccaaguauuuuuugaccagggauugacuggagaaauggacagaaggcugaugacaugcuguggucaguggaagcugcuuccuccagccccucucugcguccuaagggaucaugguggacccauucuuagcccagaggguuugcuuuacagcuucucuaugggggggggggcagcaaaccagagucucaaaggggcuggaacaccagauaaucccuaggcucaguugaccucuguuugcuggagauggaagaggagauggaugagguacuuugggugguguagcuggguucagagggaccaaagcuuccguuggagaaguuaagggcagaauuauauaaaccccagcucugauucccaugaggagggaguaguaucuggggaagagggcacacggcuaaaugccauggcuucuagguucuauucuuggucccucccuugagccauucuaaccacaaaccaacccccccaccccccaccuucugccuuuaggaggauuaagacaucaugaauagagaugcauggccccauccuguucucagccacccaucccucuucuagcuucuccuccucuggcccagcaugccuuuggccagcacucauggauaggccaggccuaucaucccugcaaugaugucccggccacaucucacauuccacaucucacacuccuuuaugcucccacaccucagcccuggagccccagauccauuaucaagaaugaguuuuugaagccauuggcucagcccagccuuccacugaggccccacguagggaccuaagacagcaugguuuuguucgcaagcccuuauaacuccuucgauaacuacaccguagugaguugucaucgcaguucaacacuuacauucuccagcaugcauucauucuggaagacagucauacaacgcaggaguccuauggugagugaaccaaucucugaggaggccuaucccacccgugcucucucuccgugcucccacccaucuuccucuccgacacuuggguuacauuaaggacccuccugccuggugcccuagggaaagggccugcucugcucacuuggcaaaaggcccggcuuccaaaaacacauucucuucggaucuacgcucuguuggucccaacaaccuucucugggaucguccagcuuugggauagaaaucaaagccccugguuuucuauagagagcagaggaggaagaagagagaggauucagugcucugggacucaccugacaugucuucugggcacggagaugggagagggggggcaugucgauaaaaugauacgccucaugguuuaggacacaagggucccagucccaagacucugccgggcccgcacagucuggauggccuguugauucuugaacuugaccaggcccagggugaucugagcguuccagccagggucuucgagggggcagcggaagucgaucucgcccccgccuucggucacuagcgugaaguagauguggcgcccggugcucucuacgcacuccacggcuuugaugcgggcgaagcugagcuccuugggccggccgcccgugcccuuggccucgaagagcugcagcccgcgcucggugagcacgcagcgcuuccgcuuccacagcugcagcagcccgccgcugcgcuucuccagcacgcccuccuucagcacggucgccgccgccgucaugggcaccccgagguucccacagcucuggaggcugcggcgaucccggcugucccggcucuacagcgccggcuucucgcgcccuggagcugguuggccuugcucccugugcggucgagccugcggcccgggccgccucgcagacagcggguaccgggaggcucgugcgaugcuacucucucgccgccggcuuggaacccugcgcgccgcuucgaccuccccgagccucuacccggugcccugcgccucgccgcccgcacgcccgcuccccugcgcuccgucugcgagcugggcggcugcuggcgggaugugcccuuacauguuccaccgcucgccuccugcgccgcccgccgcgcauuccugccccg

SEQ ID NO: 390 - RNA, 905 nt, Mus musculus
cauguggaccuauguggacaugggcucugugacacuuggccucugggucuuugaagccuuuuccuucccaccuucuagauguucuguguccuuccugucuuuuuuuguucuuuucuauccaauccuggacccgagguccucucaugcucaucaggcuguccccuacaggaccugccacucccuuagcuaagggcagcugaaggaggacuuuuguggucauuuggcacuucugcacccacauccaguauaacacugaauuccuacacugcuaugauuucccaggaaucguauguaauaguucugagaaagugagucaaugaaucuauacauugcuuccaaacauaaaguguacauaaagaugacuggaggugaagggccucccagacgacauccccuuccggaaccccaacaccuaugacauccaucggcuggagaagauccugaaggccagggagcaugugcggauggucaucaucaaccagcuccaaccuuuuggggacgucugcaacaaugccaaggugccagccaaagacaacauuuccaagcgcaagagaaagagggucucugaaggcaacucagucuccuccucuuccuccucuucaucuuuguccucuaacccagagucuguggcauccacuaaccagaucucccucgugcaguggccaguguacaugguggacuauuccggacuaaacaugcagcuuccgggcccccuugauuauuagaccucagagccgaaucaggaccucaacucaaaagacuaaaggaaaauguaauuuauguacaaaguauauucggauauguaucaaugccuuuuaguuuuuccaaugauuuuuacacuauauuccugccaccaaggccuuuuuaaauaaguaaagaaaaugaaaaagaaaaaaaaaaagaug

SEQ ID NO: 391 - RNA, 14998 nt, Mus musculus
agaauuugaauuaauguuaauacuuuuauaagcuauaaacacuaauaguauuuuauacaauaguugcuaauaugacuaugauuaaauaauagagaaaaauaaaaucuuucuucccauugaagacaaugacauuagaauaaucccaaagucacuugcuuauuugaauguaacauuuuggagcauuuguaucuaagucacagauauaaggacccauguucuuuuucucuagcauauagauuugaaagaucagugucaccuugaauuagaagacacacaucaaaaaagagugcuucuaggacccaggagcucagagcgcacacugucucaccaguccguugugcuagucuccaguuuucauauggaaagaguucaucccaacagauauuuacaguguaccuaccauggccauaaagaagagacaguauuagcacuaccucauuucuaaagcucuagguugguuugguugauacacucacaugcauccacaggagcucaaagaugcuuuuuucugagacauaaaauguaagauauucauuguuuaggucggagucuguagaaggcuucuuaucuccaagucguuguggcagucggaauggcgagaaagacugggaaaacgcauccacaacuucuucgguggcuucuggaacagaguacacagguuggugugaacguuccaagggagauuccaauuuaccucgcuaacgagaacaggcauggggcgggcgguacagguggugcagguuugcaucacaaacacaagcgugugguacagcaaggaaaggggucacugugaggugcgagccuuucagugaugcagccccacuaaggaggcagugacucacuccuggugaguaagguaggucucuaaauagaacuaaagauagaacuuagcugccagcugcccauacuacuggccacuucaaagaaaccuuagagaagucucaucaacaaaauauguuccucaugacuaugugaaggaagucuguaaggacuucauaacucucccuaacaucaagacuucaguuauaaucagccuagguaacuuaaugagacugucucaaaauaaaaacaauaaagcuuauugggggaguguuugccuaaaauuugcaugagggcugaggaccaacauaaugaugauaaugauaucaagggagccuaaagguaagggcaucaaaucuaggagguaucauccucacugucccugcucccuccagcuccucuuccagccucugugggugggcagcacugaccaaagccagacuagagucuagaaagugagaguacagcuaaagacccggagcagaggccagagugaggggacgagcaccugugugugcugaaggaccaggaaggauacgggguagggacagcaggagaaggagaugguuccaugcaccugcgacgccuuagcacacccucaguagccaagaaccaguucaaaacuguauuuacuuucuggcuucccccuuccccucucuauucuuuagcugcuuaguacaacuuucuacggucuaucugacagccucucuuuccuucucucucucucucucucucucccucccucccucuuucucauuuauuccauguguaugagucuuuugcccaugugcauguccucuuuccacuugcaugccugguaucugcaucaggaagauaucagauccucuggggcuagaguuagagaugguuaggagccacuguguggguucugggauucaaacccagguacuguggaagagccagcagccagugccaccucuccagccccagucugacagcuuuuagugugagauuggacaauauuuccauauugcucccucugccuuuguaaaguugaacaacccagaaaaaaaccuguuuuucuucauuuuugugugcacaugcagaaccaggagacaaccaguauaugcagguggugcugccuuuggaguuuuaaacagggucuuguuaaguauccuuggcuagccuugaacuaccugaauacugaauacugaauccagcuguguguuuuugaaacaggguuucauuugccugucuccaccucacuaauacuuuguuuuuuuaaaauauaguguggguccuaggggguugaacugacaucccugugcuugcaagaaaaacacugacugacugagcucucucccaagacuaccuucuggccuuuuacaagcuaaagccaaguaugguggcuuccaauggucacccucuuccaauggucaccugaagagggugaccaugaguuugaggccagccuggacuuaaaguaaugugagucagucucaagaaagcuaaaguaaacuaaggguuacucuugggcccguuaugcuuuaaucugacaaguaauccagccagacugggaagauuaaggagacaguguaacaguuauaagcaauaucuuauuucuaacacugccuucaugggacagcagcaaaaggccacaagaauaucuuccaaauguguccugugugaauaaaaccauguuguggcuggaguguagccacaccuaagggcuggacaugguggugcgcaucauuaaucccaacacuuggaaggcagaggcaggcaaaucucugugaguuugaggccagccuggucuagcuggagaguuccaggacagucaaggcuauuuauccuccuuccggucagagcucaguucucacuuggagagucagcaguguggcagcuccagcauggaaaacugacaguguuucugucuuagaaauguuauuucuguaacuguuguaaauguuuccugcaggaccaaagcuuuacaaggaaccuagugcaaaauccaauaaacacauaauacagaaugcuuuagcucauugcugucuggcuggaaaaguaaaugaaggucagaagaaaaaaauccuagagguaagcaugcucucaugaaaguuacaucucggagcuucccugagaagccucgggacucuucuggauggaugggugaaggggacgugcugugacaggccgcuagaguuggcagcaugagaagggucugcagugauggguguuaguguuagauggaguuacucuacucucagaguucuggaagacuuacaguuuaauuagcguacgguggcugagcgccuacuuagcauguguaggcgaucccugauaaugccaaaauacuaauagaaaguuugguuuuagacuaugucauaaguuuuaaccaagaaauauuaacaaguauauauaaacacuuaguaaaauguuacagcuucauuguuaucuuguuuuuguuuucuguucuaaaggaaauggagaagucagaugccaacaacuucuuaaucuuguuccgggauucaggcugccaguucaggucuuuguauacuuacugcccagaaacugaagaaaucaauaaacugacugggauagguccuaaaucuaucacuaaaaagaugauugagggacuuuacaaguacaauucugacagaaaacaguuuagccacauaccugcuaaaacuuuaucugcuagcguggaugcgauuaccauucauagccacuuauggcagaccaagagaccaguaaccccaaaaaaacucuuacccacuaaagcauaggcagcaggagaugcucgcuucagaaccuuugugguaaauuuguacuucgucuuuccugccuauagaaaaaccuuucuaauugccaacaagauuuuuaucaauuaaaacuggaccuuaacucuguuguugugaacaacuggaauguaaucacaguguuuggaaugccgacgguucuuacuaggugauaaguccacgcgaugaaggaaaugcuuugauucacaggcggagauuugcaugcuagcaggcucaccugccuguguuagagaccgugcagcacugaauucucauggacacagcgggacauaggcuugagguguggcuagauggcaauuaugugauguauucuuuuuaccccuguacugugugugcacaucgucaaaugguuucguuguuguugucgucguucuguucccucuccugggguuauucuaagcugccuuuguguuuguuuuauguggagaucaugaaaguagaaaguuccuguugaaaaguaccuugcaccuuucauaugaugguaagagagacacuaguauuaguuuuacaguagcccucguguucugaugguguuacaguauuugcaagaauccuucuaaguauuuacauucuguauuuauuauucacacaaguauuaacauuucucuauuaguaaggagguguuuaaaagcugcugcuggguccccugcagaccacacaagcuaacccagcacauccuguaagaggcugcugaugaaaucagugcugguugucucuacaccacuucugccaacucagaacaaaucagauuguacuuuuaacaacagagcacuuuguauugcauuuaaagugcgucacuguauaagguggcagaagugagugagugacacgugagugcugccuuucuguaugaaagcauacagcuuccuggcagcucaggaggccuuuauauuuauaaccgauagggaaauuauauuuaggauuuuuaaacaugcacaaagggcuacauuuugauuugaaaguagcuuccuguuauuuuacuuauacuggguuuucuuuccuuugaauccuuuuccaguggaacagcuuagauucagggcacacuugaaaucuccucuccaugaucuuucuucuuuagcaagcauaccagaguaaguuggggggaaacuucauucucaggaaaagacuugaaugauugauuguguggcccuuuuauguuucaguguugugacaacuguguacacuaguggggaagacauuguuuauaagugagagaguaguuuguuuucuuucaugggauauagagaugaaauauguacauuucucuaauuaaguuguuuagagagggaacucaugucucauguuauguauuuacuuauuuaaaaagaagaauggaaugggaagucccucagcuguacuuuucuauuauaaagccuuuagggaucagugcaucuggguuuucaacauuuucucaaaugcugucaauauuuuacuguaauuuauguucuuauauuuauguauauuuguuaaaacuguaaaaaaauuuuucacagauuuuuuuccaauaccugugcaaaauguauguguagcucaagacuauuugugaucuacugcuugcaugugagagaccaggauauguaacucuuauauuuuaaauguauacauacuguguauauauaaauauuaaaaacggggaauuucacauuuuaccuuucagacaccaauuuuuaucacaauuagaaggaaaugggcaaacaaagacauccuuacgauaagauuaguuuaagaguuauaaacaaacuuaaucaaaacaaagugaauuauagacaaaggaauuuaauaagcauuuucuacuacuaaccaaggucuuuucccuaucaaagcagccucauggcugucaccugaguacugaauaaagaaaagucaggugcaggacauugagagaacuaaugaacacugaccucgccugucuucguucuuccaucuguacauccagcaacugagcggaaugucuagugucuaaaggugugaugugaauauugccacaaaguucauugcucucaguauaagauuuuacuuuauuaaugcaagaggaauacagauauauuucuuuagucugcagauuuuuuuuuauuauggugcagcuuuuuaaauuauguuuuaaaauuauacaaaugaaaaaaugccauuccauaaaguuuggagauuuccauccaccuuacugaaacacaagcguugucaucguuggaggucaaauuaccaugguaacuacucaguuaaaucugccaaauccuugucaugguaaccaguguggccugucaacuccugcuacuuaccacaacuucuaaaguuuuccucucaguuucucaguuuuguuuaggaggacuauuguuuguauuuggcugcucacagccagagucuccuucuuugaugugacucauggacacuguugggcgaugugcaguguguagugugcuuccuguccacuccugagcgcugcagaugauccgucaggcuugcucguuccuggggguuacaguguaguuccccuuucaucugaauaaaagcauggcaccaacugacgcugauucuucaauaaagugcguguugucuugucuuguguuugauaacguuauuuggacucaggaaaauacaucaugaaguuuucuugucucagccuagguuuaaauuuaguaauugaauauuuaccuaaguaauuuuuaauauuaaauuaugcuugaaugccuuuugagguggcauugcgguguuguuaaguuucugugcuuugcucugaaguaucugucucuaugacucucacauguuuauguuccuuauacacagucacacuggcucuagugaguugagaauugugaggugugaguaccacugcgucuucaguguggcucugagccccucuacacaguggccaguucuguaccagucucuagcugucacuugugcucaguuuauucggaugaaggcaugaaauaaauccugauagccagaacaacccucaugcauaacugugcgcucagacacugccugagcucuuuuguaagaugcucaguccucagccaagugguuguggcgcacaucuuacucccagcacuuaggcggcggaaagcaggcagagcucucgaaaaaccaaaagauaaacaaaaaaagacacuugguccucagaguacaacuauacuuccauaagucuccaguauuuuaauuuuccaaaauaaaaacauuugauccuaaaaacugaguguaucagcagagggaggaauauccauaaacuaugaugcuuucccucccccuggcuaauaagcgggugaacgcugcuggggucgaggaaaaugccccacagcagacaggagcaucuucacuacuaaccccuauacagagauaaugaagaaaagcugaugaaucaaagagccucaagccuaugaccaggaauuagaaaaaaaauucugaaaugagugaaaucccaucaucccauagaaauagugcuacuuaaaaccagagcugugcuuucagaacaaggguuucuuuuuaaaaagaaaucagguuuuugugggguuuguauaaaucgauggaguuugaaucaucucauguuugcaccuuugggcaucuaggcuucucaaaagcaccucagcauugcagugcugugcuuagauaccaaaacuuagugucacuguugcacaugagcaucgaccaguguuuucuauuuguguuauagaaggauaggaaggacuggagagauggcucaguggucuguauguagucugguuacagggcagcugauguauucuggccucuagacaccaaaaguaccugccaguugguaaaugagucaacuaaagagacagcugucaaaaauagaguggccaguacaaguauuuacaauccuuauccagggaacugcaaaugaagacuaagauccccacucgugaauucacaguggcugccauugaaaggcacauuacaaaugcuaggcuagaaccuccagagucucuuacuuccuuuccuacuaauggaagaaccuuaaucccaggcaguaaccagaaccuaccugguguguuccuuguccucggugccauuggcucaugccaggcauaggucucccuccacacucugcucaccuaagcaccaguuucaucgugucaucccaguggugaaaaccuugauggacuugguaaacaucacuucccacagugggccucacaggcucaccgagcucacuuuuuagcauggcugaagcagauugauuuguagacacaccaaaacagaaaacuaagacauugcaagcuaucaaaacuggcugggguuggggggcucuaacuauauggacuucucuguaguuuccuguucagcauuguacuuuaaacuacauggagaacugcaguggagguggucaucuuaucucacagaauuuucguucgcucacacacaucuucagaaacccuuaaacuugcuuuggccuugacacguggcaggaugucacaaucugcauuuuaucacgguuacuaguacaggaugacuucucucuaaugccugcgcccugcuugagaggaagcccccuaagucccauucucuguguuaaguucccugauaacacaacccuugcccagaagcaggcaggggcuguuuacaaagucagucugaacggaaagugacuuuagaauugguuucauugcauggcagaaucacagcacugggcagggucagcccuuuuaggucacucuugcuaauuacuugcugugaauagcuagaaaucugcacuaaagugugaaaucacugagaagugauuuaccauuaaauguuauuuccaaacaaauucugggggcauuuuuacauugagggacuucccuguugcuugucuuuaaauuuucuggugaguuuguuuaaagcuacauuccucccuagaucuccaguucugcuccuacucuccucccccaugcccuccaagggccaccaaagaaauacagguauaucuagcccugggacaauuacacaccuucaggccacaaggcuuucacauugauucauccccuaagcuagagcccagugcuccugucugauucaagauaguguccauucccagcuaccccacauuuaguaccugaaaguaucuaaaauaauugaauaucuaagaugcuuaguaugagggugguguguguguguucaugcacauguaugccagccaucucucagugcaggaccaggguggcuacuauugauccccugugccccucagcacaugcucacaccuacaaaggaccuaaccccaauagaggaagaggaguccucauucccaguucaagcugcaucauuggcauaaaaacacacgauagggguuugcuuguuuuaacucgaccuuaggauucaaauucuaacuuccccagucaacugccuggcagagugcaagcugugguuuuaaucauucuaccaguuuaucaucuaacauuuggccccgagggauucgucaucagagugacaccaggagaguaacauuuuaaacugaagaugacaacagcaagaaacuguaagauuaaaaacuaagauagcugaggaaaagucuggaaaaauaucagaauugaaugugaucaugauucauccuaaauaguuuaugaaaauuaauaguaaauauaugaucauaauaauacauaaggacaugacuaucucaauaucucaaacuaaacuauaccaauuaaaagaaauaaaccacugaaauaucugaauuuaaguacuuaaaaauuuaagcaagauaaaaaaaaauucgacuuagccgggcuugauuggucccaccuuuaauacagcacucagaaggcagaggcaagcagaucucugugaguucaaagccagucuggucuacagaguaaguuccaggacagccaaaguuacacagagauccugucucaaaaaagcaaaaaccaaaacaaacagaaaacaggacuuuugaggacagcagacaguaagccagguacauucugaugucaaauauggcugaaacaguguaaaaucuacauaccuggagauacaauauuuuuaaaaauccaaacauuagcuggagcucaggaaaccuuacggaagaguugggagaaggaaagaggacagggacuccacaggaaaaccagcagagucaaauaaccuggacccucgggggcucccagagccugaaucaccaaccauagagcaagcaugggcuggaccuaggcccuugcaccuauguagcagaugagcagccuggucuucaugugggucccucaacaauggggaugggcugucccugagccaguugucuaccugccuguggauccuacaccccuaaauggacagccuugucuggccucagugagagugugucuaguccugcaacaacuugauuguguguguguuucaggggguauuagugugaggagaguuaacucccagaggggggcuucuccuuaaaagaaggggaagguggaaugggagggggacuuucacugggaguagaggaagaggcugauauuggguuguaaauugaauacauuuuucuaaaaaucuaaaaauuacgggagugcauggauuuuuuuuuuuuucagaaacauccuucccuggguggaaaaaauaucaccaaucuauuaaguaugauugugucgaagagucacaucugcggagauuuucauguggcguaaugaacaaggccaggacaaaauuuccuugaaguuuauucuuuguacagaaaaaaugaauuguagugugaugccuuacauagagccuacauaggggcagaaagaaaaagcaacuuccccaaacaacugagauuaaagguuguacacguuauucucucucccuccaaaacaauacagugccuggacagggccggguggaccacagauuagucagcccaguggcucccccaguacagaaggaggaggcuugugaggacccggugucagagaaggcuugggagggggacuggaaaagagccggccacuucugcuuagccucggcacacuggucagagugggcuucaccucggcugagaaagauggacacaucaauuggcuaacuuguuuguaacccuguggcaagugcuccucacgggguaaagagacuguuguuagccacuccucacagagccccugugucaggugcuacagggguccacccacacucagcacucuccuuggcucaggccuuugcugcuuucuucuccagggcagagaaaauccaccacaugugcccaaccagacuugccuugggcaugagaccacagccaggaaacauagcaaacaaccaacuucuacuuccccucugcccccugcugcccuccucucugggcagcugcccccagucugccuucuccccagggcagucccauauucaucacuggcuuucgugauuacucacgcucucugaacccugagauguacccacugggccuggccucaaccgucugggcuugguccugcuggucuuccagggaaggaggcggcagccccuuuggcuaaccaggagguaggcgcagcucaccaacaccauguggguggaggaacuuuaggagaaagcccaagucuagaaacugagguguccacaaagagguuuacucugcagccucuuuucccagcuuguagcuggcaugagagauagucuguaaaaaacuguugugccuuuuuagugugugugugugugugugugugugugugugugugugugcgugugugugcgugugugugugcguguguguauguaugcaugaguguauacaugguggggggugagccuguguguuauagcacgagugugaucagaagacagcuuggggagguagguucauucuuucuacuguguagauuggggcuugaacucagguccacaggcuuaauaacaagcacuuuuaccuacugagucaucucagcagcccaaggaaaaaacuucuuggccggaacagacuagacaugaaucccaguccccacacguuugauuuaauggauagguuuuugcaggacggagucaggugaggaaaauuaacucuaggcccuuuccccucacaaaaauguaaucuggcuacacccgcccucucuagcuuaaaacccccuacgcugugaaaacuggauugggauggaaauuggaaaccaucuagcccuccaucccacuuccuauucccugccagguggcucuguauaugaaaggaaaugacccaggugggguccugaggcucccagaauggagccacgggauccauugcugacgaugccucuuucacucucagacgugccuagguuuggaucauaagugauguuagcauccuacuuccaaucaaugucaaucugggugcacacacagcugcccuucugugcucuggcccuauaaggacagagacagcuaccacacuguuccaaagaagagacaucccagaucucccuccagucucuccacauggagaccuguacuguaucuccugacacauccucucuuuucugucccuagugucaauaacuaugucacucaguggcaggacucuugccuaaugagagugaaagaucuuacccccccuaaaauaaaacaaccaccaucuaacuccuucaugaauacaacagcccccuguggagucccuguggcuugaugagccuucccccucugugacucauacaguccugccaaaucagacugaugcccaaagccuucaggaucaggccacagccugccagugucuuccugcaugucucaguauacuugcuuuuuuaucccuuccugggcuggcucauccucucugcuuugccauuccuuuugaccuuuaaccccuuccuagacccgaccugaacugucgccccuucugcggaccuuuuccccgaagcaugaacagcuccuccuucuaagcgcugaguggacgugguuuuaaaccuguaccacaguuugacugauggcaggcuggccguugcacacacagccugugucucuccccuccucgagaagggaucugaggucaagaaugcauuucuugcaaugcagaggaagccagugccugcugcacagagagguccccugagaguggaaugggaaggaacaaagcuuagacauccugcaccccuuuagccacaaacccuuucccaucaguucacaagaacucucagagcuacugucucaugauuuagaauagcaaaucuguuggauuguuaggggccauuuugugucaucuuuuguauagagguuauaacccuguuugacuuaucagcuagauuuugaaguauggggaggaggaggaggaggguuaacccaggggccuggcccccuuccagcagggccaccugauuacacuuucugucucuagcuuagacccuuuccacacggcuccaugaggccuggaccaggacagaagugucacuccaggugacacgucuagucuuuuauccuaggaggcuauuaauuaguccaagaacuguggugccaauucuugaucgggcaccaagggaaucucccucaaccuucagaccccuucaagugcuacacagcagagcagauuagagaaggaagccgaggcguugcccucccucagaaacccucaugccuggucugucuccccacccuccacccccccucuaaaaacuagaaaagaaacgccuggugagaaucgagaacagguuagggcucuacggcacccacugccccuugcacccuaucucagagucccacucccuucccccagauacuaggccaagcacccagaaaugaugagccaccaauucugaguggccgcaguucucucagcccuaaggacaucucacaauacccaguugugcccuucccuuugggucagccccaacuuggaagguaacaucaccaccacagaggccugccccucccagccccacacucuucucaccccaaagccucggccuaggguggcaggaagggagggagggaggugcugggcacaggcugugaaaagcaaacccccuccugcucagagagggcagccgcccugcgccaggaugcacgccggcccggugaccccggccaugcaguccaccgaacccuggaguccuagcuggggcacguuguccugggacuauucgggcucgggcucccuggaccaaguggaguugugcccugcuuggaaccugccuuacggccacgccaucaucccagcgcucuaccuggcggccuucgccgugggccugccgggcaacgccuucgugguguggcuacugagccggcagcgcgggccgcggcggcugguggacaccuucgugcugcacuuggcggccgccgaccugggcuucgugcucacgcugccgcugugggccgcggcagaggcgcgcggcggccucuggcccuucggcgacggccugugcaaagucagcagcuucgcgcuggcggucacgcgcugcgcgggcgcgcugcugcuggcgggcaugagcguggaccgcuaccuggcggugggccggccgcugagcgcgcgcccgcugcggagcgcgcgcugugugcgagccgugugcggcgccgccugggcugcggcguuccuggcggguuugccggccuugcucuaccggggacugcagccgagccuggacggcgugggcagccagugcgccgaagagcccugggaagcgcuccagggugucgggcugcugcugcugcuacugaccuucgcgcugccgcuggcugucacccugaucugcuacuggcgcgugucgcgccgccugccgcgcgucgguagggcccggagcaacucccugcgcaucaucuucaccguggagagcgucuucgugggcugcuggcugcccuucggcguccugcgcucccucuuccaccuggcgcggcuccaggcgcugccgcugcccugcucccugcugcuggcucugcgcuggggucugacugucaccaccugccuggcuuucgucaauagcagugcgaacccggucaucuaccuccuguuggaccgcucauuccgcgcccgggcccgguucgggcugugcgcgcgcgccgggcgccaggugcgcaggaucagcucggccuccucgcucuccagggacgacaguucgguguuccggggccgguccccgaaggugaacucugccucggccacuugguagccuccccgggauggcgcagguggaacggugcuucaaagagaggaaccaugugcuugcagaugcgccaggggacugcccaucagcuuucucggagcuggcuguuggggcuggcuguucucacaaaccgauggggaaggaugggcuauuauauuaguuuucuccagggcaagaaaagcuguagacacucaccuggagaagcggguucaccuaguagaugggagggaaguggguucuguucucugcuucauucuguguaauucagcccaaauauccaaaccagacucucaaagguccuucuugcuccugacuguucuugccccuacaaaagccauuguccuuugaggaauuucuucuccuggucagcccucuagcaacaccaucucaaac

SEQ ID NO: 392 - RNA, 78016 nt, Mus musculus
caugcucaguguucccaucugcucuuuccauccagugccgcagccggaaaaccgcagcgacggcggcggcggcggcugaaggggagcgaggcguccggccacgggagggguagcggaaaauacgaggacaagcccgauaaggcaggagccgagggcccgugauuugauuugcggccucccccaggccgcugccuuggcccugagcugcgccgaggaggcgggcggcggcgaucggagcgccggagaagcgccgggccgcgggcggcucgcgcgcugcagcgauucugacguuuuccgcggcgggucccgcggcccgaggggcggccgugagugaggcggggcgugcgcgcuccgccauggcggggacacuguccgcgacgugaucguccaggcugcccccgcccgagcauuccgggcccucucagccgccacccuccugcgagcccgugugacuaaacggagacaaaggggaggcggaggggcagacccgggccggagcgagcgcggccgggugccgccucacgucuaugcccggggccgcggcggcucccgcgggcggcggacucgcgacgagcacagcugagcuuuuccgugcccggcgcccgggagggccgcgaccggcgcggacgaucugaacuccucucuccgccacaccaugugaaggccgucgucccuccaucccaaccagccgccgugaaagaugggggaugcugcagacccgcgggagaugagaaggacguucauuguuccagccaucaaacccuuugaccacuaugacuucuccagggccaaaaucgccugcaaucuggccuggcugguggccaaagccuuugggacagguaaguggugucgucccuuuccucuuccucccgaugcuguccacaucccaguuuuuguuccugauuccagcccccucccccauguguaucuuccgguacagguuuagggagaugacgggagacgagcucuaggagaaagaaagaaggcagguuuggucuuaaaugaggugcccuugacugacgcgggagggguugaccggguuccuuuuauugaauagcgugugucuaaauuccgcgagcaaauuaucguguuuucccaaaauggcucuaaugugugguguuuuccuuauuaucuugcauacguuucccuuucggucauaauugugguuaccauaccaagaaaucugagcuuauuacuggaagaaggugggguacuauauugaucuugacauuuguaauggugguugcuagucaggcuauguaggaugaaagguggucaguguugaagugcaguaucuuuuguaggcguuccuuacuccucucacagccuuucauacacauuccaaauucucguuaagccacccauuaaaaccacuuuuaguuuucugacuggauagugcuuuuucacuuaaugucacugaggcauauuuccuuuuccaaauguauuuugacgucauaaaaucagauaaacaaccccuccuuccuuugaauuuuucuuuuuugaaguagaagugguuuuuugggggggcuuggggcagggauguguuguugacauagaaauccuguaguacagcaguaauuaaacacucucucucugacccagccuucgcagaauaacaggaaagggaccuccugcuguaauuccucagcucuugcuuuaggagcccuuguuguggaaugcuuuaaaaaaaauagagaaguuccuucaugcuugcaaaauugucucuggguuguuugugggggaugacugauuucuuguuuuaggacugugaaaauauguggcuaagugguuuaauccagcuuuauuguuuaacuguauacauaggcaaguguuuacagagcuuguauaucuaggcuaaagacuagaugaauuccccccccccccccgucaguaaaaguauuuguagucauuuagaagaaauuuuuauguuuaugucugucuuaauuuuauuuuccuauacuuugauagagagcugacaucaggaaugaaugguuuuuugaacuagcuuaaauuuuaaauggaaaacaauaauaggaagcacagauaauacuuuuuaaaauuucgauaugaagaauuaggauagcaguauccuaacuauccauuuggagaacaacuggggcgcucuaaguaucuagagaacagggaaauugacacgguuuccuguguggaagcuggaagacagaggagcccaaaggcauuuucuuaccaucugagacggagagggcgcuuaaagugcagaggugaauguauugcuguucauucucacagaggcuucugagcagaaacgcccugcuuucuggaugugugucaggcuggucacuggagucuggugugcuugaacacacuugagaagaaagaaaguaaagguguguacugucagugggauccgacuucuuccaggcccucuguggcccuuggcauuguuuuaaguuaggauccacucugauggcagugugcuuugcauuaaagcaggagggagccagggcagcaauuggccuggagaaaagaucuaaguaaguccucaagagagugacuuacaaauugaaacagucuuuaaaauggcugugugugugugugugugugugugugcaugugugugugcgugugugcgcgcgcgcgucuguuuucugagagggucucacuuguguguucagcugaccugguacuugauauaaaguccaaacuggccucaaacucaaagcaauccucugccuuagugcuaggauuagaaauguaugccaccauguuccacguuugcuuugcuuuacugauagucuuuuuuuuuuuuuuaaaugauuuacuuuuauuuuauguguauugguguuuugccuuguaugugugucugagggagggugugggaucuccuggaccggacgguacaguugugagcugccauguggaugcugugaauugagcccugguccucugugagaguagucaguguucuuaaccacugagcauucccuccagcacccuuuggcaaucuuuaaaacauguaacauaaacuuacguauuauuuacauagaguaaauagaaaaaaagguuaagcuuuuuuaaaauauauuuuuugauggauuuuuauuugccacauacacacaacaaaguuaauaaacaaguauuucaaauuguuuuauucaaaauguuaacccagcuuuuuaggauaauguuguuguuagaaauaguuuguugucuuauguauuauuuauauauucugugugcgugcgaguguguccgugcuccuucuuccucacgcaugagaggacaacuugcuggaguugguucucucuuucccauguggauuccagggcuaagacucauguuguuagucuugguggcaagggcuuauacauugagcagucuuacgggucccuuucuaacuugauacacaaaaaauuaucaguuuuagagcuguauguuggaaaagcaauuuauaaugguuaacgcacagucaauugugggcaaagaauaaauuaauuuaauuguaacuccaacaagacacuagcaucgugauaccuagaaagcagauaugagguauuugugugaguaauauucuuguucugaaaaauauuccaaaggccucaucuuuugggguaggauguguuuucauuaguuuuuaguuuuugaaagacagugucucaugggaucuagacuagccuuggcuucaccauauaaccaagaauuacacugaacucugauccuccucccucaguuucuagagugugugcuggagauuacgggcuccaguccuaacaguuuauuuucucaaagaaugccucuaugcuuuuguguaaaugaagaauaaguuuguguagaugaauuuacagcagcaauagguguucugguuguaaaagaggagguugaauugccugauaaccuuuauuguguuugaagacuuaacauauucaagcagccauauaauugaaauugccuuaaauguuuuguuccuuuaaaucuuccagcugauggguauagaaucucuuggaagggauuuuuuucugcucccuaccccucugugugugugugugugugugugugugugugugugugagagagagagagagagagacagagacagagacagagacagagacagagccagagagacagacucaugauauagcccuggcugaucucaaacucacagugcucacaguguagaccagacuagccuggaacucacagacucuucugccucuaccuccuaagugcugggacugaagguauauacaccacugugccuggcgcucgcgcacgcguguguguguguguguguguguguguguguguguguguuuguguguuuugauacagauucuugcugugugguuuuggguagcuuagaauucuugugaguccuauucggccucuugauugcugagauugcacaggugagccuugauguccaccuuaaggcccauuuugcagugucaauuuaucauguuaacuuuaguagcuaaguuuucauuguguguguuuccaugugugcaugugacuuugccucuuuuccaccccuguggcacauaggcagaaucacucucugcuuuuugagacaaguuuucucauggaaccugcaguuuugcagucacucagauccucaugcuuguucaacaagcaauuuuacuuaaacagagccguccucccagccccucuuccuuaucccaucuaguuagugguaucagaccauuauuucuguuacuuaccagcagacauugcuaaaauccuauagaaguccugacucucagauacuuacagggauuguuagagcauuggguagccaugaggugaaaaaaagucauggggcaaaggcuguuugggacauuauugcaagaguuuggacaagaggugaugaggacucaaggugggguggauauaauaauaaaccugcuguauuauugagcacuuacuguuugucacacacaucacacauaguaucuuauuuuaauucucaugauggccuuaagagguggaaacuauuaaucaucccaguuuacaggguucaggagcucauccagaggcaucagaguaaugggacugggaucagaaccgggaagucuggcuugugugugcacucuuaauaguuaagaacuauuuuacaugugccaaagggauggaaaagaggcaaguggaagaagaaauccaauccuuaggauuucuugaagacugaauuugggauaagugggugacugacugcuuugaagaguauaaaugagaauauagccaccugaggaaucagagaaagugaaacuuggagacuucuugacuaggaagguaaauugugauaccaguuaauggagaggaagaugguuuuaucuuauuuuauuuuuuuaaguuuuauuucuuuauuauguguacagcguucugcuugcguguaugccugcaguccagaagagggcaccagaucucuuuauagaugguuaugagccaccaugugguugcugggaauugaacuuaggaccucuggaagagcaaccuuugagccaucucuccagccccuguguuuuuaugcucucgagcuaaguguaaguccaaguauguuuucugggaaguccaguaaaguagguagucacaaauaaagauaagacugcaguuuggcucaagcugggucuagaaauagcaguuugcuguucuguggauagcaacauauaaauaagcuuauguaugaggagacguaacuguggaggacaagggaaaagucgaggacaguuuaggagagcgagugcuuaaaaggaggcagaggcagagaggcagaggcagaggcagggcaaucaguuaaggaccguauuguggaaguauauaggccauugagauggcucagcagguaaaggcccucaauuuaaguccuaacaacuugaguuuggucuguaggaacuacacgguaggagcagauaacugacucugguaaguccuucugugacuuucacaggcacaccaugacauaagccuccccugccccaaauaaauaaguaaguaaaugacugaauaaauguucaaauguuuuagaagaaaagauacuaacccugaaguccugggaagaaaggugguuugacaaacugguuuuaagcuaaggugaaagucuagcugcauuguagucaugauaagagccguacaaugagaauagugacucagagcaucuuauguaaauuuuuuuuuguuuaguucugagaacaacucuauugagcagauagguuauuucuucaccuaagucucugucaggguuucccaacuguagagcuauuggucagauaauucuuuguuccaucaguguccucaguucuuguucaaaugcugaaaguauucucugcaccugcuggaaagucggaacacguugucagcuuuacauuaaggugcaaacaauguccacauugaaagcaagagguuaggaaguauaguccccccccccccuuuuuuuguuaauaaaagaagaaacaggcauggagaggcucauuacauuaucuuuggccauccagauaaaucuagugaaaaauuuccuucccaccuggacccugaacuacucagcuuuguccugugaaaggucauagcaucagacaucauuuucagaagcucucaugcaguacuccuuuaaaaagcugaaagguguuuuuuauguuacaugcauaucaccauaaaaaaugaaauauuggaaauagcauagaaaauggguuugaguaggacuaaaaguuaugacaggauccauuguauguuagagcuggugacuacagacagaugggggaauccauggauguuagagcuggugacuacagacagauggugggggaauccauggauguuagagcuggugacuacaaacagaugggggaauccauggauguuagagcuggugaguacagacaaauggagggaauccauggauguuagagcuggugacuacagacagauggagggaauccauggauguuagagcuggugacuacagacagaugggggaauccauggauguuagagcuggugacuacagacagaugggggaauccauggauguuagagcuggugacuacagacagauggugggggaauccauggauguuagagcuggugacuacagacagauggugggggaauccauggauguuagagcuggugacuacagacagaugggggaauccauggauguuagagcuggugacuacagacagaugggggaauccauggauguuagagcuggugacuacagacagaugggggaauccauggauguuagagcuggugaguacagacagauggagggaauccauggauguuagagcuggugacuacagacagauggagggaauccauggauguuagagcuggugacuacagacagaugggggaauccauggauguuagagcuggugacuacagacagaugggggaauccauggauguuagagcuggugacuacagacagauggugggaauccauggauguuagagcuggugaguacagacagauggugggggaauccauggauguuagagcuggugaguacagacagaugggggaauccauggauguuagagcuggugacuacagacagaugggggaauccauggauguuagagcugaugacuacagacagauggugggggaauccauggauguuagagcuggugaguacagacagaugggggaauccauggauguuagagcuggugacuacagacagaugguggggaauccauggauguuagagcuggugacuacagacagaugggggaauccauggauguuagagcuggugacuacagacagaugguggggaauccauggauguuagagcuggugacuacagacagaugggggaauccauggauguuagagcuggugacuacagacagauggugggggaauccauggauguuagagcuggugaauacagacagaugggggaauccauggauguuagagcuggugaguauagacagaugggggaauccauggauguuagagcuggugaauacagacagauggggggaauccauggauguuagagcuggugaguacagacagaugggggaauccaaggauguuagagcuggugaguacagacagauggugggggaauccauggauguuagagcuggugacuacagacagaugggggaauccauggauguuagagcuggugaguauagacagaugggggaauccauggauguuagagcuggugaauacagacagauggggggaauccauggauguuagagcuggugaguacagacagaugggggaauccauggauguuagagcuggugacuacagacagauggagggaauccauggauguuagagcuggugacuacagacagauggagggaauccauggauguuagagcuggugacuacagacagaugggggaauccauggauguuagagcuggugacuacagacagaugggggaauccauggauguuagagcuggugacuacagacagaggguggggaauccauggauguuagagcuggugacuacagacagaugggggaauccauggauguuagagcuggugacuacagacagauggugggggaauccauggauguuagagcuggugacuacagacagauggugggggaauccauggauguuagagcuggugaauacagacagaugggggaauccauggauguuagagcuggugacuacagacagauggggaaauccauggauguuagagcuggugaauacagacagauggugggggaauccauggauguuagagcuggugacuacagacagaugggggaauccauggauguuagagcuggugacuacagacagauggugggggaauccauggauguuagagcugaugaguacagacagauggagggaauccauggauguuagagcuggugaguacagacagauggagggaauccauggauguuagagcuggugaguacagacagaugggggaauccauggauguuagagcuggugaguacagacaguugggggaauccauggauguuagagcuggugacuacagacagaugggggaauccauggauguuagagcuggugaguacagacagauggagggaauccauggauguuagagcuggugaguacagacagaugggggaauccauggauguuagagcugaugacuacagacagauggugggggaauccauggauguuagagcuggugaguacagacagauggagggaauccauggauguuagagcuggugaguacagacagaugggggaauccauggauguuagagcuggugaguacagacaguugggggaauccauggauguuagagcuggugacuacagacagauggagggaauccauggauguuagagcuggugaguacagacaggugguggggaauccauggauguuagagcuggugacuacagacagaugggggaauccauggauguuagagcuggugaguacagacagauggugggggaauccauggauguuagagcuggugacuacagacagaugggggaauccauggauguuagagcuggugacuacagacagauggugggggaauccauggauguuagagcuggugaguacagacagaugggggaauccauggauguuagagcuggugaguauagacaauugagacuaggucagaaguggauaggaggucauuucauuuuugguuaauggaaaacccaauucaaacugguugacaauaaagaggauuuauugguuuauaaaacuacaaggguccuaaagugggagggauuuggauuugaauuaagugggugcuuacuuuguuuuaauuauuuuccuugauucuuuuagcuguaccuuucaucaggggaagaucucauagcuauagcuauaggugguccaggccucagccagaaaccucagagcccuuuccugauuauuacgugaaaguucugcagucuuuucuugccuuuuucuuaaaaccauuugaugguaucucaucuaugcauaguaacaguaaacuuuuuggacuuauuaccucugaagucaugaacuuguggcgagucuugaucccucuggaaacacuugcaccccaccaagcauuugaagcaaaucucagauacugcuuuaucugucaccaucucacuguaaugccaccaucucacugcuggcaccacaggccccgccccauagccaagcauuagcaucucuuacuguuucauagguucuuuaauuuuuauuuuuugguuuuuucaaggcagggauucucuguguagccaugguugcccuggaacucacuuuguagaccaggcugaccuugaacucagaaaucugccugccucugcuucccaaguacugggauuaaaggcaugugccaccacugcccagcuuuuguugggaucugugaaagguccccgugguuuaaguuucuuuguuuuuguuuuuuaaauauauagacucuccucugucucauuuugucuuucuugcaauuugcuuguuggaaaaaggacacuguucaacggaauuucuuggguuucagcuguacuacuccugaaaaugaacccaaagaccucguuauccuccacggaagcacuggcauauccauguuuauuacuuaugagaguagggaaauggaugcacccuaaaugcucgucaacagaugggugcugaugacagugugguaugacaguguggugcucguacacagugggauguuacugagcuuuagcagaaaggagucgugaaguugguaaagaacaaacgggugagucuggaaaguauaauauuaagugcagucacuaagacucaggaaaacaaauaacucauucuuuuacauauccaaauccuagccuauaaugcauacuugcauacauguaaaaauaaaacacacacacacacacacacacacacacacacacauauauauauauauaaaaucuguaaaugugggaggagccuaaaagucuccuuggaaaggagucuaagagaggguaauaauaucagaugaugaggaaggaaggauggugugcaggacacauggaauaugaaaggugaaaaaagaguuuuguaggaagcuacagucgggaacaggcuagcgcggaggucaggguggaugaaggauggagagccucaagagcaugccguucuaaguguuguaaugguguuuaacaccuuacaugcugaugagaaguagucuuggauuuuguuguuucgagacagucuuaugcagaccagucuggccguguacauccguggccagggauggccuuuagcuccgguucuccugcgccugccaggucggagcuugguaggcaugugccacuccagcuggcuuagugaaaugcuuuauuuagucuucaaaucuccaaaauuauuuaacaaguuucuuuuugucuucucuguuucuaaguugauaauuagauuuaaugaauugauuacauucagauuuuuuuuuaauuguauacuguguaggugaguuuuguguaacaggugacacuucauaucuggcugugauucugucaugauaucuucuuuuguucauugggaugcuccuuucaaaauaaacugcuauguguuguuugguugccccgggugcugugugggaaauuaacccucacgcauuaauaaccucuaagcacaugccggacagcccaccccagaggucugagaacagaaagcagacagagugacuugaaaugcuuaccucucaugacuuguuaaaucaauuuacaggaagaagcaaaaggaaaaagaugugcuagugaauauacugaggacaagguagaggcaggaagggccacauuucaaauucuguuagagacaauauuucuaugcccaucuuuucugccacuuuagcuuuuccugcuguuggcauggggaucaggaaaagaagugaaauuccaaggagccccuuagggagacaaaggccacugagacauggaaugagcacaccugccacaguggaagcuuaccaguaagcuugauuaaguccuggauuuuguguucauuggguagcaaacguauaggccaaaaugggcaucauugcuggauuaaggacucaugaauauuaaucuuuacagaccuuuucucuuugcauauuugcuguaccacaaauauuaaguaccauguauauguauauauuuguagcaugaauauucaguaucuaggagcuucaugaacaugaggguaucuuuaauuuuuccauucucucugucuguuagaccuauacuccuaacaacuccaguacauucuauuacgucucugcuugcuaaccuuucucuuacuugaaauaucuuaacacaguucacuuauguuucacaaacugcaaaugcacucauguuuuauaauagaauccaacagucuuaaaaguaaaggcacauugagguauagggaaggcgggauaaaugguacauucuuucccuuuuuuuuuuuuuuaaaaaaaggggaaauuggaccaaguugaaugaaucacuggccccugggaaucuaaauggguauaaagacuaggaagaaagaacauugcagcauggaugaccagaaugugcaaagacucuggcguagacagaacugguuccuaggagcugaguguggcuggcagagguacgaucauucucuucuuguaggcaagaggaaggauuuuaauucuuacagaagaaaaaauaauugaaaauccuugggauggauggggaucugugccaugaauuugcuuaugugaaauaagcaguuugacuggagagaaugacuuaauuuuaaauuuuauuuuaauuaauuaagaugugugugugagcguucaugugcuuaugcgcaggugcuuucacagaggucagcauacgugucuugcucucuugugcuccaucuuauuuuuaaagacaggcucucugaaccuggagcucgaugcuuuggcuauguuggcuugacaccaaagcccccaggacccaucugucuccucccuacucacccccccuccucaccccgcccugccccgccccaagcacugggguuagagguguaugcugucaugcucugcuuuuuacauaggugcugggaugugaacucggguuccuuugcuugcauggcaaacauuuaacucacugagcuaacugucucagccccagguagguaugcuuggagggagggcuuuagagugaagauggaaagacaaacuagugaaaauguagaauugagaugaacagugcugaucacauggaccagagagagauguuagcugacauggacuggcuucugaauuuuuuugagggcugagagggaaauaauaaugacagccuccuagguuucugguuuguacaauuagguaaauacuguaguucauuggugugugaaacucuggaaggucucccuuccccucccucuacacaacuacauguauacauuauuucuguauauguguuguaccuguauagauaaauacagauacaaauauaugugaccuuuguauuugacuauguacuuggggcauuguaccccaauuugcaccuaaguauuuugcuguauuuuuuuuuuuuuuaaagauuuauuuauuuauuuauuuauuauauguaaguacacuguagcuguccucagacacuccagaagagggagucagaucucguuacggaugguugugagccaccaugugguugcugggauuugaacuccugaccuucggaagagcagucgggugcucuuacccacugagccaucucaccagcccuguauuuuuuaacaguaagugauuucuguuaggaaaucuccauuaagagaacaggaaauuaugauauauuuucuagugcacaacucauguucaguuuuguuucaguguuaauuauuucuauuuuuuucucauugcaggaucaaauucaggaucaugcguuguauuuaguguguuuaaauucacguuuaaucuuuaauaguucuguaguuugucaugacaugagcauuuugaagccacaagcacugagcuacugcugagcggagcuuccagcuuuuuccuuagacuauaugcuaguccuugccaaaguacguacggugugugccugauaaaagcagccagauuucuaugggaguugacuggcuuacuucuuccuguguguugcuccucagagcucuggaaugcuggccuucccucagcagaugucucccuccaccuugguucugagugaccagaauggugaugagguccuggcaugggcucuggcuguggcccaguacaggagugccuggacuggacaaacagggcacagagaucucccucaguuaagcugauagaaacgcaguacuucuauccuccuugacuuucuuucucaccuucuuuucucuucauacaucccuguuacaguucccaccaccaccagagacaccugucucuccuacagcagauguguccuguuccucuuuucguagaacugucuuugcauuccgcaggacccuuggcaagggugucucagcacuugaagacaaaccaaauaacccuaaaggaccauguucacguagaagaaaucuuccuuacccacuacuuuccucccaagcucauagcgacuugacagccucuccucuguggugaugccaggaagguuuguggguugggggagagaagcggucgcuccuuuuuccauuaucccccaguacgugaaccuucaguguugauggcuuuuauuaaaaugcacuuuuaucuuggaaaaaaaugggucacuuaauuagagaaugucucugaacuuggauuuaucuaauguaaugauugaaguuaguaaaaaucugacaaaacuaccacaaagacauauguguucucaguaaauccgaucacgugacacgugguguuugucagagauguuuauuaugagaaucugccagcuuccuccauuauaaaacgauucuuuacauuuuuaaauaaaagucuuaguuuucuuuuaucugucugaaugucuugccugcauggaugucugcacaccaugcacgugccuguuaccagaagagggugagaggaugcuggguccccgggaagugggauugcacaugauugugagcuuccaugugaacaugaaacucaacccaggucuccugcaaaaaccaccuaugcuuuuaaccacugagucgucuuuccagccucacuuguuuuucuccccauuuuuagucaauaauucauagggauucauuguaaccuugcaccuacuauuuuagcaucaaguacugauuuugccugaaucuauuauaacuauugauuauugccaucauuucuccucauuuauuaguuguuacucuguuacaaggaauauaaucaauuacauuacuuugucauuaggcauuuuauuguaacucaaguuggccuagguuuagucaguaggauuccuuuccgucuggauccuaugucccuugacauaacugcaucauggacagcaucuccuucccaccuggcauucaugcucacacauacuuauuaccugugugugcacgaagauguccuaagcuagccugcacuuuaucuuuaccagguuuugaugggaaaauacuaaauacuaagaaucuauguuuauuguuuguggaauguuaauuuagcagaaagccaauacacagaacauauagcuacaugucucuuucuccauguuuaauccuuuaccauuucauacaacacccaaauuccuucuagucuuccucauauuguaaccccuuggucauggagaaaccugccuacugcugugaguuugcgguuucucuguggcaucgaagugaauuaaguguguugaugcgaauauaaggaucuggugugugaaagaucucaggucucaggguaauggaagcgggaagggggacuuaagcuugagaaugcuguaccgcucgagcacagcacacacacagcacucggcacauugcuugguaguaaaguucagagaaggaaggacuuuuuaauggacgccgucuguguuuaggggaugcacuuuauuuuaguaacuugucaagugccuguucuaugucauaguucugugcacuagugacacaggacauuagagugggaguaggcagaaagugugauguaaaauguuaggggguaguuaaaauugcuaaacuccaacuuuggggaguuggcucuuaauguucacccuguuggggcagguacucuaucguuccugccacuuuccucaggcuagcuggcaugugaacuucuggccucuucucccaucucugcuuccuaucuugucuuagaaguccugcgguuacagaucagacucagguugucaggauuagccgcccagccgcuuacucacugaacugucuucccagcuuuuuaaaauauccuuuaauuguagcuuucuuagauuccuggugcugugaguuucucuccuauuaguggcugcuuuuuuauguuuuucaggucagaguuugucuuaccuuuaaucgaagguuuuaaaaauuuguauauucaguguuugcaauuauuuuagaaacuuuuuuuuaagauuugaaaaguaaggcauucucuuccucucuggccucuuacugcugugagaaguuugcuccaauugcauugcaucagugcagugagaucagcagcugcccuggcugcuccccugcugccugagcaacugucuacugcggccacugggcucaagcacggccagugcucaugagccgcaauaccuagccagucagggcagugcuaacaugauugacacagugcuguuaaagaccaggcacaugagaaaaccuugucucacauccuuugcagcuaccucucauggugcuaucucacucagcuguucuauaacuaugauuguuuuugcuuuuauucuugaguucagaaaagaauaaaacacucuaccuguuuugcccacuucuuuucuaauauguuguuucugcucauuuuucaaaaaauaauuacauuuuugaaaaauaaaacauaguccauuauaaucuguuuugagucuauucuuuuuuuuuugguuuuucgagacaggguuucucuguauagcucuggcuguccuggaacucacuuuguagaccaggcuggccucgaacucagaaauccuccugccucugccucccaagugcugggaucaauggcgugugccaccacgccuggcuugagucuauucuuaagaaugucuuugaggguuuguuuuagaugguguggugcuugucaucccagaacuuaggauacucugauuacugucaccucccacucucuuugaaaccccaauccuucugaccuccuacccacaauccuucugaccuccugcccaucccucuuccuaugaguuuuuugcucccauucauuuuguuugaugacuuggugaguuuaaccaggaccaugugugugaccagggcuuuugagcuauuuauuggaaccucaugggcugacucaguggcauauacaacuagaggcaaugucuguucucccagaauguaugaguagccaaggagggcagggcccuaugagauaaauggcuuacuguuacaggcccagucuuguguaggcucgcugcaggcagcuccagcuguggugagaacaugauugcauuggcuguguuaugccuggaagauggcuuucacagcccuacguccugucuuccagcucuuccacccuuuuaccccuucugugauguuucccaaaccuaagcagugguuccuaaccuguggauugagacucuuuggagagagagggguucaacaacccuuucacaggggucgcccgagaccauuggaaacagaaauacuuaauucacaacaguagcaaacuguaguuacgaaguagcagugaaaauaauuuuugguugagggucaccacaacaugaggaacuguauuaaagggucacagcagaaggcugagaggcacugccuuagaggguccgaaugucuuuugggcggaaccaguuugaccaucaucaccuggagcaccugucucuguacugacugcuguucacuguaaagagcuucccugauugaggcugaaggcagccuguggauguaaacagguaucaugaaagcagcacgggaccugacaacuuguguauucuuuaagggauugaaaaauacuuuauaaucauauuugaggcaaccuuuguuuuuguuuuuguuuuucugagacaggguuucucuguguagcccuggcugucuugccccaagacauaccauaaauaagaaaucuagcucuaaauagaaaauaggcuaaaaaauagcuuugauauuccaagaucaaaaggauggaagguggaagaugcaaggccuaguggcuauguuuauuuuaaggcauaccagaaaccucaguuguaaaagucucccuugaaaacagcucugguacaaagaaaagggaagcguuuagaguaaaccaaagagugcuacaaaugaaggcagguguggcggcgcacaccuuugacccugugcuugggaggcagagcagggaucucuugacuucaaggccacccuggacuauaaaacuuacuaguuuuuagccuauuaccuauuuagagcuagauuucuguauuuauagcugcaugucuuggggcaagauagcuucuuaaguuuaucaguuaaacacauauaaaaagguuguuaggauucauguuuagagcaaugccugacacagaccguguacuuaguaaguguaaguauuuacuucuguuauuuaaucuguacauuaucuacuuaucuguuucacuaagauuuucacuguguaugaaaauguaugaauagaugugaaaccauuaaguaaacguuacauggauguauagauacauaugugucccggcuaauuuaugucaacuugaccaagcuagaguaguuugggaagcaggaaccucaguugagaaaugccuccaccagauuggccuggcaagucuguggugcauuuucuuguuggaugauuaauguaggaaggccaagcucacuacuauccaugugcugaugguccuaggugcucuaagaaagcaagcuaggcaaacugugaggagcaggcuaguaggcagcacuccuccauggccugugcaucaguuccuucaucuagguuccugccaugauuucccucagugaugaucaguaguauggaaaugaagacugaaauaaacccuuuccuccccaaacugccuuugggccuucuaucacagcacagaacccuaggauuguaagccagauaagcuugcaguccuggucacucacuguuguuuguuguuuguuuuugcauuggccaguguuuagaugucaagauuaccuauguuaguaauuuuuacugcuauuauaggaaguaaaauauccauccauauauuucauaacaauaguuuuaguauguuuuucuuuuuucuuuuuuuuuaauaauaguuuuucuuuaauaguuuuucugcuguguuaguagcuuauguuuagguacucugauacuaaaauguaguaccacuacugaggucugaaguuuacaauacugagcccuauguugaauuuaaguuugccucacucuugggugagcagugcagcuaggaaggaggagcuuucaguuaucaaauguggaugauauuuuuagaugucuccaaaaucucaaauuuauagauuugcucugaccucuuucucaguccuauauuuucugcugcucacuggguauuucuauuuggauauuuuugcuguuguuucaaacguaacaugucuaaacugagcuuacccuuucagugcggcuucugauucucaguuuucuauacuauacuaucaugcuuucuguauugguuacuguccuaguuuagguuuuauugcugugaagagacaacaugaccauggcaacucuuauaaagggaaauauuuaauugggucugacuuagaguuucagagguucaguccuuuaucaucguggcaggaagaguggcagugugcaggcaggccugcugcuggaggagcugagguuugugucuugaucagcagcagcaggagacuguauuauacacuggguguugccugaacauagagaccucacccaccuccacagugacacacuuucuucaacaaggcaacuucuacuucaacaaggacaccuccuaauagcgucacucccuguggccuagcauccagacacagggcccauuccuacucacacuaccgguuacuuuucuguugcugcaguaaaacauggaauguuuccagaugggugagaguuuaucacggcagggaggcacggcagcaagaggcaggcuuggcaguagggacaggaagcugagcacucaagucuugaauccccagcacaaagcagagaacaaacuggauguaggggaggccuuuuuucuuaaagccugucccagugacauacuucuuucaacaaggcuguagcguuuaaacaugccgccagcugggaccaaggguucagaaucuguggagggcauucucaaucaagccacuacacuuuacgucuaaccucgauuucauccucucugauuuuuaccuugaucucugcugucugccugggugcuuucugauuguuuuuagcaauaugaugucuucuguguacucacuacgggcuucaaauuuacuucuuuauccauguaaaguaauguuccaucaaucuauaauuuuuauagucaucaguauugauugaaagguuuuaaacagaagaucuuaucuaaauaauaguuguaacuauuauuagauuaaaaugaacuauuauuauuaauaguuccccucaguaacuucaguagucgcagcagaaagggacagagaccgguuggugcagggccuagggggcuuaaggaagaaggaccagauuaauuaggcagccucaguucuuucaugcaguagcuguaaagcuuugggcaaaggauuucuccugucagaugauaucggcagcaagcggucuuuauagagcaggugccuuuccugacugacugacugacugacugacuguagcuagucacuggcagguuuaagagccuacuugagacacugaauggggggggggggggagggggcaugccuucaugggucaccacacucugaagacuuucuccuuguucgcuuuuccuguuguauaccucacagccauaccuucuauaaaggaaauuuguaucuuuccuuuuauaucuuaaaccuagguagaaaaacagacaaacaaaaguaucaucuugccuguuaaaggaauauugauauuuuuagaaucucaaggucuguaguaauauuuuaaaugauauaggguuuuuuagauagaaauuuuacaaaaauaugaaaacuuguuuucuuaaccuuuauagaaaaugugcccgaggagcuuggcgacccauuuuacacagaccaguaugaccaggagcacaucaaacccccugucguuaaccugcuucugucggccgagcuguacugucgcgcuggaagccucauccucaagagcgaugcugcaaagccccuccugggccaugaugcugugauccaggcauuagcacagaaaggccuguaugucacugaccaggagaaacugguaacugaaagagaucuccacaagaaacccauacagaugguaaggcuuugcauaccuaagguuauuucagauuugaaaugcauacuugagugaguuguacuauaaaauggaaggaacuaaugugugagauacuuuauggcaucugcaucuacaccuagaguuuaaaagucaccauuuauuucuaaguaaaggaagauuugacaaaccaucuuggaauauuuguuuccaucuaauaccuagaagaaacaauuauauaaauucaaacuauuaugaaauaauuuuacuuuauuuaaaaauuuucuugucuuagagauuagcuguaagaaaugggaaauguauccuugacuauuuuuguaaggcaagaauuuggauuuguaaguuuuucugcauuggugaggggcuauagcuaaauauuagaauguuugccuggcacuuaaaggccuugccuggguuucauucccagagcaacauaaaacuaacauguaaggugcuggagaaaauagcccauacgugugaguacuugcucugagcaagcaugagaagcagaguuuggauuccagcagccacguuaaaggccaggcaucguccucugcaggccugugacugucauugaggggacagucaggaggguugcuggugcuugcuggguuaauagccuagccaaaacagagcuaagugagacacccugccucaaagacggaggguguuagauguggaugccuaacacccuacuuuggcuuccacguguguacaccuaugcauauauacauaugcacacacgaaaauaauauuuaaacauguaacgggaaggggcuagagagauggcucagcggauaagagcacuggcuggaaccaaauccaagaggacccggguuuggucccuagcccccacauggcagcucacaacuuucuguggcucuaguuccagggggucucacgcccucacacagacauacaugugguaugcaccagugcaaauuaaaaaaacuguaaugggaaaauuggaaaaaaugacaaauauaagcauuuauguguuucagucaugguaaaacucuugcacauuagauauuuuagcuuauuuaacaaccauuaacucauuucuuguacaacauacauacagaaggauucuaagugggucugggauaaguaugcagggagucauagguaaucugaagacauaaaucuaaauacauuuauuaaaucuaaguacauuuuccaaaaauacauguaucaucaagaauguuacuaaaaagcaggucuugugaaauggcucaguggguaagaguucaaauccccagcaccaacaucagacaagccaggugugaucauguaaccccguaaccuaaccauccugggguaugggaccagcacagcucugggauuauuggccccagccuugcucccaccucagggcaaggcuguguggaagaguaagagugauggagcagagccccaacccauccuguggccucugugugcacacaagcggacacaccuacacauacacaaugauaaaaggaagaaagcgguguuguguaaauuauuuuucaugagaauaguagucuugggcugaaggacauguuauguagaaggguguauuuuaagacucaggaagaggaaacacagucaccaaggcugguacuaucuggaaaugauuuugcacucacucuuucugcuauuaucucucuuuaaaacccucacuuuaauccucuaaggaacugagaacagcuucucaagguaacgucacuaaguguauaauaaauaaggcuggcugagcagauugaucuucucucauguaagagaguuucaguucucacugauggcaucagacucacauggcuacccugacauguggacauguaugcaugucauguguaugcaugucauguguaugcaugucacgugcacagcauucacuagcucuagggauaauuaaauucugcucgugaauaugccacauuuagcucuucaggguuuacugccuuaguuggauucagauggcagcaacagccacuuauaauugggaguuucaagguugcauagauaguuaggagcacacggcagagucugaagcagcacuugguuaggaugcggguagguauggcuggguaaccccauguucuuagcacugcucacagccucaguccuccuuaauaaggaggcagacggaccacacuuugcacagucuuucuagugugguuggugugugaagauauacuaugaagacacuuggagacuaaguuacagauaaagaguuugguggguagccaauugcauuacuuagguuucuuucaucccguaaagccugcugauaacuuugaauguuuaauauuuaaagacuaauuuaaauaacauaguuucccuguuuuucuggcucugacuuguaguuuguuaaaacuugagauuagacuauaucaccuuaacccuuugcagugucauauuuacugaccaguauuuuaaucauauacuucaaguuuuugucagaauuaaagauuuuucaauuguaacuuuuauuuucauugcuauuguaauauuacacuacucuuuuaaaagccuauaugagaacguuuuacuaguagaauuuuguuuaaaaccuuuuuaaaugugaaauaagaguuauuuaaaauaccaguugcagggccaggcgugguggcgcacgccuuugaucccagcacucgggaggcagaggcaggcggauuucugagccagccuggucuacaaagugauuuccaggacagccagggcuacacagagaaacccugucucaaaaaaacaaaacaaaacaaaaaaaaaaaacaaacaaaaacaaaaaaauugccaguuguucuuugccuugcuuuuguauugucuaaauagugcuuugacucagcuugcauguauugauacuggauucuacaacuuugcaauucugaauaagcugaguggguuuaaguaucuuuuauuucugugugcugccucauagcuuugggggccggggaagauaauaguagcagaaguauuaucuuggcuuuuuaagagauagugcucuuucugauucuuuuuuuuaaaaaagacuauauuuuguauaggagugcuuuacccacguguauauguguucaucauguucaugccuggugccuauagaggccagaaguagucacuggguuuccugagaccggaguuacagaugccuaggcuaaggcuuggggccauggugcucuguagaguagccagugcuccugacagacagccccuucauucuuuaguaguaguaguaguaguaguaguauuaaagucuaaggcaauauaaaaguuaaagaacuaaaugauuagucuucccugguuuuggcucuuccuucuaauuguugguuguuagagccucacacuagacugcaucagccucccugcaguuguaucuagugugaaaauauucaucagauguuaaccuuaguuucuucugggaaaugggguuuagauggggugagagagcuccagaguuuuaugucacagucauaccaccagcuagggcucaucagugcccuaagugucuuaccuaagcgugcccugcucugcaguaaagccaguuagaaucuggacagagcugcuguuuucuaaagcacauuugcacacuuguaguuuuuuacuuuuauuuuuguuuuuguuuguuugagaugggaucucuacauagcccuggcuguccuagaauucacuguguagaccaggcuggucuugaacucacagaaauccaccuguuucugccucugaauacuggaauuaaaggcuugugccaccacaccuagccaguuuuuagaauuacauguacccagguaucaucuagacuagagacugugagagaucaaacucucgguugugaauuaauuucuuaauuuccagccauauuugugcauguauguagggaaaaaauugaugggacuggagagaugacucagugguuaagagcacuaacugcuuuuccagaggucugaguucaguucccagcaaccacaugguggcucacaaccaucuguaaugggaugugaugcccuuuucugguaugucugaagagagcuacaguguacuuauauacauaaaauaaauuuuaaaaaaaugacauccauaaaacucuuaaguaaauguacauauguauauaauggaaugagguugauuuuuaaauaggacuuauauaacaauguuuguuguuuaaucagauuuuguuuaggaacaaacauuauuguauaaaucaagguauuuaauuuauuuucccuguuuuucauuuuauuauauuucaaagacucaaccucauguucucuaguguacccacaaacuucugauccuucugcauacagcucccuggugcugggucacagauaacaaccaccucaccuggcuugucaguggugggcaucaaaccagggucuuccugcauguuaggcaagcauucucccaucugagcuacauucccagccccuagaucuuauauugaugaguauagaaaugacuaauaaugaaaaggagaaguagcuuauucugguuacuuagugguaauuaaaugggaugaucugucguugauaaguaaggcaucaaauguucucuucuggggggcuggagagguggcucagcgguuaagagcacugacuguucugaguucaguucccgucaaccauaugguggcucacaacuaucuguaaugggauccagugccgccuucuggugugucugacgacagcaacaguguauucauacacauagaaaaaaauuaaucuuuauaaaaauguugucuuuugaaaugcuaaaacucuuauaaggaaagcuuuauuuauuuacuuguuaauauuuacuuaaaauauuuuuagugggagggugggcagagucuuguuaccuagcccaagcuggucaaaaauuaucuuaaaugaucuuuaaugaucucagagcaauccuccugccucaaacuuuuugaauucuguaauuauagguguaaaccacuaucuagcacucuugcacacuguuuuauuauauuacauccucaaggcagggucagugaguuuguagcuagaacacagaaagacaguggaaauaucuuacccuccaaaaggguuaucuccauacauaaagaagugggcuuuuuaaaaaucauguuuuuaaaagauuaagcacugaccacugagagaucaucuucauuugaauaaugugcuuaaaaaacuuaggaaaacacuggggcaaaucacccagucaguuggcaggaaaugugugcucagaacccugugucuaagcaguagacccugggaaccacaaaguaaauagaauuaucucuguuggucccaggaaaagcaucguaggauagguuaaguaagaagaugggugaacauggugccugaauugacggaaguaccuuguuuaugacaacuuaaaagugugaccacauaugggucauacauagaguacacaguuagauugaagagacgggagcucaaagugacaagaucacggaauaaauuaucauaguugucuuuacaucccaccccacccccaccccgcgcgcacgugugcaugcguguguguguguguguguguguguguguguguguguguguguguauuaggucuuuccgauuuuccugcaucugcuuuucuguuuucuucccagacuccuugguagcucuuucuguuuguuuguuuguuuguuugcuauguaccaugcaguaugcuuauacuucacacaccugugcucauguaacgcggcucuuaaccaucauguucuccugagaaagagacgggcuuuaagaaugucauaccagaucacaaggacaggacuguggugacaagagacgaaggucucacugcugcaccuacaguauuacaguaguagugaagugaggaggaggccauaguuucuuaucaagguuuuaucaaaaugcaugaacagaacuuggcucuguaauuuuauuuuuaaacuuuuuuguuuaugauuuucauuuuucucuguaugaguguaugcuugugcauauaugcacuuuguggcugcaguagcucauggaggccacauguauaagugcuaggaaccaaacucagggccgcugcaagagcagaguuggugcucuuaacacagagccgccucucuagccucugguagcuguuuuuaaacagaguccuuucccuuuaugcuagaucuuacucuucugguuucugcuuauuguacaccuaauuuaaauucuccuuuuuucuggguagcauauuauauaugccuuuguuuuuuuuuuuuuuuuaaauuauguuauuggggcuggagagauaguccaauagauaaugugcucacuguacguuuuaaggaugcagaggcaauaaacccaguccuccucuugggccaaguuauuguuuuuuauuguuuguguacaugagugugugugugauuuguguguguauguguguguguuugugugcacacacacaugugugcuugugugcguguauaugacagagauaggaagaaaaggauaugagauugaauaguuguggaggucagaggacaaggcuguagaguuguuuuucuccuucuacauuuguguagguucuggaaaucaaaccagguagucagguuuguauggcaagcccuugaccuacugaaccaucuugccagccuugagccagguuuugaaaugugugaaggaauuuacuagauagggaaaugaagggugugauguugauaauguaugugggaauauaaggcagugcugaguuguagcuuuagcaucacguucauacugacaggaaguuauacuucaggaucgauggacacagcaccugagugguccuucuugcugugagaaauuugacauucuggaagugaggaagaaucacacagaauagagguuuaaccccacaaaggauauagucaguuuguguuucagaaagccaccuugcugguagguggaagaaaugucacuugggaguuugaaauuguuggggccugaacuacagaagacaccaaggagcuggagaacugcuuuggggcggggcuuguuuucugcauuacugaggagugagcuuagggucuaggcuagugggagauuuacuauauucggugccuacaagaaggcuuucuuaaggucuaugggauggagcugaauuuuuuauuucucagaguugggaaauaaaaaagagaaguuaaaaagggacaggacuagggaaaaaaaaacaaccaguaugucaccuuuaauuaguuaauugguaguuaaaaauuagaaguuagccccuuaguuuuacuauuuuggacucuaggaugagauauuguuuacucuuagccccuuaccccaugugagucugugucuguccgugucugugacuccuuuggccucauguggaagucagaagucaguaucaugauguccuuucucuuuggagguggagucauucauagaaccgcuggcuggcaagcaggugcccagaacuuggccugccucuguuccccuugagcugggauuacagaucccugugacugugcccagcuuuuuacucuuaaaaauuguuauuuuguuauuucauguauguggguguuucuccugcuuguauaucugcaccauaugcauacguguuucccauagaccaggagaguucuguaugcccucuuuuuuuaacuuaaaaaauuguuuaaaaagguaagaucccuaguagauuucaucuuauuccuauagaaugaagcuaaaguaaaguuucuccgcagucgucccaccccgcugaguaaccccgaacugcuuuuacgcagaaccccuucugugaagacagggccugcggguccugauuaucaccauguucuuagagccuagccaaggagaugcaaaaucagcaaacauuugauauauuagugaguuuuuaagaauuaaauacauuuggcaagaucauaucacuuuuccaacaaacaaacaaaaggaugcagucuugcugugcucuguuaggcuugggcucagagcucaaagguuucugguuugcugagguaaaggauuagagccccugucuuuguuaggguuucuguucuugugaagagaugcuaugaccacagcaacuccuauaaaagaaaacauuuaauuggggcuggcuuacaaguuuauaguuuagacaguuacugucauggcagaaagcaugguagugugaagauguggugcuggacaaggagcugagaguucuacaucugcauuggcaggcagcacugagaguaagaugcugggcauggccugggcuuuuaaaaccucaaagccuaccccuagugacaagcuuccucuaagaaagccacacccacuccaacaaggccacauuuuuuaacccuuucagugccacucccugugcaccuguugggccauuuucauucagaccucaacagcucccuguugcuguuugucucuguagcucugaagucagugucuagugauccuucaggccuccuuugcacacagagcucuugggagacaagccucucuacuugcuaggcuauuaggagacagccacagugaugucacagugucacuccaucuugucuucugauaaagcugaugccacacagccaccuggaaaagauuauggggcaagcuuccccucagaguuucugcagguucacgcagcuuucucgggugcugauuuugagauaauaaaaaacaguuuaguguaccuuuggaacuuguuuuagauuuugaaguuugaggcacaguuuuuggcuuagaagcaaguauucuuggaaaacuuacaaauuuggaaaacuauaaaaaacagacauuuagaaauacaacauacauaacugguugcaaugcaguaggcaugccaucuugugcagggagagaacgugggugccauuuuccgcugagggcccagguagcagcaguuagcugagcagcgcuggacgcuccugagcugcuguguguacgcugucauaaacagaagccuguucagcucauuugaguauauucuugaaaacacacucucuucacuuaagcugcgacuuguuaaaugcaauuuacucucaggagcuuuuaauggagccccuggcucauggucuugaugguuaguuuuuccuguuaacauguuaacauaucugauugguucauuggaauuucauuaauuccuuaaagucuuaauuauuaaaugauuaaaacuaagucuaaagaguauuuuuagauuuuauuucuuacuuagacuguauuccucuauaauaagcuucugucaacauugcaaacauaaaaccaaacugacuguaaaccuauaaaaauguuccuugagaaacuuuuagauuacuuugagauauuuuuuauuugaaauuuuaugaugagaaauuaaauguuuauucacauuugaaaaauuguucugaaucaauacauaguaccuguacauauuugugggauaagcaugccauuucgauauauaaacacaauguauaauuacagguucauaguaauugcauaccuguugcuccagacauucgucauuccuuuaugguaggaaaauuaacaucccuuuccugacuccccugccccccccacacacacacacacauacacacacuucuuuuuuaguauguguguguaauguguguguucauaucuguauauaugugggugaguaccagaggaugcguuuacauguggaggccugagguggauaggaaucgccacucuuccacugucuucaauaaggcagaucucucaguuaaacccagagaucucugggcuggccuuauagauugcuugcucuggggauuuuuucuguuccuacuuucuaaggcuagaauuauagacaugcauccacaaccaucugucauuuucauggguucuugugauccuaacucgauuaagaauuuaacaauccccuucuacuagcugucuagaaauacucauagucaaucaguuaguucauugugcuauagaacauggaguuuuuccuuuuauccacaugagccucuguccccaguagaucucuucuauuuucccucccgacauuccuccuaggcucugauagucauucugugugcuacacuuuauuguuuuauuuuuuggagugacaggucucuagcccaggcugauacuauccuguaucaguuuguccagagagucuugcagucuguaaugcaaaccauucaccuuuguuauucucugucaaaauuguuauuucaguuucuuuacauuucccuauacacucaaaacagcuuuucacacaggcacacagcuagcccccacuuguacacuaaagaaaaaccaacaaagaauaauacugucuguaggacuuuugaauauguccuuucuuuuugcaguuugcuaagaaguuuguguauaugaaucauaaguaaaugguuuuuuuuucaaguguuuuuccuuuuguugagaugaucacguggguuucuuuacuuaucuuguuaauaggugaacuguuuuucaaauauuaacaaucuuagauguuaccuugucugguccugauauguuagccucccuuccauacauacacacacauguauacacaugcacacacacacacaaacacauacacacauaugugaauaauuccauucauucauucaguggggguggcagggagggagaaagagagauggugagagagagaggagagagguugcagugucccuuuguggcucuucaguggcaguaguucuaguggaaguguguguauaugugugagaaagcucucucaaccuuaucccuuccuuccuuccuccuuuaucuccuuacacuuguuuuuguuuauuagggcuugacagaaaugacaccauuaugacugacaacuuucaccuuuccuucuuuuggugaagaaucacugaucaauaauuuugauugagccuuggugcugagcuguucuauuaaauggcucacauucaggggaagugauuuuugaguagacaccagcagcaaaacucccuccgaucauguucaggaagcaggaggguucaggaguaguaguuuacagauugggucugcccggcguucacuguuccguccagugguuuuccuuucccauagacauccacugucaccugcagggcugggccagcauggcuuuuaguggcuuuacuucugcagaguuuugagagggaauagggaugcaaacguuuaaaaggaacuaauguuaacaaaaagaaagacuaguaagaguaugucuuagucagggucucuauuccugcacaaacaucauaaccaagaagcacuuggggaggaaaggguuuauucagcuuacuaugcacauugcuguucgucacuaaaggaagucaggacuggaacucaagcaggucaggaagcaggagcugaugcagaggccauggagggauguucuuuacuggcuugcuuccccuggcuugcucagccugcucucuuauagaaccaagacugcaagcccagggauggucccacccacaaggggcccucccaccuugaucacuaauugagaaaaugccuuacaguuggaucucauggaggcauuuccucaacugaagcuccuuucucuuugauaacuccagcugugucaaguugacacaaaacuagccgguacagagcauaacaaagcaacuuucuuacuggcuuugggucaugagucucaguguguaugggcaacuaggugagccugguugcaucuguuuagcccacuuccuuacugaaguuuauucagaugcaguauguaguauugggacacagauauuuucuauuuagccacuauguagucuggaucaguuugucuucuaguacccaugccuauauggaaccagaguguuuaaaguagagggugagagaccaucuauacagagugaacaaacuguuccauugagauuguuacuaaaguugcguaguggacuaaaggaugccuugagcugaguuggauagcugcucacucuagcuauugguugugaagcaaguguuugcgaguacuuuguauaguucuuccugaauuugauugugaaaauacauucagcagggaagagaauggauaauaaaaggaguaguuugaauaaauucugauaaaagccuaguaauugacaagacuagucaguuauuuucauaguauacacccacuugugauugacagccccaugccugcaaacuuuaggaauugucagguaaucuuucacauauucacaucagugaaaggucugcaguaugccuugagagcaugcuaccucauaggucucuguggauaagaugggcggucaccuguaaacaucuaaguuacuucuaggucagaaaggccuaauucacacauuggagguacguuauuaaauuaaaagggaaaauuguuaagaggacacaaaggaauugggggaggugaggcugcaucggggaggagguggggagaaauaggaucaaaauacauuguuugagguucugagcguuaauacaaaugugugcuuuaaagaagacauuucagaacucuaaccccgaggaaguuagcuaaaauugucuagcaguuuuaaagcacuuucaucaaagcagcuuuauagauuuuugggaaaaacaguugugaaugguuuggacauugaaugaccccaagaggucuguguguuaaaagugaucccuaaggugacaguguugagagggguuuucaagucauugggagggaacaguaaaacuccaguagccuccuccacucuccugccaugagggugagggugcucugucacagcuccugccaugacuugcugccagugccauaggccaaugguggaccaaaaccuucagaacugugagccaaagaaaacccuuucuucucggacagcaacugucuugggugcucauuaaaguaauaaauugucaggacagucagccauguaaucagagggauaauggaaagacuuugguggugacccgagccuguaauccuggcauucuggaggcauccucaguacuaggccagccugggauacucaacaagacccaucucacaaaaugaaacacaaauagacuaaaaaaaaaacaaauaaauucaagaaaaaaauuuaguucuucauuaaguaaugaaaguuaaagccuaguaaaaagauaucacaaaucauaagaacuuacuucagcaaaugcuuguuuuccuaggcucauugccaaagguaaaggcgauccuuuucagagcgauugcuucucuacggggaaccauguagccguguagacaaccugggucuccuccuggagagagaggcacuuggguuuaauuaaacacuggacuguauguccgagguuaugaacacauaacauacuauaaaaguauaguauuuuauuuguagcucccaagcuugucuucuuugcagaguuuaagaagccaggcauacuuggcaaauguacuccuaaguauauuuuccacugacguuucaguguuuuagcuuauuuagaaaugauucaaauaucuuaugagucaccuacauaacauacaaugaaaacagcuuaauguuuaaaggauucguuuauuugagagugaccgcucuuauaguuagaccugagacccucucugcucacacagucugcuggcauccaucuguccaucuauccugucagaggaaacuagugucaucucacauaaggaacaaguguuuguccuaagcaaggucugagugacuaaggccuaagaacauagacucggguugccauaacuaacauguuuuauuguggaaauaguuucaugaaauuuauuccuauaaaacaaaaaagaagucauaaaucgcagcauuuaccauguauaguagguagacagguaauagcaaaaugggggaaaguuuuaguuaucuaaacacauuguuagcuugugaguuaguuucauguauaacuacaaggugguuuucuccaacaaagagaaaggaagguuagaaaaggagcuaaugacaguccaaaauaauuuggcuccagauuuguagcauuauaacuucucacaauuacagauuuguuagucaucguuguagaauuuuccacaggaguguggcuuuuuucccccugagaguuuacaguucauuuuuauucugacaccuucuauaaccucuaacacuuuucuuuuaaaauuagcuuagauuaauuguacaaagcaguggguuuucauuaugacauucucuauucuuacauacauauaauguacuuagaucagcuuccccaagccaucccgucacccuacccuccccugucuacauucuaaugguucccuuuuuacuguuuauguuuccaguuuucuuacaaaugacaauucauucuuuaugcuugaauaaaauguguguguguguacauuuuucuugauccauugguucgccccaggccaguucuguaaugugacuguugugaguagguaugacagcaccuccauaggaaagugacucuugagucuuuuugguauaccccaaaguggugugggaucuaguuuucauuguugaggaaccuucuguggcgguuugagugagaauggugccuguaggcuugugcuugguccacauugagugggacucucugggaaaacuuuggaggugccacugagggugggcuuugauguuuccaaagccagccagguccagccagucucacucuuguuuauucuuccugccuauguaucaggaugugagcucucaacuacugcucuggugccaugccugcuugucugcuaccacacucuccuccauguggucauggacucucccucugaaauuauaagcaagcccccaagaaaaugcuuucugcuaugaguugccuugguaauagugucucuucacagcaauagaauaguaacugagauaucuccaaacugaauuuuuauaguagcuagaacuaguucacauucuuaccaaugugguaugaguucccuccuuccacacacccuccauggccuugcuacacuugauuuuugauguuacuuauccugccuuggaugaaauggacuauugcuguaccuugauuuucauuuuccuaauggcuaaagauguuggacacauuuucauguauguaugugcuauucauacuuauuaauuuuaaaaguguaugguucauuagcccauuuguugagugaauuauuugcuccuuugauguguaacuuuuuugagaugcuuauuauauucuggcuauuaacagucuguuaggcgagugucuagcaaagaccuccugcucugugugcucucuucucuucacucuagcaguuuauuucuuugcuauacggaaauacggaagcuuuuuaauuugacgcacucaugucuuugaacuccugcuuuuauuuccggagcuuuuggagucauuccgaaaggugucucucagguuuagauguugaagugucuccccuaguuucaggucagcacuggggcuuugucuuuucagcugcucuaguuuccucucccacaugugcacaucugcucuaccagcagcacuguuuacaaggcuggcuugucccucaccuuucggccucauuacuaggaaucagguggcugcacaggugugggcuugcuucugggcuuucugagcuguucugccagcugaugccugguuuguguuacugcugagccucuguagugccaucugaaaucagguagugaauaccuggagcauuccucuucguugcucaugguugcguugauuauucugggucuuuuguauuuugcugugagauguagaauuuucucuucuuguggagagugccgugaagguuuugaagaggauugcauugcauaugaagauagcuuuugcuaauaauaauaagucacaguguuaauucugccagccucugagcacauggucuucugccuucuagugucuuccacacguauuuaauaucuugguugugguaguuguuuugugagguuauuguuuucccucacuucuguuucacugacuucguuauugccgauggaguuuauucagagcugagaauccucagguggacucucugaagucuuaacuauaggaucaugcaccauuccuacagggauguuugaucucuuccucuccugguuccaucccucuuauuuguuucuugacugacauacugcuuuggcuaagcuuucaguuauuucagggaauaauaagcuuucagguuuuccucauuaguucugaucuggcugucacucuguccuccacaccuguauuauguggaagugugacccuucuagcuuagcuucguuguugucauaaagggauguugaauuuugucaaaagacuuccuuuugcaucuauugagaugauuaugcgguuucugcuccugucugucugugugcuguuuauuggcugcacauauugaaccauuguauuucucauuuuuaaaaaaucagcuggucauggcauaaugucuuuuaaaaauauguccuaacagugucuuaguuaggguuucauuacuaugaagagacaccaugaccaugggaacccguauaaaggaaaacauuuaauuggggcuggcugacaguucagagaguccaugauuguuauggugaaaaguaugguggugcacaggcagacauggugcuggagagggagcugagaguucuacaucuggguuggcaggcagcaggaagagagugucucugagccuggcuugagcaucugaagccucaaagcccuaccccagugacacauuucuaacaaggccacaccuccugauagugccauuccuguagugggggcuguuuucauucagaucaccacaagcacuauucuugauauguacuacauuacuuguuuuucaguccuggagauugaauccagggccucggucauacuaagcaaguguacgcugaacgacaucccugggcuuuuugagacagggcucuguguagcucagucuagcuuugaaccugcacugcucuucaucugugcucugggaugugcggugcaucucaccuuucucagcaaguccuuuaguguuugguguacaaacuaugcuacacugcucccacuaccugauuggcagcuuagggcaucggagcacaauagcacuagggauuuguuggagcucauuuaauuaaccuaggauuuaagaccagaaauuuuaucaucuuuugaugacguuggucauauuuagaaaagaugcuuuuuaaacuuacugccuuuuaaacuacaugcuguauuaauuugacugcugguacacaguuucuuuauaugucuaucuagaauagccacauuaaacauuuuucauuuaccauuuaagguuaaguaugaaccaugauagcaaaccuuuaauauaugugaaguauuaauuacaaauugggauuaacucuuuaaaagaaagucuauaugugccauuucaguagaaugacucaaguacuuccuguuuauaaucuaagccuuaguuuccuccucugccccuuuaaagggcuugggcuuaguagguauaggcacuguaugggauugagaccaguguugauguuaggaauuucucucuuaguuauguagccuugacacuucuuacaacacuuagaaacucuucauuucugacuuuucaaggauauguguuaugcauguguauggcacaaguaaguauguggguguuuguacucgugaguguaagucuggaaaccagaggacacacucuaccauauucccuagagacagggucuuuuacugaacuggaagcaagcuagcuguuccagacaggaccugccugucuccauucucccaaugcugggguuuuuggguguguggucaugucuagcuucuuacgugggugauguggauucaaauucagaucccugugcauacacaccaacagcucuuacucacuggacugucucuccagccccaaagcucuucauuucucacacauaauguguaacuuauuuuugccuagacucuuacuaguugaagguaauaaaaauccacuccuuguaaugcagcuacagagccugcuguuggccuuugggugauacuucagcuuucaccaaaaucaagaacuguggagcccagcauccuuuucccuuuuaguaagaugcacguggagcuugccugaguuuguuggguuuugguuuuuugagacaggguuucucuguauagcccuggcuguccuggaacucacucuguagaccaggcuggccucaaacucagaaauccgccugccucugccucccaagugcugggauuaaaggcgugcgccaccacugccuagcaucugaguuuguuuuuguuuuucauaaccaguauuuuuugcucuuacuccuaaauacuguauuucacucugccaccuaguguccccaggagggaacuuggcuuauucuguagugcugggagucuacuggaagucuagguuggcauugagucuguaagaauggugugugguuguguucugccugcuuugccugccuguuguguaacuacagauccauuacauaggguuuuuuuuccccuguaaaauacuuauaguagugcuuaauucaaaggcuguuauauuaaaugaguuuacugagacuccagaaagcaguaaacaguacgagcugaacagagcaugguuuggaacagcgcuaacuguugguaucagucugacuaauguguuuagauaacaaacuaaguguccuuuacuugagaccauaaaagcucuacuuuuggccuugaggguuuuuuuaaaaugugaucuuuucuuugucauauauauauauguauacuuuguguuacauuauucauaacuuaccccaccucauaaaguaaaaguaugaaaaaugcuguuucuucuuaguuucuucuaucagggaauuggacuguuuuuuuuuuguuuuuuuuuuuaaagauuuauuuauuuauuuauuacauguaaguacacuguaacuguccccagacccuccagaagagggagucagaucucauuacggaugguugugagcccggaauuggacuguuuuaaaacuacuuaagggugcuggagagauggcucagcgguuaagagcacugacugcucuuccagagguccugaguucaaaucccagcaaccacaugguggcucauaaccaucuguaaaggaaucugguguuucugaagacagcuacaguguacuaauacaaauaaaauaaauaaauuuaaaaaaacuacuuaaguaauuauacuuuguguuuaguaucccaacucuugacauaaacuguagauuuaaugugugguuuugcaugcuguauaagguaauuuuauucauugguuuucauuucccauuucauauauaugacauauuaauauagagaacauuauugcauguuuuauuuuuuacuaguuuuauuauauacauuucauauacuguaaaguagccaaaucuaaccacaauuacucauugugggacauuuauauuucacuuuugauauaaaaugcuaaagugauuucuuuuuggaguuaacaacguuguacccaguauaugaugaacucuuuacaaaugaaugagaaagauaaugucccaaaggaaaaaacacacaaaagauauaaugggcauucuugaagacgaaaugcagauaguugcuaaccauauaaaagcaugcccagcaacaaucagauaauuauagagucagacaagugggagaguuucuuagccuuucauguagauggagaaaguaaauauuaaaaauguagaaauaugaugauaacauucuuagugggauguaagucugguguaacuuuucuaccagaacauaaacagauuggacccaguagccccacuggaaguaauuaucccauagaggacagugcugcagcacuguuuguaaagccaaagauaagagacauugugagcaugauacucagcuaguauauauuaaccuuaauuuuuuaagaauacaaaccgaaccgaaggcaccacugggaaguagaagaguccucauuuauaugcuuuuguaguauugguaguuuuaaaaaccaucauauaacagauucauauauuuaaaaaaagaaggauaaaaaggccuauggaauugcuggaaguccuugccauagggaguuaguuagaugagaaagaauuuggaagcaagagaaucaguuacacauuuuuuauuuauguuguugcuuauucagaaguggaacuuuguagucugaauugaagguguacuuuuaaaguucgaacuuuaaaauuauacuacauggguuugaaaaugaggguuaucagagaugaugcugggguuuguaaacuucauugcaggugauacacgagugauugauuauaauguuaaagagagaaaagaggagaagaggcuuugaauagauacugagcaucuuaacauagaucuucagugaguaaucaaaugagucugguccuguugguuuucuuagcaugcuuugugcuaucuuaacaccugucuguagucuggcuuuacuauuguuuuuaagaaaaugcuaauauuuuacaaugaagcaauuucuaaguguaaccuugaaauuguuugugcuuuucuauuuucagagugcacauuuggcuaugauugauacucuaaugauggcuuacacuguagagaugaucagcauagaaaaaguaauugcaugugcucaacaguauucagcuuuuuuucaagccacagaucugcccuaugauauugaggaugcugucauguacuggaugaauaagguaggcauguacuugauuggauaugguucuaagaacagaaaacugaaauccuugguugcacauuguuccugucuggcucuuugucuuaaaucaaaguauaagcuaaaguugugcgauuuacuugaaauauuuuacuuuuaaaaauauaaaagcugaacacggugguggcucagaucuguacccucaucgccugugaggcugaagugggagagucauugaguucaaggccggauugggccguacugagaccuggucuuaaaugaaaguguugcaaugauaaagcaguucuauauaucuacgaguaucuguaguuuuacuuauucuuaauaauggcuacucagggcuaaucaagcuuguaucagauuauuacaaaacucagggcacugcacucacaauaggccacauagugagcaggaacuacucuuggcuggcauaauucucacacauuucggauugggagagucuuagauuuguuuaaccaaauuagacaaaaucauauugaucguggauucauuuucuuggagauuuuuauggucugugcuuugaacugguuacguucuuaauuuauugcucuccuuguuuuuugaguauuuaauucuucuugacccacauccaugcauucuguuuugagguaaggucucacugugugcaccuaacugaccugaaguuuguagagauccucuugccccugucucccaggugcugggauuacaggcuugugccaccagaugcagguggcucuacuuucauucaguugucauugcagagaaaauuaaacuacaucuguggacaggcacugaacaaaugugaaaucacaucuugagaugucugggcuuccuuugcuugcaugagcuugucauaggcuagacugggcuggagagguagauggcuuaggacguacaacacuugcugcauaaacaucaauccacagcucagaucuucugaagcugcaaagaacuggcagcuuaguuguagucucaaugcuuggaagcagugacggguccugugagguccugaguacuguggccguaucacacccagacggcagcauuucacagcggucuugcccucuuccagcucuuguuucugucccacuuucugagauguucccugaaccuuuuggggcagggaguuaaagagauguuccauuuagggaugaacacacaacaaucacuuauuaacuccagucucugcuucaaugcugcccacacagaaaggagcaucucugaccaagguggaaaucagcauaaaccugugagaauaaaccuaaguauuuaaaaggcaguuugacaggugaccugccaggcagguaugcccacgggugcaauaguggcauggcagucauggggcugacagaaccucucauggaucggauuugaugccuacucauaggaggagggaauucaugccuguaauguaaacuuuggccagugccuguggcugggguggccguaugccuaaguggaagcacuacugccucaguaaaugcuccuggaggaggagaaaauuaacuccagcaccacagggagcccacccauggcgugcacauggccaaugauauugaacaccuucaaaaaugucuauaaccauuuauacuucuucuuuugagaacucuguaguuccauagcccccucucucaagccccgcugguaauguggacagcuguuggauuuccucaaaagcuuuuucggaaccuguggagaugaccauguaauucaguccuugaguccauuuauguaauucauaacauuuauuaauuuaccuauauugauccaucuacguaucucuggaauaaagccaucuugaucauaguuaugaucuuuuuuaauguucuugagcugaguuugcaaauauuuuguugagaauuuuuguaacuauauucaucaggaguuugguuuguaauuuucuuuucuguuguuguaucuguugucuguuuugaaugucagaguaauauuagcuuuguaaaaagaguuuagccguguuucuuccuuuucuguuuuauggaguaguuugagaaguauuaaguuugcuucuuuucugagacucugauaaguaucaacagugaauccaucugggccuggacuauauauauauuuuuuaaucugagauauuuuucacugcugcuucagccucaccacuguuagcucuuuuauaauuguuuaucucauucugauuugauuuugguaggucaugugcaccuagaaauucauccauuuauuuuagauuucaguuuaaugagaacaugguuuuagauaagaccuaaggguuuucugaauuccauuggcaucuguuacaaugucucccuuuucaucucuaguuuuauuaauuugugucuucucuuccucuugguuaguuuggcugaguuugucuuguuuauccuuccaaugaccaacucugcgcuuccuugaucuuuguucuuuuuguuugguguuuucauuucuuuccuccugcgcugauauuacugguaucugcccaaauacugaguuagcauguggcuugucuuucuuuuuccagagauuuaaggaauaucauuaagacauuuauuugugaucucucugacuuggagacauaaaucaccccccccacuccccccccccccccaccgacugcggucacugcuuucuguagauuuggguauguuuaauucauugucauuugguucuaggcuuuuuuuccccuugguuucuuuuaggucuccuuccucagucaguucuguuuggcuuaaucucuccaugagcucuaggggcuguagggcucauagccuuaguacauugugauaagguagaauacaagaaauuauuucaguuuucagauauuuguugauuuguucucuguccugauguaugaugcauuuuaaaagaaaaucccauggacugcuagaaaaauauauauacuuugccacguaugcauggaauauucugaauauacaucucaaauccaugugaucuguggaacaucauucagauguuucuuuuugccaagauaaccugucuguuggugaaaguagguacugaagucaaccacugcugugcugaguuaauuuguggcuuuucauucaucuacuaauauuuguuuuaugaaauugcaugcaccuauguaacuuccucuuguuucuuuaaccaguuugaagugacccccccucaaaaaaaguuuugguuugaauucuguuuugucaaaaucagcagcaccugcuuguuccuugggucuguuggcuuggaaugcccuuuuccauccuaucacuccuaaggcagugauccucaaaggguugagaccccuuuggugggcguguaucuaauagguauuuacauuacuauuuauagcagaagcaaaauuacaguuauaagguagcaacaacauaauuuuaugguuggggggaucaccacaacgugaagaacuguuuuaaagugucauuaggaaggcugagaacugaugcucuaaaguaaugccuacuuuaucaugaguuagugguguugguuugcuuugcuuugcuuugguuuggguuuuuuuucgacacaggauuucucugugucucccuggcuguccuagaacuccuucuguaaaucagacuguucuugagcacugagaucuacugccuggggcuccugggugcugagaucaaaggcaaacgccaccacugcccugugaggcguguuucuuggagguaacaaguacauggcuucugcuguuugguacacuguggaaguuauuugucuuucgauugugaaguugagacuuaauagucagaguuauuauuguaaaauuguauauugauuucugcuauuagucuuuuuacuauggaaauuuuuuaucuucacuucaguugugacaaguagcuuugcuggcacagugcucuggacuggcuauaguaguucuccuucagaacuugaaauacaucacuccaaaccccgcugaacuuccuguagacauuacuaauugauuaacugucucuugucacucucucaucuccauucauacccugaaauuguuucuuuuggucaguuaaaaucuccaugcugacaaguccaguauuuccccccccucaaauuaaacucagcccucucuagaagcacacacuaucauucuaaaauuuccauggaaacccgcaguauuuauccugaacacucgacuauuugauggaauuugaacaccaaauugucuguccugugguggcagcuacuuugaccuuccagcagguguucucuccacugggucuguggguucuuuuuaaaguauacauaauucaagguguagccaaaaauuugaggcugaauuaucaguaggcuggugguucucaaacuauggguuucaaccccuuugagucacguaucagauauccugcauaccagauguuuacauuacaauucauaacuaguaaaauuacaguuaggaaguagcaacaaaauaauuuuacgguuuggaggccaccauaaccugaggaacuuuguuaaagggucagagcauuaggaagguugagaaccaccaguguagacuuuggucuuccuuaacagugacccuguucuucccaggaugcucucccacacauguaccacucuaauagugucagauugcucuucaagcccaugagcgagccucugcuuaaguucuagucacucuuuccuguaucaauuguaaggcggccccauguccuguuucauuucuguugcugugauaaaagacccugaccaaagguucagcuaaguuauaguuccucauuguggggaaucaaggcggggauagucagucacaucauaccauagucaggagcacagagaagugaaugcacaaugcaugcuuguuugugcuguacucagugucuccacucauacaguucccccaccaucacaccacccuccuccugucaggggugcacccucaagugggcuauaucuucgcacaucaguugcgacagccucccgucgacauguccacccaauggagauagcuacucucugggauucuucccaggugacauaggcugagucacccauaggaaggaacauaaauacaguccaccgcguucguuucuuccucaggcugaguccuuuccuccucccguguguuuuguuuaccuuuacaggguucuuacacaccugcaugcauaaauuacauauuuggugcuguggauggagcgcagggucucacaugugaugccucaugugcgaccauugagcucuacauggacuucagccuugcugcuuguguucuguacagaauuuacaguugucaucgaagaugggcuuuguguguuaaaugccuaguaguacaguacguguuaaaguauaauaagcucuuacuugugcuguauaucaggagcuguaacaaaaacuggaacaguuucugacggacaguaggugcucggucuguacuguguaauuuauggaacugaguuuagaguuuuagauaaaguuccauguaggggacuauuuucuaguuguagaaaugauauuuuauuugaguguuaccuguacuuugugggacagugagugugggggaaggggagugggagaaaaccugcggugcucugagcggguggguagacauggaaggacugcagcaugcuuuccacgccaccccugguaggugucuggcuguaagaagccauguaccccagcucagcaggugguggacagggggcaguccuagauaccagguucuuagccucaggcaucccagacaccacuggacaccgcggaagagcugagaacagaaugagggccccagagugguucauuagcccuggggcugaggggaagagagggcagggggagaggggagcacugggugguucccauauggagaguccuugguucaauccguggcuggagagcaagaaggccuuccagcaggagguuagacaccccuugcucuuuaggggaaagccuaagcuuuguucaagcacagcgggccuugaugagcagacacagucuaugguuuuaaagcuuuauuguagaaaggcagggagaacgagagaagguagaaagagagagagaggcuggccagggccacauuggggggggggagaaggaggucuauagagaugagcauaagaaagguuagagcuuagagcuuaaagagaacgaggaggggccagguagccccucuuauagugggcugggcuaucuuacuguugccagguaacucuggggcagagcauaucuggcuauagucagguaagugugcggguagagucuagccagaaggccagaagcuugggacguugucugcgugacugauagucacacaccucuccuguggggacugucggggcaguaacuucgacaggagccagggguccaggagacaugauugaacaccuuccgcccuguguagguggaaaucaccacccauuggguccucucuggagaucagacugugcacaguccacugccccacaguacuugauauugggaaucuaacugauuuuauugcuauauuuuaaugaaauucaaggugauuuuuacauuuuaagguaaaugaacacuugaaagacauaauggaacaagaacaaaaaucuaaagagcaccacccagcugaagcuccaggaggccaaaagguauacacugcaauaugacauguauuaugaugauauaucauauauuuuauagaugccagaaauuauccuaggagauacaaaauaaacaaucacuaaugauuaaauuguacugagauuagaaacuuaugaauuuaguguuuaaagaguaaaacauaauauucuguaggauaccgugagauagcagaauuauuaacauuuagauucccugucaugucagcuacauugcugucggcuuuauguugcuguuauuggagugaauguuuucccuucagaacgccuauugccuucuuagagucggugcaugaaugucugagacucuaaccuuagaauccuuuuacuuuaacaaucggguuuauguuuaagugauucugaauggccuuuccuuaccuccugccucucugucuuccuccaugcuuccccugaagucuccuuccaaaugguuuuggaaacugguuccaguaaguuuuccucacuacuucgauuuuucucuccagauuguaaugguauuggugguauuauccauagcuugcugcuaucgucauuucauauugaucuguuugucauuaaguagagggaucagguuuuuguuuguuuguuuuguuuguuugugacaggguuucucuguguagcccuggcuguccuggaacucacuauagaccaggcuggccucgaacucagaaaucugccugccucugccucccaagugcugggguuaaagacgugcggcaccaugcccagcaaaugaucgguuuuuaagauauguucauaauauaaaauaaaaaauaaugggucaagucaguuuuaaggacauuuuaaagaauaagcacauuugcucaucacaacauucacagaccauuauuacuaaugcaaguauggauacaaaaucuugcuacuaguaaagacuuuucauaaaagugaauuugaauaaucuuguaaguugccugaauguuuaaauuauuuuuggcaaaacaauuuucuuauuauccuauauaaaaacaacacuuuacuauuugauaaaaauuaaaagcuuaucuguguccucaccaguauugcacuuacacuguauaaaacucuugaguugaccuaugauuguuauuucaagguuaagugugagcaguuaaaguauuuuaagaccucuuaggcaccguccugauaaaaacauacagccuagugagcuagagaguuagcucagcagguaagaguacuggcuacucuauagggauauggguucaauucccagcacuuaccgagcagcugacaaucaauccauagcucuugucccaggggauccgauggccucuacugacaucugcaggcaccaggcaugcgagugguucgccacuuguauauauauaacaugcauauauaugaacauacacacauguauauuauauguuauauuuaauuauauuauauguaauuaaauuauauauaccuauauaauguuaaaaaucaccauuuuuaaccauugauuuaaaauaugguuaaaucccuuugaaugccagauuuuuaaguuuguaaaaagacuaugaaauauuuuugugcagugaauuuauaaaacaugggcuuccugaguuuggucccagcaccuaauauugcauaaaucagguauaguggcaauauaucuguagucucagcacuugggagacagaagcaggagaaucagaaguucacaaucgccaggcagcgguggcgcacgccuuuagucccagcacucgggaggcagaggcaggcggauuucugaauucaaggcuagccuggucuacagagugaguuccaggacagccagggcuacacagagaaacccugucaaaaaaaaacaaaaaaaaaaaagaaguucacaaucauccuugacuauguagugaguucaaggccagccugagaugcaauacaaaacacaaggcauauucaguauuuaaagguuccauguaacucauggagugcagauaaacuuaccuuggaauuguacaaaccucacauuaaaguuuguuugcucaguguggauuuuuauuggguguaaucuguaggaaaugcuuuggccugccauauacaauugccacuccaauagggcuuuauugucagcacgugcacacacacacuucucauccauacaugcuaauuggcagagggaauagaauacaucaaaccaguuuugcuugcggugcuaaguugguucacuauggccgucgugcuagauaacuggagaaaaagaaggcaggucuggagcagugcucgcugucuggaaagggacuugccacuggcugguuuucuuucuuccuuuccuucucuccucucucuuuugaauggugucacagcaacaaggaaggguuugagggaugauauaaaagucaguagucaaggagucuaggcuaggcuaugcaaggucuccggcuguaccaucaguguuuggaagccaaggcuaggagacugagcuugaagggcaguuuaggcugcauagacgucauaccaucgccccagaauggggaggagaacggaaaaguggaucugugugagagauuugcacauguaaauaauuguuuucugaauauagaugauguaugaguuagggauauaaugucugccuugcacuccuccagcuuuuuuuuuuuuuucccaagaggaaaacaugcuccacgguucuugccagucagcagcuagggagaaagaagcagaaauaugugccuuuucuucauugaugauauguuuucuggaguaugccauuuaaaagaaucgaguugcaucuucauguguuaaguguuuuguucaauaaauuugaaauuuucugguuuuguucccacaagcccuacagcuggcggguggcucagcaguucagagcacuagcuacucuugcagaggaaccacgcucuguucccugaacccacgguggcucagaacccucugugacucagguucagagcaucugacccucucuagcuuucauggauacaggcacacauaugguguauauauuuacauggcgcuauauauaaaauaaaccuuuuuguaaaugacuacuaaauaucaguagccuauguaaaaaaaguucauacuuuuuguuaauauaagguuuuauguaguauuaguaaaguguaagcauuacucuuuggcuuuaggaaagcuucuaguuaauaacggccagcauguacugauugcuucugugugcccaggagcguacauagcacugugugucugucuuuuuaagucccccagcaguacugcaaaguagguuuuacugcccccauuuuacagauaaggaaaaugacaagugaguguuuagguaacuuguccaaagucagagcuaguaaguggcaguaccaggaugcaaaugcaaguaauauggcucaagagauuuucucuucacuuuuuacagcauuuuauagaucucauuuuuagagaucuguguuaacauuuuuauuuuauuauuuuguuuuuuuauauacaagauuucccuguguagccuuggcuguccuggaauucacucuguagagcaggcuggccuugaacucacagacaucugccugcccugccuuaacauuuuuauugagccacauaaaguuauuuuuagaaagcaaagauuuauuuuucuaagggagcccaacccugccacuuggcucugucacugguucugaggccuggugcccuggacauucagaugccagucagaacagacugccuugggguuccuuuguaaauaguacuuuuugccacucaccaauuuugauagcucuuauaguaauuauuuuuuucucaaaugauaccucugcuccucaaaagcuucaaaagcuuaauaagucuuugagaacuuuuagauuuuccucuaauauugaguaaaugaaaaucuaaucaguaaaugaacagaacugauuuaaaugcaaaguguucagaucuguuuugugguaguguaacuauuguaaaguaaaugccaugugauauuauugcuaaaauguuaucuuaaguuuauagauuugaaauuacuagacuuuaaucccagaacucaggaggcagggguagguggauuucugaguuugaggccagccuugucuacagagugaguuccaggacagccagggcuacacagagaaacccugucaaaaaaaaccaaaaacagagaaagaaauuaguguuauugcuguaaauuuaaccuugguaauauauaguauuguugcccucuccccacaaaaaaagcuguguaguugggaauucuuccuucuccuguuuauauuuucuaacgugacuaagaacuagaaucuauaguucugguuuugucugcuuguuuuccuugaauuguguaggauuuauuuagaacucuuucugucguaggcucguuacaggaaggaacaaacacugcuuaagcaacugccuugcauuccauugguggaaaacuuguugaaggaugggaccgacggcugcgcacuagcugcccucauucacuucuacugcccugcuguuguccggcuagaggguagguguuucagggagggauucugaagugugggcagauggcaaaaaauauuuaaaucgcaauauuuaauaacuaaugaagguguuuuaaaaggaacauuuaaguauaauucugagaaaaaguugagaacauucugucuaauggcuauuaguuauaaauacauguuuguuaaacaaauuuuacauacuuagguauuuguacugucaauaguuaugaagcauucauggcuaacccaaagccauccccuuuucuauuugaagauauuuguuugaaagaaacuaugucuuuggcugacagucuguacaaucuacagcugauucaggaauuuugccaagaauacuuaaaccauugcugccauuucagcuuggaagauaugcuuuaugcugcuucauccauaaaggugaguucagucauucuccuuuuagccuuucguuaaaguguaaaagcuguugcaacaaacuggggucucagugguaccacaggagcuagauugggucuccugaagaaguagcaauagaaggggggaagggaaguggggcgggaggagcuggaguucaaggccagccugagguugugcugagucugaggccagccaggaaauccagcagagucuagcuccaaaagaauugaauauaaaacaaaaguuacaaaauaacuuuaucagugaagaauuggggggggggguggugcuuuuucuucuuuaaauauccauuguuaguuacaagucuuguacauuguaaaggcaaacaaaaaguugucuacaaauugaucuuuuguuuuaguguggguagaguagaguaugacccauuaaaugguuuuugaucauagguaaauguaacaaaugagacucuuccuuuaaaagcaagcuguguggggguguaugccaguaauuccagccuucugaaaaaaaaacgauggggaggcuugaguucgguugaugccugaggcuguaaugaaacacccuucuaacgaagcacagugaugagccuugcuuuuucuugaaggaguuuuauuuagagaaucaaaugaaaggcuuuggugugcauguguauuuuuauuugugugugugugcgcgcgcgugugugugugugugcgcgugugcgugcggguguguguguagaauuacagauaggaccauuacuccuugcuuuuauggagaugcuggggguucaggcuugggucuacucucccgcagccaagccgucucuagccucucugguguauuuuaaucagaugucaaugugcuuuuugcucaggguuguuuugccucuucagggcuuggggcuuccaggugaauuucaggauuguguuuucuaguucuguaauuuugaugggaauuacauugaaucugcagaucacgucaguaauuuggucauuguaacaguauuaauuuugucaguccaugugcugcuucuguuucaaagcuuuaggaauaaauggucuuauauauuuaguuugacuuagagguaaguuuucugcugagccuagucagaguuccagugcuaguccuacuuggaagugcucaagagcuccugucaugaugaugcuccugucuacuuacacuugaauucuuagucucuacuaucuccucuuuuuccuuuguccauuucaggaucuccaaaugcagaaaguagagccaaugauaaaaucguuuccaaauggggcaguagucgcagugacucauggucacucccuacucugacacaucaaauggaaaaccuugauuaaucaauucugaagguuuaccuacaccguuacuaacuauagcuuacuaaugacuuuucuagcauauguuaccaaguauaaguacuacuucuauaauaugaaaaguggucagacaccuaagauguauuuguuuuauacauuaguuugguauagacuaaguuugguaguguuccuuccuguccauuuuggagagcagaacagaauauagacuuuaaguaaaccauuaacccugacauuuagaaccuuguaagcauagccacgagguugaaugcagagcucuaucuuaaggcucuaagcucgagggagguugcuugguccauguugcugggcaccucauuuucacuuuaacuuuuaauaguggaaaaugagcacugccuuuuccucuuauagaaauacagguugggaucagacugcuuauagggcuguuggacauugccugagcaagugccuguacuggauccuaaguaccacccaaaagagcaucagaaggucuggcuguguccuagauagagccuagcucccuugcagugcacuuggcaagcuauuauuuagagggcagggguggccaucgaaaggcacucucucucucucugucugucugucucugucucugucgcucuguguguguuuguguguguauuuuaaaccugagaaagguuuucucagguuuuuuuuuucagggcuuuuuuuuuuucuucagggcuagggauuaaacucaggaccacugacccauauucccagccauucccuaaacgauucauuguaauaauuauuuacauguuguauuaacuauuuguaaguaguguagaggugauuuuaacugucuugucggcacuggagcgauggcucagcugguaauggcucauacuacuaaacccaacaccuugaauuuugucccaggacucacauuguugggggagagaaccaacaccccguggaaggguucgaauggguucuauucauguacugcaaagcuuacauagggacuuaagcauccauaaaucuuuagugucuguaugggguccuggaaccaacugcacacaaaugcugagggacacauuauagauucaggaaaaggaugauuaggguaacuauaaaacaaaaguaauuuuucugaaugugguguuggauauuggugaaggugugaagauuugcgagacuucuccagucuugguaacuucucuggcaccauccuggcuuccauuggcauuugcacucacaugcacaaacccucguguaggcacaugcuucauauauuuaaaaaguaggccaggguugguggcgcacaccucuaaccccagcacucaggaaauaaagacaggaugaucucugggaguuagaggccagucugaucuacacugucaguuuuacaucagccagggcuacauagggagaaucugacuaaagaauauauggaaagacgauuuuaaauuauuguaccauuucuggaacaugaccagcuuauugucauuuaauuauaauuuuauaaugaaacaaucuccagauuaauuacuagaaaaaauauuuuuacaauucugccaucuuguggccaauuauugccauuauguuauuaggacaauucuuaccaagguccuuaaaauaaauacucauuuucuaucaacuccuucucuauaauuacugcacauuuaagggguguuuuuucuaaagucaccuucuaguuaacaguaguaguagaguagagccuacuaccaguacuuaccaaguuuauccuuuggcuguaaaggguauacuguaaagauuauagcagcguauagucguaacaagcuuaaugugucaguuggccuucuguaacuguaacaggcaucugggucaaggacuaaggaaggauuuauuucugcuuaguuucagaaguuuugauccaugcacagcuggcucuguuuuuucucagacguugguugaggugggccaccauggugaagaagacaugguggaucaaagcuguuucuugugaugaacaaaaagcagagugugccuaagcuagcugguuuuggaggaguggcccagcucagugugagacuggaaugguucagcaaaaggaggggagaagugugggguuaguaugagucugaucuuaaggaauuucauccgaaggucaaaguguaggggugaggagaaagaagagggcgagucacugagagaaggucuuauuuuucaguggaagaaaguugaaaggaaggguaagucgugaguauaauuaggauugcagagccuaugagaaggcaggcagggugaguccacaguguaagggacugaaacaugcucuuuuuaaaagaaaggacaaaugucaauagcuucaaauaauagcuguuuauguguaagcauuggacuguuuugggaauccacagugaaaacaaacacugaaaguaaaguaaaaacccaguggggucgugucuuguguuccauguccccacaguaccccaccacacacguccauagccacugcgaugucugggaaagugucagagaccuuuuuaguccccuguguuuccagucuuuguuuuauuccuggcagucacaguugcucaaaucagagacuuggagacguccuugguuccugugcucucaggagccauaagauggcagaugaacaugaauguuaccagcuuaaauaugaaaaacccaggcaauaaaaucuaaggaacccuguucauguuagcgccuugaggauuguucaaaauuagcaaauauguggaaggcaagacaucagaaaacacccacauuuccagugauaauagccauaaugaggaaaacggguuuuguauagugcuauuguuagaaauacauuaaauaccuaaaauugaaguuauucuuuauauauauuuuaacauauaagccuaauucuaguacaguaggacacaucuuuaacaccacugcucagguuuaagacuguuucaaaacgaaaaaaagaagccccuaaaucauauaaauguaugaacauaguuauguguauaauucuauagaagcaugcuuuugagaacuccuuuaagccauuuaaagaauuauuugcauuuucaaguauaaguaauaaaagauuguuauccuuaauguuuucaaaauuagaagcauuaaaugauaaaaguaguguuuuuauauauuucaagauuauuuuagucauaauaauauauagaguuuguuauuacuuagcauguggcuaacuguugaauuuaacauuaucaaacauuuggauacaauauuuaaguuacauacuuuuucuagaaaaaucuuacuuuuuuaaaugguaaaugcuuugugcuauguguuuauguucauccuggaagaagggacauuuguuaucacagagauguauauagggagagacugcaaugucuggaagcuuuguaucagaggccuggacaugugugguuacaaguucuaaacuucuuacuccagcuuuaauacaacauagugaacauuuuuaaauaacaagugcauagaauucaaacguauauuugagaagguaaagcauaacuuuuucacuauuacaugauugguuuuaccuaaugcagggcuucuuuuaauuuucucaacucucuuauauagaguaauuauuugguguucauggcagaacucuucuggugguuugaaguugugaagccuucauuugugcagccucguguuguccguccacaaggagguaaucuaucuuggucauuuuuaauguagaaaaauggaagguuuauacauuucauuugguuuugaguuuuuguuguuuguuuguuuguuuuaagacgggguuucuguuuguuuguguguguguguguguuuugagacaggguuuuuuucguagcacugguuguccuggaagaagcucuguagacugggcugggccagagauccgccugccucugccucugccuccugagugcugggauuaaaggugugagccauuauugcccagcuccucugguuauuuuuuuuagauagaaacuuguuauuauuuuagauuccagcaauuauccuugauuuuaaaaaucuaauguuuuaguagucaaggcaggaaucagaauaauauuaucugcaggaaucaaaauaaaauagcucuguauuugguaucuuacagcaucagagcucucagggccaagugggcgccaucuugcaguccauaccuuuaaucccuuuauuccgaucugcaguuuuuauuucuuacuggauucuugguuuuuaagauccuguuacccaaacuccacuccauuaagacuugauuuuucuuuuaaacaaugaaauacuuugugguuauauuuuuuuaaacuaguagccuuuguuauuacaauauaauuaugauaaagacugaauugcugacaaaggcugggagcacagccuuugucaaugguggaguacuugccuagcccuggguucaaacuucagcucugccagaaagcaaaaaaaaauaaauaaauaaaaggaauuccuucuggauguuuuguagagcaaaugcuguguauggcacaguaaagcuggcuuucauuuuugaagucagacauacauuccuguagcaaaaaugacucuauguuuaguguuucuucuaaacuuagaacuuucuuccagcuaaaauuauggggcuaguucuuucugcuacaguggcuacuauacccagcauagaaugugauuauucuacuucccagcuacuuagcaacuuuccuugccuccaguuuccuuuuucuaaccacuguaguuaaccccugccuucucagagauauaaaggaaaaaaaaaaaauaagaagaaagaggaggggguuguaaaguagcaaaagaaacguauuguugugguggguuguguauggucuuacuuuauaaacucugcugcccgcaggccccaugacgggcagcaugagauagcauguaugugaucugacuugggagcucaaagccauugaaaggagguucuaaauagugagcuguuagauaaggauaccucccugaaagaaguuuagagccuuaaggcuauugucacuuaccuuuaaugauuaucaaaaccaaugucuauacaauauuuugcaguuagugugacuuucacuugcauugccuuuugugccccugucuguggagcccagcacucagcaguaauagcagcuuuugcaucaaacaucacucaaaacuaaguuguuccccucagauuacuuacacguguauguaaggcagauauagugaaggcuucucagugaaauucugaccaucuuaguuaacuacaaacucaccagccauucauaaaaagcaaaauugaagccugccucgugucucuaaaauucugugaaaacuuucaugauauuaagcacucgggcuuauccuugucuugaauaccuguauuuauuuuaugauaccuaucccacuaaccuuaaaguggauuuuuaagaguccgauuauaucaagaaauucuuuggaccuuuuggaaaugauuuaaggguacauuuauauuagaaagaguuaugggaaauagaacggaagguuaaauguuugcuuauggcucagaaugccugcagugguguuaggaauccauugacgauacaguuuugaaguuucaucuuuuauuuuagcugagccugcaaaagacgugccaucgguuccugucuuaaaugcugccaaaagaaacauccgggauaguucaucuaguucugacuucuccuccagguaguccacagugacuucacuauucgccuguuauuuacuaaugaaaucaaauaauaccuugucauaaaaaaguuuuuaaauuuuauaguuagauuugaaaauuaacuuacaaguaacuuaugcuacuaaggccuaguuuaauuuaaauauaauugaaauuucuacugagaugaguguuuacaugaauagguuuuuaaugaacaaacacugaaaaguggaggauaauaaucuaaguuccaaauuaggaaacucaaguuaagccuugcugcugcaucacuccaguaagugagaauauuuaacacccaguuauuaauagugagagauauugcuaguaggugacucuuaggccucauggaacuuuuagaauuauaucuggauuguuacauuuuuaagcacauuuccuuaugucugugacacguguggaggucagauggcaguuuguagagccggcucuuuccuaugcugcaucccgggaguaagcucagcucagcaggcugacgagucccuuuaucugcugagcugucuugcuggcccuggauuuguagauuuccuauuauuaaaaacucuuugagacagguguucuccacuucuauuuguugcugugauaaaacaccaucucugugcuguccaccuuccacucagaagugaccagugagcuuuaagaaugggucauucagucacgauugggaccaggacccugaaugaacagucuccccaucucuggccaugaaaaaauacagcuuagguccuauggagacucaucccuuuuacuuagauacccuaguggcuauuuucucucucuuuucuaggagaaccccaauaaccagguagauuccaaauccucucccuugaggaguuccugucuacugucauccuaggcuccuaggcccucuaaugucuguaagucuccacgugauccuuuguagaacuuuugaggaaggaguugauuaauuuuuccacucccugggaauaauuuggucacaucuauagauguuacuguuucuaaaugaaaagucuuaugaauaaaaaggaggcagucgcagcagaagacagccagcagcucucccaucugccuggcuccuacgucaaaacccucggugcaagucugaaacugagaugguuacccagcuuguacugcaugguagccguuaucuggggaagaagaaaagagcaaacacaguuuaauaaccagcuuacugguauucaggauuacccucucuggccauagagcuaaggaagaguauaagcuauggaguguaucucggaaagcgggcuaucacaggcaugcuugggaacuguguguucauugauaggccuaacagugaguacagauaaacgagaagagaagcugcacauaauuaggaggaagaaucagagaccccagguagcguuugguguggacagaggcaguucuucagaauggcugcauucgagagaaagauuaagcuuucauaagcgauagaggcacagcauugagagcgcccuccaagucugcguuugucguguucagugucaguuugucugagcugaaggacagcgugacugugagcugcugaagcuucugccucuuauccccgacccccaucccuggggggaggauaucccccacucgacaccagcggagcauggcaccuuagagcuucaaaggaggacuuaaaguauauccucaucuggccaguuaucacuauuaggugagaagcagacuugucaguuuccuuggacugaguacaguagggcagagugaggucagaacaggaaagguccacagacaggugcugugcugaaaggcuuggcaggaucaucugggauuuuauuguacagaaguuuuuggagauucaaaguuccccaaaauacugcaaauuaaugguuuuuuuaauaaaaauuuucauuguuuauucaaagguauguguugugugggggguguaaaagagagaaagagaguguauuagcuauuacgugggacacugggaaggaggcucuauuuacugucucgucauugccuuuuagauauacacggccgcagacucauucuucagccucagguaauguauuucagaaagccuauugaggaaaaugcuauguugaguaggcuaacuuggaaauaaaugagaauaaauaugaagaauaucgagucuuuuuucugaaaaguaucugucacauaggugauaggugauuuguagcuccaugccugcuuucuuuccuuuuuuugcaguguugugaacuaagccaagagcuuugugugucacaugcuaggcaacugcagugccagugggccgugucucuguuccuugugcuugcuuuuguuuuguuuuuagagauaacaucucacauagcccaggcuggccucaaacucuuuauauagccagaguugacugugaacuucugauguuccugucuugcuuuguaagugcugggaauacaggcaugugccaccguguccagcuaacagaggugugccaccaugcccuguuuguauuuuucuuauauuuuucuagcuuugugguauccaagcuagucuuaaacuacuaacccuccugccccaaucucccaaguacuaguauuauuaccaugugacacuacacuuaguguauggguuucuuuguuaauaaaaaaaauucuuggggcugcagagauggcucagagguuaaaagcacugucugcucuucgagaggucaauuuucagcaaccauaugguggcucccaaccaucuauaaugaguucugauacccucuuuuggccugcagacauuuauacagguaaaacacuauauacauaauaaauaaaaauuaaaauucuuuguauguauguacuuauuuuggcagggagguaguuuacugaggauuaaacgcagagccucucuugcuagucaaguauuagcuauagauuacguauuucucccauaaacuuaaaaaaaagggaauuauuuacuuuguuuguguuauugcaacugugguuccaccuuuuagugccaugaaugaauucucaaauaugucuaauaugugaguuucccuuuuuuugcauuugaaggaggaauuagaaggucuucaucuaugucuuauguugauggcuucauaggaacguggccuaaagagaaaagguaagaacgaaguuauucuugguauagccacguuaccaaaaaugccagcuucaucuccuucugcuuuguugcuauaauuagucagcuuguccaagcaugauuucagcuaggaccuaacuuugaaaagggcagcauggaggucacagaggugagagggaugaacugaaaggagaugaagcagcccgguucaccguggggucagcaggccgugaacaguggagaaaggacagacuuccaaacugcucgaugcuauguuuacagucguuucuuuccugcagauucuuaaacguuuugucuucccgucuuuuucagaacaucagugcauggcguuucauucgacauuucuuuugauaaagaagacagugcgcagagcuccacuccaaaccggggaaucauccgcucuguuagcaaugaagggcucacucucaacaacagccgugcauccaagcacauuaggaaaaaucuguccuucaagccagugaacggagaagaggaggagagcauugaggaagagcuucaugucgacccucauggugaccuccaaucacccaugccucucaacacgaaugaacugaacucuaaugagaguacucacuacaagcuuccaaauggggcuuuacaaaacagagugcuucuagacgaguucgggaaucagauagaaacgccaagcauugaagaagcguuacagauaauccacgauacugaaagaccuccucauacgccacggccagaucagaucgcuaauggcuucuuucuucauggucaagaucuaaguauccugaauucaaauaucaagcuaaaccaguccaguccugauaacuuaacugacacaaaaggugccuugagucccauaacagacacuacagaagucgacacuggaauucacguuccuucagaagacauuccggagaccauggacgaagacuccuccuugagagauuauacuguuagcuuagacuccgacauggaugaugcaucuaagcuucuucaggacuaugaccuaagagccagcaaccccagggaagcccugaguccuugcccaagcaccaucagcaccaagucucagcccgggagcagugccucgucuagcucuggggugaagaugaccagcuuugcugagcagaaguucaggaagcugaaucacacugaugggaaaaguagcgggagcaguucacagaaaaccacaccagaaggcucagaacugaauauuccucacguggugucuugggcucaaauuccagaggaagcggguguugccccaggucgggacacgacacagcuguuggcuucugagauggugcaccuuaggaugaggcuggaggaaaagagacgugcgauagaagcccagaagaagaagauggaagccgcuuuuaccaaacagaggcagaaaaugggaaggacagcguuccugacuguagugaagaagaaaggggaagggauuuccccucuccgagaggaagcagcaggugcagaagacgagaaaguauauacggaccgagcaaaggaaagggagucacagaaaauggacggacagaggagcaaguccuuggcagacauaaaagagagcauggagaccccuccaggcagauggcugaagucgccaaccacgccuguugauccugagaggcaguggaaccugacaagcccuucagaagagacuuuaaaugaaggagaaaucuuagaguauacaaagucgauugaaaagcugaauucauccuugcacuuucuacaacaagaaaugcagcgcuugucccuucagcaggagauguuaaugcagaugagagagcagcaggccugggugauuucaccuccgcaacccucuccacagaagcagauccgcgauuuuaaaccuagacaggcaggccugucaucagcugcugcaccguucucuucagacuccccacgcccaacucacccauccccacagucuuccaccaggaagagcgcgucuuuuucuguuaaaaaucaaaggacuccaaggccaaaugaauuaaaaauaacuccuuugaaccgaaccuugacaccuccucggucuguggauagccuuccucggcuaaggagguuuuccccaagucagguucccauucagacacggucauuuguaugcuuuggugaugauggagagccccaaaaagagcccaaacagaaagaggagauuaaaaaggagcccucagagugcaaagggacuuugggaccuugugaccauaauccuggggagaaggagauuaaaccuguugaaucaacagugucugagguguugucacagccuaucacagagacugugugugugacaccaaaugaggaccaacugagccagcccacagagccaccuccuaaaccuguuuucccaccuacugcuccuaaaaaugucaaucugauugaaguuucucuguccgauuuaaaacccccugaaaaggcugauguaucuguugagaaguuggauggagagagugauaaggaacaguuugacgaugaccagaaaguaugcuguggcuucuucuuuaagguaauacuaaugacauuguuuugagcaucuuccuaggauggguccuaggaaguuuucuaaguugauacauuuauuucuucaguaacaauaucauugauuacaagacagccauuaguccugaaaugugucuaggcaaaccagaccuuggacuacagaaguacuaaguacuggcuccugaaaccauauuccaguguggacucagagcugcacucuuccaccacagucaugccaucaugccuguauuuaaaucauauuacaugguuuccuaucucccguucucacuuuuauugaugcucuuuuaggaauucgucuauuuccaauagguaaaaaaaaaaaaaaaaaaaaaaaaaaaaaacgcucaaguugcauuguauuuaaguauguuaagguuuuagcauuuucuaucaacuuaaauuuuacagacuuuuuaucaacuugaguuuuacagacuuagcagauaggaucuuauaaagugaaauguuuuuaaaaggguguaguaguuugauguuaucauugagauauaguuucucuuuuucugcaguucugggaaccaaagccaaugcuuugcauauugaacagagcucugccaauagcuauacuguccaccccugaaaaaacucuuaaaagcaguuuuuaaaaagacguauauacgauccaugggcugugguguuaccuacuuaugcucugcaugguggacugcaguuugccuucuguaacuagaaauguauguuucagauuuguuguugguaaggcacuaaaaccaggugauggcuaauccugugucugaacagauuaggauaucaguuuuaaucuuacuaccacuguuagauuacaguaguuaaacgguacuucagccaaacaaguggcagagccgggacaguauuacuuccugauagugaagagcuucacuuuguacauaaacucauuguauaguaaagcuuuucuccagcuccguuagccgaucgaucgccaccuggaagaggauggcgcuauucacacuccuucccuucgacucagcggcuguugccucuggccugggaugcucaggguagauuuaggaaaagugccaugugcagcagugguggggagaaacgagcuaccgacugcugagacaguggggcuugcuuguucuauugugauuuguuuuaaauuuuaucucaggaugccugucccuuaggccucugucagcauuuagaaauuugauguaacucauguugugucugcuaaucauuuagaaguauuguuuuuaaauagacaaauacuaacacauagcaaaguuuuauguguagguuuagagaccuuugcuaccauuuuuccuugcccagaaaggaaacgcggggccggagcauccccaguguaagcugggccuccaugcaucugcacucucuuccauccuguugauucuaucuccuggacaugggucccuagccucuacucacgccaugcuguucuuuacacugcugucuccaugagccuggcuccacuggagacaccuuauuuaaagaaugguucugaauaguaaaccuauagccuccagcauucugggcggcaaguguuuauaaaguucaaaccuuagcccaacucagggacuugggcagaauaacccagaccuacuuguuuagacucuucuuguaucuucuagauuguuccuuaacuguuuucucuaagacuguucaugcuuccuugauuaauuaucuccacagugucucugugggguccugaguauacugacauccauaguuuuaaguuuuccucuuuuucuuuucuuucucucuuagacugugaacaugcagggacacuguucuuuuuaccgaaagcauagcauaguaugugugguuaguuagcuagaugcagaaaugcauguuuaagcugauggauuugauguaccuucagacuuuuucuguucaccauagaaucugucucugggcucccaggcaaaaaaagacaaaagucuuucuuuccugugugauuggaaaccuguaauguucagcacuugaugcaaaugcaugucacuaaaacauaagguccucaagaagucauugagacagugaaucaguaccauggcguguuaguuacuccuugcuuggauuguaagcacugcacuguagaggcauucugggaacugacugccuucagucaguccaggagguuuacagaucgugacaaacucugagaaugacagaauuucagaaaaggaaauuaugccuaggucuucuuccaagugaccucuaucagucaaacugucaguaccucagcuaaaaaacaaaaacuaaacuggagacaagcccaugcaacauuuaugugacgugacauuugguggagaguuuugaaaugcuuuuuuaucugauuuuucauuauaauuuaaaugugauuuuuuaaaaugggagccaagcucugcuauuguagguuguuuguuaggauggaaacaugugggggccagugcggugacucgguggggaagacacuugcuggaaagccuggcagucugaguuugaucccugggaccagcauuguagaggaagagaaccagccuuugcagguugucuuccgacugccaugugggugccauguaugaaugcaugggcacacaggucacagauuguaacugauguacacaguuguuuucaggccaugagguggccaccugguaaaggcuguuaacaccgggccugaaggucugacucaguucagcccugagauccacgugagggaacagacuccugcaagucacccgccaaccuccacacgugcaccguggugggcggccgugugcacaugcacacacuaaagcaguaagaaagcacuuguuucuucuuuuuucuuuuaauggcuguuaaguuuaaggauuucuuaacauuuugugaaucauguccacauuugguaggguuguaauuaguucagauuucagauaaaaguaaugauaggauguggcuauguuaaauuagaaucuaaauguuuacucuucuuguucuuaggaugaucaaaaggcagagaaugauauggcaaugaagcgagcagcuuugcuggagaaacggcuaagaagagagaaagagacucagcuucggaagcagcaacuggaagcggagauggagcauaagaaagaggagacgaggugaggaggaugcugcgaugaucugcagugagacucaggcucuuuagagagaacugcaagugugccuucagggcaggcaguguucugucagcucuggagcgacaggguucuucaggaacauugugggggacaaaaaggagcgagaccauuguugacuaggggcaguuuuagaagaucaaacuauucuuuuugcuugucaggguguuaacuuuaaaaguuaauacuauguuuaaauacuauuaauuuaaauaacugagaaacacauacagagagaggaaaaugaccaaaauuuuaaauuuucucaaggacauuuuaagccaacuauguuuuuccccaagauucugaaauauuuuccucccuucaaacauguaacucuuuccagugucauuuguauuugauauacaaaauaaccaauuuggccauuugguuucuuagacgaaaaacugaagaagaacgucagaagaaggaagacgagcgagcacggagagaguuuaucaggcaggaauacaugaggaggaaacagcugaaacugauggaagacauggauacaguaaucaagccucgaccucaggcggcuaaacagaaaaaacagcggccaaaauccauucacagagaucauauugaaucucccaaaacaccgaucaaaggcccuccagguaaccgcaguuauuucugaggagucuguucauaaacaccagcuuggcuuguugugcuaacuugacagugcuuugguaauacuaaaguggacacacgguuugagaugaugcauggucuuauuuggaaaccaaaauaagcuaaggaaauuuguauuuaaucgaggugcauugugugugcaugcauauauccaguaaauccagugugaaugcuaaaugugaaucugcagauguaacaaccuuccuucccccugagacaagggcucauacagcagagacuaaccacaaacgcaccacaaacguuauaaccaaggauaaccuugaacuucucauccuccuaccucugcccuguaguacuggaauuacaggcaugaacugccucuuccuucucaugcaguguuggggauuggcuccagggcuuuguacuugaugggcaaggaguagucaacagccacacuauguccccaaggcuuucacuacuguuuacaaacauaaaugaggaugcaugugaugugcaugcgcgguauaggaggcaucccuguacuuuuguccaggcccuuccugugagguuuaagggcucugccauugaccauuuccugaaacauugauauccgacaguaaagaacaucaggucaagacugcaaaggucccucucuaagauacaaauagccaaaaauccaaaauuauaauuucuuggaguugaaaaauucaauauacauaauuuuuagccauuuuauuuaauauaguaccauggaaaauuuccaagaauuucuacaguuagagcugaagauuaaaaaaguagaggccuugccuaauauccuugagacucuagauuuuaucccuaucacuccaaaaacuaagaauuucuaaaguuacucuggauuguggguggaggggguaaccuaaacuugaccaagcagugaagcuuggcuucucugcuugcucuucagcacaagccggccuccagcuagcaacucugcgucaguauuccaaaugcugaggcuauaggaaugagccugguuuguuuggugagacucuuugauuuauaauauuggcugaugagcugaggcgauggcugggacuagggugauaacucagugguuaggagcacuugcugcucuugccgaggacuaggguucaguucccagcacccacauaauaggucauaaccagugguucauaauuccaggggauccaacacagccuucuagucuccgcggacaccagguauacaggcaguacauauacauacaugcaggcaaaauuuaagaaaauaaaaaucaaaacuaaaaauuguuggaagaaauuuguaagcuaauuuugcacggaggaauuaaauauugcaaaauauauguuuguuuguuuguuuguuuguuuguuuguuuuuuuaaaaaaaaccuaguuaggguaucaggucuccugaccacuuuacuuuggaaacaggaaguuaguuuuauuguugccuaaaacuugguucuuaguuaaaguuguggauauaugcaugcaaccuacugugugcuuugauucagaguaaagaaaagaggacauggcaaaagcccaguuaucuucgcugguguuaucugaugaacagacucuuuccuaguuucuucuuuuacaguuccaauuuuguuuuuguucaggaucacgaauuucucguguuuuuucagucucuagccucucauuggcaucgcugaacacaggugauagcgagaguguucauucgggcaagaggacgccaagguaagcccagagcuuuuggauguuuuucacaggaaagagugugguacuugcaauuauauaaaaauguaaauaaaaauuauuuaguuauuuuaugauaagugaaacaucacaaauuuuuagcuuugcugauuuaagacuuacuguuaaaaugauaugagguggggccacugagauggcucaguagguaccggcaucugccgccaugccugaugaccugaguuuagucccggggacccacauggugaaaggagagaaaugacuucagcaagucacccucaaaucuucugcaugacauuguaugcacaugcacgcacgcacacacacacacacacacacacuguguaguuauuaauuaugauauaguuauaaugacuuacuuaucagugcucuuuuagaauuugaauuaauguuaauacuuuuauaagcuauaaacacuaauaguauuuuauacaauaguugcuaauaugacuaugauuaaauaauagagaaaaauaaaaucuuucuucccauugaagacaaugacauuagaauaaucccaaagucacuugcuuauuugaauguaacauuuuggagcauuuguaucuaagucacagauauaaggacccauguucuuuuucucuagcauauagauuugaaagaucagugucaccuugaauuagaagacacacaucaaaaaagagugcuucuaggacccaggagcucagagcgcacacugucucaccaguccguugugcuagucuccaguuuucauauggaaagaguucaucccaacagauauuuacaguguaccuaccauggccauaaagaagagacaguauuagcacuaccucauuucuaaagcucuagguugguuugguugauacacucacaugcauccacaggagcucaaagaugcuuuuuucugagacauaaaauguaagauauucauuguuuaggucggagucuguagaaggcuucuuaucuccaagucguuguggcagucggaauggcgagaaagacugggaaaacgcauccacaacuucuucgguggcuucuggaacagaguacacagguuggugugaacguuccaagggagauuccaauuuaccucgcuaacgagaacaggcauggggcgggcgguacagguggugcagguuugcaucacaaacacaagcgugugguacagcaaggaaaggggucacugugaggugcgagccuuucagugaugcagccccacuaaggaggcagugacucacuccuggugaguaagguaggucucuaaauagaacuaaagauagaacuuagcugccagcugcccauacuacuggccacuucaaagaaaccuuagagaagucucaucaacaaaauauguuccucaugacuaugugaaggaagucuguaaggacuucauaacucucccuaacaucaagacuucaguuauaaucagccuagguaacuuaaugagacugucucaaaauaaaaacaauaaagcuuauugggggaguguuugccuaaaauuugcaugagggcugaggaccaacauaaugaugauaaugauaucaagggagccuaaagguaagggcaucaaaucuaggagguaucauccucacugucccugcucccuccagcuccucuuccagccucugugggugggcagcacugaccaaagccagacuagagucuagaaagugagaguacagcuaaagacccggagcagaggccagagugaggggacgagcaccugugugugcugaaggaccaggaaggauacgggguagggacagcaggagaaggagaugguuccaugcaccugcgacgccuuagcacacccucaguagccaagaaccaguucaaaacuguauuuacuuucuggcuucccccuuccccucucuauucuuuagcugcuuaguacaacuuucuacggucuaucugacagccucucuuuccuucucucucucucucucucucucccucccucccucuuucucauuuauuccauguguaugagucuuuugcccaugugcauguccucuuuccacuugcaugccugguaucugcaucaggaagauaucagauccucuggggcuagaguuagagaugguuaggagccacuguguggguucugggauucaaacccagguacuguggaagagccagcagccagugccaccucuccagccccagucugacagcuuuuagugugagauuggacaauauuuccauauugcucccucugccuuuguaaaguugaacaacccagaaaaaaaccuguuuuucuucauuuuugugugcacaugcagaaccaggagacaaccaguauaugcagguggugcugccuuuggaguuuuaaacagggucuuguuaaguauccuuggcuagccuugaacuaccugaauacugaauacugaauccagcuguguguuuuugaaacaggguuucauuugccugucuccaccucacuaauacuuuguuuuuuuaaaauauaguguggguccuaggggguugaacugacaucccugugcuugcaagaaaaacacugacugacugagcucucucccaagacuaccuucuggccuuuuacaagcuaaagccaaguaugguggcuuccaauggucacccucuuccaauggucaccugaagagggugaccaugaguuugaggccagccuggacuuaaaguaaugugagucagucucaagaaagcuaaaguaaacuaaggguuacucuugggcccguuaugcuuuaaucugacaaguaauccagccagacugggaagauuaaggagacaguguaacaguuauaagcaauaucuuauuucuaacacugccuucaugggacagcagcaaaaggccacaagaauaucuuccaaauguguccugugugaauaaaaccauguuguggcuggaguguagccacaccuaagggcuggacaugguggugcgcaucauuaaucccaacacuuggaaggcagaggcaggcaaaucucugugaguuugaggccagccuggucuagcuggagaguuccaggacagucaaggcuauuuauccuccuuccggucagagcucaguucucacuuggagagucagcaguguggcagcuccagcauggaaaacugacaguguuucugucuuagaaauguuauuucuguaacuguuguaaauguuuccugcaggaccaaagcuuuacaaggaaccuagugcaaaauccaauaaacacauaauacagaaugcuuuagcucauugcugucuggcuggaaaaguaaaugaaggucagaagaaaaaaauccuagagguaagcaugcucucaugaaaguuacaucucggagcuucccugagaagccucgggacucuucuggauggaugggugaaggggacgugcugugacaggccgcuagaguuggcagcaugagaagggucugcagugauggguguuaguguuagauggaguuacucuacucucagaguucuggaagacuuacaguuuaauuagcguacgguggcugagcgccuacuuagcauguguaggcgaucccugauaaugccaaaauacuaauagaaaguuugguuuuagacuaugucauaaguuuuaaccaagaaauauuaacaaguauauauaaacacuuaguaaaauguuacagcuucauuguuaucuuguuuuuguuuucuguucuaaaggaaauggagaagucagaugccaacaacuucuuaaucuuguuccgggauucaggcugccaguucaggucuuuguauacuuacugcccagaaacugaagaaaucaauaaacugacugggauagguccuaaaucuaucacuaaaaagaugauugagggacuuuacaaguacaauucugacagaaaacaguuuagccacauaccugcuaaaacuuuaucugcuagcguggaugcgauuaccauucauagccacuuauggcagaccaagagaccaguaaccccaaaaaaacucuuacccacuaaagcauaggcagcaggagaugcucgcuucagaaccuuugugguaaauuuguacuucgucuuuccugccuauagaaaaaccuuucuaauugccaacaagauuuuuaucaauuaaaacuggaccuuaacucuguuguugugaacaacuggaauguaaucacaguguuuggaaugccgacgguucuuacuaggugauaaguccacgcgaugaaggaaaugcuuugauucacaggcggagauuugcaugcuagcaggcucaccugccuguguuagagaccgugcagcacugaauucucauggacacagcgggacauaggcuugagguguggcuagauggcaauuaugugauguauucuuuuuaccccuguacugugugugcacaucgucaaaugguuucguuguuguugucgucguucuguucccucuccugggguuauucuaagcugccuuuguguuuguuuuauguggagaucaugaaaguagaaaguuccuguugaaaaguaccuugcaccuuucauaugaugguaagagagacacuaguauuaguuuuacaguagcccucguguucugaugguguuacaguauuugcaagaauccuucuaaguauuuacauucuguauuuauuauucacacaaguauuaacauuucucuauuaguaaggagguguuuaaaagcugcugcuggguccccugcagaccacacaagcuaacccagcacauccuguaagaggcugcugaugaaaucagugcugguugucucuacaccacuucugccaacucagaacaaaucagauuguacuuuuaacaacagagcacuuuguauugcauuuaaagugcgucacuguauaagguggcagaagugagugagugacacgugagugcugccuuucuguaugaaagcauacagcuuccuggcagcucaggaggccuuuauauuuauaaccgauagggaaauuauauuuaggauuuuuaaacaugcacaaagggcuacauuuugauuugaaaguagcuuccuguuauuuuacuuauacuggguuuucuuuccuuugaauccuuuuccaguggaacagcuuagauucagggcacacuugaaaucuccucuccaugaucuuucuucuuuagcaagcauaccagaguaaguuggggggaaacuucauucucaggaaaagacuugaaugauugauuguguggcccuuuuauguuucaguguugugacaacuguguacacuaguggggaagacauuguuuauaagugagagaguaguuuguuuucuuucaugggauauagagaugaaauauguacauuucucuaauuaaguuguuuagagagggaacucaugucucauguuauguauuuacuuauuuaaaaagaagaauggaaugggaagucccucagcuguacuuuucuauuauaaagccuuuagggaucagugcaucuggguuuucaacauuuucucaaaugcugucaauauuuuacuguaauuuauguucuuauauuuauguauauuuguuaaaacuguaaaaaaauuuuucacagauuuuuuuccaauaccugugcaaaauguauguguagcucaagacuauuugugaucuacugcuugcaugugagagaccaggauauguaacucuuauauuuuaaauguauacauacuguguauauauaaauauuaaaaacggggaauuucacauuuuaccuuucagacaccaauuuuuaucacaauuagaaggaaaugggcaaacaaagacauccuuacgauaagauuaguuuaagaguuauaaacaaacuuaaucaaaacaaagugaauuauagacaaaggaauuuaauaagcauuuucuacuacuaaccaaggucuuuucccuaucaaagcagccucauggcugucaccugaguacugaauaaagaaaagucaggugcaggacauugagagaacuaaugaacacugaccucgccugucuucguucuuccaucuguacauccagcaacugagcggaaugucuagugucuaaaggugugaugugaauauugccacaaaguucauugcucucaguauaagauuuuacuuuauuaaugcaagaggaauacagauauauuucuuuagucugcagauuuuuuuuuauuauggugcagcuuuuuaaauuauguuuuaaaauuauacaaaugaaaaaaugccauuccauaaaguuuggagauuuccauccaccuuacugaaacacaagcguugucaucguuggaggucaaauuaccaugguaacuacucaguuaaaucugccaaauccuugucaugguaaccaguguggccugucaacuccugcuacuuaccacaacuucuaaaguuuuccucucaguuucucaguuuuguuuaggaggacuauuguuuguauuuggcugcucacagccagagucuccuucuuugaugugacucauggacacuguugggcgaugugcaguguguagugugcuuccuguccacuccugagcgcugcagaugauccgucaggcuugcucguuccuggggguuacaguguaguuccccuuucaucugaauaaaagcauggcaccaacugacgcugauucuucaauaaagugcguguugucuugucuuguguuugauaacguuauuuggacucaggaaaauacaucaugaaguuuucuugucucagccuagguuuaaauuuaguaauugaauauuuaccuaaguaauuuuuaauauuaaauuaugcuugaaugccu

SEQ ID NO: 393 - RNA, 2542 nt, Mus musculus
uagauucuccaguuaauuuauuucugcugccguucuuggguuuuaagcgagcaucgcuuaagaucaccccgcucauaaauaccccugggaugucucagagcacacacaggcagaacacggcagggcaggcucccuuuagcugcucccuucucugcggaaugacauauuccgauagauaauccacaagcagauaugaacucggugaccccagaaaugugucugaucaaaccuaacaaugaaaacgcaacauaaucagggcauaaguguacugcucugcucucucucucucucucucucucucucucacacacacacacacacacacacacacaaugucaaggguguggagggucaccuggcuccuuuucugggaugcguuaaucugugcuuuucaaucuuccccaugcguucauaagcgcgcagcuguucuauauuagaucugguuaggauccauuggagugcguauggguuuuucuuccuugagaaaaaucaagacagugagccugucggccuuuuacaaggccuguuggagaauguuuucaaaggagagugacagacauauugcugauguucagguguucccaucuguguccaggucgcauuaacugacuugcaacacucguguuugaggaucucuguuuguguuuaccaguguaccuuccccgcgcuuuaagugacaagaacugacuaaacaaggacggacagaaacggaacuccuaacagauguuucaauaagugccgcuaagacacagaaugcuuagcugagcugaacuucguccagguggcuuuaaaaaacuaauaauaauuuucaguuacugugaaacuggagugugugacuuuacugaaauguuuuaguaaaacccaguagauaaaucaaguuucuugaauuccuugaauagcuguuauuaucaguuugacaucuuauuuuaaaggaacugcuaaaaauuugacaaaacaaauguggaugguuguaauugaacuugacaaucgguauauuggggaagagaugacaccccuguauugagagugagcgcucuuggcuauaucccuccagccacacguucagguuaaauguguguacauccugguggccagaacaucuguuucuagcuuguuguuccucuuggcugccuuucaauuggauuuccucgagcaggucccaggcuugucaccgcggccagggucuguuaaacaucaccacugguccuacauuaagugggagguucagggcuaagcuaauaacuugccugccucucugacugaucacagggaugcucucuggggccacuuaucaugcgggcuccguggggaggguacucuuugucugcaccucuggaauuggcuuugcuucccucauucccagaguuacggguggacagacagggcucacagucaguggcgaggcuguguuucgcuuuaccaaugccuccccugacaggggucaaaaggacugucuaucaaacacaacgccugcuguguccuuccugugugaacucuaugauaagccacgauccucucuuccucuucuucauucacucugaaaagcaaucaaaaaggaaguacuguuccaugcaguuuacaggaacucggugacucuggggaugaaauuguaacuuaacguucugaaucuugguuaugaugcaccucaaugaaugcacagcuacaaagcucugauguucauggcacagccgugugucaucuauagccaagggugguuguaaagaugcuuagaaauaccuuuaugugcccugagguugggcugcacaccuuugaucccagcccuugggagaaagaggcaggaggaucucugugaguuugaggcuagccuggucuacagagcguguuccaggacagauagacaggaguauacagagaaaucuuaucuggaaaaaagaaaaagaaagaaacacacacacacacacacacacacacacacacacacacagagagagagagagagagagagagacuucaugccauccaauggcuuccacuuuuuaaguguuccagcuaacuuauaaaaagaaacugucuagggcuggagagauggcucagccauuaaaagcacuaucugcucuucccgagguccugaguucaauucccagcaaccacgugguggcucacaaucaucuguaaugggaucugaugcuucugggauguccaaaaacagagacaguauacucacauacauaaaauauauaaaucuuuuaaaaggagaaaagaaaaaaaaaaaaaaaaggaagauguccaaguccgaggggagagaaaaaggcacuuggggaguuugucccuuaguaaggauacagauggucaauuccauucccauuucugcuuuccagguggcuucuaagauagcaaagaaaguuagguucagucaguuauaaccuguaguuguuccgggugauucacaaaccaggcauuuucugagagaagccggcuccugcuggcaaaccugaggacaauccuuuccccggggcagauguucacaggaauuccccgcuuuugucaaaccuugccauggucccuugcaagaugugagaug

SEQ ID NO: 394 - RNA, 5878 nt, Mus musculus
aucaauauucauacacuuaaaucuuaaagcaguuuaacaucucaagaaauguucaaccuuuuuuaaaaguuauuuuuagacaagguuccacuguuccuuggcuggccugaaaauuauucuguagaccaauauggauuugagauucaccugccucugccuccccagugcugggacuaaaaaggcagguguuacacauggucagcuucugucuuuuaaguuacaucaaauaccuuuacugcaucuucuauaucacaaucucaccuuucccucuaauagcuaugaacucaauuucuuaaccuuuuaauagcaaguuagcuuuuuuuaaacuaaaaaugcucaagaccauuuuaauccaucauucuauaauuuuauuauaacccuuugaggcaaaaggauauauaacaccuuaagccaaaaauauuuugauaugauuuuaaauaaagccucaauaaauaaucucccuaauauuuaggaugguuagccuaguuucaacauaauguaauuuacauuagauuucuauucuuuauauuauugugcaccucaaauaaaauauucaaugcauuuuuaaauaaaccuagaaagacaaaauacauuauaaauacaauaaaacggcaagcuccuacguuacaauuuauacuaucaauacgaauauuuuaugaaauguaauccacagagacuaagugauaucuccuuucuucaauguugugauuaacaggacuuuuauugguaguaaacuagagcaaacaaucagaauaauacauauguaguauucaguacacacaauaaaaguuaaagaaauucaaaaccuguauaaaacaaaagagaagagagagagagauccuacagcuuaagagauacagggguaaagguccucuccaucuuugaucacacuugucucuguacccaacagaacuuacugcacuuaauaagacauacagacauuuuaguacugaguguauuaaaagaauuaaacacauuucuaaaaaucuuucaaugacaaguugguacccuuuagcuaacuaaagcuaaaagguggaaggugggaaaagggaauuaacuaguauuuuguaaccauuuuuaauaauuucuuauuuuccaaacacugcuuuuauaacagaaguguuuuacacuugcacaauauuaauuacuuuauuauacauggaagccugugguaggcugauuacacaaugagacugcaaacaaccagugggacuuuucugacgucagaagaguucauaagacuaaacaccaccaaaaguacauaaaaacucaucagcauaaacaucaaaguacauuaaaaaauauaaucaggaaaaaauacaauugcuaaaaagugguuuagagcagagccacugccuaucaguagcuucaaauggcaauuagcguucauagcaaguuuugaugacaagaucccuguacaauacugacuaauacaccccuucaaaauguacauuaaaggcugcaauuucacaaagaguucugaugucauuacugaauacacacucuuaucuguuacacaagcucugccaccagguaggaugacaacccuuugacaucuauguauagcuuguacguggaagucgguauuggguuuguuaacaaaauaaaaagaaaagcaaagucagggauguuuacccuauuguuuaguauuugaaugucuuacgacauauaaaaugcauaaucaauuaucuucuagaugauaaaucacucuaaaauugaaaccaucaagacagggagaaggaacaagaaggcccagaacuuuaagaaguuaagaacaaauaccaaacccagacgugaagguggugaguaauagcuuaaacaagagaauguuuuaggccaugaauaaugcacaccccaaauuucaauagacuaugugaauugaacuuacuuucuaauacugaaaccaaccaaacacuuggguuuuuaauuuuaacacuguacuagagaagacauucacagaaucacuuaauggaauuacagccuuguuacagguggauaaagaggaugguuuuuuuccucuuucuuuuauuaaagcuaucauuccaggcuuugaucaaagaucuaagaauauuuguucuaccaaucuggaaugaaucuggguuuggaaguguggaguacauugaaaagcugcaacaaaauauagguagccaacaaucucagaauuuuggaucagcccagacagagauagcacuugaaauguuuucgaucccuuacuuaaaugaugaaauguauauucuauuagcccagaaagagcaaucugaaauguuuaagaucccuuaacuuaaacaacgaaauguguaucauacuauuuguaaauuggauauuccauuacggugauaacguacagaauucccaugcguuauuacacuuuccugagaguaaagcaauuagaauaaccuuaauccuagcaacaaaguuucuuuuuuuuuccuuuuuucuuuucuuuuuuuuuuucuguacuuuuuuuguuuuguuuuauuuuuuuuguuuuugcauuuaaaacuuuugggcuauucccugacaaucuauacauguaaauuugauugcuaaacauugucacuuugaaugucaaacuauuuuuaaucuauugauuuugauuaaaaaucauaauacaaacagagcuaaaaucacacuaacaaaauaaacuaaauaugaaaaguugcauugaaagggcauuacauuauucuuaauaggaucguguagaaacauuccaauggcaguguucucaaaauaaaacaaaauuacauuagacucccagccuggucacucucgagaccuuaccuguaacucuggcuggugggugucuuuacucuuguacuacauggcucacuuacaucagacaucauauuuguauacccugagaaaucugacacugaaguccuuacucuaugguccacuucuccauuagaguuagugauaaaggucauuggcacccugcugcccgacuuaaacugagaaccgaaugcuugugcaaaguucucaaucugguacguuguucuaggcucuaugucuuucugaggaucaaucuggcuagcuaacuccugagauggaaucugaaagcucguugaggacucuaaauuuuucuguuguuccuucuggcuagucaauuucugagaugaggacuggaaggcugaugaugucucuaaguucuucugagaaucuaucagaucauccagcuccugggaaggugucaacugcugauguguagcauccaaagcagauaaauaaagaccugguugagauccaaacaacaucccaaaaggaggcuuuggcaacgaagauggcagcacugagguaacagacuggccaaaaccacacuccaaaggagauguaguguauaucuguuuuucuggaaacaaagugugguuguggagaggugaagacaagcugacaaauuggaaaccguguccaagaguaaaaccugcauuaguggauuuuucgaaagccuguuggagguauuuggaguauucuugcaacaugcuuguuuuaucauuugaagguguuugggugccugggcucaaauuuucuucuugaaccaauucagaguguucuccugagguguguaaauccacucgugguucuguuaaauugaaaggauccuccuucuguguuucugauuugccagaguacugauccaaaauacuuuguaaaaccucaucaggaauuccagacuugucgugacaagacuuaauuucagcauuuagagcugaggagucaauaagugacaauggcgccucauuguccaaaacacugaccccugcagacugaaugacugacugcugggagaccauguguccuacauugauagaaaaggcacuguugcugcuggcaguugguagguaucuucucuucuuugaaaacugcauggcaucaucauaauuacuacuuaucgggccuugcuugccacuuguacuuuggagaagacuaauggucuccacacuauuauucgauacgaugccaagugagccaccuggcuuaccagacaaggauuucugcccaacuacgucugguaacggugacacaaaauuaagguagcuuuuaucugcauucuuucugcuuccuuucuuaaagaucaauuuuggcacccuuuucugcaguucaucuauuccagugccaauuaugcucccacugguagacacaguaggcauuucuacugaauaacucugcauguuuauauuguuugacauuugugauucauuuguuuugccagucuuguguuccuuauuuucaauagcuaugcuuuucgacuucgacuuucuccuugaggaacuuguauuucccugagacaacacagccagguuacccauacuguuaugguuugaugacccagguucugcacuagcggcuccuuuugcuauggcuucaccacacgugcgccugugcuucaacaaucugucaguccuugaaaaauacuguuggcaagugucacacuuguauggcuuuucuccacuauguguccucuugugucucuccauaugguacuucugaauaaacuucaugcugcacugaucgcacccaaaggguuucucucugcugugaauuuucucgugucucugcaguagguauuucuggaugaaacccauacuacacuggcugcacuggaaaggccuuucgcccguguggaugaggacaugucuccgcaggugguaggagcuccugaaagcagcacuacagugaucacagauaugagguuucugacuuggggacaggacggcaccuucucccucuccaaccaaagguuuggaagaugcacuuggcuuccucuuggcuuugauucccugagauucuggcuuuggccucuuugccuuuuugacguuagcguccugcuuuggcuccugguugccgugcucaucaguccugcuaccgcugcucaguaauacaucgcgguggugcugggccgguugcugcugggcaugcuggugcagaagacugaggucuuggaugacgccguggcuccccccuuccccuccuccuaggccuggugaucgcucuucagccccagcgaacagccccccauaguggugguggugauggugguggugggacggcugcuccucgggauccgcagguuucuccugcuugaugcucaccaaggacugcaagaauccccaggagguccucugcgaagggaaggccgcggcugacgccgccggcuccuucuugaaagucauguccggggcuggcggaggggggggcucagcggccggggcugcggagguagaggaggauaacacgcacugcgggggaggggcggccguccccgccggccgggugaagcuggugaccgggggaagccggugguugaacauaaccauacucugggggaaggugggcuccaucucugcucuccugccgccgccgcugccgccgcuggcgcugccggagcugccgccggagccgcuaccaccgcuacugcugggaccgccgccgccgcuaaggaacccgcugccgauuuucauaccccggaggaggccuggcugcggagaggagggagaggagggaagagggggaacggcgguagggccgggccccgggccgggaccaccgcagcguuugggacccgccgcgccgccgcccagcccgcaccgcgcccggcucccguccgcagccccgccgccuccggcccggcgcgcucgaccccgcggccuucuuggccgcucccgcgcccgccccggcccgccggccacacuuacggguuccgccgccgccgcagccgccgucgccuccaguuaauaaaaauaacgccguccucuccacaauggaauuaaaagccuccccgcuucugcgcagccgcggcgcggugucugccgggaaguccucgaccggaccagaggggcgcucggcgagccccgugcgccugcgccucaguuuccgccug

SEQ ID NO: 395 - RNA, 7412 nt, Mus musculus
ucuucugagucugacgggcugguggagugugagcguggcuccuaaauuucuuggguaggacugaagaagcacuuuuaagguaaacuauuuucccuggccuucauucuugaggaugaugcaggcuguuacuaacugguucaccucaaaucugaagagcccccccacccccacccccagaggggaagguagaggaguugccucauuuccagcugcugcagaaggaggagggauugggugugugcccagcugcggggcucagguacagaugguccagugugcgcugggaggacccgaggaacggcccagcaggcaaggcucucuccuucuccacagaugugucacuguuacuccagcuugcucccauuuauuucuuuauuuuuacgaucuuaugaaaugccauggaccagaccuggagcaauaauaagagaagaaaggaaguauuuggaaauauuaagagagacccgcgguugggcuggaacauccugcauuagucacugcugcugugggaagccaaagacugugaaaggauaucuuuuuacaugucuuacauauuuagagacgcugcccuuucgagaucccauugcgcauaucaacaggguugcuggggaacuggcucuguccuccagauauccccaagugugugugugugugugugugugugugugugugugcuucugguuaaguucuuaugcuaaugcuuugaggaacugaagccagggagggaugugguuccagcuucaugugcuuaaagauccucugccaacaaugagccauuuuccaagauuauuuccaaaaucacaccaagauuuggugugagcccuccauaaaagaaaggcuuugccuuugagucuguguucauaucuaauguugcuaugcuggggcuuucuuaaccucuaucuuucauacacagauucagccaacaagguuuaaaaauauagucagacucacguacuuaacauacacagauuuuucuuccuugcuuuuaaaauacgggaauaacuauguguagacucuugcauuguaugagguauuuuaaguuaacuggauaugacaaaggguacagguggguggguccaaguucaaguuaaauacugugugguuucauacagaggauuugagcuuccauucgucugacuuccuugggaguccuggaaccagccccauacagauacccaggaacagcugugguguauuaagacgguaccugugaacagaaagauauaugagcccagucccuuuaaacaacugcccuuauccaggugucugugggcccugguccaaaacugaaauuuugggacccuguggacucaggagggaagaggcuauguuuucccugaccucugacugcagcguaguauaaacuucauucaggaauggcgacaaagcuuagggauguuaacuguacccgggaagagucacacauuuucaaauuauacuacagaugcuuuaucaacucugucccccucccaagcuccuacuuauuuguuauaaauaacaaaugcagccgggugugguggugcaugcccuuaaucccagcacucgggaggcagaggcaggcgaauuucugaguucgaggccagucuggucuacagagugaguuccaggacagccagggcuacacagagaaacccugucucaaaacaaacaaacaaacccaaaaacaaaugcauuuguuauuuuaaaaaaaagucauauguuuugaaagguguucaaaauauaaaacucauaaaagggggggaguuuuugacgauuacagaaggggcauagugaugacagauugcugagaagcggggaucugcgcguggcuggagcgauuuccagcacagccugcucuuagccucagggcuaaaucugagcacauuugagaauauuuuggaccugaaaggagguugggcaugaaaauaaccacugugucuaaccaagcuuuugaaaccacaggcugaugggaagacgcugccuggucaaguguuccggaugcagucgugugucaucuguuuucccgacacccuucucacuugcuagauaaggggcaaacuuauuuuccauguugcaaaaauaggaaaugagguauagggagucugggagaauuauuacccaagaucgcagugagucagaggcuuuuugaguaccacagaagcccuggcucccucccugaucaugaccccagauuugcugugugcaggccuugcgguuuuagaggaaaauguaguaauuucacuuucacuuuuguuucuguuugguuacgguacaaucuucaguuuaggcaaauaaagaaaucuuuuuuaaccccaggccccccccccacacacacacacacuauggccuucuuuuugagacaaagcgucacuggcugguuaguuuugaacucucuguagaaaguggauuggacuugaacucacaaagaucuucugccuccugaaugcuggcauuagaggcacgugucaacacaccaugguuuuguuuuugagacagggccuccuguaggccaagcugacuucuagccagcugugacauccugagcugauccucuuccuucgaccuccuaaggcuacaauuagucagccuaguuucugccugcaugcuggggacugaacccagaucccagaucucucucucucucucucucucucucucucucucucucucucucucucucucugcucacauguguguaagaacucuauuaacugagcuauauucagccccaaguaaagcagguuuuguuuguuuguuuguuuuguuuuguuuugucuuguuuuucaggguuuuuuuuucuuuuuaggaauuucuucuuuggggggaaauauuguugaugauucaguugaaucuaauuaaugccuguuuguugcaagccucuucuagccagugaggagacacugagugauuuaaccccaagguuucuguggagcaugggacuaaaggaccaaacuaaacuugauuuuauaagcuuucagggguccuggugaguuauucacuuucuguccagaaaaaaaaaagggggggggcuucuauaaggaaggauacguaggcuuuugcagaguucaaccuguuugggacccacccuagcugaguugcaggauuaauuuaggcagaguauuuuuggcauggaacaaaaacaguaauuccuugaaggaaacacaaagcuguuguggccacaggguagaaagagagauugagauuaaauccaagcaggucagaggauuuggugucuggcagguuggccagugucccuggauauaagccuggggugucagcuggguauugaucuaugggugguaauauuguaggcagagagaaaagucagggcaagccagaccaggccaggccagggagcauaacaaacaggaacaggccauugcaccugaggccaguuucucuggacaugggguugaaggagaggaaugaucagaaagaacucuuacccugagaugggcagggucuggugcuagugcuacugagaugagugaguagucuuccagaaaauucuuccaggcagauauucuguaguuccauuaaucgguugguuuuuuuuuuuagauagaagccuucagcuugggcuggagagauggcucagaggguaagagcacagacugcucuuccagagguccugaguucaauucccagcaaccacaugguugguugcauggauggcucacagccaucuguaaugggauccgauggucucuucuagugugcacgaagagagcaacagugcacucagauacauaaaauaaauaaaaugaaccuuuaaaaaaagaaaagaaaaaaaaagaagaagaagaaaaagccuucaguuugguaccuucugaggcuacaaaacccuuuugcuggucagcacuuuuucucugucucccagcucuaacccuucaccuuuuaaagagucacaagggcuugcugauucuauuagaacucuuuagaaguugguuucuggggcuggagaaaugucucagugguuaagaguacauacugagcugggcagugguggcacacgccuuuaaucccagcacuugggaggcagaggcaggaggauuucugaguucgaagccagccuggucuacaaagugaauuccaggacagccagggcuacacagagaaacccugucuugaaaaaccaaaaacaaaaagaguacauacugcucuugcagaggaccuccguucgauucccaggacccauaucaaguggcucacaacuaccuguaccuucagcucuaggaggacccgaaacccuuggcguccaugagcaccuaccuguacuuacacccaugccucugcacaucauuuaaaaaauuaaaauaaaugcaaauuuuguuuuuguuuuugugggccaccacugcccagcuaaaugcuaaauuuuuauuuguuuguuuguuuguuuguuuuaagguuaauuuucuucacacagaggugaaguuacugggucaaugcauauaaauuuagaaggcagaguagguaggcaucaguaauugcuugugccacugaauucuuuguguuguauauuguuuuccugccaauaaacucuaugauuguuaugcucuaagaaacaaacaccauaaagucacaucaugcgauagguuucacaugggagguuuauuggggaugggguauacagaggcuggcucugggcgaggguggagggaagaagaaaacagggagaguggcggggggggggggggucuggcuuuuuauaaggggguguaaaacauacacagggggaggauaugugacucuguaacacugagaaugugucaaaucuuggcagcuagugaugacaucugcugucacuaggucccugggggcaggugguggagauaccugguuaccagcagugauuucucccuagcuugguucuuuucuuauauauaaaagcuccccuagucaauguuucuuuggagccucccucccucccucccucccucccucccucccucccucccucccucccuuccuuccuuccuuccuuccuuuauuuuuguuuauguacauugguaacuugccaacaugcaugucuguauaagggugucagauaacaggaguuaaugacaguugugagccacuguguggauguugggaacugaaccuggcuccuuuggaagagcagccagugcucuugacugcugagccaucucuccggcucuuugggagccuuuucuuaaaaguaaaauaaauaguaagcgcuugggaggcuaacguaggaggucagggcuagcuugaaccauauagcaagacccugucucaaccccugccuuacacacaagguucaugggcccaguacuggguuugacauuauuaacuauaauauuguguguggccacagcuugucacauaacgaugagcaucuucauuuuacagauguggaaacucagagaggaugccacuguuuugaacuauuuugaaggcacagccaccagagcuuuaggugagugacucuaugcuuauaggcccaaauguaucuucacccccucucacucccugcgcuguacaguuucccauuacccaacaugcacuucuguuagcagcugacucuuuccuaaaccuauuccuccagggacuuacuuagcuagacaaccagcuuuucaguuucuuccuuauuuuccuaccuaacuuuauuaaauuaaauuguuuauuuuuugagacagggucucaccuuguagcccugaaugacuuggaauuugcuguguagaccagguuggcuuugaacucacaauucuccaucugccucuguucccaaaugcugggauuaacagucuaugucacacauaccuagucuuccuuccuagcuuucuauuuucaggaaaugucucuugggacucagucuaucaagacagggguggaaguggagcuggccaguggaguguugggacaaagcucugaguggagcccucgaguuuaaaacggaaucuuagagaggacguguuuacuccugcauuauagagcacggacgcucaugacucaguuugauuuucauacaccguucugcucaucacugccaaguggagcaauccaggccucucaaaaugugccauacuaccuuccagcuaaaagcuuucuguggggcuggcgagauggcucagcggguaagagcacccgauugcucuuccgaagguccagaguucaaaucccagcaaccacaugguggcucacaaccauccguaacaagaucugacucccucuucuggugugucugaagacagcuacaguguacuuacauauaauaacaaauaaaucuuuaaaaaaaaaaaaaaaaaaaaaaaaagcuuucuguggcuccccuuucccucuguauuuuauuauuauuauuuuauuuuuuaaaagauuuauuuauuugcuuuuauuuauaugaguauauuguaucugucuucagacacaccagaagagggcaucagaucccauuacagaugguugugagccaucaugugguugcugggaauugaacucaagacuucuggaagagcagucagugcucuuaaccucugagccauuucuccagcccucucccucugaguuuuaaaugucagcuugauauaauauagaaugucugagaguccuaaugaggaagugucucaaucagaagagccuaugggugugucauauaugugugugugugcauauauacacauauauguuuauguaugugcaauauacaaauauguauauauacacacauacauacauauaugucauaacacacacacacacacgacuuauuuuuugucugugaauguuuugcuuccauguguacaaugcccuugaaggucagaagagguccuuggaacuggaauuacagguggcugugagccuccagguaggugcugagaaucaagcagccuggcuccucuguaggagcucuaaggaaugcucuuaccugcugagccaucuguccagcccugauuguccuggcuguuaauugaggaaggaagacuuacucugagggagggcugagccaguccccaggcugcucccugaaugguauguagaggaggggagccagcuaagcacugaccagcgagggugugcacauuuucuuuggucuuuguuuugaaugugguguggcuggcugcuucaauuccugacuugauuuccucaaaaggauaggcuguaacccagaaugguaaacugccuuuuuuuuuuuuuuuuuuugacagggacaggguauuuuaucacagcaacagaaaugaaaccaaaacaacuccacaauaaaauucuugaguuucuuggggccaagaagaugacacgauaagauaaagacacuggccaagcaugaccuccagaguuuggcccuugcauaaaggagaaaauuaauuccuucaguuguucucugaccuccacaugcguccuguaacauggguguaugcauacacauaaacacacauccacacguuguuaaauaaauaaaaaaaauauguuaacaguuc

SEQ ID NO: 396 - RNA, 29945 nt, Mus musculus
caguuugggaauguggcuucaggccuggccguuuccucuuuguuuaguuagcgauuaccaaacacuuuugugugggugcggaucgggcuaccggacugccuugaaucucugcugcuugcgccccgaaaaggaagaggaucaguaccacgugaccaccggcggcaagcuccguuaggaaaagaugugaagguuagugaaacaagaucauacuggaguuuuuuacagagccuggugacucagggauggcucgguaaaaauaccuguagacugaggucguagaagccguccuuggugacuaagguuucacguaucucaguuugucaaauucuuuguuaagugguucaaaacauugagaaagaccuuagggcccuaacagaaacuuucuucucaaugacacaggaggucucggacucugagucaguggcccugggcuccagagcaaaguaagcaugggaaugcauggaauuuauuuguaguuugcaggaaauaaaguguuauuguuagggacguuuccugucauaaacacacacacacacacacacacauauacaucaacacuuuaauuuggcuuuaaaauagcaaccuuagauguuguuuuugauccaggaacguaugggaaaccccaaauuauauguguuuuguguuuucuuugccuuuuuugaauuugugguguaagaauucuccauauuucucacagauaggauguuagauguuucuaguuucuuggugcugugcacguaaagauguaugacuucacuguauguguguguguaggugacacugcaguauaaauagggagauucuagagaguucugugaugcauuagauaugaaaaacuagccuuuugaggcugauguguagcucugugucccaguacaaaaagagcaaaaaacuuaaaaaaauaaaacaaccuggcgcacaccuuuaaucccagcacucgggaggcagaggcaggcggauuucugaguucgaggccagccuggucuacaaagugaguuccaggucagccagggcuauacagagaaacccugucucgaaaaacuaaacaaacaaacaaacaaacaaaaaaccaacccaaaacuaauaauagcacugggacucccaauuagggaggaaacuauuuauguaugacauucucaaaaagaaaauuuuaauuaaaaaaaagaaaagagugcucacuucggcagcacauauacuaaaauuggaaugauacauccuggccccugcugcaaggauggcauguaaauuugugaagcguuucauaaauuaaaaaaaaagaaaagaaaagaaaagcaagguggagggugguaagccugcuuggggugugccggcggggggguggggggugggguggggggcuuggcagagugcaggauguggggguggugugcgggggggggggggggagggcgggcgggggaggugcugggaagggaagaaaguccagccuuccuccccagugcuucccaagguuuuggaaacuaucuuagggacuuuucuucuugagagagcaacacacauagauauucaacaguuagcaccgauggucuggaccaucuacgaguguggcugaaguguuaagguccuggggcuuauguuaaggagucaguguccugggagguguuaggguagugaccauuugccaguugauauauaaggauguuauuuuuauaauaauuuuaauuauuuguguauauaaguauauauauugguacacaucacaugugugcuccuggugcccauggagaugagggguccaggauccccuggaacuggaguuauagacaguuguaaacuaugugggugcugguaaucaaguccggguacucugcaggagcagccaguguuuuuaaccacugagccaucucuccagcccuguguuuucuuucuauucauuuuugguuuuucuuagagacagggucucacuguguagccccaccugcagcuugcuguguaacccaggcugaccuugaacucacagagaugcccuugucucuccugacuacugaguggugggguuaagugugcaacugggccuuuuuccuuucuucuuuuagaccuauuuauuuuauuauuuuauguguaugaguguuuuucuugcagguaggucuggacaucuugugcauccugaaguuggaguuggaugcuugugaacccccauucaguugcuggaaaugcagauccuuuaugaaauagcaaguguucuuauccacugagccaucucuccagcucugggcuuuauuuucucaauuguaguuagcuuauuucuuggauucagaaaagcccuuuggauaagcccucagcagugagggucagacuugugcauggagauagagaaggcaggaauguguccugauaggcuucccuuaagcccugggcacaccccugucggcuucagggaaugauuaaauucccggguugcucaauuggagucccguuuccguugcuagaugagguggcgaucucuccuggcccagccuccacuuuuuuugaaacaaggucuugcuucauagacccugcugaccucaaaguugccaagauccucuugccucagccucuggaauucugggauuacaggcacauaccacccuggguucacauucucucuccuggccuccucuucuggcucuuucucacuuauuuauagcagauugugugcuguugauucugcagagcgguaagacggugagccucaguagcacuuuuuugagaugcgaggaggagagaggagaaacucugagagggaaggggcagguugccaaacugguuuaacccugcucuggaaggccaaccagaaaaaaacaaaaguccuagcuuggcucagaacaguuuagcuuaccaacaaagggaauuggggaagagaaggaagaaaacagaagagaaagggucaggggaagggcuccaggcuccucucugcaggagagcuucgaggagugcucaaaggccuggcuugggaaacaugacuguuuauucugaggugugagaccugggggacaugcuacccugaucuauggugauauuuaaccugaggaguggaaggagaauugucuucaaaagcagcaggcugucaguuuccuggagauauugcuugcgcacuugaguaggugaaggcccgggucugccugcguucaguucucagaauucacagagcagaaaugaaaguugucuucugacuucguacgugugcucccuagcacaguaaauaaguguaacaagacgauuuuuaaaaggaaacacccguuuucuuuucuuuuuuuuuuuucuuuuuuuuuuuuuuuuuuuugguuuuuuugagacaggguuucucuguauagcccuggcuguccuggaacucacuuuguagaccaggcuggccucgaacucagaaaucugccugccucugccucccgagugcugggauuaaaggcgugcgccacuacacccggcuuuuucuuuuucuuuuuucuuuuuuuuugguacucguuuucuuaaaaccacuuugcagaucuaaugucugugcuuccucuggugugcaccuccacuaaggccuuaaagcauuccugucuccaucuuuccccagccaucuaucugcuuccugccacggugcacaucuuaucuugucaucuccuuccuuaucuugagacugcaaaacaugccagaaagucuagaaugaaauuucaguaacuggagucauagcgacagauagucgcuggcugucuuccuaccuagaccauuuucaacaccacuccuccuccuccuccuccuccuccuccuccuccuccuccuccuccuccuccuccuccuccucuccuuccuccuccuccucugcuuccucuucuuuuaaaagcacacucacccucagacccuuuguuuuguagacccuggcugguuuugaacucacuauccugcuucagcuucccaaguccugggacugugugagccaccaccccgguuuauguacgcuucguaucuuuugaauauuugaaaggaauuucccagggaguaauuuugaguguaaguuaggauugcugaguuuagaccuuauaucuacccucucuaccacuccuuccaccccaguuuuucuguguggcuguggcuguccuagaacucacagagaucaucccccugccucugccuucugacugcugggauugaaggccugggccuccacuagccagcugaccuuauuucuucuuaaguaaagauguaaaaugaaccuuuuauaaguuauacuugaaaauugcuucuaaaggcauuuccagcugaguaaagaucucugcuacucuucaguugagcauggaaugaagugacugccggaaugagcuugggauuaggagagguuucaaacacuagacccacuaucuuccugcccccugccuuccuguuuugagacugggucuaaaguauaggagauggaccuuaaacuucauguggauugagucgaacccaagacuccugcauacgaggcaaacaguuaccaacugaguuauauucuagcccacguuagacucucuuuucuaaucauuccuccuuucuuguccuaguuuggccccuugcuuggcuugguaccaccucugguuuggauuuugguacccaaccugggccuccaugccuaagcuacuuccuaggcugcaagaaggacagaacacuggccuucugaucuauucagccacaugcaaaugagguguguguguguguguguguguuguuuugagggaccuauuuuuacucaggugcccacaacccacacccuucuauuuacucucccaauaugccuuaugaccuccaguaugcuggcugcuugugacagccuucucugaaguucugagcaaauuagauuuucuccacacaugagacugugggugagcauuacacaaaugauacugagugacaggaggcaguagcacaccaggugcuuuguaauacuuguaugcaagugaagccagugguugggacagugacugggaugagaugggggaggcuggcggggaguagagcaagggagcugggaugcugcuguugcuguugaguguucuacaacuuaauuugagugcuggcuacaagaguauuuuuaauaaguaaggguacugcuauguagcccugccuggcuuugaguucguggcaauccugccuccuguucugagugacagaauuauaaauaugcaaauugcugcccaguuauuuuuacuuuuaaugccuagauuacacaguaaguuagggccagucuucuucauacuauagaauuuuuuuuuuugguuuuucgagacaggguuucucuguauagccuggcuguccuggaacucacucuguagaccaggcuggccucgaacuuagaaauuagccugccgcugggcaugguggcgcaugccuuuaauccuagcgcuugggaggcagaggcagguggauuucugaguaucucccuucuggguuuuguugccucuuuccgcucuuauacagccaccucgguuccuggcuuaucucugugccaaggacaugcucaucaggcaagcugucccacucugacccucccacuacguaugcucaggaccuuucuggagucugacauuugacuaaagcaugcauguauauuuggucuggaucacugacaacuauauagcgagaggccugacagccuucuauauucagaagccaagucgccaucaagggugacaaaugacaccaacuaaugaccacaguaauucacuguccuguuuaaagacacuauuuagcaaagucaagguuaaaaccauguaauggaacaaaugaaggggcucugccucccaagcgcugggauuaaaggcaugcgccaccaugcccaguggcaggcuaauuucuaaguucgaggccagccuggucuacagagugaguuccaggacagccagcccuacacagagaaauccugucucgaaaaaccaaaaaaaaaaaagaaagaaagaaagaaagaaauuugccugccucugccucccaagugcugggauuaaaggcguguaccaccacacccggcucauaguauagaaucuuguuucaagaaauauauaaauagggggcuggugagauggcucaguggguaagagcacccgacugcucuuccgaagguccggaguucaaaucccagcaaccacaugguggcucacaaccauccguaacaagaucugacucccucuucuggagugucugaagacagcuacaguguacuuacauauaauaaauaaauaaaucuuuaaaaaaaaaaaaaaaagaaaaaagaaauauauaaauagggcuggagaaauggcucagccauugagcacugguuguucuucuaaagguccuagauucuauucccagcaaccacauagucgcucacaaccaucuguaaugggauccgaugcucucuucuggugugucugaagacagugacaguguacucaucuacauaaaauauuuauuuauuuauuuauuuauuuauuuuauuuauuuauuuugguuuuucgagacaggguuucucuguguagcccuggcugcccuggaacucacucuguagaccaggcuagccucgaacucagaaaucugccugccucugccuccugagugcugggauuaaaggcgugcgccaccaugcccggcauacuucuuuuuuuaaaagaaauauauauauuuauuuacauguaguuacaguuugugacuuuuuguauguaaaacuuaaaaacauugauuuuguuuguuuguuugcuugagacaggguuucuuuguagcccuggcuguccuggaacucgcucuguagaccaggccggucucagauucacuugccucugcccuccaaaugcugggauuaaauuguacacuaccacuaccugacuugauuuguuuuuguuuuuuuuuuuaagauuuauuacuuauuuuuacuugcacugauguuuugccugcaugaaugucuguuugagagugccagguucucucgaacuggaguuacagacaguugugagcuaccaugugagugcugggaacugaaccugugucuuuuggaagaacagccaguauucuuuuuuuuuuuuuuuuuuuugguuuuuccagacaggguuucucuguguagcccuggcuguccuggaacucacuuuguagaccaggcuggccucgaacucagaaauccgccugccucugccucccgagugcugggauuaaagacgugagccaccacgcccggcucaguauucuuaaagaaugagccaucucuccagccuccuugauucuuuuuuuguuuguuuguuuguuuguuuuuuguuuuuuugagauccuugauucauuuuuaaaacacuuacuuucuuuuauuuauuuagagagauggucuuacuuuguagcccagguuaaccuuaaacgcucguuucuccugccucaguuucccaguccugggauuucaugcuacuacaugcaacuacaugcaacuacaugcaacuacauguggcuaauauaaacuuuuuuguuuuugaaauaggcucuuacuguauagccuuggcuguccuagaacuggcuauguagaccagaaugucuuuaucccacagaaauccaccugucucugcucccagggugcuggaauuaaaaaagguuugcuccaccacaucaggcuaguagagacuauuuuaaaauguuauagugcauuuaauuacuuuuaaauccauuauggugauuucauuuuaaaauccacuccauuggaccauaaaguauugcuuauauucaguuuucaguuauuggguggucacuguaauugguauggauaggucaaaaucaaagguuauauguuugauuuuacuuuuaaacauguggcuguguguguauguauggcugugugugugugugugugugugugugugugugguuaagggaacucauuuucccagagucuauuugcauacaauuuguucucucugcuguucauggaagccucaggauagaagugugggacaugucaccacagguagggacaaugauggacacuugcuuuugccuuccaaccuggauucuccauucugugacaacagugaccugcccuuggcuuggcagguaaucaguuacuagccucuggguacaguaccaucuugaccauaauggugucgaugauguuaacaccucacgguuucugagggcaaggguuugggcaggcacagcuugcuauggcuugcugccuggaucugaggcuuguuuccaaacuaacagggcuauuggcagaacucaguucuucucaaguugccuccccuucuuggcugugaucugaucaccagcccuacuuccuggaggccacucaauuccucgccauaacauggcucccuauuuugucaagccaguaagagcaggauaccauuagcgagcggccucucaagccuugugacauauaacugcauaccuaggcucuuuauugacuggugaggagcuagccacaggauguguaccuucucaaggcaaggauugcacaggggugugaacacugggaggcacaguuguggcagcuggccugccuaucugccacugacacagcuguucaagggaagcagaccgcuaugccccaggacaagccgguauccacacacucuuuccuguccacagaaguuggcuacaggugauguauggccgaagugacugcaggguugggugagcaggcugaguuuuuacauagugcagggaagagaguccugggacgggaagccaaucugcaaaggcugggcuagaguccauugcgagaaacaaugucauucugcacucauggagacagacagggacguucaaaggguguaggucaggcuggaccacuuaauaagacccugucucagaagacagaagcaacaagagaaaucauaaaaguauucguccuuuauaacagugggucucauuauaguauuuuauauuuuuauuuagaguaguuuauauucuucuuuauuuauuauugacaggucucugucauacucagguuggccucgaauuuaccaucagccuccugaggacugagauuacaggcauagaucacuaugguaugacagguuuuuggguuuuuuuuuuuuuuuuuuuuuucaagacaggguuucucuguguagcccuggcuguccuggaacucacucuguagaccaggcugaccucugccucccaagugcuucgauuaaaggcaugucccaccacaccuggcuaugacagguuuuauuaagaugccuuaauauauauaaacaguauccuuugaucauauuuaucuucccauagugcccuauucuuuuuuuguuuuauagucuucacauauaagagaaacauacacaguauauauauauauauauauauauauauauacauauauaugcaucuauauuauauucauauguaauuuuucauguuuuucagguuacccuguaagucaccguguagcugaagaugaccuugaacuucuaauccuggcucugcuccccauuucugggauuauaggcuugggccacuacauuccauuugugaguuggggauugaaccuacuacuuuuguuuuucuuuuucuuuuuuugagacagggucucucuguguagcccuggcugcccuggaacucacucuguagaccaggcuggccuugaacucagaaauccgccugccucugccaccggaguacugggauuaaggcguagcgccaccacacccggcugaaccuauuacuuuuuauaaacuacuagguaagcauucucccagugugucaugcccccauuguucuuucuuucugagccucauguggccuagguuggccccaaaccuacugauagaagaugcugacuccuuauucucuccucccuccacuuucuuagggcugguauuccaagagcaggcagguacacccagccgugagucagggcuguuucuccuaacaugguuagagauuuuuaguugcuaucagaugguugguugguugauuuuagacagucuucuuugucucuugaacuggccuucaccuguacuucucuauguagcccaggcuggccuugaauucccucagccugauuuguuacugagauuuuugucucuagacuugucccuuuucccuuucugaagugagaaagcaaugagcauugacuaaauagcgaaacagauaucuuccuauucaacaagaacaagagaaacggggacaaagggagguuauagauacgguaucaaaaaugaggggaagaaagugcuggagagauggaucagcaggugagggcguuagcuauucuuccagaagacgccaguucaaauuccagcacccacauggcagcucacaacugucuguaacuccaagaucagcacucucacacagacauacaugcaggcaaaacaccaaugcacauaaaauaaagguaaauuaaaaaaaaagauuuuaaaaaugaggugcugauaagggugauggguagugaagauauuuauucaucucuuuucugggaaccuuaaggcagucucuuuuuguuccuuuuauaguucccugccacgguuaccauggcaauugucaacaggcaucgugcuggagaguaugccauuuagccggcagauagauuacaaugcgguuaaauguugucuggcuguugcucugguggccauuuuaggugcagacaguuucugcucauacacuuuccugaagccccgaacauuuuguccucaaaaugcacuaagaucagaaacacagucaggcugugcuuggggcgacaaaauaggagccguuuuccugcagcagggccauuugggucaagcccaccugcgguaggcucugcuccauauugaaaaucaccgcagcugaugggauacaugugcuaucuugacuagacuuuuuucuaggcaauguuuggaugguacccagcaccucauauguucaacaaaugcucccucacaccauccugccuagugugccugaaccgcgcucaggaaacgaguaauguugaggaguaaaccuaugauaaaugugagauuuuuguuuguuugguuuugguugcuacugagcuaauuacuggcuuugggauggggccugggcaccgggaaagcgcagggaaggaagcgagagaggcugcaaauuuguuaccagugaucaacucagucacgaacucagucaugccuacguagugaacauuccacaaagaccugaguucggagagccaugagauagauggcuggcuguucuaagcaccuggaagcuggcuuucccucaaaccccugucuugacuaugcccugagcccugugcgucccuucaucuguuaccuaguucuacaguaagccagcaagccuguuuccuuacuugcaacaccagcagauuagccaaacaggaggagggaggcacagcugguguggugguuugaaaggaaaugaccuccagaggcucacagggcguggcccuaugaggagguguggccuuguuggaguagguguggccuuuuugaggaggugugucacugggggaagggggaggagcuuugaguuucagaagcucaagacaggcucaguguggcucucucuuccggcugccugccaauccggauguagaacucucagcuacaucuccuucaccauuucugccugcaugcagccgcgcuucccacuaugacgauaacggaccucugaauuguaagccagccccaacgagacuuuuuccuucauaagaguugcuguggucaccacggugucucuucccaggcaccgugagccugaauagcacugacuagcacagcugaguuguaguugguuagaagcacaacucaaaaacgauccauagcgacuggcacgggauguggggagccugggaccaaagugucuucaacgugugggaucugacacggugaccggcugaauggugucauauccaaagugaguugcaggacugagcuguugucugauucggggccuacucgugacuggcuguauagauccugcccgccuccccaccccaccugcacgcaccuguucacagauguuuuccgugaugauugaugacuaagcagagaaagaacuuugauuauuuuguccucucagauaaccucuaaauaugucuccccuagggggagacaguagggccuucaagaugcuuuagcagguaaaagcccuugcugggcagggcugacaagcggaguuggagcccuggaacccauauacaaguggaaggauaaaucguccugaagcugaccucugaccucuacacgugugucaugacacauuugcacacucuucccuuuaugacuugaaaaaaaaagucaggugucaagaaggaguggcugcuguuggcacccccuucucugcccacccuggagacagggucuuacugugcagccuaggcuggucuugaucccccugccucagcaucgcaaggauuacagcugauccaucaugcccagcuuccccuuccauugucugaggaagcgguucuucaccuguggucguauaucagauaucccacauaucagauauuuauauuaugauucauaacagcagcaaaauuacagucauaaaguagcaacgaaaauaauuuuaugguugguggucaccacaauaugaaguguauuaaaggguagccgcaucaggaaggcugagaaccgcugaucagcguuuggacaacaaauuaaauagucagccaagguuuaaggugggcuguucuguuguuguuuguuuuguuuuaacauggaaagccuuagggaggcccaccauuagagucaagcugaccuacaggggagagcugcagauguucccgcccuuccucuguaacagccguucucaaccuuccuaaugccacgccccuuugauacacuucuagaaucauauuguggugaccccccucagccacaaaauuaccucacugcuacuucauaacugucguuuugcuacugcuaugaguuauaauguaaguaugcuuucggauggucuuagaugaccccugugaaagggggucgcgacucacaggucgagggacacugcuguacaagugaggcugaaaguuacuuucagaaaaaaggcauggcaggaagcugaggugaaacugaagacguggggaagaagagaagggcgguguaggucacacaacagugacaugagcucuggagacaagucaggcagauuggaguguggauucugucccuucacacuuguaugacugugucacguucaucuuucacacagugcuaacaaugcuguggacauugaggaucacaugggauuaacacacagaggugacugguccaggccuugcaccauaguaaaaugacagccaggaucagccuuuaugaauaagacucgauggaccuuuuaauauuucauguggcugugaauauauuguuccauuucacuaaaagaucccccagcuugugcuuggggaaaguauggcuuggaggugguaucuguuugcagugguggugggcaucuucugccucugcugcuucuccaccauacucugaugcuagguccccagagcccaagacacuucugcugagggaccuacugaaugcacacaggcuggcugcagggauggcucccaucuccaccgugaccguucuuuuguguggucuguuggccaucugaggauucggcucccaggguauugcacugcaccauuuacuaugcugacucuugucuuggaggcuuugugcguugccagucccuggccaacacaguuuucagaaggccagcuuccccuuguguuguucacucauggcccaaacuaaacuaagaagugugauuguucggagcuucugagguugaggacucuugauuuacuuucaaagauucagauaccaaaugugaacuuggcaagcccacccuuccuaagucgagucaaaugcacaccgcugucuuugccaggguugugcuuccaaaagcagucauugccacccucugcagaccguuggcugccuuuguuucagaagcuguguggucccuggaagaacuuagagcuucagucaugugguuuccagggcccacggccucaugcucaaagcuggauggaugcacagaccccaaacuuggugaggucagaugagguaccagaucugaaaggcauuacuguuguagauuacuguaaaaauauaaagcauuuuaaauaugcauuggugaaaaaaauuggagaauuggaguugaaucuagaaucuuaguauauuuuuaaauguuauuuuauuaauuaaaacaaugaaacaugaaaauuuuuaugugaguuuugcuuacauggaugcuuacgaguacaugcaguacucagagaggccagaaggcggcgcuggauuuccugcuugugagcugcacgugggugcugggaacugagcuugggucuucugggacagcagccaguucaucucuccaguuuguaguuaauuauuucuuaacacugggaauugaacccaggacuucaagugugguaggcaaagcuauugugccuagccagagauuuuuuuuuuuaaacaaaaaaaaccuugagauaggaucuuacuacauagcucaggcuggccuuguacuccugaucuuccugccucuuggcuccuaaguacguguguaccaucacaccuagcugaauauguacaagaagguccuaucuccuuccuuccuuccuuccuuccuuccuuccuuccuuccuuccuuccucccucccucccucccucccucccucccucccuccccccuucccucccuucuuccuuccuuucuuuuuucuuuuuagauuuauuuuuuauguagacagcguucuacugguauguaugauugcaggccagaagaggacaccagaucuuauaaaugguugugagccaccaugugguuccuaggaaaugaccucaggaccucuggaagagcauucagugcucuuaaccaucucuccagccccagggggcccuauguccuuugucaccucuagauuaugagauuaugacguguaguauuuccucaggcuugccugugugcgcuauuuaauguugccauugugaagggggaggagaggggagcuugauugaaucauuaagucaugggccugagacagaagaguugcuuugaguuggaggacagucuagccuauggaguaggaccccacucaaagagaaaaggaaagaaagaugcagcuagaacauuacugaggcgugagauggaaagaugcuccaccaguugagagcacacuggcugcuuuuccagaggaccuagauuugagucccagagcccaugcgguggcucaucaccaucaguaacuccaguugggggugugucuguggggguguccaccaaccucuucuggccuccgcaggcuccaggcacccacaugguacagagaccuacaugcaggugaaacacccacacacacaaaauagcaggagagagauccugaaguucuggaaggaugcuucuguuguaugcagcgcaggcucuguggcccagacccggccucuaagccucugcuucuaagcuggccguuacucccagucccugcauccacaccacauggccuucccagugguuuugcagcuuccuuucgguuuggagccuggaucacuggagccauggaaaccaauccucuguggcacuuccuucagagcacaucaacuggaucacucuugcucucugucuguggccuggggaccauuuuugcccgcauauacuuacacaaaaaauauuuauuuuuauuuuauuuuauuuuauuuauuuauuuauuuauuuauuuauuuauuuauuuuguuuuuuugagacaggguuucucuguauagcccuggcuguccuggaauucacuuuguagaccaggcuggccucaaacuaaaaaauccgccugccucugccucccaagugccgggauuaaaggcgugcgccaccaugccuggccaaaaaaauuuuuuuaauuaaaaaaaaaaaaauuggacuuuuaacccuggugcuugguaggcagcaaguuugagaccagccuggucuacaaagcgaguucuaggacaggaagggcuguuacacagagaagaaacccugucucaaaauaccaaaacaacaaauuuuguauguguguuuugccugcauguauaucugaguaccacuugcaugccuggugccccgagaagcuggaagccaguguuggaacuccuggaccuggacuuauagagaguugugagccaccacucugggagugaaugcucuuaacuucugagucaucucuccugccccccauauauauauacacuucuuaaaauaauuuucaaaaauuuuauucagucuuggacagauggcucaucagguaaagaucauguaaaaucugucaccugaguccaauuccuggaacacaaguuguccucugacagggcuggagagguggcucguggguuaaagagcacuggcugcucuugcagaggagcugauuuucguucccuguacucacguggcagcucacaguugucuguaccuccaguuccaugagaaucuaacacccuccucuggcuuccauaggcacuguguguaaaccauguauguacauuuacauacauacacauuuauauauguucauuuacauguauguaaucaggcaaagcacucagauaaaauaaaaaaucaaguaaauuuuaaaaaguccucuaacaucuacacagaugcccuccccauccuguguacauacacaauuauaaugcuuuuuuuuuccauuuuuuauuagguauuuagcucauuuacauuuccaaugcuauaccaaaagucccccauacccacccacccccacuccccuacccacccacucccccuuuuuggcccuggcguuccccuguacuggggcauauaaaguuugcaaguccaaugggccucucuuuccagugauggccgacuaggccaucuuuugauacauaugcagcuagagucaagagcuccaggguacugguuaguucauaauguuguuccaccuauaggguugcagaucccuuuagcuccuuggguacuuucucuagcuccuccauugggagcccugugauccauccauuagcugacugugagcauccacuuauguguuugcuaggccccggcauagucucacaagagacagcuacaucuggguccuuucaauaaaaucuugcuaguguaugcaauggugucagcguuuggaugcugauuaugggguggaucccuggauauggcagucucuacaugguccauccuuucaucucagcuccaaacuuugucucuguaacuccuuccauggguguuuuguucccaauucuaaggaggggcauaguguccacacuucagucuucauucuucuugaguuucauguguuuagcaaauuguaucuuauaucuuggguauccuagguuuggggcuaauauccacuuaucagugaguacauauugugugaguuccuuugugaauguguuaccucacucaggaugaugcccuccagguaaugcuuuuuuuuuuuaaagaaaauuaauuaugcaguauucugcacaaucucaauuggaaggucaaugugaacacauuuaauaugaaaauuugaaaacauaggaaauccauuacagcuucuuuaagugcaucucuuccuccucauccugggccguguguugagacuuuuuuuuagagauaacgcuauguacaugcgugcaugugugaguguauguguuugcauaugugcagagaccaagggugcugcuggcauccucuuuagucagcagagcacagcccugacggcccacagugcuccagaugagacacugguugggauggacgcagagaaauuuguguuucacagggacuuagcacuuaccagcauccguuuccauccccacacccccuguagaugcuuauccuaaggcagcuuguccuuuguuggugguccuuauucauucucgacuguacaacugugugugugagcauccuaaaggcaggcucugaaggucagcaguggccuuccgcauggagguggcaucaggaacugaugggagccucacagauccauuacauuugauaggugagguuuaaacacagaggaccuuugauugacacacaucucuucuggggauggacugguaaggaaguagaggcucucacccucugggugggauaagaguuggggugugugugugggugcuuuugaaguaggcuggggagcaucuguugugauuugggguagagaguggauuagcuuauguucucaggcugauuaauuuuaggaaagaaaacauauggacacaguauuuugaaaugauuuccuuaaaagcucugugcccacguacccucuggaaagucuucauguucccauagagggauucuuacauccacuugauuugacucaaugcgccuuccuguaacuaagcaacacuuuccuuuuagugauucggaagaauuuugcacauagcgugcauguuaaagaaagcagagccucuguauuuauaccgugcguuacuucauaugucaagcaagaaaaauuccuugggggggggggcggggcagaugugguagagacagcauagcaccauaguugacuucuccauuugcacacaaaauuuguucccguugaagcaaaucauuguguacagcccugguguacagccuuagcuuuuaaacugagauuaaaacggauuccucaaaaggaugugagucuccgcaaggucguacauauaaagcccuccuuacaguacacagcauauaccaacuauugaauaaauauccguuguuaauuuagguauugcuguguuugccagcauggguaagcuaagauggugguggaauagcuacugcuauuccaaagacaauguguaaacuguggaagaacgaguucuggaaaggccauggcucugagugauacuuuuuggauauuucaggauaccuugucauuacauaauguagaugaacgauguccggcuugccaugggcucacuugcgcaaaacauauguaaagauaugacuuccaguaacaauaccaaaacaccuuacuugguccuugugugggcaaucgucuuacuggguuacacgguuuuaaucccagaggaguugucucuugacauuaaacuguccaaacaguauuuauaucugaggcugcccugcaagaucacuuacccugcagagccguuuaaaaguaguuaaugacagaagcgacgugacucggcccucaugagugaucgccuaaguucgacccaugcugucaugguuuauggaggaaggcaguuuguccauacccagcguccaccacagcagguaauuugaaaugaaacgagacaguuucuacaagcagauugauuugggaaucuugccuguucuucccuuugacccuugacaaguugacacuacaaagauugugacuuuaaaaaaugauugggugcaaauacauuuagguagaugauuuacugugcgcugaagcaaggacaguggccgaggugaugcugcgagggaggugacuguaaacuuuaacaacucagguuuuauguuucuguagcuuauuaauuaucccgccagguaaaucuacugauagcccuacaucaaguaguuuauauucuuggcaagagaccagggaccugauuuucuggugagagacuuggcacccaguuucaagacuaagugaugugguacucauauuaaccuucauugauauugcaggugcuggucgccaucuucguaggaucucaaagcaugaacgugaagugagauagcuaucucaguuugugaucucucucucucucucucucucucucucucucucucucucuagcauacagaggaauaaaugcuaaauaugauuaaaguaaugauaagcuuaauuacacacacacacacacacacacacagaguuaaggaguuaaggacuugccagggauaucuaaaaggaaauucugcucugaauuaacacauuuugggggcuagagaucuggcuuaguggcacucacugcccucuggguggacucaagcuugguuuccagcacccacgucaggugacucacaacucucugcaaguccaucuccaggagaccagaugccuccacagggacuugcacucauauguguacauauccacaugcauagauacacaccuacauauaguuaaaaauaauaagaaugaaucuuaaaaaugaguuaaugcacucuuuuagaauccuuugaaauugcauugagauuucauuguccucuguagcaguguggcuggaacccagagccuugagaauucaggacaagcacuuuaugucugaucugcaucccccaacuccacauuuagguucuuauaacaaaucuauucuauauaucuauaucuaucuauaacuauaucucuauaucucuaucuaucuauauaugagagagagagagagagagagagcgccuagagcuugcuauguagggccaggcuagcuuugagauccuccuuucugccuuugccucccaaggacuaugaucuaucaacauaauuuaaagaugaaguauucucuaaagcaggcaccaggaagagccuuugaaacauguuauuccagguguggaagggcacaccuguaaaucuugcagaggaggguaagaucuaugaguucaaguccaaccuggccuacauggacaggaguacacagugaggugacccccccuccucaaaguuaucucaucuauaaucaugaagugcuuauggcuacauaucuacaugaagugcuuauggcguucugccugcaugcgugucugcgugagagugucaggucuccuagaacaggaguuauagaugguugugagcugccaugugggugcugggaauugaacuuagguccucuggaagagcagucagcucuucacuaauuacucuuuagagacaggguauuguguaguucaggcuggccuugagcacugucuccuuagugcugggauccugggcuguccuaccaggccuccugauaaaugaacuugguaacagagaauuguugauggguuagcguuuagcuccgggccaggcauuacaggccuccauacuugcuagagaaauauccauucugcgaggaugggaaaccuugggcuauucucuguagcuuuuguuccuuucugucuuucuauuuaccugcuuuguuugaaauauaaauugaagaugcucuuaaaaaaaauggaacaguuuccccauuggucucuguuuaaauuauuuacugcccuuucgagccguaucuucauugaacuauguuaaaaguauuuugcugaaauguuucuuuauguuguccaucggguuuaauagacgucccauuuaauaagcucucuaccuguaaggauagacuauuugaccucuaugcccugcuacugcuagacauaguauaagauugcuuugugaaauaaagcugucgguaacaucaacaaaauaaaaaaugaucguauuccaauacucuccgcugaguacucugacagcgcugaaauauggaauaaaauugaaaguagauuaguuuugggucuuaagucauguuuugacaagaaauaagagaggagaacauaucuuugaacuuuuaguuuuaaaguuuuuaaugaaaauauuuaucauuuuguaagcuuccuucuuucuuuaucgcaucuaggccguaugaucuuaaaacaauccguucucugauugugagggacauaaauacugcucuaucuuuauacuaaauaucauaaaggagacgcgcacagggcauggcagcuugacacuuguaaguuaaggagugucaugcuaauaaaaaaagcuuauugaagagguugggaaaucagucauuaauaagcuacauauuuccaggguauguagagcauguaaauacugcagacaagcaggcugcguuugcuguauuucuaaacucacccuucuggaaugguuugaaucugaagaggaagaauaaauaugucacgggggagaaggccuugcuggcgauugcuuccaaccuggaggaaugucagaacugccuagacaugcagauugugaaacgccuugccuuucgcuucuuugguuacauauuaaucaaaugaacucccgagggagagugguauggaugguuggcagagagggcuggccgagugggugacucuccccccacucccccaccccaggcagcugcaaacauccugggccaccagauucgggguuguggcuuccuugaagguacagagccucccuccuccucuuccuuuccuaugcagaagguucccagagggcugccuuagcagugugcaccucacucggaacaucucuauuugugugcuuucccacagacugggggcuagccccucccugccuuccucauuguguccacuugaggcaaggcugggcacgagagccuucaaugacagcuucucagauggacaucucugccgacgguccccuccuaagcccaccuaagugugagucacaugcuagccuaagcccaccaugcuagcgcgugacuaagacgagcuagagcccuugagagauucuuacuguuuucaguagugaaaagggcaauucuguguguuuguauuuuuuuuuaaucauauuuaugauugaguccagcucauggaugcucucucucugagcuacauuccuuccuucuuuauuuuaaaagguuaguuuuaucauuuuuuauucucaugucuguaugcaugugaguguagguacccucagaggucagaagcaagcuuuggauccugggguacuugggugacaggggguucugagcuacccagcaaaagugcugggaacugaauuuagguccucuguaagaacagcaaguguucuuaauugcucagccaucucucuagcuccuuuguuuaaguuauuucauuguagcccagucuggcuuuguagguguggguggcacugaacucccgaaggagcacuuagugaggaguccugcaccuccugccuggccuuaguguaaguguuuauaaggucucaaacaaucuuuccuuagauguuuuacagcuguucccaugaagaacauuuuaaaaauguagauggcuggcagauugcugaguucaaggccugccuggucuacagagugaguuccaggacagccagggcuacacagagaaacccugucuugaaaaacaaaaacggacaaacaaaaaacaaaacaaaacaaaaacucaaaaaaucacuuuaaagccgggcgugguggugcacaccuuuaaucccaacacuggggaggcagaggcaggaggauuucugaguuggaggccagccuggccuacaaagugaguuccaggacagcuagggcuauacagagaaacccggucucgaaaaacaaaacaaaacaaaaaauguagauggccacaugagauagcuauuuccugguaguggaagucaaugcuaaagugugcgguccuggagcagagccccuucauuuguuccauuacaugguuuuaaccuugacuuugcuaaauagugucuuuaaacaggacagugaauuacuguggucauuagguuggugucauuugucacccuugauggcgacuuggcuucugaauauagaaggcugucaggccucucgcuauauaguugucagugauccagaccaaauauacaugcaugcuuuagucaaaugucagacuccagaaagguccugagcauacguagugggagggucagagugggacagcuugccugaugagcauguccuuggcacagagauaagccaggaaccgagguggcuguguaagaguggaaagaggcaacaaaacccagaagggagauacauuguaucuagaagauaacagcaaggagaaauauuggcggaaaaauaaaaaggguucuaacagggacagagauuugggaaacaguucgcugugaggagcuauguaaugaagcagagagagggagacaugacacucaucucuaugagcggcuccaguguccggcuugcuggcuguagcuguagcaccuuuagcagaugggacuuuugccagggccaaaaucuaaucuguaaaaugggauguugaugugggcggagacuggaggggcuugguagggcggcugcuacacugcagcugcuacacugcagcugcccuccggaccugcucaccuccucuucuguccucuuccuucuggaacaaggaugucaacuucucuucagaucugaagaaucugaggaggcccauuccauccuugugaaaggaauuucuacaaguuucuuauugucaguaagcaaaaguucuuauuauucucaggcguucgucguauguuugaaggacucugaacuagagcuuaaugucaauuuacuugauuuauuuauuauuuauuagggaucaaucagagggucuugccauacucagcacuuaacguucaccuugcucuugcaaaagaccugagauagguucccagcaucacguggguagcuagcuuaucaucacgugaaacuuaaggacugggagaguggacgcucuggucucuagaggaacuugcacucacgugcacauacaaagacacacaugcauacacauaauuuaaaaaauaaaugagcauaugauuuuaaaauauuuuucaguagccccucauuguuuguucuguaaaaacaaguauuuguacaaaaggcauugaugccgauggguaauaagaaaaacaauaccgaggcuggagagauggcucagugguuaagagcacuaacugcucuuccagagguccugaguucaaaucccagcaaccacaugguggcucacaaccaucuguaaugggaucggaugcccucuucuggugugucugaagacagugacaguguacuuacucaucauauauauaaaauaaauaaaaucauuaaaaaaaagggaaggcauaacauaguuggaauauccuaugaaaugauaucauagugguacauauaucuguuuguuauguuccaggcaccguucaaugugucuugauauacaucagcucauuuaaauguaauaagaagccaguaguauaaugauuacccuuauagucugaggacucuuagggacagacggcuaugaaauaugucuguggucuuucaggaagagcuaggauuccaaaccaggaggaaggcucagccuugagugcuggcagaugccuuuaguagaagguggaucucggugagguugaggucagcuuggucuauaucguaaguuccagacagccagggcuccuguucucauucuccugccagcaaaacaaacacacgaacaaauaaguaagcaacaagcaugcaccaaccaaccaaccaagcaaccaaccaaccaaccaagcaaccaaccaaccaaccaagcaaccaagcaaccaaccaaccaaccaaccaaccaaaaaaccaaccaaccaaccaaccaaccaaccaaaaaaccaaccaaccaaccaaccaaccaaccaaaaaaccaaccaaccaaccaaccaaaaaaccaaccaaaaaaccaaccaaccaaccaaaaaaccaaccaaccaaccaaccaaccaaccaaccaaccaaccaagcaagcaaccaaccaagcaaccaaccaaccaaccaaccaaccaacuaaccaaccaaccaaccaaccaaccaagcaaaaaacccuaauccaggaacucuggugucagagucaugauucuuuuuugucauuguuguuuccagucaggguuucacugcagcccuggcuguccuggaccgugagcuguagaccucaaacucaggagauucaccugccugcaccuggagugcugggauuaaaggccaccaaggcuggccuccaggauucuuuuaaaaauuuuuuuuaauuaauuaauuaauuaauuaauuaauuuuuauuuauucacucuaugucccgcucacugccccccuccuuguuacccccucccuuaauccuuccucccucccccauccccuucuccucugaaccaguaggauccucccuggguaucacccuacccugguacuucaagucucuguagggcuaggcauguccucucccacugaggccagagagggcagcccagcuagaagaacauaucccacauacaggcaacagccuuuggauagcccccacuccaguuguuagggacccacaugaaggucaagcugcacaucugcuacauaugugugagcaggccuaggucuagccuguguauguucuuugguugguggcucagucuuuaagagucccaaggguccagguuaguugacucuguuggucuuccuguuggaguuccuauccccuuugggacccccaguccuuccuccuauucuuccauaaaagucccaagcuccauccacuguuuggcugugggugucuguaucugucugaaucagcugcaggguggaaccucucagaggauagccauguuagacucuugucuguaugguucaggaucugaagguuugaugaggauggcaggagaggugauggguaccccugggacagcaggguacucagagccccaugauucuuauaaaaccuggcacaaagcacuguuucuuaauucacucuucaacuaaccagccagccagcaaaccaacuaaccaacaacucacccauccacccaccuaaccaaccaacccaccaacccaccaaccaaccaaccaaccaaccaaccaaccaaccaaccaacguauuuauguggucucgacuggcaagaugggaacuagaauagggguuagaaagagauaguguuggcucagcaguuaagagcacugacugcucuucugaagguccugaguucaaaucccagcaaccacaugguggcucacaaccaucuguaaugagaucugacuuacauauaauaaauaaauaaauaaauaaauaaauaaauaaauaaaucuuaaaaaaaaaaaaaaaaacaggacagugguggcacacgccuuuacucccagcacuugggaggcagaggcagguggauuucugaguucaaggccagcuuugucuacagagugaguuccaggacagccagggcuaugcagagaaacccugucucaaaaaaaagaaaaaaaagaaaaaaagauugugccuucauguaauuuacagauaacugagggaagcagguauucaauacucaauucaugaauaucuuaguaauuacucauauaauucuaauaucgcaguggaagacagagguagcagguagguacuggaaggaauuugaucuagcaagacccuugaggaaauguggaguuguaucugaaagaugaaguccagcaucaaaugggagcugagccuguucuuccacguuccugggacagggaagucagugccuggggagaucacucaggucaguagcagccccgugcuagaggagacuggggccacacaggcggaccugugugggcuguggaagggaguuccagguucaucucccagaccagaagaguuugcagcagggagaggggcuaccauuuguuucuuuguugcucuucuuacuacagugaaaaggauggauuugauaugggcccaagguggaugugaggagcgggauuuggggccacugcagggcucagguaucauagauggaaaagcucaagacagaggauggcaguggauaggggugguguggaaagauucaagagguuauugggaagcagaauugaccaaaagcaugaaugaauuaaagagaggacaguuguuccauagucccugagcuuugauuuuggagcuuaaggaaggucuguauugauggggaccguggauaagaccagagugggucugcccugggaaagcugaguuuggaguugacauuguggguuuaauguugcauaaauaaauaaauaaauaaauaaauaaauaaauaaauaaauaaaauaaaguuuuaaaaaaaguaaauuccuuuagcuggacuuuuauaagaauugaauucaagaagaguuaggagcgggcaugcucaauaccuaccauucucucaugaaaccggguuuuauaggcgcggguucauuuauuccucgucccucaucauuuuauguuuaagagcaaaugcacuuaaaaccacuguuuggaacaucgcuuuuacuaaagaggggaccacucuaccaucaguguaauugcuucggcacugucuucauguagacagacuuguguaagccaucauuaauccuuuguauaauuaaugcauaaaaugcagaguuucuauuacuggaaaagcaaacucaagcaucacgcugguaauaucaauaacaugcauuuguaauuacauacuguagauaacucugaaagcuacauuuuauuacauuaauaaaacagaaaacccccugaagccacccagaagcaggcagcggugacgcugugagagcuugcugcuuugucugucaggagucugcagggcgcugguagccggucgggacacacauacuacacaaaaggaugauguucauauuucuauuuucaaaaauaguaugaauuuacuauacaaauuaaugagcuggauugugacauuuucauaugugugucauguucuuugauuauauuccaccuccauuacccuuuuuuuuuuuuuuuuuucuccaagacagaguuucucugacuguccuggaacuuacuuuguugaccagguggaucuugaacucacagagaucaaccugccucugcuuccagagugcugggauuauaggcgugcaccuccuggcuuuucucuucauucuucaaggaaugcccauacuggcuuccagagaagcuuggucacguuacauccaucucuauaguguaagcauccuuccuuccucgcuaguauuuguugugaucuguuuucugggugauagccauucuucauggcaugacauagaggcgcguuuguuuucuuuucucuuuuuagacagggucuugcucuguaucccuggaugguuggaacccauucuauagcccagguaggccuugaccaugaggcaguucugcgucagucugcugaguaguugaucacacaccuguaccaugagcucuugacauaaucugcccuucuacugacugaaaauuuucaugugucucuuuuucuuuccagauucuggauaucaaucucuugcucaguagauagggggguaacauuuuccucccauuuugaagcuugucucuucacucugguaacgguuuccauggcuaugcauaaacauuuuaacuucauguggaucauguucagggcaggacgaauguucaggauggacaagaccagucgcuacuccuuauggagccugucacucacaccauagaggaagaaaccaggagggcuauuuugggcaguucuaagaugcuccaaggacugaguaagucucucuucuagacaagacaugggggaaaaaauagcuucuuggggggaugcaagagugaaagucuccagauuuggagaucacuggagaacauucaaaccaucucagcagcuggcuccuguggucagugcuugccuagugcuuaaggaagagcuuggguuucauccccggcacuagagaagacagugucagagacgaugauggcucuguguaaccuacacuguguaaacagagaaggcauuucuacaagcuaaacaaaccaugaaaccacgaauccucacacccucguuacuaucucauggugauccaagauccagagccugucagaagcagauggagacacaacccagaacacccacaagccauucccauccaauuuaccccagaaaugcaacucucucugacugugggacaagguuaaaggguuuuguuuuguuuuucuuuuuuucuuucaguaguuaaccaccagauuugaaccaaaaaacauuuaguguuuaaaaaaaaaaagaagaagaaagaaagaaagaaagaaaaaagaaaauaauuuccaagaauaaucuuguauuuaaauuauugucccaggauguaugauuuauuuguacugauuuuucucccuacagcacaaaacaaugagguugcuuugcuuggguauaccgagggacuuugggcuguccauauuugucuacaaaaaucuauugugggaaucggagagacagcucagugguuaagagaacucgcugucccugcaaccacacagcaccugacaacuggccauaacucuaguucuaaggauacaauguccucucagacuucggagagcaccaggcaugcauguggugcauagacacacaugugaggaaaacguucauagacauaaacuaaagaaaucuuucuaaaaaagguuuuauuuaaaau

SEQ ID NO: 397 - RNA, 393 nt, Mus musculus
cucaagcgaagguggaaccguuccagcccacguuggcagcguucaugucguaauagcugauauaggcccgguccgggcugaugugcaggcgaucggacagcaggccgcacagcagcuugcuuuaguugcgguucuggguaccaccgaugcugugcaggcugcagagggcgcagggaucguucgugccucuaaaagucaugagcugguccgggagcacgugcacugcgauguacugugcgggcuugccgguggccugcgccagcugcugggugagcuccgacagaaaccccucuggcacggaggugcggggaacauugguguucacgaugaacauaggcauggugguggagagacugcgagcguggaccggaggacgguacaaagcgcgguguc

SEQ ID NO: 398 - RNA, 393 nt, Mus musculus
gacaccgcgcuuuguaccguccuccgguccacgcucgcagucucuccaccaccaugccuauguucaucgugaacaccaauguuccccgcaccuccgugccagagggguuucugucggagcucacccagcagcuggcgcaggccaccggcaagcccgcacaguacaucgcagugcacgugcucccggaccagcucaugacuuuuagaggcacgaacgaucccugcgcccucugcagccugcacagcaucggugguacccagaaccgcaacuaaagcaagcugcugugcggccugcuguccgaucgccugcacaucagcccggaccgggccuauaucagcuauuacgacaugaacgcugccaacgugggcuggaacgguuccaccuucgcuugag

SEQ ID NO: 399 - RNA, 3721 nt, Mus musculus
gaugcaacccgaugagaaaugcaagugauuuuuuuuuuuuuuuuuuuuuuaccccgagacaggguuucucuguauagcccuggcugucuuggaacucacucuguagaccaggcuggccacgaacucagaaaucggccugccucugccucccgagugcugggauuaaaggugugcaccaccacugcccggcuuucuuucauuuuucuuuucauuguugugcuggagauugagcccagggccuugaacccagggccagguaagucaucuaccccugaggaauaccuuucaccccaguaccucuaguuccuugcauuuguacugagagugaacccaauccuagaauucucucuucucuguuaucaaaauguaacacaggggcugggaguguagcucagugcaggaugcucacuacgugugcacauagcccuggguucuauccugagcagcacacacacacuacacacacacacacacacacacacacacacacacacacacacaccagagcuggcuccuuaaaagacucuuauauuguguuugucaaugaucuaaaauuuuucauucucaauaguguauauugugcuaaucaaugcccuagagcuucauagacaaucauacuucuuuuuaaaucuauuuuuaaaauugaaaauagauucuucauacaauacauccugaccacaguuuccucucccuccacgaccccuacuccucucuucccuagacccagucucccuccauuuuccuuuagaaaagagcaggccuccaagagacaacaaccaaguacaauaaagcaggacaugguaagacaaagcaaaagcccucacucauaacaaggcuggacaagacaacccaauaggaggaaaagagucccaggaacaggcaaagaaacacuggcucccacuguuaggagugccacaaagcaccaggcuaacagcuauagcuguagcauauacacagagaaccuggugcugacccaagagagccccuugcuugccgcuucaaucucugugagcccauuugaguuuuguuuaguugauucagugagccacauucuuuugauguccuccauccugucugacuccuaaaaucuuucuucccccucuuuugaggggguuucccaagcucucugaggggagaaaucaaauccaauggagaccuccacucagucucucucucucucucucucucucucucucucucucucucucucucucucucucucucucucucugccauaauucuaaucaguguguuccugaggaaguacaaaaauuaacaaaaacuuuccccucucugugaagccuuggcuauaguagguugaucucagaaccuauucucugacauguaagaaagcagugagcuugcauuccaguucaagagauccaggcuucagcgggacccagaggaaaaauaacacaggcaaaggcauuuuaaaaaacacagccuuauaauuuggaaugccaguaaguucugaggaaauugugcaacuguuguuuaauggauauuaccuaauuauagcccaagaguggagagucucauccuguggauacauaauauaauuccgcucagagaaguacuaacaugcucuuuguuaaaaaaaaaaaaaaaagucauaucagcuuaugcaccuauaacuucuaaacagauucucaaaaggaaccagagaaccagagugcagccuugugaacuuuagacuuuggacaaaacucuuugagaagcagagucauauaacuaaacauuuggaaccacaguucucuggcaggcaaaguuaggcugcuggaugcuggagcaaccauuuuaacuuauugaagaugaugaucauuuuuuuuuuuuuuuuuauuauuuauuuauuauauguaaguacacuguagcugucuucagacacuccagaagagggcaucagaucucauuacgggugguugugagccaccaugugguugcugggauuugaacuucggaccuucggaagagcagucgggugcucuuacccacugagccaucucaccagcccccgaugaugaucauuuuaaccaccacuauuuauugaaccuuuucucaugguagaaaacuccauagauuuuagcagauuuaauuaauucaucucuuugggcccuggcaaucauguuaugauauuguuuuauuauuccuucuccuucuccuucuccuucuccuucuccuucuccuucuccuccuccucuuccuccuccucuucuuccuccuccuccuccucuucuuccuccucuuccuccucccccuccccuuccuuccccuccccccucuccuccuccuccuccucccccccuuucugugugugugauguauguaggugugaggacagaaggggaagcuggguguccugcuguaucagccucuaccucauuuccucaacacagggucuuuacugagccuggagcuaagcugguggccagugaggcugagugauccuuucugucuuuguacccacucuauagaguagggguuaccugugccuguagccauguuuuuuuuuuuuuuuuugagugcuuggucaucaggaaguggcacuacuggagagggauuaggagguguggccuuguuagagugggugugaccuuguuggaggaagugugucaacguuggguagacugauguuuuaaaaguccaagccauucccagugucucuuccugcugccuguggauccagauguagaacucucagcuacuucuucagcaccaugucuaccuguguggcaccaugcuucuugccaugaugacaauggacuaaaucucugaaacuguaaguaagccaaucaauuaaauuaaaaucuucuuuuuguuagaguugccuuggucauggugucucuacauagcagucgaagacugauuaaaacacuugguuaucgagugggccagauuuugcacccagaggaaugcauguaugcugugggucagggagcccuagccguggaaguccgagccaaggaccaggauaucuuggaccuagugaguguguugcacgauccugaaacucugcuucgcugcauugcugaaagggcuuuucugaggcaccuggaaggaggcugcagcgugcccguagcagugcaugcagugaugaaagaugggcaacugugccugacugguggagucuggagucuagauggcucagauagcaugcaagagacuaugcaggcuaccauccaggucccuguucagcaagaagaugguccagaagaugacccacaacugguugggaucacugcccggaacauuccaagaggagcccagcuagcugcugagaacuugggcaucagccuggccagcuugcugcucaacaaaggagccaagaacauccuggauguugcacggcagcuuaaugaugugcgcuaacuggucuguagggcacaggaacccuggcugccacucuagugccuacuucuggcuuccaagugcccugugcuccaucacuaggggugugauuaucccaggaaauugaaccacgggguuguugagacuuccacuuuggaagauaugccucaccuuggggccuccauaucugccuuucccucaguaguugggggcuucaucucuuuagagaaaguccaugccaaucuuugaauguaaccaauaccacuaauaaaccaguuuagaaugugguucuucugauaagaguuggggaagauaugaauaaacccaaagcccuuuuaaacuuaaaaaaaaaaaacaaaaaacaaaaaacacuugg

SEQ ID NO: 400 - RNA, 116867 nt, Mus musculus
cuguuuuuucccccuuuuucuuaacuuucacuaaggaaaugaggguuacuguagucugagguuuccuucccaaagucacaaaauaugacaagcugcaaucuuucucacauucaaugauuucugcuguaagccaaaggacugccaauaauuucgcuaagaaugucugcuaguuuggauacuggagauuuucaagaauuucuuaagcauggacuuacagcuauugguaaguaggaagccacucucuuaacaucuggcuguuuugugcuacuaaugguggauuuguguuuuaauguacuacuuugccugcaguaauuauuaaaagcauacaauaagcccacacauauaucacacauuuauuuuucuugaaguugaaagaagcaaaugaguaauucaacacaugaauaucauuuauuguauccgguguuuggggaugccauuguauuagauccacuuagcaaaaagcuuaggguuuugagacaggguuucuguguagcccuggcuguccuggaacuucacucuguaaaccaggcuagccucagacucagagauccacuugccccugccccugccccugccccugccccugccccugccccugccccugccccugccccugccccugccccugccccugccucugccucugccucugucuaccaugcugggauuaaaggugugugcuguuacugcccagcagaaaguccaguuguuaaucaucuauuucagccuuaacaauuuuugaucauuuugaaucaaccaugccaaguaaaguuuugaacauuuugaaacaagcaaauaagauugaucaaccacugaucaaauaaaacuaacagggaacuuaccagcaaugugacaucucaacuggaccaugagaugucucauucaccgugauccuauagagauuuuuguuuguuugcuuguuuguuuguuggcaaaugaaagucauucaagaaaaacaaagucagccuauuauuaaaggauucuuggggguggggggacuuacugugacuugcuuuuaaagacagaaagaaccacauacccuccccacaaguggaaccuagaguuugggcacuuucuaggcaagcacucaaucucugggcuacacaccuggccaccgugugaagcaucuugggguuccuuguuguuguuuggggaugagugaggauugaguuugguuuugguuuuccugagagacaaggggucucauuauauaaccuaggcuggccaggaaccugcucugucgucuuucuccuugucucucuccauaauaccagaacuguaggugugagcuaccauuccugacucauuauuuuaaaggauaaacauccccacacauacauuuauaccaauauagagccauaaaugugggaguuuuaccauaaauuuaguaaauacaguaacauucgguucauccuaaaaguuaaagacaaagggaagcaauuuccaguagguugugacccugcuggagagcguguccccuuugcuuccucuggauaggagccagggucgacccuucuccagggaugcuugcgccaucagugauugccagcccagucucaguuaaaacgggauaaucagggcccccggcuuugccccuuucccugggggcagccugcugacuccaccuaaggcacugauugcuuuuuuuaugguccagcuacgcccugaaguaucaauugaggaaauguucaccaaaaaaagaaaacguucuguacuuaacuaaaaagaaaacacggggaagugagugcagagagaggagagagagagagagagagagagagagagagagagagagagagagagagagagagagagagagacucuucaaagggcagggaaaccagggcuuugugagcuuugcauccacugaacgcugagcgcuucacuucgugugggaacguagcgggggguggggggggugggggggggugggggggagaugcgggccagacaggcgagugcacccgagaagcgugcuccgggcuugcaccagcacagggcuaccaggaaucugggaccacacacguggugcccuagcuggucccuagcccaccggggugaauuaaaagauggccagacagcaagcugagcuguuuucacccacuguacugcaguagucucucaaaggcucugcuggaacugaggcgggauggagcuagaacugacuggccuccaagggcugcugggcccauacuuccccagaaccauacugaaggagccucaucugcccuggaccagcuuacacucaaacccaaggcuuaccuaagccccucagaucgcuagaucucaaaaugacuguucaguucucccaaagggguaagaagagaguggagagaaaaaaggaaggaagagagggugggagugaggaagagauaggaucgcggcgggggcggggggcgggggugucuauguaguauuuaggcguauuuauuucuccugguuuaauaucccucuagauaauuuggagaguaguucccacaucucggugacuggaaagaggcuacaggcacccagauucccaucuguuuaccuaggaucacuccggaaccuuggcaggacugagcugugugaaagccagggcagggaggcaggcaccuucagacuagggcuugaagagacugagcccuuuccugaaggagaguugaccuuuuuguuguuguuguuguuugagacaggguuucuugaccuuuuaaggagucuuuuucauugcacuggacaggcccucugagguggcuggaugcccucccuaucuuuggguaguuuugagaugcaaacugcaggccgccucaggcagcugaagguucccaacaccaagcucuacuugguuguuugaaauguuugagacuugaaacacgaaaccagaaagcuaaaaaaggcucacuuacaucgcaacaaauccuggcuuggaccugcuuuagucucuaccuggcccauuggcagagaugaucugaauucagucaugaacaugaguugagcaggacaaagccucaagaacucuaacucuccccccccccccccgccgguuuuucaagacaggguuucucuggguagcccuggcuguccuggaacucacucuguagaccaggcuggcgucgaacucagaagucugccugccucugcuucccaagugcagggauuaaaggugugugccaccacugccaggccuaagaauggucucuuuaagcaucagacugaaaucuuuugcuccauggcuccaaccuccaccgcacauguacagacuucuccgucuaacccuccacugcucuucacccuauaggaagggagacuugucugggagagucauuuggcuucaagagaguugggggagacgguccccuguggaggagugguccccugugggugugagcaacauuagcuugagagauugugccugggaaauccagaugaucugaaauccuccagacaaaaacuucuuuaaaaaucuuguggucagcacaugccuuuaaucccagcacucgggaggcagaggcaggcagaguucugaguucgaggacagccuggucuacaaagugaguuccaggacagccagggcuacacagagaaacccugucucgaaaaacaaacaaacaaacaaacaaaaucuugugguuauauuuugguugauaaagauaucuaacuuuuaaacugcaaguaacuucagccgucugguaagcaauuuugucuagggauaauguuaugaucaauaaggaaggugucaaucuguacaagauagacaagcuugcugguaccgaccucuuaaaggaucuauuuuuagugguccuagaaugugacuccuaccagaaagacaaacuuggggcaacgugacaggaaagagggcaaaacuguuauuuaucaacagucagcuguaaaguuuacuuuguaaaacccacuuucuuucuuuuuuaaaaaaaaguuuuuaaaaauuucauuuacauuaguauucugccucuguguaugucugugggagaaugucagaucccuagaaguaggguuacagacaguuguaagcugcuauguggguguggggauuugaaccuugguccuuuagaacagccaauguucuuaaccucugagccaucucuccaguccccuuagagcgccuuuucuaacuaaauuauagacgcaaaaaguucacuugcuugagcaaagcucauugauggucagcagagugagcuguaaagagaaccucggcaacugcaacacaucucagucugcucccccucuccucuccucucucucugauauucagggauuauagcuuaaaauuggucagaguuccccaaagaacauaaagggcucuuuguauuccucuguauucuguaauggagaucaccccuagaauucaaaagggugaaaugaacuuggcaauaacugcccgggagauaaagguggauguuaagggaggugagaagcagguaucggugguccuagccuagggucauuauagggugcugcugcauguauagcaagcuaaggacauucacagcauccaugcuccuuaguuugaggaagauggggaggucgcuugagucacugaguucagaagaagggaugcguauuguuggccuauggggaaagacgaugggcaaagugacaguuuugaaacacuuuagacaaauccagucgucccucucuuggggagaagugcuggauuccuggcucaggaucugaacacacagugucuuuguuccccucccagcuuaagaucaucccuugaaggaccugugugagcugagugaggucggucgcucugcuggguuuuagaaccuuccagguccuaaacuucuagacaggaauggcauuacugcuuuauuucccccuugacagggauucucuguauauagcccuggcuguccuggaacucacucuguagaccaggcugaccuggccucccaagugcugggauuaaaggcgugugccaccacgcccggccuucucucuggguuuugagauaggguuucaguuuguagugaaugcuaaccucaaacuacuacaugcugggauuccuggcuggcuacaacacuuggcugcugccacucucaggacuugggcccuaccacccccaacaccuggccauaguacaucucuuccaauucugaguauugcacaugacagaaaggugaugugucaaauaagcugcauccccagguccaucccaucaucucuugaucacaaacauuacauucuggguaaaggagacacuggcacccuuugaauugggcagguuugaaaauuuuuauuuauaugaauguuuugccugcuugucugccugccugccagccugucuuucugugugccuggugccaaaagagggccuuugaucucuugacuagaguuacagguaguuuugagcugucuuauagguucugggaaugaaaccugggugcucuggggaagccaguguuccuaacuauugagccaugccuccauccccugaagagugaagcccuugucaacguuccaccucuaaagcugccccucucuccuuggguacccaugcucagggcugucacuacuauaagccauaagccuaggguuccacauugccuuuuuacagacagaggauucaauuaccuuuacaagagcaucgacauuauugccuauaagccaaucacugauuuaccugaaguguaagguaaucucaaaguagagucucuucugagaaagguucucagaucuuagcagcggaauuuuuaaaaaccuuauaaggacccggcaguggcagcauacaccuuuaaucccagggcucugguggcagaggcagguggaucucuguaaauucuaggccagccuggucuacagagcaaucucuaggacagccaaggcugcacagugaaagcaagaaaagaaaaagaaaaagacaccccgcccccacacacagaagaagucuuagcucaauuacuucucauugaaguuuagcccuaaaggaccauuucuagccuagauuaaaaccagguggguuuauagaggagagagauauuagguguugccuaguuuguuuuaccacagaccucuuggccaacuggcuccuggacugucuugggccugucagugcuuugugguguuuggucuggucuacuaagcccagguaacuuuccaacuccgaggcuuuguagaccagaucuccuuugaagaucccaggcucccaaggcagggcgagcuugaacucgguauugaagaaaguucccaaugauguaauuuuaaagauaaagagccuuaaauuccaaaaacagagguccaaaacucccuccuuucuuucagggugaggguggaggacuccagcaguauagagagggaaguggggauugcccuggcauauuuuccccaggcauaaagcccaggaugggguauuuauuaggacacucuuuuaggguauugaaaaucugcagguuugccccaauucgggauuggcagcccgcccucucacggaagcggaggauguccccacccccacccccugcagcugccuacagugcuuauuugaaacaaucaauacaaagagaauuuuuuuuaaguuuuuuuuuuuuuuuuuuuuuuuuaaccagggaagaucacuggcuuuaaguucguguuuuguuuugcaaagcuuggucuacaaggugcgcugaaguuuugucuuuagaaaccgggcuguucuuuuuaaaacaaagcgcuccgggugagggcguggagcccaggaaggaggugggggggagggccagaacccacccaguaggcaaaacgcauuauuggcucaacugaguuuugcagcuucaccugauggaauguucaagugggagggguggaaaaauuagggaagucagagcuucagaguugauaaauucguuucucuuuucccuugggcugucacuucccuucaggggaagaauacuuuaaaacagagaucuaggacucuucccgggcuucagaacguaguaucaucaguucaauacaacuagauaccuaggaccggaaagguaacuuuacucaauucuuuuucuuuccuuccuuccugcuugcuugcuuuuuuuuuuuuuuuuuuuaacaucaaaagaaaaagagagaacagaggaggaagcguuaaauuuuguuacuaagaaagauguuuuccaaguucuuugcuaaauugggcgggucgcuccaagcuucaucuucucaggugcgugggacagcagugucuacuccugugcuucuagcgcucagaaaacuucaauugguccuggauaguuuggcucuucucccacccccauccccggcucagcugcagccuagaguggauuacaaacgcagggaggacuggcgcuucuuaggucaggucaagggcaggcuugcucuccgugagcgcuccaccgagcggcgcggcgcgcaaccucgggaagggagaagaccggaggagaacuugcaguugcauccucguggguggggagugcgagaccgccucagcuccagccagcugggugaaugggggcgcgcacggccccgggaacgccgaggcuggauaaaauaugccaggccugcgcuucucgggcucaucaaggcugcgggagccuccccgagcuaucauccuuuguaauugcaaccgucaaucaacacuugaagacaaagucaaaaccgggaagggcaaacccgggagacuacccuugcuggaaaggaggaggcgcgggggagggcugaggagggagaaguuugcuagaaguuggcuggagauugcaagagaaauucggagugcucgugguagcuaggggaaacuuaucuuuaagucuccgccagaaguaaggcucuggugaauuccuacacgugcuuccauaaagaggcauaguggcauuugauaagagaucuucugcggaggaugggaugugcguccccgcucaugguugaugcguuccgggguacguacugaccguuguuggcuucagcauuuagaacacauaggucccuuuuucccagccauuuagucccucaggccucaucugagacuauagaaccagggacccuccagguagagggaaggugaacacccugagcugcuguugcuccucauuccucccuccuccuccucuucauccuccucuuccuccuccuccuugccgcgccgcacagcccuaggggacagaacauucuaggagacaccucgacacggccacggucacagaacugguccccugcuucagugggaucgucuguccaacggaauaagagggugaaggacuccgaggggguguuggguugucuagacggcauugggagggugcacucugaaaguucggaaugaguuugguagcuuguuuccuucacuccucccucagcgucugcaccagggucagagacucgccacucccccaaacgugaggaacaacuccgggaaaaacgugagugugcccuugaauuuccaacaaaacccagcuccuugaauccgcccuccccccccccccgcgcgcccccaagcccuacugagauauugucaagaaccuggaaaucugaaaaaggccgaucugaguuaccuugucucauucuggaggugggagucagguuuuucuaggaaaagcucagccucccuccccucucccuuccccugugugugugugugugugugugugugugugugugugugugugugugugugagagagagagagagagagagagagagagagagagacagagagacagagagacagagagacagagagacagagacagagagacucacuaugccacacugguugucccuuacuaacuauagagaccuuacauagaccuuguuggaaucuuaaacucagagagauccuccugccucugccucccaagugcugggauuaaagguggcaggcacuacaccuggcaaaaaaggcaacuucucuuguuuguuagaucucucuagcaggccccuucauuggcugcuagacagaggcucugccuagacuagaucuucaaagcaaggaaaagcuacuuaaaugucaaaggccagauucuuuuagaccuugucuuggacaccuauucccugucugccccucccuccucaucuacuaggcguuuucuuggaaagucuaccugugggaagauaaaggaaagccccacuugaccuuuggcauacaccgcucuggcuuuggaagacaagcuggggguggggggcagauggggcugcaaagccacuaauuugaccuaaguauguccuuucugggauagaagcuggugcuaccacaaaguucaccacacugggucagcuucagccucugguuuuggccagccuucuagccacuguaaaucacgaggcucuucaacuuugggagccaccucuugaacaaaaaaagaaggggggggggguggaccaagaagcuagaguugcugcauccuuggcugguggguaggaagaugauaaacaagagaccacuaugaguccuuagaauugcagugaguggaggugaauggagguuguucguucuuaacacuuugaaagaaacugauuucucaaguuugcaugaaauccaaggcaaagcgggcagugagcagcgaugcugugagccuagagaguggcccccuuucugaacuguguaagaaaugcauuuguaauucaaagugaugucuuaaagaaggggcaaaacugagcacguauugacauuguuacuugauacuaacgugaaaaccugaggguaauggacacuaauagaggcaaauucagccugcuccacuguacaaacuaauuggcagccccccucaauauuuguggccagaagggacaugcuuaggccacauuagggcccuaaaaaugcugcaaaagguggaaaucagauauuuuagauucugcauauauauguuuuacagcaaaaauaugaaccaguuuagaacaucaauaugcaugaguugauagccaucaauggauaguguacuucauauaaaaguguaagcaaugauuuggaauaauuuuuuauucauuaaauacuagacugggcaguuuuuaugugaucuccaugccauuuacauagaauaaauucagcucuuuugagauucaaauccacccccuuguggguggacucugauaauuacccaguugcacagcagaccgugggcaugaagcuuugccugcauccaggaggcugggaagaguguuuuucaucuuguugggaugagaucugaaaacuuuaaagaugaagcugggcuaguggccuaacagaugguucuuuauaacuuaaaaaaaaaaaugcugugccucguggggguuggguggggggcauggggccaccaaagggacucuagaaagaaaucaagggucggaucuuuccauccuagguccaaacacaggucucucucacuaaaaauucgacagucauuaagauaauuuuagacucaaguguucuuuccauaaguagggagguggguuggugagcagccuggggaagcagaaguggcugucuuuuacuccaauuacaugcaaagggagagaaaccucagugacuucuucgcuguccgcaaagugagccauaaccccuggguucuucagggcgcagucauucaguuguaccucucugaugucugccuucagggaggaccuugauagaaggaccaaccacccuccauuuaugauuuuaacauccuuuuuuuuuuuucucgguguuuuaaguaggcccuucacuccacaggucuccuucuccacacucaugcauggaccaccuacacccacacucuccagcccuucuugccuuucaccggcucuuugaaauggccucucggcucucagaucccuggccgcuucacuuaagacaccggucgcuccucaauagcugagaaaccuaguagcauuuauaucccccacuagccccucccgucucaagccagggugggguggaguagauuaaggcggggugaagagguuggggcaggccccgaggccagagcuuccuuauuggcuaguggcuaguguccgaccugaguccggaaccugcgucccgauucacugucuucaccucuuaccuccccccugcccccaccccuccagcuuaccuccccucuccagcgugucuuccccucuccuccugacucugucacccucggggcuggaaggguugcucuccacccuagaggagugggagguuggaacuucagaacuccacacuugugauauuaggagagagggagcugaaggagagauaggagaaaggggcggaaaggagaggagaggacaguagaggaggggagagaagugaggcgagcgaaggagagagagagagaccccugcugauccugagccagagggcgggugcaagaggggaaggaguccgggagccguucagccgcugcagcaguagcagcuggcggcugccucugcugcccuccggagcgcggcgcgcacagaucgcuguccggggcagcagcgccuuugcugucgcugccuccgcccuugcggagcggaacccgggcagcggaacgcggucuucuuagucuagcuugguagccgggaucucccgcgcucagcuuagggacagcuuugaagcugccggaccggacaggguuccgagguccugcccggcagcucuggcgagcgggugggugagcgggcacgcugaucaccccuucucucuuuccgcuggaguugaaucucugcugcccguguccaggugcugggcuuccggaccgacaccgacgccccauucccgcccgcagccgccuugucaugcugcccaaaguggagacggaagccccaggacugguccgaucgcauggggaacaggggcagaugccagaaaacaugcaagguaagggggugcguugcgguguggcgcggcgcucugguuccugguuuuacacucucgggcuaaccccgcgggcuucagccuucugcagcaugggcaccagagcagcccagcuggcaguuguggugcgcggcggcuucggccuccucuuuagacgcaagcauaaaaguuaauggcacuugaacuaggcggauggugcuuucucaucaacgucuaauuggccacuucuaauuaaguagagagacuggaagcggagagucaacuggagcugggggcagcuggaagcuaagggcgccguggaacaaucuuucuuuugagaaguggaauuccucucugcucaccauuucuaggugguucgagcuuuuacucacaugcucccguguggaggggaaaagacugaguagagaaaaaucacaggaaggugauugguguuguuagugguguucgauuacaccagcacccccaaaagccuugccagauccggcagucuuuuaaggcaacucaaaacugcuggcauaacuaaacaccaaucaccccaacucuauucccgucuaguaucgugccgaaugaggagcuggggugcucaggguuagcuuguuauccuuucggucucagagccgagaguguggauauuccauuugugucccuauucuugauugguaacaucagaaaaagaccaaaucucaucuccuguauuuuuuacacucuaaacucuucagaacuuuaucuuagcaacgggccaaggugaaaaaaauguuaggaaaaguuuuucuaucuucaccccuaucggaguuucuggauacugaggccagccggcuugugauccccuuaaagcuuccugccagccguuuuugcacgaacuugaaagggucagagaaguguugagaacagagcucuuggacucaaugguaggcugugcgcucuggccgggaaacccaagaucgccuuaggcucagggaaggggacagcagacgugcggguggggucagauauccugggugaucuuggggucuuuccaagucuuuggguaggguuguagaaauucccuuggccucaguccuuagacuaacuuugugugucugcuacugaggaagccuuguuggcuugaagagauacaccugggauuccugauaagugccccaggccugcuuccugagcucugggcucuggccucuggcuccgcuaaguuuccucccggcagaaggaccagcuuuuugcuacuuccugccccaugcaggcuuuuaggguggcgggauccggggcaaaaaagcgcaguggagcgaaacacggcguacugaggacuggagagaaauaaccugguaacauuuucuuuguaaaauuuagagggcccuuucuggccuccugucccccaagccaagacacuagcuugccuuauugcuggggggcuagcagauaugacccuucuuugcacugggcucuaaagcagcgugggaaaaagccuggcgcggcuuugcgguaguuugcagcaaggacagugcgcgccugccugccggccgccguugggucccuuaccagggacacacucauacuuugacgggugcuggaacccagaaagaaaauucguuacuggauucucaggcagcgcgaagcauccaacuucaaggggauuaacggaggaccuagcuuuacaagacccaguuguucccucacuuuucccaggggcacagggauuuccaaaccaugguggauuugguucucugaacucuuaauuuaggugacccaggugcccuguggguaaacaaacaaacaaaaaaauucucaggguucccagaugcaccucuccccacuuagacuccgaauuuuaccggaagaugggcuuccgucuuuccuucuauauggaaucucugagaagggcacggagaauguaagugauugccaaucugauacucuuaaaugugaaguuagagauuacuuuuggggggagacagggagacagaagagaacacacaacuaguaaaguacagccccucucagcccagaaacauaccuggaaacagaagucagaguuuucagaguuccguaaacucccccaaccccaagcuuuucuuuucccaaacccucagguccugauucuuuagagugucucagcuucucucuaacaguugggguaagagcuggcuucgcaggagagaggcgcgcucagcaucccuuauuucugaguuacugagccccgggaaugccuuucuuugcuggugccucuacccgagaucuuugcaaacuguugcucucccggaccaacuuaugcuacagcccagggcucugugucggggaacagacacuuccuuaagacagaaauaaaugaacuucauuuuaaaagaauaaagauaccaccuaguaauaaagaggcauaguacuuuggcucugggguaggggcaguuucuccauuuucuuuuuaguaaacaaaucugaggaaacuucugccaggcuguggguaccccucccccgccccgccccuugcaaugccacugauuaacuuaaagcaaacucucuuuggaguuugugcgucuuuggguagcaaaggguugagcaagggggccggagccgggugcacaaaggguuugaagagggugcggggagucccgguaguggcugguuguacagaucugccccuugccuagaugcuggcccaucccugcucugccuccugaacuggguuuucagucucaucugguagugccuaggggucugugggccacuaacuaaccuuucugugcacaguuuaucuuuuuggcugcaaagacuagggcguuaaugucccuagucauagggagucaggauaccauggucugauuuuuguuccucccgcaaucucggagguguuuauacuuugcaacgcuucuccuuauugaagcuugugaaguucauuacaaacaaagcucuagaacucugcuaaacccuccuguuucuuuuccuugcuuguuucugccccgcuuccggguguccucuccucuuccuuguuuuuauuuucacagggcauuuucaaacgugaggagaugaaaguggucagaacagaccuacagucaaugcggaacugaauguuuugauuaaucuaacagacuugaacccugagagccacaggcuguuguuaaaguugcuucugagaagcaaguuucugcagcuucauugcucugcaaaagcgacaaugcgcaaauuagcauugcuaagccuagcaaagggagguguacuuacauacagcaagucacuguaggagugugccagucccuuacagccuccaaauuuugccccauucauuaggcaaaggcgacauuugagaacaguagagagagguuuaaaagacauuugagguuaacauuuguaugguucauguuuccuuucugaucuguugguuuuugguuaacaguggucacuuuaaaauguuaaccaaaaaaaaaaaaguuggaaacugaaaaauaauaaagcacauguuuauugaugcacaaagaugcucuccucauguuuaaaaguacuccucuucaauaccacuugaguaaacauuauuuuauauuuuaucugauaucuggccaccaaccacaucagcaaugcuuuucagugcagcagcauuaaaaccuauauugggaaauuaauagggcauguguucauguuucucuuuuuuuuuuuuauuucagugucucaauuuaaaauggugaauuacuccuaugaugaagaucuggaagagcuauguccuguguguggcgauaaagugucuggguaccauuacggucuccucacgugcgaaagcugcaagguuugccuuuucugugcuaccuaaaaaagauagaacgguuugaccaaacccauggaaacucuucaaaguuaaaccuguuuguuucuuucuuucuuuuuucaacuggaaagagugggguggggugaggugggggaagugucauagagcgacuaggacuuacaguaugucugauuuaguuccaaaggcagguaggugccuaugcuguagaaaacugucagacugguggcuuuaaaguaguuuauuguggugcggugcuguaucuauagggggacauucuaacaguccuaaauauugauuuugcuugacuuauauauauuuaaagcauccuuguuaaaaggaaacaggacagaguacaacccaaguguguuuuaauuugagaggaaucugugcugcaaguuggaacauuuuucuuuaguccagaagacaugaaggucugauuucccaacugcaugauuucauccugauggauucugaaaauaauuuuaaaagauuuuuuuuuaaucaagguaucaagaaaccagauuuuaguuucuaauugaacaauuuuuauuaguguaucauaugacuuauuuaaaagcaggaggaauuugaguauguuuaaugucucuuauuguuaauaaucuugucaagaccauaagcauuugucagagguuuuauauuuuuuuaaauaguccccaugaauucaauuuccucuaaucuuuccccaacaucuucuuuaaaguagagacucaaugcauuuauuuaaaccuuugcuaggaaaucccgcuuuguuuuccauaacaaauuaagguuguuuuugugugcucgcucaaauaagcaaggauaccaucuuaguagagaguagaggaguuccucauucaaaagccagacaccaggccugaccagccccuuaaguguaaacaggcacaggcuaugcugcgguccagcuucguggcuuaugcucacacacacaucccugccuaugugugugucuuuuccauuaguuggauuuucaaacacagcuacaacccuugaauggguuccaguggccuuaggaacauuuccccauuuuguucuugaaguccuuuuccuuuuaacugucaaguguugacauuuguaaaagaucugagguacuugcuauucagcucuuacaaugguuugcgacugaaauuguaugagacuaccuaaaaacaauggcaggguucuucugugaguuaccucugcuuggaacauggauguuaauaggaaaccagauuuaagaaaaaaaaaaaauuggucaauauagaguguauuuuuuuuucugacuguuggaacgaaaugguacaaaauugauguaauucuucaggaauauaauucugaggccagaaaaaucuucacugaggccuugcacugaugcugaggguuggucuugcugaaaugugaaauuaaaccucaggaccacauaagggcucaguggcacaauaaaaagaccuacuggugauuuccugagaguacaacaaaagaagaaaagcgaguuagacucuacaucucacuauuuucucugucuuacaggguuuuuuuaagcgaacuguccaaaaccaaaaaagguacacgugcauagagaaccagaauugccaaauugacaaaacgcagagaaaacgaugucccuacugucgauucaaaaaauguaucgauguugggaugaagcuggaaggugagagagucugccagaguccucugggguguggacuuuaaaaccuguguggacagggagacacuguuucucuagcccuuuaacacuguugacagugauggagaggauuuuuuacuuuccucuguagaauugccugccauuuaaacauguuaacaucuaccaggggaaagaaagagaagcaggaaaauugucccacuccccaucucuuuaguuuggggugccauauacuuaauauugaaaagaucaacagaacuaaaacagcucuacugagaacaaaucaaauucauuugcaaaauuugaaaaaugaaaucacccuaucacccuuaauuuuuuuuuaaaucaagaugcgcuagaauuuuuuuuugaauuuuuuugaauuguuucauuuauacaauucgugguucuugagaaaaguuaguuuucucauugugaaaagggauuucuuguucagaauuucagguuucaauagcuuaaaaaguauacaucuauuauacaucuauauuuuucuuuaaaaaaagguaauaacaaucuauacacuaauaacuaagaagcagaaagcaugccaagcuauggguucucgaucaauagugauggcgaucgggccuucaaaagucacucucaacugccgaagaaugcugcgggguucagcuuggcagccagugaaguuaauaugugacugcuguaaauaauuuguacuucaugacuguuauggugugcugcuauuuuccagccucugaccugcuggccuuccacagauuaaacagacugcaaauaacgcaauauggugggguacccagcaccuugcuagagugcacuucauuugaucaaggaaaugcaagcuacuuuuuuauuuggagguuuucugcugugcagaacucauuauugggagaguuauggggaaaaaaaauuaaagaauuugugcuuuugcguaaaucugccaaauugcuaacaaguuuuuuuuuuuuuuuuuuuuuuuuuuuuccaaauagaaguagccacuuuggucagccuaaggaccucuuuuaaggggagguugagaaaggaaguaauuugauaucuauuaauuuuaucaucagucccuuuaguugccaaauaguggcagaugcuaacuguaagacaaguuuuaauauugcagaagaugugguuuccugcaacaagucauuugauuuuuuuuuaaugaaagaaaagaaagauuguguuuuuuuuuaaccucagcauuaugcuaauugugugugaguggcccauagcuauacccauacuuuaacaguggucauggaacaauggaauauuugaugaauuaucuaaauuaaaaaccucuuaugauccaguguuaaauuuuggaugcuuagaauguauaguguacauuuuuaaugugaauauuaguccuaagauuaaaaagcucaaaaaacuugaccuccagcaaucucgguguaccaaguugucagagguugcuggguucugucuaauuaccauuggccacuguggguggccucgaagggcccuucugacuaacuuacuaggcuuggcccugauuccacacaacuguggcacagaagagccucgggacaacuuuggaaaggacuuuguuuuaauuguaucuaauuccacuucaauucagugcaugccuagugcuuuucugauguguauucacaaaguacaggugagacggggcuuuucaagaagagcccccaccuaaccuuuuuaauggaguagccccagauaacuaggauugaggaagauguuguaagaaaaagcauuuaauccagaaaugggguugauucucuuuuucuuaaaaaaaaaaaaaaggaagaacccuaguuccaacacacacaugcagauacacaguauacacaauguuguuuuccaccagaaucaugacagaguauguauacuagaagcuggcacacccagaaagaaaaucucucucaccaccccccccccaauauuaaauaucuguugugaaaugucucuaguccacacagggcuaaugcuuucuuggguacccaaaauauguuuuugauuaacaacccccuugaaggagagaauucauaagaaagacauuuaucuuuuuggaaucucuguggacuaucacaguaaaaugcacacacacacacacacacacacacgcacacgcacacgcacacguacuucaauugucaacauuuuccauuuccucaagcucuuucagagcacgacugacucccuuauauauucuaugccccuccucuuccuuacagccguaagagccgaccgcaugcgagggggcagaaauaaguuugggccaauguacaagagagacagggcuuugaagcagcagaagaaagcccucauucgagccaauggacuuaagcuggaagccaugucucaggugauccaagcaaugcccucagaccugaccucugcaauucagaacauucauuccgccuccaaaggccuaccucugagccauguagccuugccuccgacagacuaugacagaagucccuuugucacaucucccauuagcaugacaaugccaccucacagcagccugcaugguuaccaacccuauggucacuuuccuagucgggccaucaagucugaguacccagaccccuacuccagcucaccugagucaaugauggguuacuccuacauggaugguuaccagacaaacuccccggccagcaucccacaccugauacuggaacuuuugaagugugaaccagaugagccucaaguucaagcgaagaucauggcuuaccuccagcaagagcagaguaaccgaaacaggcaagaaaagcugagcgcauuugggcuuuuaugcaaaauggcggaccagacccuguucuccauuguugagugggccaggaguaguaucuucuucagggaacugaagguaugucaaauccugaucaacccuccucucaagaaaagucuggcuagcuuuuuggcuguucuugguacuugagaagagcuuuuccuuuuguuuguaugaguuaaggaugaaauggguguuguuuguaugaguuaaggaggaaauggguguuguuuguaugaguuaaagaagaaaugggugugugaccaucccuguagaguuauuacagcuugauuggguaggccuuucauucuguguagcuccuaauugggagaugguguuuaacaugacauuaaguauuguuuuguucguaauacaacacauuuaucccuuuuaacucagaggugguucgaaaaaaauguugcaucaaacaacucuuaaacuauuuguaaagugaccaagucagaaaacaagccauauucauggaaucuugaagguuucuuuucaaaggaccgagccaguauuuaacuguccagguccaagacugugcaaaugguaccacuggcuagaaguaucaacuagguauuuacuguugguuugcccugacauuagggugguaaaccauuguuuucugagcaaauugaaauaggaugcucacugcuacuguaggccaauggugagugcuugucuccuggguuccucucaugccugugguuuaaguaaauggauugguacauuguaaauacagcacuuguuugcauaaggaucuauguuuaacuauguaauuauuuuauuuccucaaacuuaagaccaaauuaauacaggaaaguuauuuaggaguuugaauucugagcgaagaccaagccacguuuggugacuagucauucuauuccugauuuaaacaaacccugaauuugacuucuaagccuuuuuauuauaaaaaucaauguuaggcuuuugcuguuguagugggagaggugacaauacggaucuguggcuucugcuaacuuagugugcuuaucauuaacaugugcuguacauacagagagaguaaagaagcagugugugaagggaaaacaauguuuugcacagaagucuuagaucaacaguauguguauggaauuaccugacugggucaagaggucaaaauuaccugauuggagcuaaaaagaggccaguaaaaugcuaccagcaugcaguuaggaugcauccugcugguuauucuccuggccuuuauugcuacauagaaauguggcugaugcugaagaccaggcugcagaggccaagcagaaugcauugaguuuaagaccaggcuacuuucagaguaaguagagaaaccacucuaugauagagcauucauucuuuaaaaaagcuaaacccaagcacucuuaauauucugggugcuuuuacauuuauagccacggcccaaagaggacacaucgggucuuuaaaaaugaaagccuuuuuagcuguuauugaaagcugaagugauggauaaaugggcagccaggugcacuguauguagcugggugaugucuucuuggcuuguagcugcgucugccacaggcuagggccagccuugccaagucuugcuguucucgucuguauguaaaacuuugcaugugcucuggagggggcugaagaggcugaugcuugcguugaggucaugggggcauacagaagugcugcagucugacgcacugcaggcacaggagagaggcauuuucuuuaaauuauuuuagugguuugaaaggcucgucuuuaugcaacacagucuugaauucagucuuauauuauucucuuaguuugguaccaggaaacaguguuaaccaaguguuagaugguuggucugacuggauuguaaugaacagucaaagcuauacauacuuaaaguagccaaggaacaagugaguuguauaagaugaauauuaaauugaaugagauaaagauauuuuccccuaaaguuucuaaugagguggauuugucuauaauuucuuaaaaaacaaaacaacaaaacaaaacaucugguguggaggcauaugcuugcaauccuaacacucagaagguuaaggaaagaggcuuguucugaguucaaggccagccaguuuacacugaguucuaggcuagccugguuuacagaaugagacccugucucaaaaauaaaacaacaacaaaaauaaauaaacaaauuucuauuaggaagacagcugaagagauagguuuuaaaaaucaucaaugaaacaaugguugcuuauaugcacacacacacaaaaaacguuacaagguauaugaaugcucuagucauagguuagacuucaagagggcugagaaaagaguuuuuguaugucuuccccuuucagcuaaguucuggagugcaauucuuuccaauggccugggcuuacaugugccugaaucgccaaugucuggguuugcaguggggcguugacuuccuuaccuuguuguuuaauaugugguuggcagacugucauccgaggaaguaaacugaaaaguaagaacagaagacccccaggguaccuaggagggcuggggaguucucccaggggacacacagccuggaccacucgcuuaaggcuucuuccaagaaccaacaguagagcucaaagcagcuucaggaucgcuuaagcauugcugugaaaggagacuuucguuucugcuuauguguaaauuuacuuugucaaaaaacagagcaaguccucugaaaucagcacaagacauaguuugcaagaauauaguuugaaaagcuaaaagcaugacucaugaguaggacauacucuucacauuggggaauggugugccaaacauaucucauagguucucaugcacacacacacacacacacacacauacacaccacacacacccacacauaccccccacacccacacauaccccccauacauacacacccccccccacacauacacaccacacacaccacacacaucacacacaccacacacacauacauaccacacacacacacauauacacaccacacacacacacacaccacacacaccacacacacauacauaccacacacacacaaauauacacaccacacacacauacacauacauacacauaagcacaucuccuauauucauacaaguacacacaccacauagacaucucauacauucacacacauaccacauauauacacaccucauacauuugcacgcacagccuuaaagccagguuucccacgaucguuggugaccuacauuuauuuaauagauuugcucuaggacuuuauucugcuucagucucaucuauuucacgcuuuguuuugcuuuugauucuggucaugacccacuaaguugauuuugugacccacuaaucacacaugaccugcaguucaagaaguauugcuggggggaagguucuguggucuauccacuuggcugucaccuaccugucaccacucacugccucuuccggcuugggcuagaagacaugccuaacccugcagucuucauuccuuuuguugaaguugugacuuuuaagucucacuugggaagaagaguggucaccuuuaaaccuugucaugcucuuguuagugucacagcaaauugcccaucaagugacacauuuaggggacagaaagcuccuagaagagaauaggauaauaaggcaauuaugcaaacaaccccuugaucacaccaagggacaaguuacacuuccucccaccucaaaaggagagaagacacauuuucuuuacuaguuacaggacuagaagggccugugggcaguuuugauguugcuucauaucugugaaaaggaaaucucaaagcauccguguugagaucaaaaguugaguuauagaaaacacaauuggaaggcgaaaggcgaaggcgggggaggucacacaccauaccccagcugguuuguuucucguucuuauaaacaaccuuggccucaguccuaaccaacagcaucuaaauagaaaaauuaauauucugccaccugucauuuuugaagaaagcacaaaugcagcccauggcucccguugccuagcuagaucuugucuagcaagauuuugccuagguuuucagagccaaagagucacagaauacccaccacucccucuucucuuuuuuaaugugugagugguugcgugcauguauguauuuguaugugugcaaaugcauguacacaucucucucucucucucucucucucucucucucucucucugugugugugugugugugugugugugugugugugugcgcgcgcgcgcgcguguguguguuggccagugucugcaguccuguguuuucuuccaugccucuccaauuuauauaaccaggcagggccagccggcuugcucuagauuuuucucucucugccuccugcacugcacuggcaggcuggcugccuuacccacucagcuuuuuacacgaguucugggggaucagaagcagcacacacuucuucaucucugggaagucucucuagacucuuuucauaugaaggaagggaggcagaagagugugguuugccccuagugaaggcagaacugaggcucagagucagggucugagaaguacacuuaauguguaucucuccucaguaugcaugcacccacaccaugcagagagacugacagacacacagagagacagacaacugacacaugcacacaggcaccaugaccuuugacucccagagcacagaccuuugccaguaaagcuacaucggaucucuaaaguucucagaaguccaucaccacugccauuaaaucacuaauaaucagcaagacagguuuucccugagcccagacgaccccggggagggacugacucacuguagaaagccucaauaauucuuuucagccacuggggaaccauuucauggagaucuacuggcuugcgaagacucaguaagcacucaacuccacagcacucagacccugugaauccacguguccaagccuaggcagauggccagaucugauucuguucuguccucucagcuugggggugaggugugugcaguguguguuccuucucccagagaagaugggcagaaagagaaaagaauuagaaucuagcucacaugucagccguagacauaaccuugugaacuuaugcucagggcgacaucccuacccuguuaucuguccuccuaagggacggaugcuccacuuccucuguuacccacaucaccugugacuugaauauccaucucauaaacaugaguacagugagaaaauaauucccacuuuguuaaacaacuaacgaaucuggaguaucuauuugaucuuuuaaugagaccagauguccucagaggauucugggaauggauauagaagaacuuccccuccaugaaugauucggauacauauaggaagaaaaaagucuaaauuaauccugacugaaacucguaacuagcauuucuguggaaaauaggucucagagacuuggggaguuugugucaaaggaauucagucaugucgaaggcagguuuuuagugugguuugcucuaaaucaaaacagcaaaggcuggggcuaagauuucuuucuuucuuuuuuuuuuuuuuccugauccauuacagaauuucuaagcaggguuacauuuauuuuuaacauuuauuccccaguauccccuuuuauugagguggggguggggucuuacuauguagcccuagcuggccuggagcucucuguagaucaggccggccucagccucacagagauucaccugccuccaccucugcuuuucaggugcagagauggccacuguaugcccccaggccagacuaccagacuaucacaguucauaguucaauuuuccuaaccaauacacuuguauuggagcugccccaguuuuagaaacauuuuuaaaaagauucauucauuuuaauuuaaauuacauauauucguguguguguguggggggagcauuugaauccaguugcacucgggccagaaggggggucuagagguggaguagugaaccaccugagagaagugcuguguccucuguaagagugugaagugcucucaaccagggaaccaucucuccaucccuaauucuauaugaagguuaguucucuuugauucucccugucccccucacgugcgugcgugcgugcgugcgugcgugcgugcgugcauguguuggggagaauugauggauggacauacaagccugccuagcgucuucccauuccaccucccacuuggcuuucugccucugccuggcaguugggagucaggaaugguacagucccuacuggaaagcauccagguuccaggaccuuaggcacacagcucacuuagcuaucuuuguuuucacuucugggugcugcacagucagucugagaaagagauuaauaagguggcaaaacaaaagccaauaaaauaaauucauuauaucaagauucacaagggcagggcaaucuccaaggagagggaggcugguuuccuucacuaaaguuggauagggauauuuucuucaucuuuguaaagccagagaguugauaagccagcagguauggcauccugcacccugccuuucagagccauccuuuuggguuuucagguuccaggaugaucugagacaagccugugagggcgggaggugugaaugccugcauuugcuucucacuguagaccggaggggucagcucacuacguguuauggagaguuuguguucuuguuaguugauuggugggacaacuggacaugcccaucuggcaauggugaaggagagucuucauuucaucuguguguauauuucugaaucuuuaaaguuacuuuauuugugugugugcaugcauagcaacuuucaagagucaguucugcaggcccacacuauuuugguaggcuguuuugaugacagguaccuguuaccuguugagccaucucuccagccucuacaucugcauucuucagggaugccauggcagugccacaggcuggugcacaucuauaaucccagcacuaaggagucugaggcaagaggauugugaguucuaggcccucuugcuuacauagcaagaccuugucucacaaaacagaacaaaagacacauugucgcuuucauacacuuauuuuccuuaaaaugcaacuaacaucccuuccuuaggguuuaucauucuuagggugcaggcauacgagcaauucuguuaccacacacaguuccuguaacccccuucuagcaaacucccugcuccacuccaccccaaucugcuuuucuuaugauucucagauacuuuaaaauagaauuaaggccagguaugcgaugauucaggucgaucucugaguucaaggccagccugguauauauauauauauuaaguucacaaacacacacacauacacagagagagagagagagagagagagagagagagagagagagagagagagagagagagagauuaaauugcuuuguuuugcaagcucuauuuaaccuccugagcucuuugaacuggggagucugcacagcugaucgaacuagccaaaaaccaugggcacacagacuuccaggaaagccagcauuucucuaugaaaagaguccuuguucugaagucagcaccuuaacuucuccauggcuuuguuuacacaaucaacaaauuucccaucuuagucuauauguaauacuugaguauaagaaggcacgcgcacgcugugccugccugccugccugugggggaugguuuuccuaagguccggugaaagagcacugguuuuuuuauugggucccacuauagaccuuuucccacaguggaauaaguauaacacaccuuaccugccuuuugcuuucguuucuugagaggagucucaagcaaguagcucagguuggcuucaaccuugaacaguaguagcuuaagccagccuuacuccuccucuugccucugccuccucaguguugggaucucagccuggucuaccacuccaggcuucacccaucuccuggagucucuuuuuguucaaagagaaauagaauuaaguuugugucagacaguucacacauaagauauuaauucuagaggacacaaucccuccugucccucaacacacuucuaagguuacugcccauaggcauaugaguuaauuguuuaguaaaaagauauuaugagcuggacacagcauauucaaugccagcugggaagccugaggcaggggucuaggaguuuguucacaaacugggggucuuagggacaguccugucugaaaacagugucuuuucaggcccaaaucuguucauuuuguuuuuuuguuuuuguuuuguaaauguguucauaaaauugacacggcuaacugaaucagcuaggagauuccaggagaaugggagcaaugggagacagaaaggaacaggcuagaggaacucuccgggccauccagucucaaggccugggaauaacagaguagcaacagaauaauguaauguuugggcucaucacaacaggagaaacuguaauaaagggucaaugccuuaggaagguagagcagcacugguuuagacaaagaauugagacgcaaggcauuuacugaugugguugcacaauuaaaacaugaguagugguauuuagacaacuguaugaaguccuuugugaacuguagacuguauccugacuguuaccacaauuagugcguguggguuuuagacuugguacuugagagggacccuucucuaaguugacgccaggauauggaaauccauugcucuuuuaauuuuuuuuuucuuucuuucaaguaagggagcucguuguaggaaauugaguguagagccguacucuaagcuugcaucagagcagauaggugucugcauggggaauggugggccuguucuggaaacugcuuuuucuuguaaacuggccccacaccugcaggcacagagaggguaccagguguggaguugcaggguggcgguccuuaaauucaugaacagcugggugggcuuucccuucccucuccagccucccagggccaguacuguuuccuuacagacuaggcaguagaaaugguuuugucaguuugucgucuuagaagcauuccgugccugccugcugauaacaauuagugcgugugcguaaggcuugauuacagagaacauguuuaacuagcucauccauggauugccuaccugcuuguaugaguuccuugggguggggguggggggugugagauucccugugagagucccuggguccuugugugucccaugcauccauggguagcagacgagcgaagccagcaaacaugacucacacuugacaccccuucacgcacuguugaaggacuuugcccccugaaccugugaagugcaauagauccuuuuauuuccugggauaacugaagaaugauuuuugcuccggcuuguucuucugcagcuugggaaguagaucacccaagaguucaacauccauuuacagaauggcugcauggaaauugggcauuuaaacuacucuucaaguuaggaacauccaucucuaacccaagaaugccacccccaaucaaacacaaggacagacaguccaucacuuccuccagcauuuuggcugcuucuccaaugucucacacuaaaacccgauucuagguugucucaugccagacagagcuugggcagccaggagggugggagcccuccuggcugccugggcuucuagccuagucuggaucguuggccuuaccaugucaacccucuuagccauccagacucuuucuucuuccucagcuuccuuuauucuuuauguugcuuuagaucccagggccugggugggggguuuccuuuucccucaguacaggauaggggaccuagugguuucuggccccugcccuuggcccuguguucucuccgguggagaguggaagacgguagucuccugagguugacagaggacaugaaagaaacaguugaguagauauucccauagaccugccauaccuugcaauagauagaacuuccuucuaaaucuucuccugggccauuguccauaaagggugcaguggacucauggagagagagagagagagggagagagagagagagagcgcgcgagagugagagagcgcgagagugagagagcgcaagagugagagagcgcaagagcgcaucaggucuggcagggugguuacagauggggucugugccacucaaaggaaagcacuucugaaauucccaucuucuaggggauggacgaauaagaguaacguaaggaaaaucauguuuuuguuuucaaacagcggcagguuuccauuccaugcguggcaacaggucccaaugcaguucucuuagccacauggccacccagcccuacagauggcugccugggcucgcuugcuuucaccuuccuuugggaucauugucacaugccauaugaauuaccuaccauagcuaacucucugauuuucuuuuucuuuuuuuuuaauaauggcuguguuggggauuugagcccaaagccuccuaagaguuaggugagcauauucuaacaugguacggccccaguucuucacguauggucuaguccaaagggauagccaaacacuuucggggagaaauuccaagucuaaaguucacagggcuguuguuugcucaucucagagcacauugcccuggagacugggagaugucccacuggcuguacggcacugaagauuuacuuugcacccaguuuggauccagcuccgauuuuuguccaaagccuuuccuuucuaugaauauaauucaccuaaagucuaaagcagcgguucuccagcugugggucccaacccccaucaccccccaaaugucagauaucuugcuuuucacaccaauagaaaaauuaugaaguagcaaugaaauaauuuuauaguuggggaucaccccaacaugacgaacuguauugaaggcccgcagcauuaagaagguugggaaccacuggucuaaagcccgcccuucacugugcagucauaguaccacaggcagaguucaguccugauguauguucuucugcucacagcagacaagaaucuggccguauguugguuuuaaaaaaguccacagcaggaccaccugccaaggagugucuuuuaccccagagaagcauagcaaaugaaguugaaagcauuucuuuauuuuccuuccuuccuuccuuccuuccuuccuucccucccucccucccucccucccucccucccucuuuuuuuuuuuuuuuuuuuuuguucuuuuagaaagguauuuuauuuuauacaccuggcuagccugaaguuauguaaaccaggagagccuugaacuccagaaaucaagugcuagaauuaaaaguuaaauugaaaauauuuuauggaaaggaaauguccuagauacaaauacguguugguuaaguauggcacagccucggaagcaaacgcaagaggauggaugugaguuucaagccagccuguucuccauacaaaguuccugcucuacuuaaccuugcuggcucuucuccugucccuccucccuuucuacuuccucuucucccuccccuuucucuucuccccaccccccaucucucuccaucucccuccaucccuucaaggccugaugaaugcuaggccuagcaucuugcuuuacuauuaagcaaguaucuuagccucaguguagaauauauaucuauaucucagaaugcuguuuucaaugacuucuuagcucucgcugcugaugucugaugacgugcacacguagguguggggguccuagcuaauuuugcuucaguauuuugaguggauauccuguuuucaggcuuguucucugcaguugggucucuaaggcaugucauuuuauuuugaucacuguauccuguggauucugaaaucuaucugaacuuccuugccccacacaucuuuucagucuugcuugauuggucuaaaguugugaugaauaagagacuuugcuuacugccuaauuaaaaaaacuuacuaaauauuacauuucccuuguaaaaaaauaaugauauagauuaguguuugugcagaaguguuggcaauagaauucuucaaaaguuuuccuuugggugaugaaaagcuguuacauuauuuugacucgcuaaucaaguguaauuggguagcuugaagugccuuagauucuccuuguacaguuaucaaagcaggaaauguaacucacggagcugaugaaaggcaucucucacgguauucuuucaauuauagaucuuacagagcaaaugaaagaacagcucugcugaggaaaaagccaagguuugaggugccccuuaacguuaacugccgcauuagcuaguuaacacauuauuauguucuuuaauugacucuuacuccagcuucaaggggggaaagaaaagucugaucuauugggccuggaauuaaggauuggaagaggcuggauaacacuauugcuguuuacgcuagauucaaaucacaucagcuauuugcaaugaaaacaauaauccuggcgagacgauccgccuuuucaaauguuaagauuuaguuguggcugagagcuaacuggaaauagaauuuuuucuuucuuuuuuuuuuacuuuauguuuuugcuucagccuagacuggcaugagugauaucauucaaaauggaugcuaagguaaaguuuuauagacacacacaaacacccacaccacaauaaaugagaauuaaaaccacacguuauaccucuaucucacuagggagggagcacuuucuucaaguuggcucaaacucaaauuaucccuaaaaggcugcuacaagcgaggaggugugaccuaggcuugauccguguauuaauuccuucauccacuccuucaccacacagauagaauuacggugcgguaaucccuaugcuaagacaacugcaagagcagucuugaccagacaccugcuaagucccccggggauccauuuauuccacaacacacguccuuccugacagaggcagcauuugagcacggacucugaagccuuagucuuauguuugguuguguggcaugcuaccaaucgugugcacacagagagguucacaaugacauugccaccaggcaguguaauucccaaagacagccagccagccccugagcaacaccgaguaagcccaaccaagauuaaaacagagagaaggcagcuuguccagauguaguacaaacccuuucuuugaaggguaccuaagccagcacaggagaggcuaaaaugaucuggagaguagggauggagagccagaugggaaggcagagucaucgagguacggcuccgcuggcagggaacagcuggugcagaacuguugaugcccuggcuguguggcuuuugggaguguggcucaguuccuguacuggaaggucacugucagagagcaagccagcggaagaugagcaaugaucuauggggggugggcauuaacauacgguucuuguuguuguuguuagcuaccagcaucccuaaacaaaugucccuuuucuagguagacacaagugccucacugggaacagcaggcaguaagacccagcaacaguaaaagccauaggauaagguuagauggacagcagguccuugguguuaauugucacauugcuugauacugagagcuaaaguagaucuugccauuuuggcagcuuuaagaccuacccagugcucacuggcaaaaaagccugugguccugugcauguuuugacaccaccaccaccaccccaaccccaugcuguaccaccaccccaaccccaugcuguccagaaacuuacuauguagagagggcgggcgucccaagcacuggggcuaaguguucgccacuaugucugucucuaacaaacugcaccgcuuggguuuuguuguuguuguacagaggguauguaugcaaguggcuaaaauuacuuuuguuauuuuuuuucccccaagagucugauuccuuccaggcaaauuuuaguuacugguggcacacagguauuugaggucuuaguccuuguaucauguuugauuuuaaacaugccauauauuaacaguuuuuucaggagagccuucuuuuagacgagaaaacuuuccuuuaacccucaagcagacauugauuuuuauuucacagucaauuauuuaauggccccaaauuagcuuuucaaguguugguacauguagagggggcugucuagcccaguggaccuaaagugaccacguuggcuuuuuagaacuugcuuauugcuuggucugaccccugaccugaugacucacacauucauucaacacauguuagugaaauucccacaaugccccgaguccuggacacaguuuaguuaaugagaccaacaagggcacugucuuuuuuuuuuucccccauuggugcuccugugccagagggagggaagcugaugauagacaagcuaacaagggaaguguuuacugccagaaccgaucagugcacagagcaaacugcaggaggccagcagccaacagccagcucugcuucugagauggucaggggaagaaaugacccuugagcuaaggucugaacagcaagaacaaacuagugugaacaaagacaugguguccaggcauagaacagacagagggggaaaaaaaaaaaaacccgagaacuaacgcaacacuuccaagagauacuggaggccaauggcuaucgagggacaggggggaaaauggcucucuguagaucaaggcaucugaaagguccagcucauggauggauuacauacaguuuauccuucuggaacacgaaaucuugacauuuaagcaaugcugugaugucaggagaugguccuaaaauauuauugcucagguggaaagugggcucaacagaugcaggagaggaaacaagaaacccagauuucaccagagagcuuuauacaguggcuuggcccaagaacaggagcugggggagggcugaguggaccugggauacagguugagauagacugccaggacggagaugacgagacaggucaguuucuggcugaaagcaugggcagucuuuauaagcagaaacagucuccuggggccagccccaacagugcccaacccccgcccccccagccccccccagaccucccccccccccccccccgacaggcagaucuagggcuacuuucucggagcauugauuuguucuaaucuuuauuccuagucuagaacaugaguguaauguaacuaagugaaccuggugcaggccccucccugucuuuggauucaagcuuuucacaaagacccuaagaggugggcucucugcaaauguucuuucauguauuucagaggcaaaaagcaggcgagauacaugcaucuuugacaggauaugucgggcagucccuuggagacugucacuagaugaaugugaccuacuguuugaucaucaacauugcuuauugaauugcaauugugggaaaacccaagaaagaacccagucauugaauaugugagugauuagccucucuggucugcucaacacugccuccaguaacacaacaccuuauauaagauacaaacuagccaggcuccaaauucagcagggaaccagcuaaggauaguuucucugccaugcccucuucuggcucucagauuggcucugagcucaaggaagcaaaacacuuuguguuaaaaugacuaaauauuuuuuaaccacaccccacccuagugcuaggggugguaccauccggauuagugguuuuguuuguuuguuuguuuguuuguuuugguuuuuggcuuuuugguuuugucaacuugacacaagcuagagucauuugccaugaggaaaccccagcugagaaaauguucccucuagcuuggcuuauaggcaggccugugccguauuuucugauuuguuuuuuuauuuguuuguuuguuugcuuggguuuuuuuuuuuuuuuuuuuucucuucagacagggucucuguaguagugcuggcuguccuaagaccauguagaccaggcugccuuccagacugacacgauucaucugcuucugcugauaccagucacuacuggaauuaaauguguguacuuucacguccagccaguggggacauuuucuugauuaauuacugauagggaagugccuagcacacugggucugugggccugggugcucuuagugggccgggaaagccucaaggagcaagucaguaagcggcuucuccauggacuucccuuucacuccugccuccagguuccugaugcauuugaguuccuuuucuaauuucccucaguauagagaguuaccuggcuguaagauguagccuccccacugccaacuuguuuaugaucaugguauauuaacauaggaauagaaauucugccugggacagugccuaugcuggaaaucaccccacuacugaacuagguaaggggccagccuaaaaauguguuucuuuaguuuggauccuuagcgaaauucgacacacaguuugugccugugccgcagcauagacuuucucuccaugccucuugguuauuguaaaccuccauccuaagcuuuaccugcaauccuucgccauuuuggcuugauuuggaaaggcuguuuucuuuccuuccuccaauaauacaagaugucuucucuccacccagaccagagcagcagaacagcgcacccccuuugauccuagcacuuaggggcagaggcaggcugaccuugaauugaggcuaaccuggucuacagaaccaguuucagaauagccugggcuacuuaaauaaacaaauaacaaagaaacaaacagucuguaaacgaacaaauccagagaguuaucuacaaaauuugaggaccauaaaaaaaaaaaaaaaucaggaccauaaaaaugccugucauacaugccaaagucaauuaauugcccuguaguaauaguauuuacugucuugugcuucucaggucucccaggauuccaacaagaccaaugcuuaguuuaguacuucauuuacuucuaagcauucgagugcaaaagaacagacuagguuagaagaaaguucuugccagcccaccuagugcaaguccagcagcccauggagugcagauugccaguggccaugcggacccugaagcagauacaaucuaggaaaaggauguaggggcuggugagauggcucaguggguaagagcacccgacugcucuuccgaagguccagaguucaaaucccagcaaccacaugguggcucacaaccaucuguaacaagaucugacgcccucuucuggagugucugaagaccgcuauaguguacuuacauauaauaaauaaaaauaaaucuuuaaaaauaaaaaaaaaaaaauaaaaaaaaaaaaauaaaaaaaggauguaggcaauaucuugcucuggcagguuuuauaagaacauuaauuagacuuugugcuuaccgcuguccuggucucucaaagugccuuggggcugucucucugagcaagugauggguccugaagcugaggcauaagugauaaccuugcuuaugaguugcaggucugcuaaugugccuuauguauaggaauaaagcuagaaauccacucuuauucugaguaauauuguacauuguaaucuagugggauuuaaauugcugacuggcaaccuuagauaccuuuacuggguuuuucuucauuaaaguuucuuuucacuauaugguggcauacacaucuacauacauguccaauacauacaauuccaauguucacacgagaguauuagaccagcucuaggauggacagcaacaaaaagcaaucaagcaaauucugacugaugugucgccuuuucagaccacugugccuguggacugaagggauuuugccuguagcgccuguaaugucagcaucauugagccauuuccagcuucucagccuuaauccccucacagucuccauuucaccuaaacuggagauucuggcugcgguuaggcuuucucuccuuacucuggagaaucugugguguauagacgagcuggggacuagacuuacauacgcaccacaccuuugauuccaauauucuggaggcagggcagguagaccucagucugaggucagcuuuuucauaaaguuucaagccaaccacggcuguaugaugaaaccuugccucaacacaaacagacaaacaagcaaauaaacauacaacaccaaaagaaguaucagcuggggaugccuagugggugcaagauccuggcuuuaauucccaguacugcaaaaaaguuaaagaauucauacucuauaauaacauagacauagcucccacggugaucugagaaaaaguguugguuuccccaugcuaagacuauuaagcaguuuauaaaccuucuaggguguuuauauuucugugcuuaaggagaauuacaugguagguugucucggcuaaaaugcuuuagcauuaaaggguuucagauuuuuuucuuccccuuugaguuggggauauuuauacuugcauagugagauacuuaagggauagaaugcaagcguaaacacgaauucgguuuuggagcauuucagaauuuagggcuaugaaucagcaacauucaaccugcaucaaguaaucucacuuucauuugguuuucuuuugccuguuauugcuuucuccgucuaagacuagaacuguuuaaaaaaaaaaaaguacauucgaaaacauuucuaauugugucagagcauccaugaacgcuuacuuugagagacuggagcugacuuuaaaguggccucuaaaaagcaucugggugaagcauuuggucuucagaacucaguucugcaauauuaagagggcagggagcccaacccaguacgguguaaaccaggcaugguagaaccuaacagcuguguaggcaggagaaucagauggucacuauuuggugcugaguuaauucaugaaaagagagacaacagccacuauggcagugguggcacacaccuuuaacccccagugcuaggaggcagaggcaggcagaucucugaauuugaggccagcauggucuauagagcaaguuccaggauagagagagaaacccugucugaaacccacaaaaaguaaaaauaaaacagagaccacagccuauaaaauucuaugagggcuuguguguguguuuuugagacagucuuaguuuguagcgcuagcaggccagaaacucaauauguaaaccaggccggccuugaaacuacagaaauuuacccccugagggcuaagagcuucagauuugggcuaagccauucauauugaagggucugaugauuuugauuuuuaaauagucacgauguuaagagccugcuuucaaaaaaaaaaaaaaaaaaaaaaaagggaaucaaaagacuuccccagcuacuuaguguaacuacacugaaucaaaacucugcucagaaauugaauguguguguaagccugacuaggcauuuacuguggaaguauccacgccuauguaugugaaagggcauauuugugugagaagcucuuaaauaaaugugaggauuuugaaagaaucugccagucauggucggaaugugccggcaacuuagaggagacaaguaaaggugagagucaucuuuugaaauaaggacacagcaguacucauagacaggagagccaugaguugaagacuagucugaucaaaccaagacucucccagagcauuagaugucaugaauaaaucaucaaucuauccacauuuccuccuacacagccuuuugcaaaauuguugacuuucuuuggugauguaccuuuuacccagauuguaaacuagugagaauuccugauuagucaauuaauuuguguuuagacugcuuuguuuaauguucucugauuuguaaaucaaaugcaucagacagaucaccuacagagacaggaauauccacaaaacaucucaugagucuuugcuguagacuucccccagagcuuuucgucuugaucccacgucgggcugaauucggaaaaacccuaacaucuguaaugaggccagagcugaaaggacuuggugcacagaugugcuguuucacagaacucucugagcuggggaguauuuauuucccuuuaacuuuaucaaauaaaacuaucagguaaaaacauacuaaaauggcccuuaaaacaacaguucccccaauccauuauuuucgaguaaggggaaauccaacauuaaauuacccuauauugagaauuacugcucccguuuugacugaggcucuuggcucgaucugcauuagagcagagaaccagccuuggagugcucuaauuaacugcugacuguuauucccauagaccauuuuaaauaaaagcccccacugugugccuucuaguagauuuugagguagugagaagcagaagugaugcucugucagucaggacuguggcuucagcgccaccugugcccucccucucccuccccugcuuccagcaguggagccaucaaaguaguaacaggaguuuucuuucccuggaggucuuaaaagcuguucaaaguugaagauacagaguuggacugaggcagcccacacuguauauagagccugacacacaguggccauugaguccugguucaggcuggugggaaguauauuucuggaguuuuaaauauagccuugaaucuguugauggauaggaugauggugccacucacuagaaagcaguccagagagcagggguggggauggggugggggcauugucagugcagcugggaaauuugugguuuuucugauucugggggcuccaaugagccugugagugcucugcuuucgaaggcagucccaggucuuaccauucugagaagacuuguagauuuaauguuauuuuuguuuuguuuuguuuuguuuuguuuuuuuuuuuuuuuucgagacaggguuucucuguauagcccuggcuguccuggaacucacuuuguagaccaggcuggccucgaacucagaaauaugccugccucugucucccgagugcugggauuaaaggcgugcaccaccacgccccggcgauuuaauguuauuuuaaccaugucuuauaacaaucagauacauuucaggguucuacccugauuauuauaaccacauaaugaacuggacacaauggcagucuaagauuuaugacaaaagucaggaugaguugagaaaguaggauuuaccaccucaagugggacucugaaucaaaacaccaaaugaccaaaucauuacacuuccugcaaaauuaggaaggaaaaccagccuaucgccccacccccaccccgugaaacuguuuuguaguuaauacggacguaggggggugaagcauuuuauuucuucuaaauauagacuuuuauauauuaaaagaaaagcuauuuacaacugauuuguuacuaaauaaaaucuuggaugaacacuuuuaauugcuaaaaagguaagggaacaauaaacacgggaaauauaaaugaauaaaguguucggagucaagcugcuuucaaggcuauaaauagcauccugaguucugccacuauucuuagcgagaaugaacaaaagaaggugucccaaaauagaaaggcaagcacaucuccccgagccuuggguuccagggcauaagaaacucuucgaacaaguucauggauucaggggcuugauugaucuuugaaaaggacauuuccccgcugacucuuugccaaggaaauucuuuuccuggccuguuuguaaaauuggcgggcugauguuuccuuugggugacacaaggugugaugaagaauuuuaucuuuacuuccuuacuaaaaucagccccggugacuugcuucccaguuaacuuacucgguuauuaucagaugacagaguucguguacauaauggacuggccccgucaguucuuacauuucaucugaccagcuccugaacuuggucaaaacauuuauaaauauaggcacugugugcuuggccauaccuuucaucccaguacuccugaggcagaaccagguggaucucuguugagacuagccugcuccauauagucaguuagaggauaaccagcuacacauagcuaguuagaggauaaucagccagccugcucuauauagccaguuagaggauaauaaguaagacccuaucucaagacaaaagcacacaacaaaacaaaacauuuacacacacacacacacauaugugaauacuuuuuuguuuuccucuaagcugcuagaacagacuugugaacacuaucaaauagugcuacccuuaguuuauaaggaucuuuucuuuuuugguuuuucgagacaguguuucucuguauagcccuggcuguccuggaacucacuuuguagaccaggcugggcuugaacucagaaauccaccugccucugccucccaagugcugggauuaaaggugugugccaccgcugccgggcuauaaggaucuuuugagggccaaugacauguuugaagccauaaacaguagaagcuuaugcugguauugucccauuuacuacauauaaaaacuucuaucauuucaacaaagauuuuauuuuuuaauuaugugugcgcaugugugucuguguauggauauggauaccaguuugacugguggccuuggaggcuggagguguuggauccccugaaauuggaauuauagucaaucaugugcuacuugaccugggugcucagcuuuagcagcugagccaucuuuccagccccucccccauguuucccccacauaauacauuacaauucucacacuaacuuccacaaauuuaaaaaauuaacuuauuuuccuuuuugacaacuaauuaugauguuuauuauuugagaauugauucuugcacuguaaaagugaaaguaauacaaauuucaaauaccuugaaaaaaauucaguaugaaacauaauuagguauuaaaaaauuuaaauccccaagaacauuuucaugaguagcagugaaagacugaauaauuuuuuuaaaaaaacuauacugcuguguuucagcauugaaacuaucauuuuauaauaguuuuagacaucuuucacuuauucauaaacuauguagacccugguaaagauuauuuuaaaauauuuaaauuuuauguuuaaauuuuauuguaaaaauaaauaauauuguaaaaauauuucuaauauuuuaauaauuaucaaguagaacuauuccucagcagaagguuguugucccuaacuauauguagucaggcaguucagucauuugaaguucuccucaagaaguuuuucguuuuugcccugauggauucuguauacccgcacauucgcauguugggaguagacgacguaugugagccuuuaggugucugcacaugcuugugaaggccugagggagguugacaucgggagaccguuuccccuguaauucauuguggcaggguuggucuuucagcugaacuuagagcucaccuuuuagcuggccucucuagccagcuuguucaaggucuccagagcgcugccuucugagugcugaauuauagguggguuguaaccagagucagcauugaugugggcucggaggaucagcgccacucuucuggcuuggauagcccaguggguauaaguuuuugguuuugauguuugguugguugguuggccgugagccuagguuucuuuuguuuuugaggcaggucuuuguucguauaacccuggcuguccuggaacucacucuauugacagggcuauccuuguuuuguuuuguuuuguuuuuugaaaagauuucucuguguagcccuggcguuguccuagaacugaaccuguagaccaggcuggccaugaacuuacagagaauccaccagacccuaccuccuaagcucugagaauaauggcacgcaucacuagugccuggcuacagcacuuuugggugucuguugagaaccaugccaaagaggaaaauggaauuugcuccaacaugucuugguagaaugaaacauuuaaaaauguguauggagguaucagaugucaauugcauaccugguuuaauaucuccauuaagaugagaacccauuuuaaaaaaaaaaaagguggugcgugcuggcgcacgucuuuaaucccagcacuugggaggcaggcaggugaauuucugaguucaaggccagccuggucuacagagugaguuccagaacagccaggacuacacagagaaacccugucucgaaaaaccaaaaaaaaaaaagugagagagaaaacccauuuuuagccaagaaaagagacaaaguucuagcugcagauuaccuugaaguguguguucaguagaauuuccauugugaauaaguuggaaauccaguguauuuuucuuaacaauugauugaauaccgaccgcccugggaaaagaugcacuacuauagcaaggugccuccuggagguagcuaauaacaggcuagcccagaaucaccaccuaaugcugcugcuacugcugcugcuacuaccaaagccccagcagaucuuugcccuccugcuuugggcugaguagaggguauuguuuguggucaugagucuuuguaaaccuuuauugccaccuuucuagaaaauguaagcauggcaguauaaauuugggggguaaauaauaaaagagccucuaagaagaucuaguuucauuuuucccccuuguuaagaaacaacaguguuuauauaucguauuggcuuagaaauucuuugguauuuauuccaucuucucauauuuuugcaaaacacuaaaguguagucacuaaacagcacgccaauuuaaguugagcuuggacgagaacguuuuaugaagauugaauggggaccucaauccaaggacauaauagacaagaaacauuuuuuuuccucucccuucucuucagaaguagucuuccgcaugguuuaaugugcuaacauaacccccguuccaauauuucaaaagauacagaacuucccagcgugaugauaaaguuuuccuguguuccaauaauaaaaccucgucggaccagccauuuccaguuccuuuguggcucagcgauuuguagagaccaacuaaguccgaagugcccugcuccugccgcaguaucagugugggagucggaaacagauguucaagggacaaugccauuuguugucacugucgauacuauguggcagcuuucccaaaugaaauuguuuguggguggaaaagaauguaagcagugauucaugcccgggcucuuuuuuuuuuuuuuuucugcuggagucuaaccauauuuguuuaaaucauagaucagaagacauugguggauuuaaaaaaaaaaagucuuaaauaacuuacacugaaguucuucguuuuuuuuaaaggacuauuucgagaguuuuacugaaaauacuaaaugccuuccuuuuuuuccuggagaagucugauaagaauugacauuuccucagauucucuauuuuggauuggacauuuuaguauuucauuugguaggcacaguuuccauuaaaugauuccucgcuuaacauuuuauuaaaacaguccagcaugaaguugacacucuuccugcgcucaggugugggcgcucaguagagucacacaggcaggcacauccagugauuuacuguccaagacaaauguguuugucugcaagauuuagauauuuaccuacaaaggcauuuaaaaugugcacugaauugauauaacaaagagacucucaaauuagauacaccuugccacagggaaucccuaaugaguuucaggcauaucugucagaaaaauaacuuuauaaaaacuaaggaagaacauugagcauguauuccuaccuaucgucuugggcugcaauuguuugaaugcuuguaguuucugcaccacagaaaaauuauuuuaagggacauuaaaaaaaaagucauuuauacacuagccaaaggcacuauuggccgcuacacuacauguaguagaagagcuauacgcuaggaagugggaauuuggaacccaccaacaguuucacuguuguuugaaauagugaucacgagguuucuuuucucauuggccagaugucaguuugcuagauaugcuggccagccuuucuuguucucccaguuuuuuguuuguuuguuuguuugucuguuggucuguuuuuuuuuuuuauucuagcuugauaauuuacaaaugcacaggcaggcagaucucuggcuuuuaaaggcuagccuggucuacagaguuccaggacagccaagguuacaugaugagacccugucuugaacacagaaaacaaaaucucuuuaggcuuaaaauccucucuguauaaguaguuguuaauauuccuugggaucacagauacaucugagugucgaguggaaguuacugagcuuucuaggaaaaaaaaugcauauuccaauaauuucccaugguacuauagaacaucacuggccuuaaacccagugguagucacagggaagggauccugaggaugacugaagaacacugguguuuuccuguuuugugaagauuuaaguaggcuuuucaaauuuuuguaaacuuuuccagacuuucuuucuugguagugcuguggaccagaucuugggcuucacguaugcgcugcaaguacgcuaccacugagcucuggagucaaccauugccauagcaagccguucuccccuucucccguuggauccaggguugcacucguguuuuuugggugucuccuaacuagccauuuauaugaauucuuaaauguuaaauuaauaauuaauugcacagauauuuaagggcuaccauaagauuauugcauauaugugugaugcuugaggaggugacagggagagcuuucgaauuauuaaaaaccaacauuuaagccuggcuauggugguaguucaugaggauggucuucucaggaggcugagacaggaggauacuuacaacuuccaagugacccuuccaccaaagucuucccccuuugcucucuuuuucauccucugacauuucuacaaguugacagugauagcagccugcccuaggaaggagaaagcacucugcagcaggcgugcuuuacaaaaggcaccggggaugcuaucucacaugaaugacuacaguccuugugcuagggcaggacagaguaagcucaggugggcuugccucaaaaccugugaggcaagacuuggugaccauaaccacuuucugguuuuauaacaagacuuauucuuuuuuaucaacuuauuuguauaugccucugugugaguucagcgagucuuuuuccccacugcacccuguagaagguuugaaucccuuuguccuacauaugugcugagaucuaaacgaggguuguugggauagauagcuacuuaguacaugcuuaacucauaucuuaacccaugcaacuaucucuguaacucauaaacauuuuuaauuuagaaaggaaugaaaagguagaguccccuaccucuagugagacaguugcccuagggaggacuauuuuaaagacuuuuuaagcaccaaaugacucugaaacucacgauuuuaguaaugauuacaagcuggaaguuaauauucauaucuaaaauauuugcacugaugcuuucuuugugauaacuuuuuuuuaagccaguggcagacacuucuacauuuuccuaaauuuuaaucucauuuggagaguauuagacuuguaaaaguagauucacauauguuuuaauuauguccuuuaguuacuaucauuuuaaauacuucuagauauaauauguaguagacaauacauauaaaaguuccacuuuuaaaugaauaucuggucauguagcccaggcuagccuagaaauaacaguccuccugagggcugagaucgcccacauaugcuacagccugguuugugacgcauuuuacugaacacugugaguuucaaaauagccaaacuaguucuuugacgaaaaaaaaaaaaagaugcuauacuaaaacuuucccuugacagucuaacuguggauauaaguacucaagcuacggaagucuuuaagaacauaucauuuuucacugcgucucaguuucucucuaagggcgaauggauggauugguguugucuaaguaaggccagcuucugcagcaaccuccaggagaaaucaagagggcagaaauucuaauccuggcauggcaggaaaggcccaauucuauugacagacaugauuucaauuaaggauucccuggcccaccuuuccauuuucccuggagugaauguuguuggcaccgggggaaauccuuggacaccagauaaccugcccagcgugugggacgcagcuccuuagaauacuccgaaucccaucuuugaucccgggcgauauuuuucucuguuaugucacagaggucaccuggcucaugugugacaaacugccuccauaagucacggugccacuggcagagauuuguaaccgugccccugguccauugccuuugaguuauuucacaggcccacggcuguacauuuacacucugucgaagaugaacaggggacgggaguaaaaucaagggcaggggcucauccugaaggacaaggggaaacagguggaagguuaauggcccuggagcgauuccacaagccucucaggcuugauauaugggccucgggcccaaaacgggcauuggcuuucaaagauauauuauuucauuugaggagaggcacucuggaguuccugcauuugucuccugauagaugauccucugucuacaauugguuauggcgugugaguuuuccucgggccugcuccccuacauaaaaauuuugcugagcccuccaacgucuugccuagauaagaacccggacaagugggagcucuuuggcaggcuguugggauuuucuuguuauuuuaguaguugguuuuucugaggcgggaggcaaggacugggcaaaagacaauucuguucauguguacacaacuugauacggguagcucagagagaaaggggcaggcauggagagccaugucaugaggugagcucuuuuagccuuuuagauuccaaaaguugcuugcuuaaaaguaggugcccguuacaaaaaaaaaaaaaaaaaaaagcuuuuuuauugcacaauguuggcaucuccccuaagcuaugaaccaaaggcuuacucuuuguaaaagaacaacaaaagucuuccaaaaguucaaggugcuuuggaggaaggacagcuggaaaaugaucauuaauuuucccagugaaccaacccagucgagcucugaccacaucugccuaacgcuacacaaaugaguugagcuggugacuagaugaauggagagagucgccugaguuaacccgggucucuuaaaagugcuacagaagggaguaaggcuauuaaaaacaacagucucagccucccuggguucuuaggguuaauguucaugaaaauauuuggaauucaaauagucuucaauuuauaguauuuugaaauuaauuauuaaccugguuugagguguguacauaugaagucuuugccuuuauaauacccgauaacugcuauaccagccuucucugagauaaugcuuauuuuuauggcuagcauuaagggaaaaacgagcucaauaaacgcacugucuaaacauaaagcuaguuuuucucuucaucucuuuucauguuccacuguccuugucucuagugcauucccacaucaccgugugaggcaucaaaaauucauucaaaauuuuuauuugucaaaaacaaguucuuaguuuuccaccauuguucuggacucaucaguccuuaucguuuaagagauaguauuagacaggucugauauggaacagcguauaugaccugacccgugaaugugcaggacugucacacacagcaaaccuuuaucacaguaauuaucuuuguaaaaucaagaucagggcuauagaagcgacuugggagaagcuugccugcauguucuaggcuuuggcuccauucugagcaaugugugauagaagaagaagaagaagggaaaaaaaaacagguucaagaaugaggcagcaucuggcuauuggcuucuuuuaauaaugaagguuuuuuuuuuuccuuuuuuuuccucuggaauauugccaacuggaauauucugagguuagcucagaagcaagaaggcuagaacggcaugcuuaguaucuaaggggguggagugugcgauagaauguuuuaaaugagagaauccagaucccagauuguauggcguugaaccaucggugcuggucguccagcgucuaugcucccacuuguugcuuggauccaugcguggcugaggacuucacacagucagcccgagaugucacggacaacacucucaagcagaaagugagcuccgcagacccacacagccgugcuuucccgucacagccuagccagugcuuaccuuugucucuuuggcuaaugaccuaaaggcuccuuuggcuuguuugaacaaugacugguuucacuucacccacacugacugucgcucaugcucuuuucagucaguaagacccagucaguagguuaggucagcuccuuagguagagaucaaacuugagaaacccgaugucccuacaucugucagagucucauuucggauggauccucccuccauaagcaaauccauaggaagcaaaccauugcaaacagccucuuaauugcucauuugcaguugagaccaaauaaauaaauaaauaaauaaauaaauaaauaaauaaauaaauaaauaaauaaauaaauaaaauugucaaaugcaaaagaaccucaaagccaguggaaucuucauugaaaaaaaaaucuuaauacauagagccgcuuauuauugcaaaauuagaauaauaaacgcacccagcacgaagccaacauaaacuugccugaguuuuauucaaccugagacccacucagccucuugucucuaacagcaauagaguaggcauacuucgcagucuguuuguuauucuauacuguucauuuaaugauauauuuagaucuccaucacacuuuguauuuuuacacguaauuacccauauuaaaaaaacacucauuaguguucuguuccacuaacuuaauuaugccccuuaauuaaaucuugacuaacugggggucaccgcagugucagugggauuugucacuggcugucagcaggugucugguugcaucuauuacugguuugccuauggcuugaaucuauugaaaaauugucuuuuuuuuuuguuuuuuuuuucccugccagaguucuuauuggaggcaagaaauagcacauauagacaagcucccccagaguguguguuuguagaaggaaauuuuuguuuuucauuagucuggaaauuuucuuggauuaggagaaagcagaauacagaauaugaugcacauuccccugcccccaccuucccucccuucccccccuucucucccuuccccuuuccuucucuccccucccuucccuucgcuuucuugcuucuuuccuuaaaggcagggucucacuguguaacccuggcugacuuagaacugguuauuuaugccaaguggcuuuaaacauagagaugugcugggauucaaggcuugccacccugccuggcugacaugaaccuuuaaaaacauccguauuugccuucuauagguugugaucauauuuguguuuacaacucugaacuucuuugaagaacaacaaggaagauuccuagagguguuuaagcaucacauuggguagcuggaaguguggugcagugguagauugcuugccuagcaggcaggagccccggguucaagccacagcagugcauggaguggugagagggggcacacuccuguaauccaaacacuuggcagaugagaggagcaaguucaagcucucauccacccugcguagugaaucagagguaccugggcuaugugagaccccaugucccucugacccuuacuccuuacauaacaaaaggucucagauggaaccaaaccgucuacuguacacucaaguggccucauuauuuggagggaaggucucaggacagccgcuuugucuuccuguuuuacaguagaguguuuuacacucauggucuuagcacauuacuucagggagacagaauucccuuguuucuguguauaauaggcaucuaauguugaucugaauaauugauuaguccagucaggcuuuugucauuaguugucaucuucuuaacauaaccccucaaaaacacugucagugcaccuaaaaggccuuuacauuuauuaauggauuuuuuuuuuuuuuuugcuuuuaaacauuuuauuauuguaguacuagugacugagcacagggccucuuauaugguagguaaacacucgaucacaccaauuagcuauauuucuaggcuuaauuuauacauuuguuuauuuauauaugagguaggguaaaaaaaaaaaaaaaaccaccaugauuuucacugcuggggccuugguggaaggagaaccaauuuccaugggcuauuuucaugcuuugaggaacacauuuauucucuaccagcaacuguaaguuuucauuuuagauaauuguuccaaaugaauuuaacccuuuucuaaguuaucaggcagccuagcccaugagguucauacaucagaugcagugugucugcuucaugcugacccuugagacacuuugugaugucccagugcuaucugucuggggaguugagauguuuuuccggccuaugcaucuucugggauuguuuucauaguuaguguucuauuuuuguuuguuugguggguguuuguuucuucauuuuauugucccugucgacagggucuugacacguagcccaggcuggccucuaauuuguaaccuuucugucacagccuccugguggcuggaaugucagacauaugccgcuuugcuugguaucagugucuucugaaggucaaagggggaaaaaauaguaaugcuuuaacaaaaaaauguguucguuuuugaguguguguuccuucgugugugugugugugugugugugugugugugugugugugugugugugugugugucugugcaucccugugcuuaucugugcugacguuggugugaaagacagagaacaacuuucaagaguugguucucuucuuucuaacugauggagccaggaucucucuaguuagcuagccggucuaucuugcuuuuggaaacagauugccaauguuucgaacuauauccaggcccuuuauuuauuuauuuuuacaguguuggcuucagggaucaagucgucaagcuucaucaaagcaaagcauuucccccccccccuccagccauuucacuaacccccagagaauuuuuuaaaugauaaauuaccaguuuauugugguuuuuuuuguuuguuuguuuuuuuguuuuuuucccaaaacaggguucuuuguguggcccuggcuguccuggaacucagagauucccccugccgcugucucucaagugcugagacgaaagguaugcgccaccaccucacggcuaugauccccuaauuuauagacuuagauaucuaucuuaaauaucccacgagauagauguauuacacaacuugauuagcagcguauuaauuucuuuguaguagcaucucuaauuauuuuaguugauaacacaaaugcaguaaacauugcugguguuaaaauaccugcacuuaucuauaguuagccauggcugugagauacgagaggaaaaaaaguuuaccuccguuggaggaccagguuuucuaggcacaaaacgauguggcugagcucuacuaggguuuaacguguauauaaaaagaaaguuagagcauaggacuccuucaagaaauauguucaagucagguauaggacccagaguggccucaaggggacccaagauaguaaccucaauccauaagaaacgccucugccuacuuguagugggaagagacgcuuaggguaggaguggccauaugcauucuucucuaguuccagauuauuaacuuagcuguuugcagacuguuuccuuggcuguaacacaugcaguuaaccuccuucagagaucuuacuggggauuaaacgacuuaacacaaaucaaguuuccugguagauagcauauacucaagaaacaucaauuucauccaagccccaaaauccuguguuugauccacucagccagugcuugacuauggcucaaguugcagggcacagcccauucucuucugucagaccagaggguaccugauuuggcagucaggggcauuuaaaauaccacacggcaucuguuugugugcauaguucagcagaauucugagacgcugugagaauacgacgcuuccauuucucuagggucugggguaagguaagcuagucaccugagggauggcggagacuggagggaguggaauuuuuauucaggaucaguguguguaucugucuaccugucucacaucgaaguuaccaaaccccuucuuggaagugaggagaaaaugcaaagggccagggugauucauguauuguuaugaguggguuagccuuucuuuuauuaguaugccaaacaugucuuauuuaugccaaauaauuaagucuauuauuaauggaaagguaugaggguggggagagaaugaguuccggaaacuuuuuuagaacucaaaagcacacuaauuaccuuccaauauggcaaauguauuuaauaauagaccuccaguaaaggagggucccgucucaacaaacccaagccuuauuuguguguaugucuauaacccugaccuggguuaaaacuggggacacauaaacaaagaaaauuuuuauuugguagcugaaggauauuauuguguggccucugucuuuagcucccgggguagccuuuggaauuuuggccagaccccuccuuuagccaccagaaacucucuucccauauuccaugcaacacauuauuuccagagcuuagcucugcuuuugugaaacgaccaugcucuucacaacuauucacaaugucucauugcacauaccacacuugaucuuagccaaaaggcugagaagcgauccauugcacauaccgaaaaagcuaaaacacccaagcaggcagcaugccaucaguaucuuugaccaauuaaaauggagccacagagcuauuccaccacacagaaucugggucuggcauagagaaagagaaccauugcauucccccccccccacaucuaugucuccagcccucaccaauuguuauaacccaagcuuagaguuuugaacccaguggucuccaggacucauuugugaugguacagacaugauugugauagguuuaaauggcuaucuucaaaccuuucaucucagcuugucuggcagucuugaaaguaagaacuugggucuucuaccugcugaguacuuguggugccacugagcuaucccccacccccaccccagcuccgucgguuaagacuaucaaaauuaauguaugaagggucaaagcagagaaucccccaaguacacauuccauuugccacgagagugaugaugucauuacauccgcagcuuccagguucccgagagguagagggucaggaaaguugagagggcagaugaccucuugguauaggagaaaaucauuuuaaccuuuugugcucucugaccagacuuagaaaaauggcgccauaaauggugacuuagcacagcguucuugugaucguugcuguucuuucauggggacuuaagucugaggagguuugaggccaacugaguuuaaagcccaaauagaguucuuuccuucuguguuagguuuucuuuguggaugugggauggaaccuugagccuuguucauacauuacaccgagugagcuugcuuuaugcccaguuucccuucacuauauuaagauguggccuggcuaccuuacccagguuggcauuuuccuugauguugaucauucaacuucagguuucugaggugagguucugaaguaugucucaccaagccuagcuucaacguggaaaguuuucaagucagcaaguagaauaaugagggggcacugaagggaacagaaauccaguaaugccucuggaaucuagccgucaugaaccccccucgugugggcuuaucuuuuucacacacacgcucgcacaugcaauacacacauagagggguggggaagauagauacagauuccuacagggccaacaggcauccagguauuagcuggaacuuaucagaagugggaauuaaacuaaggcucaguugguuauguugucugcccaacuucccacugauuuucuuggucccuggaggcgggggcaagaguuguauccucugucugauccuguagugguuacccucgcaggcagcaaaugaccuucaucuguauuccuuugccuaaaaaguucgcguaugaacacaacauuugagaguuugcuuacaugugcacaugggguuugcagcagcuuccuagcgauuuuucuucaaacuguggcgcaucaaccaucaacgcugccaggccacuuauucuguuagauaugcagagucccacugagucagaagacagacuguagguguaugggggucugagaccacagguaugaaacauagcucggagcaacccccacacgcacccccaguuuuaagucaagcagccuucuacugccaagaaauguauagugccuauaauaacaaaaucaaagguagcacucuuaaaagaauuacuuuauuuaugcauuuaugauaucauaauuacaggcauauucucccgguucuccuccucuguuaagacaggcuaucccuuuucuguagucaucuuugagguaagccugcagugugcguuauuaaaagcaaaugaacaccgaagguccccgugcaagacugcggucugugggagaaucuaauuuguacuagggagcaaaggucauguaguggagcucaucagugcacucacuccaggacgagaucaaucuccauacuucaccauauugauccaagggcucauuggcacuccccuccuugaacuguguggauggugugugaauggagauggauagcucucagcccgaggagucuaucagggaggauguucucaugcucauuuaggcugucugucugucugucugucuccugccauuaagaucuucuccuuguuuaacaaguacuuggagaaaacagcuuggcauaguagguuguuuuucuccugcagacaagaugucuaugaaaugucaccuucaauaucagauuaugaaaaacaaccucuucguccuuggucauuggaacuuugagaaagaguagugcaguccucauggagagggugaaaaaugacaggcaggaauauauuaaacccagcuccaagauggaggcucucuuaaguaucucuuaagauuguuacuaagucuugcuacuuuuccugcaccaccuuuguaaaggcagauggucccacuaaagggagugaugcagguuguuccuuauccugucucugcuugagccacugaaauggugucaagacaccagagguucuuggucuguguagccaucaacaggcccagucuagcugauggaaaccaaugcugucuugauacgguuggccuuggaaucguggcuaggaugucugacacauuauuuauuguuagcuacucucuccugugugggggcuguggauauaugacuggauauccucuaaggaaaggucagaagucaucauaaagaaacagcuuaaaauacucugaccacgaagaguuccgauuggucauaauagcaaguacugcagacuaaaguuggauacccucuguuucuaaauugugucuuauggccccuugucucugucgacaaggacgccucauagacuaacaagagcuucucaucacagugauacauguuugaaacuccaguguguaaaacccuaccuauucccugagucuacuuaauccuccaguuacaacagaguauuuaggagcagcuguauaaagauguagaaaccccuggaguuguagaaaccucuggaguuaugcagcuuccuggcuucguugaauuaccuucuugauaaccacagugcauacaaacaggcuuauucaugaggugcccccggggaacuacacagcucuuccuuccucugucucugaagaacacuauccuuccaguaacuguguguguacauggaaacuguaaacagcuucauacuauaaauagcauaccuguuauuguggagccauauauauaucuccaagcaauuuucuacuguacgaaauccggaggaauacaauucgcucaguucccucauauuugaguaggagcaggaacuccaucccuaccaaucucuaagagaaaucuuauuuguuacaaucaguauuauuucucucccuuuuuacaugguaguaagugggagagugggacucagcccuugaacucuaccuuuguugcaauguguaucugcuguucauaaauucuuauagacuuucuugggcucuuuccucacuguguucagugugaaacguaguaguuguagguuuuauaaacuuugagaaauaggaaagaugaaagacgugaguuugggauuaaacuaagacaguggugacuccuaaugcuuccugguccugcgacgaccuuuuaauacaguuucuuaugcuguaaccacuggccauaaugucauuguguuacuauuucaugauuguaauuuugcuacuguuaauguauuguaauguaaauaucugacacuuaggguaucugauauaccugugggccugauccacaggcuaagaaucacuuucuuaagguguaauucaaacagacugacuguaaaaucaucgccuuaggcacgaacuggaucuuucuuccuuuaacuggcagaaguaagaaauugagauuuguguuuggugaggaguacgcaagaucauagugacacugcuauuaagguuuaggcagcguauacucuauucugccaagcuacaagcagcuaaaugagacacugguugggcauagacacuaggaauccaccuguaggucuucuacaguuagaggacuagucucuucagugaagacccaccaggggacuguuauaguuacuguucuauugccuugaagagacacccugaccaaggugucuuauaaaagaaaccacuuacaguuuuagagguuuaguccaucaucaugguauauaggauaucaagguauacaguagcugagugcuauauccugaucaguaggcaggguuuggagggagagacaggauagagagugaguauucaccugggccugaugugagcuuuugaaaccuuaaaacccacucccaccccagcaaccuauuucuuccaagaauggcacaccucuuaauccuucuaauccuuucaaauagcaucagcuccuauuaacuaaguauucaaauauaggugccuaugggggugggagcauucucucauucaaaucauuaccucagagaccaagaagcuaggagccucagcaggcagaagggcuaaaguuuugaaggaaggugauugcugggccagguguuucuuccaggcugcuggcagaaucccucccagucuaccauaacaauaagauucucucuuccaggcugcuggcagaauccugcccagucuaccauaacaauaaaauucuuacucacuaugcuggucuuaaaagacuccaggaucaaauuuagcucuugccuaaaaauuuugagaaaaagagucaaauaucucucuguaccauaucaugcaguuugggguuuuuggaaauagacaguguaaccuuucaucucauccagucucugcauuuucauucugccaguccagggagaaccccauccuucuuccaccagauuguaaagccgccguccccuuugggauucaacaaauaccagcuuccauccucagccaaccucacagucuucccccagggaggaacaaccaaaauuguuugguuuugaaauagagaaauuauaacaguguuaccauaucuccuuguaggaaguaguuagggacauuuuucagucauucuucuaccaacugugacaaaaugcuugauauagugugcuuaguaggcagaaacauuugggucauauuuuagguuauaauugugaucagccuauucaguuuuagaccugugguauggugaugcuauguaaagccccgggggcuuacaguggaagaggcuguucaauucgaaauguagugaagggguggggguggacauacacacacacacacacacacacacacacacacauccacccacccacagugacaugacuucuauuuggucccuucucccaaaguuuccaucugugcccaggagcuagaggccaagcccuuaucagaggagucuaugaggaaccuguaagacccaaauccuaacaguuauuuuuaagacacaaacaaaacaaaacaaaacccaaggaggcugcccuuguuuauaacaagcauaguagaauaguaugagauagaggcuggggcauucuuagauuccuccucugcagucaauguaacccgccgaaauuauagcccacauaucuugaauuuggcagaggcaggcagauuucugaguuugagaccagccuggucuacaaagugaguuccaggacagccagggcuauacagagaaacccugucuugaaaaaccaaaaaaaaaagacaaaaacaaaaaacaaauuuuucaucuuuaaaaugaaaucauuggaccaaagguucuuacuugaucauuucugucuugaguaaauaccagucaagcaccgacuaugagcacagggccaggaccaggcugugacucagcauagaggguuaauggugaacacucauucugagcuguaaguaguguguguguguguguguguguguguguguguguguguguguguguguguguuggggguggaguuuuggugaccacucauucugacugguaaguggugugcugugaggggguggggguggggcaugagguauugccauccacacucccaaugacagggaguuuucaugugaaccauuuagcaucacugugcuauguuuagcgcuucgggauaaauauuucccgauaauacacuguugaaaauguuuucacaaagcaaaaauuguuuuggcuuaccuagaaauaacuuuucugcaccuugagaucuaacuucugacccuggagcucuuggccaauugccagccucuucugcgaacccacuucugggugccucugaagacauaggaccuacacuuggcacggugaccugaaagaggaauuugaaucaugucagggaacaaguccuguuguguaucccuggggaacucaaggaaaaugcuccuaggaaucuuugugcccagagaauucccaucacucaauggaccuuagggacuguagcaaauucccaucagugaauggacccuagggacuguaguuuuacuuugcgccuaauuuuagcuguguuuuuggugagauauuugggccacuggguuguuguuguuauuauuauuauuuuuuaaacuccuuuggcuaaaugccugcuugaagcagccagccgaaagggggaggaccaaggacacguuugccucuaaacacuuuuuauaaaaagaccuugcaaugcuuucuggaaaggacaguuauuuaguggccuuagagggcacagagcaucaugcucuguagagcccaccuugucuuuuccuccuccccucugucaacucgaagacaucaacuguaguucucacagagaauggaacagucagugccuuuuuccauucacaucuuaaucuaagaugcuaaguggagggcccaucacacucucaaaauucuccucugcccgggcgcaugcucacuaguaagacaguggcuggcacggagaccuagagaaauaacuucauuauagacuuuuguggauguccccauaauacagauccuuucuugacccugaguauaagccaacagaaaauacuucuuuuuauuuaggauuuucuuuguuguaagcuauaaauucaggagaugacacagauguagccauugggacuguguuccaccuggucuguugaucucuguaucauauguagugugguuuuggaaaaaugguauguaugugcacacauauguguguggggcgcauccuauacauguguuuauaauaauaaaagaauuugacagccuuuucccuaugaaccuggauguucaugggaagggaugaagauaguguaacugggaguagcuggaagaaggaacaagaagggggaaagugagcuaauuuuauuucaacuaaauauaauuuuuaaagcaacuugaacagcuguaguccuucauccagggauauugggacaggaacuugguggcaggaggccaugguggagugcuacucuccagcuugcuucucaugacuugcucagccugccuucuuacagcacccaugacuuccaguccagggguggcacugcccucccugagguggacccucccacaucagccaucaaucaagaaagugugccacuggcuugcccacaguuaugcaucuaguguguacacuuucucaacggaggcuccuuuuuucaaaaugacucuacuuguuucgaaaugacauaaaacgcaucuccuuaaaaugaauuuauuuccugcuuguucuucugaaugacgaacaggaacuagguagguggccagcaaggcaaagcucuaggaaaguauuugacauccaucaacuuucaaauacuguccuuguucaucaaccuuuucugucaccugagccuuuucaauuuauuucacccagcaucucaauuauguuucuuucuucuauccguguagacucuaauuaugcuguguacgugaguguuaggucauuguccccgauguacaugcaucucauuugagggugcacagcuggaggucaguccugcuguguucuuuguccaaacucacaguccugguuggagauuuuuguccacugaccaugccugacauucuguggggccuggucuacuccuucauucuccagcuaucaccacugguugggcccacuggagagggugagguaacagccucucuccuccuucacuucacguuauggcaaggcugcagguggaggagcuuugcuuuuugacauguuuuuagguaaugacagguuauuuucaagucaauagaccuucauguuugcaauccccaguuuaagaauuugacaaaaacugaaauccacauaaauaggugacugacuguguuguaagugaagacuguaggcuuugucagcauuggauggagcaaaucagcgaagacuuuacaaggccgcagcuuuuugaauggcuucuuagggaacaugugaguauucuugggagagauguuauuguauuaauauuccuguucacuaagucaugagcuuuucaaaucccuguugcuaaaguuacaaaaccuuugugccuuaguuuccccauuagcaaaauuggaaucaugucgguguaccucaccaaguguuguguggauuaaaggguuuguggauggaaagcuuugcuuaucugcuuuuuuuuuuaauguauaaaaaaaaugacauaagucucaugacacaugacaaaugaugagucucaugacacagguccaaucucagcuuccugggagggugaggcaggggaucuuauguccaguagccaaagugaguuucacggaaagccuggaaagucuaguaggcccugggucaaucaagcaguccguggaaaggaucaggaauacagcuuguauugcacgcaugagaugcuccugagagagcuacaagaccugggauaggaaagagguuuacaagaaaguuuucucaucauuaauuacacacaagccacagagaagcuggcccagcgacaggcacagagcggagugccacgaucagaggcagcucuccuuagcagcuggcuacuguggacauccuggcuaggcgaucagccuguaggagggucuggggacucuggaagaaggucauguccagauaaacaauaugcacaaaccagaugauucuaaaaucuacuguauaugauggauuucagcaagagggccauaagaaccuccuagguuugggggggauucuuggucuugaccuaagugcaagugcgaauagacgaagacaaucuguucccccucccccauguagcuuguguguauuagaaagaagaggccuauauauaggucauuaaagcucuaccucuuucuucccuccugagagaguucaucuccguggaggcuuaauggagauccuuuguugcuccauuggagaaguauagaaagagccaagauggcuuggguccagacacaguguuaccagauagguucuuguaucgugaacaacagcaauacagacugaagcacgcuggacucccaguuaucuggaagcagagaaggaccauaaaucuuccugcaugcauccacuggcccgacagcuuuccuggcugcucguucucugguucaguucuguuuucagugcuuguuuaaucauuguuaauuugaaaucuuuuuuuuuucuuggacuuuguagcaguuuauuguacaggcuucagauaaucgucuguguucuuuauaaaacacugaaggauuaaaguagccgggugucuuugucuugccugaagcaaguuuugauuuuucucauugcuuuugaguagaugaauauaaaugucauuguuggaaaaagaaauaguggucaaccuucagagauuuguuugcuuguucuugcuaagggaaaaaauaguauguggguauuauuuguagugacgcagaagaauguuuacacgggguguguguuuguacgugcacacguguguacguguguauguguguguacauuuauucguuuauuuuggagugagugguuuguggguaaaggucagaggacaacugguauugaacgucagaucagcaagcuuggcagcaacugccacaaccuacugggccguuucaucagucagguuuucucuauguuuuuccuuuucuuucacuuuuaaacuguauuuggauccaggaguuacucuaacagcagugacuaauggugagagggcuuuauuauacaauucuacaagggcugggcauaguggcauguguuacucagguggcagagaccagcagaucucuugaguugaagacuagccuggucuaaacagcacuuucuaggacagccaguacaacaaagagagacccaucccauuaaauaaauaaaagauucuacauugugaauuccugcuccuuucuguaauucugggggaccuguagacuuggccuuuggccaucugguucccagucagcuccugucacuagagugugaguucucuguccuucacagcauccgcccccauuuuaacaucagcucugcacaccaaguugauguucccaaacaagaaguagggucacaccuaccuguccauuucaguagaaggucuuccgggaaggaucauuuuuaaaagcucaaccacagcgauucauuggcuuauauaaaagccucagcagcugagaagaggaagggggacaccaagucccacuccuaaacaagacgcuguuuuuaacucauaaccccuuggaaagagagauuccauucucuccaauugauugacaauauaucaacaacauucaagggcaguuuccacguucaguggucagccaagacaaaaugggcucuguuuguugugguuguuaugaugugguaucuuggguuuuuugguauggugggguguuugggaguuuugauuuggucuggucuuuugaaagagaggagguagaaggcauaugaacuugauuggagaugugggaaaacucggggaaaggauaugaccaaauuuaaaaucaacucuacaggaggcacagugaaauaacaauugagccagucucucagcuauccaaggggaaacgggcaagaaggcuugauauuggaggcucugcauuuuucuugcuuaccagguccucucuuagcaugaaagugcacacaugucuaaugauuaacaggcuggggugugggaagcaguacuugauaacaauaugaggcuugugucccucuacaugcuugucuaaaauaucaauauaaauaguuugauaagcaacuagagucugagauaagcacuuccuuuuauuauggcagauaacccaggcuuauggggguacuagugcucacaacuagugagauguuuuguucucuaaugggacugauagcuaauugguccccuuccugggcuccccaaaugcgacacuauguaugugucacagauaucuaucuaucuaucuaucuaucuaucuaucuaucuaucuaacaaauugccagcacuuguuaccuagagauagagaagaacccaucaucuuuccccagccccuuuauucaccgugcucaugaaggugaugucauugaguagcaugaagcugaacucucaccaauuuuaagaucuccuaaaacaucacagggucaaugaugagaaacaaugcaauggaauauugguguaaaaaauauuggggguggggucuucaaaggaaggcucaauugcucaggaggguuucugaaauuauagucaguccagaaguccuuaccaagggaguacagaccuggagggccuguguaaccagggaccccacaguggcuggugguuucgcuguaugaaaaauuaucauucauuuuacaagggcuaaaggagacacuagcuuagccuguggagcuggcuaccuuagauccauggggaaagccaacaggcacuguggaagugauucacaggcguuuguuccuuuaguuagacagcaccacauggguucuagaagauucuuaguuggucucaaagaagcuauggcacaaacacagaauauaaaacaaaaggaaaccccaaaacggccaggacuugccgcuuuaccaucucuucacuuauuuaaagauuuuucuuuucauuuugaauuauacauaggcaugucucugggucggcauguacacaggagucuagguguccagagaagccagaggagucagguccuccaaagcuugaguuucaggcaguugagccaccugacuugguuucugggaauccaggaagaacaguacaugcucugaacugcuuagccaucuugccagccccucuucacucuucuuuggggaguguucaggagaccgggcugcguucgaacucccagaucugccucccaaggcaugcucucacacaauagaaauauguucuuaagcuaaaaucuuccuuucccgcccacacguggauuugggaggucugccuggccucacuuccuggaaguucugcacaaugucuuccugugucgucauuguuggaaacacaaucucaaauacaggguuuuuugggaucaauaaauaaccaaagguuuauaucacgcuuaaaaaaaaaaagggagccaaauugucgacugauaaauuugaaauaagaugcugauagcauaugagggaguaauaaaacccagaagaacagccugcacuuugcucugaaaucaccuuuagcaucugagagagaaaacuguagagucugcucuggugcaauggccuguugcugggucaccaggacagagcuccccaccugcagucaaccagaggcagaggauaaaguaccuaaccacugccccacccaucucugcccugcccugcccugcccugccccucccgccccgccccgccccgccccuccauucgguacucaguugacuugaguguucccauuuuucuucccacugucagcuaaccccacagugugcugggccaagcaaaugauuuucccaaagucagggcuuggguuagccuugcuaauucuuuuaucccagagcccuacacuuagacacgccaaauaauuggcucaaaaauagccauuugggccugcuuaauaguaaagcauugauuugccuaggguccuugguuuaaauccuaauuauggaauucuuagcagcgugugguuuuucagcuggaagauuuuugucacccagcucacuguuagcuucagucugugcagccuggauuugcaaguugcgggugaggugggaguggggugcugaaggcagaucccaggggcuuguacuuguucggcaggggggcuuuuccucugagcucuauggccaauccacucuucccucaugaacagacaugggguaugucugccuguuguuucuucacuuguugauggcuucacauccccauccacacaccacagauggcucuguuuagcucagguuaccuugaacuuguucucuaguccaggcuagccugaaacucaauugugcuggcuuagugcucuuagugcuagaauuuauagcaucaccgugccccacuuagaagugacuuuaucagugauuucuuccugugcauguaauaaaacucauuucacacauuuuagcugagaaaauaaggcuuuguagugauugggucuggcucccacagauggaaaauauagaagcuguccuuguucuuacccacguccaguguuuuggccgaauucacuaugucccagcccuagggaaaucgggguuggccaccagcuccuaucuaugugucaacuaucuaugugucucauugaaucacuuuguaaaugggcaaaguagcgcaaaccuguuuuuuuuaagccuagcccucuaggggacagccacacuacaaaguaagaccuugucuccaggccaaaaccaaucaaccaaugacuuuaauaugaguuaaacuaauuuuauuuaaaaauuuuuuucuacaucuugguauaaucaggagacaaccuggauucugggaaggagaaagaauacauccuugaccacauuguaccaucuaaaaacugagcaggacucuaccaguucaacaaagaaaaagcaugcucuuugagucagagccagacuaauaauacacaaaagucuuuguaguuacuaucucaacuugggggcagggggcucaucaacugagaaggcgacuccacgucuauaggcaagucucuagucacucgauuccagggcauuuucucaauuauugguguagaaggggucccaccccuuugugagugaggcuaccuccaggcugcuggucagggaugcuauaagaaagcaggcugagccagcuguagggggcagccaguaagcaacacuccuguggccucugcaccuguccaguuugaaugccugccgacuucccucagcuuuggacuguguuagggaacuauaaacagaaguaagggcuuucccccagaguugcuuuucauccuuguguuuuaccacagcacagaacuuaagacaguccuuaaccauucccugacauaugccagccugcagagcuucuuucuguaugagacuggcauguggaucuugcacuuggguaccccaggguucugguuugguauaccauguaguggcaguuugacugucuccaccuuuauauccuagguguguagauggugugugagauaaacagguuuuugucauucaauacugcaauccucuggcgagugagagaugcuuguugugaccagaacuuccauugucaucuucaccauaacccuaaccacucuuguugacugcaaggaaaauggcauuuagaggacuugggggagaauuguguaaaucaggaacaaacaaacccgcuucauguuuuauuuugagacaggguuguuccaagugcuggagucacaagcaagagcagccucggugaucuuucucuuaggaggcccacaucauuaagaauugucguuaacacucaugaucaauagggccaguuccccucucuccagagaucucucaggcugcccuguuagucuuccccguuuggcagcuuacucaaauguuuauugaccuuucuuuaugugagugugggcuauuugggaucuuuuagcggggucuguuaaggaccauucaggcaccuggaccuccaacaacuaagcucuccuagcugcuggcuacaacaguccaauggagcgccuuuuccuagcagcucccugaguagaaguacguaguuuauauucugaaguguuugucuacguaaaauguguucucuaggagcugccauguguuugcugaggaucugugucagagugcucauuggaggggccgcuuugcuuauuggucgucuuguguggaaaauuaggucucaccacaaagauagcaaacaacaugcccuuucucuuucaauugcagguugaugaccaaaugaagcugcuucaaaacugcuggagugagcucuugauucucgaucacauuuaccgacaaguggcgcaugggaaggaagggacaaucuuccugguuacuggagaacacgugaguauccugacugaaauaaaacaaacaggacaaaccccucauuacuaagcuugaucggaguggcaggaauuuuacuaggucagaagcccucuugugcuuugaaaggcagaaaugaugacuuggguccccaguuccugcucuccgauuagaacguugcaaaagcaaacagcuuucugcugccagucugcaggaugaggagucuuguacaagggucagaucuacauuuaaaugaaucucagcaauuaggacuggcagguugggguccccuccccccuucagcuuaugcaugaacacaccauauuuguaguuagcuagccauuuuaguuccuuuauaagcuggagaguucucgcuguuuugcugcugaugguaauggugaugauggugaugaucaggcuaaggauaaaacucagggucuccuauguuaaacguucucaccacuguugaguuauccaagcagccccaagucuuugcuccuuuggaaugcucucagagcaaucacugggagagagacaagcucaugagaauuggaugggaguuccaauuuucaagagcuagucaguuaucuacaaaaaaaugguuauaaaguugaguuuguuucugaaucuauaauugcuaaaccuauaaaucuuuguugguuacccugcuaugugcuggucacuauucagagccacugguauauauuagggagugaaaacagaaaaaguucuuuuggaacuuaauguuguaucaggaggcuggcaauaauaaacuaauccacuaaccugugguauauuggagcaaaggggaauuuaaacaaauauuggccagcaagcagaggcauggccauauuccuaaacacauguuuccaugggaccugggauuauacaguguuuggccuuacugaggugacauuugaguaagccauggaaaaagcagagacuacugugucaccuugggaaaggggaggaccucugcuauacagugggcuuaauuccuacuacuuaacauuuguauaaauucuucuggacuuguccucccuuccuuauuuagaaugaauugauugguaauauaaacuggugggguagacugugaguucucuagucaguccauuugguccuagcucugcagggcaccaugacaucguucagccagggugacucuggaacagaggcauugugaucuuuaacauccagccauaaauguuuaugugcugugaaaccacagcagugcauauuugaaaauucgcugugguaauaauaaaucacccuucccaaucaaauaaaggcaagcaccauuucaggcuuuugccgaccggaucaauucgaccaacuccaucacuaucugcuccuugcucucagcagcuccuggguaugauuugaccaccccagcccuugcccagcuugggguuccauuagaagacacagcucaggaaugaacuuggucucauuugcuuaaaugaaaugggacugugugucucaccccagcucuuuggaaauauuucuuaaccuaguuuauuuugccuggaguacugccuuaguguaauaguagugacugcugaagagcagagaaagcccacccccugccucucuugaguuuuaaaaccaaaacaguacaaacuguuauucuugcugucaaucacuguccaucugcacagugcaugaaaauggagggcgggaacuccccagcucuuccccacaucuuuccugcaguacaggugcucccagugugccccaaccccaccccccacccucgccccagugaacagcauggcgauggcgcuuacaagcaagcuuucucauuuaugguaacuaugggagacggcuuuuaucuucucuuguggagcagaaaagcccauccccaggcuccagacugcagagaagaaggccagagccacacagggagacuucuggagcuccggggcuuuccaagagcaggagaaaauuagggguuggguugaggaguagacaugaagacagagagagacacacagacacacacacagaggggugugugucuguguguuucugugugugugugugucaacaaauacauuaaaauaucugggggucgagggggaagguucuuccucauuaugucaacagccuaguaaauguggggacagcuuuagguagggacagcauguguuuuucucuagggacagaaggauuuugagacagaguugacuaugaaacccugcuagucuuaaaggugugauccucgggcuggagagauggcucagagguuaagagcacugagcucuuccggagguccugaguucaaaucccagcaucgacauggugguucacaaucaucuguaaugggauccgaugcccucuucuggagcgucugaaaacagcuacaguguacucauacauaaaauaauaaaaucuuuaaaaaacaaacaaacaaacaacaaaaaaaagaaagccaugcuccucccauuucaaccucucuaccacgcagauuauaagcaugugccuacacauguagguagauuguuuuuugacuauaauauaaacuucuugacuuuuuugggaaaaaaaaaaagaguacguauguauauaugugucaguguuuaugaauguaucuguguauguacauauguguauauauguauaugucagaacagacuguguacccuuuuuacaauuuacuagcuccaucaucuugagaaagucauccuaucuuugaagcaucaguuucuaugccuguuugguggggaccauugugguauccacaugagaaaauuggaauaguaaccacagaaaauaguugugugucacuagacuacagaguaagucuuuuaaacaaggaugacacagaaacauagugaccuauguccuauagauugucuacagugugaacuuuuacacccugcauggaagucaacuuccaugauacauuguagcaaggucaugcugaugucccggggaagaauuaagccacgcugugccaaucaagcaugcaugcagaagucucgcuccaugguuggcacucacccuuaagugaggaagaugccuuuacucuuggguaaaagguauuucugguagaguuauauaacauaaggcaaucaaagaugugagagaggaauuaucagauacugcccugcagaauagugauaggaaggccccuguuccaccugcuccauaacgguagguagcagcucuccuuugaugggcucuacagcaagcagcgcuguaaagcaagccccugagcauugucagguccacugcaggaucuucuagaagaggaaguguccucagaacaguaagcugaaacaagccuucuccacccaagcugcuuuuggcaauggugauuuaucacaguaauagaaacccuaaggcaaauaccaaagccaacaucucagcacaaagagaaccauagacacugauucuguauucccuccaagcugccguugguugccauacuuaccucuggggcagcccguggacaacuauaggcugcaaccaacugcuccagggccaguguuuguccuuucuucccacgauguguagacugcugugacaaaaccuuuacagcaaaggagguagaaaagacugcccacugaggagugcucuguggaugcagcuuggugggcagccuuugacuaacaaugugugaagcaccaggcucaaucagcagcgccaccggggaaaaaaaaaaaaaaagaaaagaaaagaaaaagagggaaagugagaaggaaggaggaacuggagaaaggcagaaagauacacaaguaaaguccaguguccccaggaaacugucuugaagccaugaacagauaagaacacagcuuuguuuguauucagucaagugggggcggggugggcaaauagccgguccaggcgccagugaugaagcuccguccaggcugcuaguaguagcacuguguucccucucuuucucccuccucucuccccucccucucccucuuucacccucccucccuucauucuccuuuuaauuauuuucuuguuuuuaaauuuuaucugcaauugguauuuugguuuuuuugccugcacacaugucugugugagaaugucagauucucugaaacugcaguuacagucaguugagggccaccaugcaggugcugagaauugaaccuggguccccuggaagaacagccagugcucuugaccgagcaaccaucucuccagcuccucacaccaagguuuuuaaauuaacucuacagaguuugauaucccauuuuaaacuuauguuuuauuguguguugguuuuuuuauuuuuucuuuuauucuaauuuauauacaagaucucaguacacaaccccagcuuguugugcagaccagacuagucuggaauucacagaucuaccugcauugguagaguucaaaggcaugcaccaccacgcccagccacuugugaguuuucauccagcacugauauaauaaauguagauuaaauaacacugaggcaaaaaauaaaguaauauucagccauggcaaagcaguguauuuaguuaguaucuuauuuauggcagcuaauuauuuuuaaucuaguauuuuaaaagcuauaaauacacauaugcauauauaccuguuuguauaucaaauaccaauagaguacuugacaugagggcagauuuuaguauuugcauauuguagcuaauuaacagccacuguaacauuauccuacgggaaugauguacugucaaccuauuaccuuuuauuauugugcacuguuuuaaaaugacaagagucuuacacuauccaagccaucaaaauuuuggacauuaggacuaaaagcaauuuagcuugaauuaucucuguaucuucaugaucaaugaaauuuauccaaagaggacacugacuuagagaugcucucuucagucucccccuugaguuuaauggccuaaagauuacauguaagagagcaaucaauuaauuuuacuaaguacauaaaagacaaggccagcugcuccugaaaugagcacaaacucugcacccaacaaugaaaauauaauuauguuugcaauaaaauguaaggaaguugcaggucugugauuuaucagaagcgagucauccguccuccuucagaacugugcaauuugauaaauuauccuuggaagaaauguugccagagccccccugucuaauaagcauauuugagcuuucaaauuagaauguaauacauguggugggacgccaguugauuccuugaggucugucuuacuacaggugucucagugaauggauaacacuggcaagcaagcaguuccuucaauagaagugguuauguuuugagaaugaaccucagcuauuaaaaguugcacgaucuguugaaaguucacacacaucuaauuuaacuagccucgucuuaauaguaaaauuuuacuacaguauacuuguguguauuacacaguacccacaguguauauucaguuggcaccaaacuugaauuauaguauuacgugccuuauuuaaagaugaggacacucagaguggagaucuuuccgugcuuguaagggucaguauuuaacccaugucauccuuagucccuaugcuugucaccucacagggccuuccugcugucauucccacugagcccauuugaucugcagaauuuuucucaaaucugaauaccccucaucugaaaaugcuugauauuaaagugcaucugauuaugggucucggggaguuacacgcucagagugaaauugcuaagagucaaagccaauucuaaauaugcgguuaauuuaaguuacacacacaaacacacacacaccucccagaggaaauccugucgcauacaaaacuugugccuaaccguguuuuagacugagggcauuucaggucucaagguuuugguuugguuugguuugguucuguuuuuggacacagggucuccuguagcccagagagggcucaacuuugcuaaguauccaaagcugcccuugaacuaagauuguuucuucugccucaggcaucaaaugaucugagcuuucagggucugagccaccagacuugauuauucacccuguucaaucugugcuguucccauagcaacgguacugauauuauuuuuguuugcugcaaucgcacuaaguuuccuugguuggucuagaacucacuguauaguucaggcucugaucccgaguuugugacaauccuccugucucugccacccuaguuguguagucuaguuugauacaagccaaacccaccucuaagaaaggucaguugagaaacugcuucugucagauuggcccuaguggcugagucuguggggcauuuucuugauuacuuguugauguuaaagagccuagcccacugugggcggcgccacucguaacuaggugguucucuguuuuauuauuaagcugagugagccaguuguaguuuuaguuucugcgucucuuccuaccuuggcuucccuccacaauggaccauaacuuguaagccaaauaaccccuuuccuaggguuugauugguggguuuugugugucugugcuaucuacuuuggagaacuucauugacauaggaaccuccccuguuaauaauagugacaaaaacccugccuugaugucacucacugugcucuggauuauccccgugaugauccccugccccaggguucacgcugcccgcagacugacccuuccauacagucuugaaagagaaucugaaagagcgcauagacugcuugauuauuaaauuacaugggcaggugcccgcccagggguagguacagaacaguaggaaagcaccaggcuugaagcaggcguuucaccgggcugcacaucaaugguggcuuuuuccugcauaguugacucucucuguaaauugauugacaccugggggggggggugucuccuuccacugauucuuaauuuucccacccuugaaaacggcuucuuuauacccaguauucucuaguuaaagcugaaaacucaacucaucauauuuacacaauauaaggggggaaaaaaaagaucuauuccguccuguuuuuaauugcagauucuacucaagggacuaguucucaugcguaggaggcagcccugugccuucuccuagcgaaacaagugcagucaauuaugguaaugaaaugucaauaaauauaaaaauuuaauacugucugcucugggugaguggcagaugaggacuugccucccagacaaauuugcugcucaugcaaaaauuaaaugcaccuaaaagagcaucggguugccugagaauucuccagaaagacaaagcugcgagugccagcuauugagugggucuucccaggcugggaccugaggggcgaagccaggacugccauagacggccacccaaaugucuuaacuuguuauuauaaaucuaacaucuuaugcccuuaugaauaauaaagaugggggccucucauugcauuuuacuaaaugaauauagaaguaagacuuuuggggcuuguuuuucaaaccaagaaauuauucugcauaaaaauuaggacaugugucaagggggagggggaggugguaaucaauucgauagacucuaauguaaccaucucaaacuaacagccucacgucagccucugaggaaggggaacugcuacuaguuuuagagucaagcauguugacaccagagaaguugaauugggaggggugaugagcuagaggccagcgugggcuacacagugugacucuugcuucuaaaacagaguccuuaaucaaucaccacccuuaaucaaucaccacaccgaaauacuuuaaucaucugcgagcaagccgucuugaucaugaguauauuaagaugucucaccaugccaguuaagauguuucauaaccauuauuuccucguauauugguuuauguuauuguguccauguagcauuauuuauguagcucauuucuuguggguagcauauuuuggucucaacuaaaucuuuagaauuuaaaugaucacccugcaugaaaacauuuuuacugaggaaaagccgguauagauacuuguaaaagaaaggcaacagaaacuagccgcuaggaaagucauuaacaugauuuggauuuuuaucagcaucauugggaagcccuuuacagaagguaucacaaacugcuuucaggagcaaagcucucccuagcuggacugguaagauguugucaacuugagccaccaguaggaaacagaacgucaacugaggaacuggcucugucagacuggccuguggccucuguguuggaaaucuacacuacagccugauucuacccacaauuccuagugagccccggggaacuuggugcugcugguucuguugguggucacagcccugauucuguguugcagguggacuacuccaccaucaucucacacacagaagucgcguucaacaaccuccugagucucgcacaggagcugguggugaggcuccguucccuucaguucgaucagcgggaguuuguaugucucaaguuccuggugcuguucagcucagguaagcgaaguccguucucauaauccauuacacagacauuauuuucaaauaccaaacauugugucaugguguuacaaggauaauggauuuccuuccaaggauuuuuagaugugaauuugcuuucaauggcauucuuucuccaaucuucgcccuuuagcggaugggugggguguagaacaggaguuguucauuuggaaugcuguucuuuccucccugguggucagguaagcaagggacagaaagcaagagcagcaggcacaguggugacauagguaccaagguggagccaucauucugccguucauauuuguaugaguuuuuuucuguuuuguagucuagcuucugcguuuguucuucuaaaauggggcuggucauuuuuguguuuucaaacucuauuaggauuagcuggggaauguuuauaaugagccgugccacuccgcacguuuaaccaauggcggcugucaagaggaaagaugcuccuucagcgaggguucgcaguaggaagauaacuaagcaagacagauuagcuaaaucaagguucucagugagccaguugagaaaaaucaccucugcuuggaauaaaaaagggauuaaggagauggauuuuuaucgacuucaaaggaacagauuucucagccugucccuuaguugauuucuguauuuuguuggccuaacaaagccaacuuaaauaaacuuuuuugccaagucuguucauuccucauuggaagaagggccgagggaggcaacuucccuugaacacaaauaauggaagaaaccagacuuaccagcauaugguuuuucuuuagucaucgguuauaagauaguugugaauucauauccaaagaaauaaaacaagaaaacaaucugcagagugaaacagaugugucugcuuuccaaauuaggcaccgugguuccagaauuccucuugauagcgccacacaacuguuguuaauauagggauggcuccaagucuuaagagaagacuuaagucuuuuucucaugccaucucaugcagucagugguggaagggaaguggcgguuugcguguuuuggaaagugugauggcuagaaagaaauauuaguguaaguguaagaagacaucuguuucauagauggagcguucaaagguuuccagugccaggagugcccugagugcuuucuguauuaaccacaacaaacggaaacguuccacucaaggaagccuguaucuauuacacgagaacaguguguggaucgccaagcgcaaggcuugcugugacccccacagaucauucugccauauggcaagaucucgguguuuucaacuggugggaaguagagauaggcacaugcaugugauuaacugaccgccucuuucugagggaauccuaagcucuuagcccaguaguuauuuuaaaccaguagagggagacuacaugugaagaugguguuacauguaagacaugauaugaccuaaacaaauuuuuuagauuuauguauuuuaucuuauguguguugaguauuuugccuacaugaauguauaugugccacaugcauacccagggagguuagaggagggcauacaauugccuggaacuaaaguuacagaugguucugaacugcaugugagugcugggaaucgaaccaugguccucagaaagagaagcaaguacucuuaaccacugagccaccucuaccccugguucccguuacuuucaucuugccuucacuguucuccaaaggauuuuauucucugacggguccggaggaggcaguguagauuaaccaccuuugaacuuugaaccuuucaacugaucuccugagggacugugucaaucagaggcuccuguccgucacuuccuuguuguucuggagaagcaaguggggggggguggaggagagccagccuaaguuaucuguugaaaacuugugugcuuacuggcuuaacaggaaagagaaauaaggccuuacgaucgauuacauguaaaauaaguacaggucaaaaguuuucguuuuuaaagaaguaguaaaaauguaauuagcaguaaaauucaggugguuuccaauuuaugaguggaaaauuuucuucauuaauuuucuccaaggaaacaauggauaauucugauuuuuuuuucaaccccauuguauugcuagaguauagccagucuacuuuagaucccaaauaacuguuccacugugacugagaagugcugcuuugaaaccccaggcuuuugccuagccaggugcuccuucucaaacccucagaaacucugagccuucuacacuugaaccaaaugcauucagaucccagcucucuccgcccaguguugccuucugucauccugacaaauagauguuguaguagagugguuggaggccagagacuguguugaagggguaguugugccugccaucucacaugagagacggcauugcccuucccucauagagucugagagaagaugcaguauaguuguaugcgcauacagcaucuugauccaaaagagcagccagugcugaaguucaaaggaaagguagggcaagaugaguuggaggggcaggaaggggugaagcaggaggcccguugaaaguaggcaagagccuagccuuagaagggugggccuuggaccauccagcaaccccaacauagcacugggcauacaguguaagagaaggaugugcccugacucaucgcagugaggacuguagcauuaaggcaggcuggccagcuuccuuucaugugauccugcagugguaacauggaaagaagcaauuuuuguacuaagagguugccaagccguaacugaguuagaaagcagcgaccuauaaagcccucaggguuuuuguuuuguuugguuuugauuuuuuuuuuugguacuuaguucuaagaaaggcuguagaaauaguaguugacaaguuuagucaaagcagguuccagagacagccaccccugccaacuagucacucacaaaaggacucaacaaaaauaaaaacaccugacuaaaagauuucaggacuacuaauccgaauccaugaauauuggucuaucuggucaagaaaagaaguaaaacccccaagucuuucaaugucuuuguuugugaccuaaagcagaccuaaggaucacucucugcuaguuguaauguguuccuuaaauucugcuaaacugaggauuggauuguaaauuaguugagggcuugccuugccuugcccaaggcccauugauguucucacagaaaagagaaguccugaguuggcuaggcguuuucaugcuuauguguuguuuuauuaugcucuuacucuuuuuccuuacaaggaguuaccuugagcaaucaguguagaaguaaauuuuacagaggaagaaguguaggugcuaauagccucaccaucguguugggcccaguguagaugaguaagauuccugcagaguguacgugaggacuguugaugugcguugagugcucggugcagugaaauuguuccagcuaagaagcuaccuugggucauagauucucuuagccugaaaacuggguggccggaugccgcugugacuuuguaucgcucucccugaaugagcaccccugguuuauuguaaaccacagaccuuuucugaucacacacuaggucuggaggucuuuguaacauuuacuuaccgcauucauuuacaguuauucuccuagagggaaaauagccacgucuaagcaguggcuaagcgucaacuccagucucuuuaaguagcccacaaaaaggaugggccuccuuuucaguugcuucugugcuauggaauucagcucuguaagugaaggcuccauugaaguuaaaauuaaugcuuuuuucccccgccacauauacaggcuucaagcacauagcuauguacaucguaccuacuucuguuccaaguaaaugaaugacuaaugacucucaggcccguuagggaagauuaguuaaggacacucuggcaguucuuccuuggcgcuaauggaauacuacauccauaagacacauggagaauaccccaucguauagccacacccuguagcuccucacgucaucccaaauuauagagccgacaaccuaagagacaccuuaggugagauaggucugcucaucccugggaacaacacagguggugcauggagagaagccacugugcacccguugccuuuccuggcugcugcugaaguccucucuggagcaucaacagaggugcagaggggacaagaaccuuguguacuguagaguggcuugcuuuuagccccaggucugguccacagauucugaaaaccgcuccuuuauccugaaggcauccucaucguauccagacuaucucugcagggucugagaauaaaugauauuaucgguaugacuuagucaaaaacgaaccuuguuauguugaaggauccuaaagcggcauuguaaggcugagcagagagcauuuuuuaccuugucugcuguggcuccuugacacugccccccgucuagagcagacaaagggggcuguauggugaagcuggacuuuuuaucuacccagucuguauguuuuaaagucauauacgauauauauuuugcuucuugcauucuaccugacagauauggguuuuuaauaaauauuuauugccuuuccucccaaucucgggaucugaagaaaguguaaugggauaugagauaauaguuuaaaauaauaauuuaaauaacacagcugaagauuuggggaaagauagcuagaagguuuacccuauggcaugccuuauuuuagaaaauaagggcauauuuuuaugaacagaguuauucuaaggaaaauggagacugaagagaguccuuuuccuuuaagaagaaaauucuauaugaaaucuaucagcauuagggcacuaggagacauauaccacaagcagccacagaagagucggucaccuucagugauguaacaggaaacaguuuuauaggcaucuguaauuuaaugguuuuugguuuguuuauugguuuguuuguucuuuuggguuucuuuuuugguuucuuugguuuuuuguuuuugagacaggguuucucuguguagcaacaguuccgguuuuccugggcucacuuuauagacucagcugcccucaaacucacgagguccaccugccucugcugggauuaaaggcauaaaccaccacauucaguuuaguuuuaggguuuggggucuugcuauguagcucuggcauguucuggaacaugcuacacagaccaggcuggucucgaacuaagagaucugccugccucugcuucccagguacugggauuaaagauguaucuagcuaacuuaacaucuuccuuacaauaugggagccagauuugaagccaacagcuucagcucagggccagugagugccccucuguuucaggcaccuuuguagaguaauugaagaagguggucuagaagguuaagaucaauagggacuugcucagcauacgucugcuguagcuaucacagauccuaaauagcuguugcuguguauuauggguagacauugguuccacuucaauacuccccugccuucacuucagauuccacaaccugaauggagcugcccaggucucugaagcagcagaguguucacacaccuguuuauagcugcucuuauacuuuaaaucaucucgagauuaauuaaaccaaugcaguauaaacucuauauaaauaacuacuauauucucgaaggaaugacaacgaucaauguguucaugaggguguagauaaguguugauuucuaaauuguaagaguuguuguuggaacuauggaacucagagcuccagugcacuugcagagagcauuugaccccucuuacagcuuaccaucaccaagaaagacuugacacuuucuugaagccucuggcagccaucuggaagauaaauggucuuaauuauaugugugaugaucuauuuuaauuaaauuuagcacuaacaucaaacuccuaccucugccacccgagugcuggugggacuaagguaugcgccaccacugcccagcugauaagcuguuuuaaggaaaccauuugaugaccauucucugcuucugcucauaacuaguuguaaaaaucccaaaguaagccagggguggucuugccagcccauaagcccagcuagcuguuuaggagguucaaauucaugguguuccuggccuauaaauuuaaguucuaagccagccugaggaaguuaaugagauucugucucaauuuaaaacgaaauccuuuuuaagggccaggaauguagccgagccguagcuugcuuacccaggaagcuggauaucacgugaaaguagagacaggagaaucagaaguucaaggccacccugaacuacacagugaguuccauaacugcuugggauacacaagacuggauaucaaguagcaauagcaacagcaacaacagcaauaauaguaaaaccaagcaagugucgggaauggagcuucaugguacaggacucccccagcacucaugaaaucccgagcuucauuuccaguaagacacaaaggaaaacaaguugccccagcaugguggagcacaacauuaaucucaggucuugggaggcagaaguagguggaucacugagugcaaggccugccuggucuacauagugaauuccaggauagccagggcucacuuaacacccaaccccacccccaaguaaagccgauguuuuacuuacacauguacacaggcacacacaccucucagaugcagaugaauagagcccuuugggaaaagacuacggugacugaagcuguggauccugacuucagugcucgugcaacgugcuguugacuuuguauuaguaaauacagucccacgucucgacugucugaacggcguguaugauuuauccuuugguuaguuuccaguagucuucaguuccugauguguauggguuuuguuccuuguuggaguuucagccacugaugcuucuuccacuuugauaaagaccuuuuugcuuggcucacuuucccugucucagugcaauccguauccuugauagcagggcccacugaagggcacugagagcuagcuuucuguaggcagugaaucaccgugcuggccucuugagcccaagccagucagggauuuugugcaagagucaaagaauccuguacaaccuuccuagacagaaaugugugugucacugcugagggauguacaugccaauuuaaucuaauaauuauuaacuguuaaucuccuaucucaaucagacacagcagggacuuagcgaagaggaaaccuaugaccauuaagugugguuuaaaaaguuucccaucauuucacacacaagaaaccauggcccaucaaucagaacuccuuucuacuugucuggggguacuugugguuaagccaggaugccucuuuagcaccaguagggaaacuuauuuaugaauacauccaaggcuggcaauagcucuuaugugagaagaaagacuucaccaucuacagggucucaauccugucugcucagcgguuggugccauagacagggcuccucuugggcaaugucagguauacacugguggccucaacugcaaugccacgugcuaauucaaucccaagugucaucaagacauaggaggguuuucuccugcagagaggaaagagcccggccggcugccuggugacuggccagucauggguugccuucuugggaggggaagcauuuuucuggucugggcugugcuuaguaccagcucaugccagcucuucccguguugcaaggacccaggagagauguguaggguccacaguggggucuugguucucccucacuuagcauugguagcaugcuccugccaucuuugacacauggaaauacucuggaguuacaaaaagaaagaguaggcuucucuugcaaaccucucugaaagaggucccacauugucgaguuuggggguggaucauuucuuuguugucaugaagcuauguguccccauauaaggagagaaacaaaaacaaaauaaagaacaaaucuccccacuuugcuuuuuuugcaacacuaaauccagguggugaaagaggcuuccaaauccggcugaggauuuugaccccauuggcuaaucucuguuuuuacaguccuaacacaaaaaugauuucuuuauaaaucuaagaaagggaccauuugcugggaagguggaucuucaaagggcaagcuuaguccuguugucauucuuuguugagguuuugacccagaaguuuugccccaucugccaccaagucucaaguccccaggacgcacauuguagagagaaagaacugauucacacacacacacuuugaaagggauuaaaaacucuaggaagaugccuacuuaugcacaguaugccugaguaucaagauaggcuacauguuuugugaaauccaaacuuauguccuggcuguguuagguuagaaggguuaaguucccaacagacccacacaacucaggaggcaaggaugaacugggaaaguaagaugaaacccaucaaaaaguccuuuaaucuugccauucugugguagguugcugcccuuucugaggcuggcccgguguuugcuguaucaaggccuuccucuaaauuauaccacacagucaguccaaaacaacugccacugaugacuggccuacagaguccaaggauacuguauauuauucaucucacaucucuccccgagugcauugcuuaaauuguugcucaugaagucagagaagccaaggaaaugucccaagguucacuguacaauuagcaugcaggcccagcuuuuuacccuuucauuugugauauucucauuuaguaaaacacucacuagacacuugucaaauggccgugcaugucuucauacuauuguccugcugaggugucugcagcugaggggggaaggccagcaaauaagcacuucccaaaauuuauguaaucauuugaaauucagaauggauugauuagcauucacgagaugccacaguucaauauuuauaccauagagauuucgcagaggcaaauaaugguacauaaagcugaugccugccuuaauuaaaugcaguauaauagguguugugugugcgugauuuuuuuguauguuugguucccccccacccccucccagugaacaaggcaguuuagccaugcccagauauaauucauuuuggacuucuaaguuugaaguuaaucaauauguauuuaccaccacugaagaagugauuaucauuuguuaucuguuggcacaagaauauaauugcccaaauagcauucauuucagcauauuucugaguagguuaugcuuaaaauauuuauuauauguuaguugcuaaugcaauacugucauuuugcuaacugcugcuguuuagugagaugauuuuuuuuuuccggagauuuggcacagcagguugagacuaacuagcaugacaaagauagaagggaccuugcucagcuggcauacauaucuacccgcuuccacauggcaacugcucuguucacaucccacagaaagugccuagugggcaucggggucauaccagauccagcacaauagcgagcuucaggccccuugagucuagaaaggggcaaaccaguggcucaccuaugagcccuguauuuuuuuuaaaucuauuuauuuauuauauguaaguacacuguagcuguccucagauacuccagaagagugcaucauauuucguuacggguguuugugagccaccaugugguugcugggauuugaacucgggaccuucggaagagcagucggugcucuuaaccacugagccaucucgccaacccgaguccuguauuggaguccccuugguuuacuggaguccaaacuuaugcccuggcuguguuagguuagaaggguuaaguucccaacagacccacacaacucaggaggcaaggaugaacugggaaaguaagacauuucaucauuuugaacacugaaguccacacagccacagauguggcagcauauggccuuucuagagacugcugcuucacaugacacagacccacucuucagcgcuuggggacacccuuccaaauaaggagugguggaccaagcaaauaguccacgccuguguuaccagcucugcucauucuucuuugucccuuucuuugucacuuuccccucugaaccaaggcauguccuaucccaccacacaccauauguccagugguucuuuguuagugacaaggucuuugucaacuaucuuguugagaaaccuaagaaguggccacccccagagguucaacaaaagguuccuaauaccaaccucggaaccacccagguuuuguuugaacacauccgccccggcuuaaaaugguggaauuccagaacaucagcuuggaaccucuaccauaacaaaccggugaugcugccaaguuguauuaggagcaggaaauggaggcugacagggguuaaacgaccucgacccaaauagacucaggaugggcagcgaacuccacuguggggaacaugcacagaauggacuucgacaguuagggaaaucgcgcgcuuguggagaauuuagaucacauuuuauuuacuucauggaagguagucauguaccaggcuauuuaaaaaugucaucauugggauggguaaaccugagaagacagaacgggugcccuggcaccgcacaugccacagagcuauuaugugcuacauuugaaccccucgaaccccgguagguucuaugcgauccaggggcuuggucuuuguaagacauuaaucaguccaccuguguucauuugcacuaaagaguccagagcucuuacuuacagcuacuuacuucccggggugauuuugaugugguuggacuucccgggcucuugggaagauagcauaaggacagcgcaugaacuguaucuuaacuuguaucucaacuuaucauuugcacuagguuggcugaaacucugaggaagggugugccuucuauggaggccaguguugggcucagauugggacaguucuuccuaaccaggaaggaauggcugcaguucaguuguuugucuuuugcccuauauuguuuauauguagaagcaucaguagaucaucugaaauaaaccuuucucuuugauauucauccuaagagagauaacuguugugcuggcaacacuaauaccuauauuaagggcauauucuuuccuccccacccccacccccugcggucugugugcacacaagcuguuuuuauuuuaaucuaaccuuuuggggaguuauuuuuauuuuuucuucaagacaaggucuuacauaucccagaaucugaucuuccugccucuaccugggaaguuugagaaacauauguaacuucuuuuggaaauacauugcugacuugggcacgacuccauuacacgaccaggacaguugcuuuucagagaacugacuagacgccuccucuuccauacguuaccaagucucugagaggugagagccucacacaguacagcacacugucucugaccuacgacccacuaggcuuauuuccaucuuuaacuuguagcgaaauuuauacaacaucaauucccauuuuauauaauuuugagcauacagguuaaacauauauauguuguuauauaaccauugucccucuccuuccaaaauugaaacuuuuuccccaugaagguguaauucccauuuucccuucccuccagccucuggagccaccuuucuguuuaggaagugucuucaacauugaacaucgaacuuugccuaucacguaacauuaaaguuaugcccugucucccagugguacugaaugcaguagcuuucaaaugcuacauuacaauacagccucaaaugcuuccccuuuauucacaucgcuagccucaaauucacaggaccaagcagagugagagaguaaggaguagagcgcaaacuaugaauuugugagucaggcauaagcggcacaucccucuaaucccagccugggcugcaugaauaaggcccugcuaaucauuagaucaacaaauaaacaagcaagcucguguauguuuugagauauuuuuauugacaaaacgaugaacuucaaaaucggaggucuugguccuaccaucuagaauccaagcaccugggaugagguggagcuaagcauccucccugugacacuguggcucguccugagugacagcuuccuuagcuaucaaacuucaggcuccagaaccucugccgugggcacuguggguguaagcuucaucuuucacucaucucucccuccgcuucuguguugcuucuuugacagugcuccauuuaucauuuucuauuguaauuguuuuguggguccacagcuggaggaccagcucgcccuucacacuguaucuugagcaucuagcaucauuccuggaaugcccuucguauuagaaagcagugcuugcuuaguuggcacauucacuuaugaccgcccgugaacaguguaauuuguacgcauuguuucugagcaucacagcaaguuaagauacaguucaugcgcuguccuuaugcuaucuucccaagagccggggaaguccaaccacaucaaaaucaccccgggaaguagguagcaauaaguaagagcucugcacacuuuagacaccaaaggccagauuucugcacaacucccaacuguuuuuccggcuaauugauuaagggaaacuauaagggcaaucuccacauuugucaguuacaacgaugguaauucaaucuaaaguagaccagucaggagccuggagggaaucaaaucuuucuagacccucagaagcugaguacaggccagcuacuugccuuuacccuuccuuacucggcugcagcccguccaaagcucggcagcuuucagacacuugcucucuguuucccagucuggagaauggacuugccaguuugaucacugcaaagucagacacacuguagcuaacaggguaaggauguuuuaugcuggccaccugucucccgcuccuaucucgacaaaccuuuaugaugagcagaagggucaguggucagagucugggaucaaaaacuugaagaaccggaaaauaaaaagaaagccaggaaagaguuuuaguaauuagcaauuucuccuaaaauuaagagaaaauaagcuguuguuguuggcuacaaagaauuccgagauagauggaauacccauaugugcuggcgccgguccagagccgugcauaucaguggaccuggggccccuggauacuguaacaguaucguuucuaauuauaacuucaaggaaauuccucucucaaugagguagcugcagcagcuuauucuucucuuacaaaagaagacugccuuuagcauuuaaaaacaucuugcuuugcucucauugccccaggguguauuuuccagauuucuguuugagaaucuuuggaauccuagggaaaccugcccccccccccccauauugcuaccucucacauucguucacuacacggcgaacaccaccauugggugauucuuucuccaguucauggcuauuuacaaaccaguccucuacauaucuuauucuacuauguuaucaggaaauuauuuucauuucuauagaaauuuuaaaaauauucuccuauucagcuuggccauauuauaaugcagaguaaacaagaggccccauuaccucuaaucaaaaaucaacacucuuaguuauuucauuaauuaguguaaguugucauuuagaauuuguacuugugauuaucaguggcuuggaacacccuucuccuguuuuucugaacucucggcucacgucauuagcccauugggaauauaugcuuuucucacucacaggguccuucccuuuucucuaaggguaacuggaggggugaauucugucucuuucacggaaguagccauagucauauuuuccugugugauucuugcuguugguuuuuucuuuagggaacccucagccuuuaaggugucuguguggguguaugucugugcuguuguguuuauuacaguacaauccuuucccgugauaucuuccaauuagucaauaaccgcaaagcuaaguaguuuuugaggaaaagaagcauuuaccaaucauuuggaauggauuuucuauaguuuacuuuggacagauaggaacacuacaucaaaaugaagauguauauuuucauauuuagauuauuacaauauucagacuaguguuuuguguguguguguguguguguguguguguauggugcaugagauuuuauuuuucuuuuauagguaguuaauuguuccaaugcuacuuauaaauaaaauacuuucuuauuuuaaugcuguaucuuuuauauauucaaagagaguguguguguguguguguguuuguguguguuuguguguguguguuuguacaugcauauggaucucuuucugaauuuuauaucuuaugucacugcccccuuugguaauuucaaagcaaaguuccauguguuuucauccuucuuacaggaaccuuucuguuucucucuaucuagcuuuagcuguccagaucucacucuguaguccaggcuggacucaagcucccagagacccaucugguucuaguuccucugugcugugauuuaaagugugcaccagugugcccagcuccuuagaaugaaucuugaagacuggcuaauuggucucaaucauuggcuuuccccgucccacagaaguugcagguuugggcuauucuuccacagacagcuaaggugggauuuugguugaaauugcuuuguguuuaggaauugauuuggggaacgugauuuacuucacggaccugaaauucugucguuugugagggugguuucucuucagugggcaggauuucguugacagccuucggggaagcugugucacuucuccacagacaucuguuggccacacuuuucuagcgacuuccuauauaguuuguuuuuacacugcagugccuuuucuugacaucuucuacacugaauauuuuuaagugaauuaauguauaauuggccaccugauucccuugauaccugaaaucgcuuuucuguaguuuaguuuggaguuaaaacagugcaaaacuuauuuucacaagagcugacagaagccuagaacauaaaccaucauauuuucauaagagguacaaauauuuucacaucuggucaacaauguaauauauuuguaccucuuauaagaauaauuaugaacucucagaaauuaguaugguuuuuguuuguauagaaagcaaagaaaauacauugacuuugaagauaugcagcuauuuuuugccuucaauuucaguagauccccuucuuuauuaauuuauucgcacucuagauagauucuugaguugaacacuucuugaucuguuauauuuuuauggaaagaauugggguuugaaaguugccucuuggcacaacuauaauuguuaacugcagagacaauggcggucagggagucuagaagggcaugcuuguuaccuuucagaacucuagggggcgccacucccacaagcgucuuugccagagcccgaguggcccuuucucgugggcccguauucaccuccaaauaucucauaucucuauucugcucuugggccuuuaaaaauuugugguuucucaagcagugggcuuucaauuucuaagcaaauaucaguuuggccaugcuuucauuuccggaauguaaauuaugagccacaugucacagagacuccuuuuguaaugugcuauuuaguuaauuuuuggaaguuuggcuuguguaauacaguauguuugucaagugucagguuuuauucacuuccaucauucugaucauuuuaaugcauuuuugugguaggcuuacuguuauugaauaauaguucuacauguuuuuuuuuuuuuuaaccgugugugucuuuugggagucugugcaucugaaugcaguacccguggaggauagccuuaggcuccccaugcaccuggauuuguaugugauucaaagccaccaggagcugaacucacauucucuuggaggacagaugauuuguguucuuacaggccucugucagcucuaugccaugccauuucccaccccaacggugagccaucuuccuauucgaucugugaaacugacuccaguuugucuuuccaaacucacagagaggcugcucugcucucuucucagcacaccuacccaacccaacaauccgaggaacuucugccaagucgugcaguugguuucuguucugucuucuagacacaccacaccuuuuccuaugcccaggcccugagaaguuccuuuugccacagcuagcgugauaguaccucagaccauuguccaggagcugcccaugcuggccuucccagguuucaugagaagccccgauuccuggagcuuugccuggggccacgaaauaggcaacgugucaauggguagagcccagaaaucugaauauaaaugaucugccaagaacucuccaccauucgauguccuaacaguuacuccuaaauguuguuccccugaaucaacuaaaggggaaagguuuuguuaguagugcccagaacuaaaccagaauaugcaguguaugguguccuuauuucaggagcgucuccagggagccuaaagccgaugguccacuuuccuguauacuaaguuacaggaauaucuuaaccuuguauucugacacauaaaccaagaguauacagaaagagugaauuuucagaugcuucugaaaaauaggggguccacauaaguucucacuguagcuucugagagcuucgcuguuucagauagcaaaggcaucuggaagaacuagucucacacugcagcagggauggcuucuuugcucuuuguucaaacauuaggcacccaagagucuucaccuucaaaagagauaaauuuauaggagaguuguacuagauaaacaacaacaauaguaauaaauaaaauaaauuuucuauuguuaccagagauucauuuccaaaucuaacuguaguuuacuuauaaaaaaauuauuggaguaacugagcuggcaucaccuagugaugaugcuugcuaccaagccugaugacauaaguucaaaccccgagacgcacaugauggggagaaaaauucuuauaaguuguucucugacuuccacauggcauguacacgcacgcacacacacacacaccuacccaccuaaauaugaaagacuacaugcaagacacuagauuauauuaaguauuaacaaauuuacuauguguuuguuagcuaagagauucauacaauuuuagcauauacaaacacacacacacugguagaguccaggcaaaggccucgugcauaccagguaaaacaugcaauugcuaugcuacauccacagccaguaagcuaucuguguuuugcauugguuuauaaauauucucuuaagggaacugaccugucuuuaacacucccaagcagaacagcaucgaagccugcugcccugguuccuuagcuguggccgccgucggagucuggcugaggaggcgguuacagagcuguuuuucauaggugugauuuuuuuuuuuuaauagcuugcacaaaagccauccacagguaccagucaaaccaagcgucauucucuaccgcugguccuuucucaggcaaccuaaggcauguuuaaaauucuucucaacuaacaagaaaggguauuuguggacauuaaacauaaaauaaaauuaaguuggaaguaaauuuuagaugauacuauguucaaaucacaaggguggccacucuccuggucauugucuaugguguccuuaguuucuaggcuagagggccagcugggcuggaucucaaaauuuagucaacaagucucuagucuuuggaaauuuugagaaucucuugagggcagagagauggcucggugguuaagaggaucugacauucuugcugggggccugaguucuaucuagcacccacauugcacagcucacaucaucuguaaccccagcaacacaucugcugccugccucuggccuccagggugccuauauuuauaugcacaccaucacagacagacagacagacagacacacauguacagauaauugcuuguucuaaaacaagcuuauaauggauguauaacacaaaaguuuuuauuuuucaaaaccauaguaacuagucaguaaagcagcuauugaauauucaguagauguccaauauccaauuaaauauggauuugauugaugacaaaaacaaaauuggguaacuaaguagcuaauagucauguucgagcaaacaaaaagaaacuaugaauaugagagagagagagagagagagagagagagagagaguuuauuguugaguagagaaugugugaauaugcucagggagggcgagagggguucuauaaauugcaagcugaaaggggagggguuuuuguuuuuguuuucagcauaaguccagcauaguggcccugguggcgcugggaugccacagcucagaaggcugaguugggaugauucugggcuccaggucuuccuggguuaaauggugggacccugcucaaauacaaaaaacaaccugguuuguuaagauuaccuccuugugaaugcccuucccuuuguauacaucagugaguaauucugacauugaucucugguuauuuucuauccuuuccuccuuuaucaccuugucucucgcuacgcuaguacuguguauuuccagaccaggucaggaggaauuauggaagaacagggucagaugcagccauggaugggguacccagggcuucuuccccaccacuucccauguugucccgaagaucagugguuagcaccugacugucauagggcucuuauuagaugaaauguguguguacauauaucucuauauagagagauauagauagauauguacagacucucuuuccauugugcuugugccaaagaagaguguccgucagacaccggcugguggcuaucugaaagcacccaacagcuggugucugucauaucuguguguucacacuuaacacgcaccagagucaaggaggaaagagagagcccugcgugcagcagccuggcaacucucagcaaagccacagcaucauacuauaugguggcucgguacugaugguggcugugccuguggagccucagccugcauuuccuuauuguaagcuccuggccaucacuuagggccuacauguugguucuuuacggacaucugcuugacuuccuugaagcaaccccucccgccaacccuuccccauugagcaccauguaaggaugacuuuaucaaaguuauucuaugaacgucucugucacuuguuugaaguccauagugcaaaauaagcacauaguagggguccacacugcccguagaugguaagugaaugggcagguugauaaauaauggggauugaguagaagccacaacaaagaguuugaaagauacaucgccauccuaugcucuccucuccaguccuccucucuaccuucccaccccccucuuccucccaccccuaccuccucacucaccccuuuuucauucagacuggugaugaaaccaaucaaggcuaacuugaaaccuccaaccccucuucugccucccuugucgggugccugccagaggaaacaaaccuccggacuguccauagaggaguuaauggggagaccaccccugcuuuguuuuuacagcaucaaccugguguagagacaggcaacucuuccgacuccagugagcgucauccauauuuaaugcuccuugcuaucacagucaagcaucucagaugguuaucaacaccacuuaaaaauaugacgccuuguuaaauaauuaauacaggugauggggaagcuucaggcaaugcucagagcucuaguaauuaacggacugguuacaagaugcaaguaagacgacggcuuaaccacuaaagccaccacauagggcuggaugcuuuaacauuaagccgcguauaugugaauggcgacauauagauuugguuccugggcaguaggggagaggaucacaagcucucaccaauuuagagacugucagaaaacauaggccuuccucaugccccaagcaugcccccugccccgucuccaagcacuucgcaguacuugguaccuuuuuuauaaggcagaagcugagaguguacaucuuuucuguucugaaaucuguuucauccaccucccuugagcauuuagagacgaaccaaagcucuguuuguuuguuuucuugcuuguucucaauauuguaggcuguucucagaaauuagccuggaagcuuucuuggaggaauuagucuacagcaucucuguucuaggaacugagaagggaaaauggccccguaacugcucaccagccggcaaauucccacucagcccgccccacccaccccgaggaaaagagaaagcuuugucagaugaaacauugucuugcguccuuuugcgccauucuggacagucagucugguaggaaguauugggcgauaauaggacggucuuuucagagaaagccccggguuucgaguuagcaggaaccaucuaucaguucuuaggauuaugccgugauuuacugucagggcaccauguauucugugauuuucugccuccugugaaucauugugcuuuccuuuccuauugauguaucaacuauaauaguuacaagcagcuacagaaaaaucaauagcuagcuuucauuacuguguacaucaagucaagagccccacgcaucaagagcggaccuuguuagauacucaccaguagaagaagguagagcgcuaccuuacagauugaaugagaaagaucaacuuagagaauuguaggcauucagaauuuguaaauaugggcgucucucucacgcaugugauauuuauguuuaagccuuuuaucaaaggagaacaagcauuccaaaaugagcauaaauaucagcugccauguguucuguucugucauuuucucaggccauccaggcagcaggaaucaguacuagcauagugacaguuggcuguuaacgugcucaacacccaggcaaguacugggcaggccucagaggacucugaguugcccaagucuuaaccgaagacuuucauucucuuugagaaugauugugggaaaaagaaaaggauaugggacuuaaacacaacaaaauguuuauuguuuuuggauccuauuuaacucccagauagcgcauguaaaucaaggcagccugagaguaaagcacacgugcagguccucugggggcuggcaaaggcccuagcguucuccagagugucagccuuucauuugggccacacucaccggagacaagcaaagcaauucuaaggagucuggguucugauccauguggaaucaugaaacccauaaagucugcauccaagccuguaaguuugcaggaaucacccaucacuuccuuagaguaccaguccaugugagcgacuuucaucagucaugguuaccauccaauuuugaaccccaguuuauuuucaccuugagaauuuacagggcuacagagaggagaaacccugucucagaaaaacaaaacaacagaaaagaaucuuaagaaaaacagcauuuaaugauauaaaaccuaauguauaaacuuagaccuggaggacuagaucagucucccccaaagggccauuuugaaauauugaugaaucuaaacaaacgguuugauuucacucuguuuguuuugucuugagggggugagaggaauaugccagcaauggacugcucagagagccugcuuucuuuaucauagucuucccaacucccagggagugcuccuucccucucccuccccccaccccauugccccuccucugugucugugucugugugucugugugucaaacaaccagaauuaccaagcagcucuugcaucucccuuugacauucugacagugccauggcucugcacugagugcuugguauucugcaggaauugugcaaagauuccuuaugcuggcccacaguggucauaacugaggauccuaggaagccaguaaugcgcucuccaacccuucuucugcacccaauucugggaggaagcucuucauuacugaaguuaguuaagcaauagugacaucaacaagguuaaauugucccaucccuucccagugcuggaccuggaaccuauagucucacaacacucggcaaguacuugaccauuaacacucuaucuucuaugaguguauguacacguguacacacacacacacacacucacacuucuacuuuuuucccuuuaggauuacaucagcuugccacuccccacucccaccuggccuaccauuagucuaguagcuuaaacuguuuuuuuuuuuuaaacauuaucuauguuuguggguguaugcaugucauaugugucaguucccauguaugccaaaagaagguaucagacucccugaaauuggagcugcagguagccuugagcuacuugguguggaugcuggggaaaacuacauccacaccacaaacacaucucugagccaucucuccagcaauccccuccccccaccuuaacaaacaugcuuuuaauaugcaccuccuaacuacagucagagaguugugagcaccauucagaugcuugaugacucugugccucauaauuccccuagauagcaccuaggcuucuaguaaaacuacagccccaggccucagccaggaaagggagagagcuuuccacagccauuuggagaguguuugcucuggcuucacccaguuccgugcccaaggucagagggcgcagacuccagcaggaaagaagcaggguguuagagacagcaggggcuuuccaggcuggcugcucugagugccacggggucacacucuggggaaauccagaaugacagcagcugugccacccacccaccuggcucccugacagagaugcugcuggucacacacacacacacacacacacacacacacacacacacacaugaaguaggguuagcaaguuuuaaacacagaucacggaaggauaucuuaugcagaauauuaagacuugagcaaugaugaaugagugaauuuagaaagaaaggaagaaagguagguagguuuguagcugaccaagcaugcacauuaagcaaagacggcugugcuuaugguuucuuuaaguagucacauaagauuugaauuuucuucccaauuagggaaaauauggaucaggucaacauuucucuaguuuuauccacauaaauguuauucugugaucuagucaaauucuuaauguaauauuaguaaacuaucuaagaaaugaccucgagucuuuuccugucucacaaauguucuuuuaaguuuugggccucaguguccagaagcgacucccagaucuucagugccgauccccuucagcuucaucucugaugugcugacacccuucggugugcuuguguggaagucucuggccagccccacagcugguguuauuuccuguuuuggacuucccacucacugcucacacuugacaccuuuggguuagggucaggucugugccaugcacccucuucugacugugucuagcccugcaggcaaaaccugccugcagccugagcaguaaccuguagcuguguucuauugacugauguaaucacuaaccgucacugauccucacccuacaaggagaaaggcucacugccacaggaagaaggcagcaguagucucaucacuaggggccuagacauuugagaacuucuugcugaugaccagcacaggcaggugauuaggaagcaguggauguuuaugaugcaauguguccucaguauguugacuaugagcuuuuccggcucuuucaggaguguuaaaagaugcuucaucuugccagcucuuuaaugugcccacagcagcucaguacugccugcagcuccaacuccaggaaaucugacacccucuuuggggcuccucaggcaccccuacccaaggagggguguaaucuggguuccagaagggcuagggaaucuaacucugggacuaagaaguggcagggcauugggaguaggaugugcaccucaagaccuaccaugucaucuccauucacaccgaaaacuggcaacacagagcaagguagcgauagggcacagagaauggagcuuagaauguaguggcucaggguucuagaugcagcucugucauuaaauuaaccaauguuagaaaggagaauaauauugucuuaagcauugaaucagauagugcuaacaccaagagguguuaaauacccauugcugaauuaaaaauuagugaaugaauugugagcacaaaacuuuccaucacuuaaauugaaaauguuucggcacaacugccaggcgauuguguacaugcucacacucuuucugccauggcuuugcacacacauuuggucugaaauagauguguucuuggcuacacgugcaugucguuggcgauucccccaugaaacucauggggagagucuuugggcugucuuaucccuuaagccugaguucccaugagacaguugugaauccacaguggcagccugagcugagugagugucuggggacccguguccuccccucguggaaggccaguggaaaggucagagaggcucaguaaugaaacacuuccuuuggggcuagugucugaaagaaggugggcugcuaaaguuucccagcuuuucaaggcuguaagauuuccuaggcaagaccugggugggcuaauggagacaguuguucaauacagucagcaccccagggagacagaauaauuaauguugucuuuugagccagguauugucuuaagcuugcagucauuagugacuuuuuuuguuguuguuguguuguuuuuaaaagaugagaauacugagccguaaaagcaguuuuuuaaacagcauaaucggauauauuaugauauuaugaucacugucuuagcaaaaucugguuauacuucuaagaucauagacgaggaucucuuccuggucaggagaccagccccaguacagucguucucagcccaauuccccugcccguuagaucuccacucuaugauuacacaaauacagaacagauugccgauauagauuuucugucuuucacagagaaauacaaauccaugagcaaaugaaugaauuauuaauuucaguuauguccaaaaccuagauaaguauuuggauuuaacgaucuuguuagguaaccaguuguuuuuuuuuuugggggggccgauccugucuuuauuuccuagcucuucuuuuuuuuuuuuuuuuuuuuugcuagcuuuuuuuuuuuuuccauuuuuuauuagguauuuaacucauuuacauuuccaaugcuauaccaaaagucccccauauccacccacccccacuccccugcccacccacucccccuuuuuggcccugguguuccccuguacuggggcauauaaaguuugcaaguccaaugggccucucuuuccagugauggccgacuaggccaucuuuugauauauaugcagcuagagucaagagcuccgggguacugguuaguucauaauguuguuccaccuauagcaguuguuuuuuguuuguuuguuuuuuuucucccucuucuuuuagcagcccacccccaaagacccuaucuuaauucuucaagccaaaguaauucaagcuaaguauugguuuucuggguaauguuuuuuuuuuuuuuuucuuguuuucaaccucugucauacugagcugaauuuuaauaagcuaagggaaaugauauaauaacagguaaaacgugcaucugagucuuaaaaggcagcuuuaucuuagcuucacaaacuaaugaaacccuggaugcauguauaaugauaauggcgguucucacaggccuuccacuacggaacuguacggaucgccggguacuacucuuuagaggaagugggaggagagcguccccaguacagcaagcucugcuagaacagaacuuuucaacuuggcgcccaaaaguugaaugcacacuuaaauuauaaauguauacuauaaauauuggaaaccaucaguucuguaaccucaaaccagcgcuuucuggguacugggcacuaagugccuucagagugcuaacuaauguaauuguuaagcaagagggcaggggauuggcuccuugcacccauauggcaauucacaaaccuguaguuucaguaucaggguaucagacgcccccuucugggcccugugagcauugcauacacauggcgcacagacaugcacacaagcaaaacauucaugcacauuaaaaaaaaaaaaggaauaaaccuguaacaaaaaaauauaaaggagaguauagagaacugacugcaacauuaaaaugcccaagucuccuccugaugcuaucacuaauuaacuguguugucucuuucuaagaaacaauaagagcaggguugugaggaaauauaaauauuuguuauaaaauaaauggaaaggcuuuggcaguaauuaaaacaacaacauuauuuaauucccagaaaggcaauauuguauaaaaugccuaggcaaaagcagacacaauaagucucuuaauucccugauguuuccaauucugcugguuaaaguugaauuuauuucucccaaguaggaucuucagaacccagaacuucccaacaaaguaaaacugaaaccuguuauuuaaaauaguagggaucagauuggucaaccuuaaccggugagcccuuacaaacucauuagaccauccugcuguuugaagaagcagcuuucuucucucucucucucucucucucucucucucucuugguuuuucaagacaaggcuucucuguauagcccuggcuguccuagaacucacuuuguagaccaggcuggucucaaacucugaaaucugccugccucugccucccaaguguugggauuaaaguugugcgccaccacgcccggcgagaaguauucuuuucaauagcaaguguaucuagguuuucccguuucaauugaugcgaaaaggggacaggaagugugguucuccuucucucagaaacaaccacacucuccaagguaccucggaagacaaaccauuuugaagauguugacacagaaguacaucacccaggggucugugguacacaguggagacagaaucuguccuucuggcaucucacugagcaggacauuucuuuuugacacagucaacaccuggcagugagacccagcucaugaguugcacaaagccaucaccugguuugcaccauguggagcgcauucuuccaccauugccauuuaaaaggacuuuucaaacaauucuccugagacucuuuggauucauggaacccucuuuuuuuuccccuguggcuucuuccucccuucccaucauccuugcauaguuucugccugaaauggucucccuuccucuccucugagagcaacgaugcaguucaggcuuugagcagccuugugugggaggcagagacagcaguggcuccuggcaauccaaauugcagggcauccuguagacagaccuguguuucaaaggaagggauuucuguaagaugcugaauuaugaaggaguauugauuauauggguagaaggaucuagaagacuccaucuuuugucuuccagacuuguuauaacauagagaaauguuaaaaucuacuauuuauucucaguguagcaccuugucuagcauaugccauacucucaaacguugccucuccuccuuccuagacacaaccugaaaguugaucuugcuugcaaagcacuaccgaagcuaggaagcugaacggaauugggcugauagccacacguagccaaaauaauauuuuaauuggcugagcuaauauuugauccaaguucauaaaaguuugaagucagauaauuaaaugcaaauacgcucuucaucccaaagacgauaagaaugccuuuaagcuaauauuuuuuaacaagaacugugcagcagcacucucuuguaaauuucaucauaccugaggcgguuucccucauucgauuaucugggaagcugaauuuauccccgaggcaaaccagacaucuaguacaggcuaaacuccacaacuggagcuuaaauuuggcuuaauauauccccacuuggaucugccuguuuaauucucuuucauaugauagcguugguuuauucauaguccugacucgccaccugaacaaacggaaccucauaucuuauucuaggaaaauaagaaaacuuugcaaaaagccaccaaaguucccgaauggaaaucaaaugcaaauguguagcucaaaacuguuucaggaugucacuguaagaauggagguguggcauggcuaugaauguggcugucuccuaguccauagggacaauguucucuaugaaaggacacacggggguuguggcucccaagcagccaaggcagcugcaauucugaggcucacaugagaaaugcuggcgcccaugcauuuuaucgaacguuaagucuguuucacacacaauaugaaguaaaaugccccuuuuaaauuuuguuucuugguucaaaauauucagucaguuccccuccaggcacugcacccugucuuacuguccuugaacguauagguaguugucccugucacccaaccugcacaggccaacacugcaucgauugggguuugcugaccuuaacauuacagcuuucuucugugguuuuggucccugaggauuuuggaaguuaaaucacaaaucauuauaaauauguuccuagguauuuaacuaggcccauaaccuggaagcugagacuaagaauccugaauuccagauccuccugagcuauauugauaggauccuaucucacauuuuuaaaugaucugugucaccgaugugaugucccuaacauggcccauagaccccaaauaguuauucuggaggaauaaguauucacacuacuacuccacgcuuucaaacaaaugucuuuccgaaacucuguucauauagcuuaauuuuuacaauuuauaaauaauaaagacuuacaauuuuuaaucaaguuguaauuuuuucuauagauaaauuauaggagcuguguucuacuauaucugagauuauuuuuagguuugaugaggcuuuaaacuuaguaguugguacuguugucucacugaaaaagugcucaguaaauucccaucacaguauuuuuuuuuucuuucaucuucuuggaagccuaauagaaauuacuaaguucauuacuacaggcaccgguuauagggggaugugcugugugggaaauaagaaauaggagacaggcugaaggcugccuccuuccaagagacagcaaagaccagaaugagccaaggaguaguggaucaaaagcagaauaaagcuuaucagagaaagauauuauuagaaguauuuagaagauccuccaacacaagcaaggggauaggccaguguguaugaaauaaguacgcagacauauuguucauaguuugucaaaggcagagacaucacccuaggcuggagcccagcacuguugcugucuuguaacuaacagacaaaugaccauggaacaccuaaugggcaaugagucagucggucauagacagcggagucugcucugagccuggggaucaagaccaguuaccugauugaaguugaagggaagaagaucucaguuagcacaggcacaggcccaucugaaaccaguuggugagaggggugaaaucagacuggagagugaaugccagacgaaugucuuuaaucgguagcccaagggcaguggcaagccgauggagaauugcgagcacacaaucagauucccauuuaaaacuauccuucugacugucccgaagaaaaugggcagcauuggaagaauugagaacaguuaaagagguuguagaagcaauaaaggcacgcuaugguggugacagagacgacagaauagaugggagauguaauuaggaagcagauccaacaggacuuggugguguguggacuggcaaagagggccagugaauucuuuccuuucucagacuuguagucuagccagacaucuguaauuggauggauugugguccaggacaauacagguuuagaacacuggagacugggcugaguuguaaacacugacacuccugcuccccagcauccguguggagaggauauauauaacuguggguaaagccagguuucuuuggcagucuccagcauggcacuggcagagccaguguugaugcugaguaugagagagcaugggaaagcagaacgucccaugugagagacaguccaaaggguuugaaaaacgcacacauaccccauguuacaggcaaaccacccggcaagacuuccgauugacucuguuuacccagacagcacuauacuuaguggaguugggguguguguuguuuguuguuaagaaacaaacgauucuauguaaaacaaaacuugcugcgaauucaauguuuaagaacagcagcaugccaaccugugggggguggggaaggagggagagagagagagagggagagagagagagaaagaaugaaugagaucacaaacacucaaaucccaccuucaacauucccaaacagugccaccaugugcccaugcuucuugagcuccauguccuagcaugucacauacaacauaaaauagcauguguguucaugucccauggggcucagaccuaaaaaaguaggguggaugaaaguugucagcuggaacuuaagauuugacgauguuucuuucccuuuaagugaccuuuguguacgugggugucuugucugcauguauuccuacggacacaccagaaaaggggcaucaggucccaagacgacaguugcaagcugccaacgugagugcugggaauugaacucaggacaccucuggaagagcugucagggcucuuaacgagccauuucuagccucuugacugauccuuuugauuggaaauaggucaaguaccucugccuuaccuuuagaaaguaaaacaucagagauucuguuauuuguucaugaaaagucagucauagggaaauggccagguugguugauuacgagaaagaccauagccacuuuccauguauugcuggaagcaaacacauggcaccuccacauggcaccugaacaguuacaagaaaagcaacacugagaagggccuuuaaaggaaccuuuaaaacauggaaguugugcacauuuugcacauggaaaagcuggcucugaggagcugaguaacuuguuacuggggcuggucaugaagacuguauuagagaacuuacugccuuugguuuuguugaacucaaauuggaccgugugaucaaauggccugaaaacuucccaugucauuuagaagacacccccagacccccuccccuuucccugaagacugaauguaaaacaguuaagggcaaaggaacuucuuggcaccuucgcagcccaccuaaguggaaagaguugggugaguauuauuccaaggacggcuuccuucuguccuguucugagguuuugucuccgugugacucuauguacccaacauuccuucccucuauugcgcaguucccugcucaccuuucaaaacaagugggcuagagagaugguggcucagcagcugagggcacugacuggaucuuucagaggacccgggggagagucccagcacucaaaauucuucaggucucaccuucauguuaaagccuugauguuuauccaaugagguuguaaggucucuccaaucuguauucacauuaaaugagcuacauaaaacaggaauugguguuccuguaucuucaguaucuggcuuuucugaauaauucaugcaucauguguauggaaaaggaagugucuuaguuaggguuuccauugcugugaagagauacuauagccaaagcaacucuuagaaagaacaacauuucauuagggcaggcuuacagguucaguccgucauuaucaagcauucaggcagacauggugcugaaggagccgagaguucuacaucuugauucaacggcagccaggagaagacugaaucucuauuccccaugcuauguggagcuugagcuuaggaaccuaaaagcucacccccacagugacaacacgcguccucuaauaaagcuacaccuccuccaauaaggccacaccuccuaauagugccacuucccaugggcaaagaauguuuaaacuaucacaggaagaauugccagaauguuuucuagacaaaggcccacaguuacaagagcccguguuucuccaaauguaaagcacuuuaugugucagucauucucaagcuuucuaaugcugagaccccuuaauucaguuccacaguuccucgugcuguggugacccccaaccauaaacucauauucuuugcuacuucauaaccguaacuuugcuaccgcuaugaaucauaauguaaauauguuuucugauggccuuaaguauccccugugaaaggguuguucaaccccuaaggagccacaaaccacuuguguaccacuuguguauaugguucugagagcagccccuccaaagccccuccuuguuacuaauuugcaaaagacauugaauugcuuguucuaguuggugagagugugucuuggcuuaauaugcauguuauuauaucgugguagaggguuuauacgggugagaucuugaguuucaggguuuauuggaaacucuucuuggaguuugauuuuaggcaacugaagcaaagacuccucuccccuccccucuauaccccuccccucccaacucuacuuuucaucagugaauuuuguucauauaaguuuccugaccaaccuccaaaacuucuuauagaauuauuuauacaaaucucucaauuuuauccccuuaaaauacuuuuaaaacuuccuugcagaaaguucuuuucccucccauuaaaaagaaaaagcccuucagacaaagcacgcgacaauaccuauauguuauagccugucaucucucucaaagcugcaaggaaaagcuguguguguuucccuuagcuuugcucuaagagacuggauguaucucaggaaaagacacccagucgugguccccgccaugcccuugcuucagugaaagacccaucuuugaaugggugugcagcagcaaggucgcuggcccucccgugacagugaccagggaggccaaggguucaucuucagagagugcugaauccugccagugacagaagucagcgcaguaauguauucaagaaagccuaaggguuuuacuucucaauaaggcuggaaaaaaaucugagcaccccacugugagcuuaucauaaugcgcuucauagagaaaguugguaauuaguccccgagugaauaaaguauugcggaggagaauugauacuucgagggaaggcaaaaugcuccugcaaucaucaaauuuuaaaggcuguaggaaggguguggggacgccucugccuguuuacguaucgucuccaacgcugaauuuguaaucacuaguguuuuguuuuguauuuuucaauuguaugaggaugaagguuauguaaauuccaaaggagugcagagugccaaaugcaagagaucaggugccauggagccaggguugggguggcuauucuggccaguaucacucuugccuucuaguugggguuugcugcugcaguccagguauuucacaacacuuuuuacuagggaaaccgaacugcaaaucucagugcuuguauauuuaaauucguugcauuugaaaaggccugaacuuguguaaaaacuaauucagagguugaugucagaauacacucaaguuuuugaacccuuccuaaagaagaaagaccauaucacaggaaaucccaaguuuccuggagggaggcguuuccaccuauauuuuggcguuaccuuucgguugcuuuuagguccuuguuagcuagucucuggaccauugguuggaaaaaaacaagguuuaucuuucagguccagagauucaagagacacgaccuuaggugcccacccccccauuguaauucccaugcugcucauggaacagcgaccaaggaagggaaacccucauugguaaaacacgaaaagcaagucucacuaucuaucuggacuacaaaaccaaaccaaggguagcaagugaacacugugaccuguaauauaauauaccuuauugccauuuuucaaaaguuaugguuauguguguguaaaauuuuccaaaaauuaguuucuaauugaaaaagaaagcacacugguucccaggaucauaaaaaggggccuuucaugauuacaguucaccagucuugugaaaauacaccaacagugaaaaagaacgguaauuaguguauuuucugaggauaccuugacuaaugugugguccucuccccagaagcuuggggucucuguggggaaauggaacuguagggaaauggacaguuuaauagauggcgggaggcgccuccgagcagggaagagugcaaugaugcggcaacugcucgccagcaagggagaaccagcuaaccuaccaugcccuccuuucucuuccccucgccugaauggacuucacuguccugguuuuuaauguagcaagauuacaugugggccaccacaccuaucagaaucuuuaccaguaguaucaauuuagaagucuuugggacaauugacaguaugugcauuuuauuauccauaaugcuaaauucauugaagcagcuuaaagagauaauuuagucauggccaaaauaauuaauaugaaacuuucccccuguauggaacacuucaaaugauuugagcuuuucaaagaauaccaguuuagagcagugucuuuggaaguuaguacaaaugauacucugagaauuauaaaugcucagucuaggaguauacaacuauuguuuuauaauuguuuuugaaacaacuuuucuaaaacacuacucauuuaucuucuacuucauccuccuuacuagucucuguggccagcuugucuuccucaugcacaucugucacugucaugugaauugauagcccauuccauauggauauauuggguuuuguuuuauuuuuugagaugggguuuccucuauguagcucuggauggcuagggcucacuccguuauagaccaggcuggccuccaacucugcauccugagugcuaagauuaaagacaugaacccccacacuuggcuucacuucauauauuuuauaguuaucuuuaaauuacuguaacaagacuuccuacugaggcagagcauauugaagguauuucugaucauuuacauuugauaauuuugaaccaagcagaacgccggaucacagacauauugguaaauguuuuuauaagucguguaaacucacuuuaaaaauauuucacauaagauggaaguauuugguuagcuacaaacugccaugugugucaagugucaggugccacaaaggguacagugacaugugacuggcugucccacucaguagauaaucacacauuuuuggaucucucucacuuugaacuaagacuuuucucucucucucacuugauguaucuacuucuuaccgauuccuuguugguuugaaucugaccagagacuuaauaauagagagaagcugcuuaguacagauaaaaacauucaaagcccccugaaaauauuucagaggcacauaucaagagaugaggcaagaggaacacaggcaggcacgcauaggcuauuguaauggcaccuaaacuauuggauaugaguuacuauggcaacagucaccuuucaucuaggacauuuaaacuuucacuaauuuugcucauuugguuuacuucagaaucuuguuuauuuuugccagaaaauaaaaggaugaagguggcuuuuauuuguuuacuuucuaugcaggaauaucuauaaacacagcuguguauuuuuuuccagcagcuucuauacacacuuugaauaaaaguuauguaacggacauaaaucaacuccagaaguaaaauuccaucuuucccuugcccaucaucugaguguauuuguccgagcauuugacuuuugugacaccgcaucucuuucuuauccaauauguagaaggaccucaagggcagaugucugaaaauuggaugcucacggggaguuaggcaggaugaauugcccauguccggcuucuucauauccgugacccaggaccagggggaaaaaaaagaagagucagacuuagaaacugcauugagguuaaagggcaccaagcauccuggcuuguauucugccuaaaggacaaggcuuuccauuugauaaagaucauuagucacugagauauauauuugagcgaguuuccaguagcaagccuucaguuggcagucacuggaguguaccagaugguucauuagcauaggcuagacaagucaaaggcuuucagaaucauuuagaaaaugucaaacagaaacaagaacccugucacuuuuuauuagaauuaacuacaucacacccuggacacagauuucaccuugggucagaaaaauuaauacagaauuauaugaauuguguaauauacugguuuaagaucggucuuucucuagggacucauuugcuagcaauauauuaugaucccucuacuuuaagaauccucaagccuuuccuuuuguaagacauaagaagaguugaccuugcucaaaauccauuggugucuaauugauuugagguauaugcagaauuucaacaagacagucuugcaaagcucuuuugcgcuccuuuucccuggaagcuugguaaacgggggcuuccugaauauucaacaguauauaaaguaugcuuucuaucgagaggaaaagacagccauccaugcacugaacauugcuucaguaaauagaaauacaaaaggaaaauacagccaagugaagucuugucuuuccuuuuuccuuuuuucaaugcagaugugaagaaccuggagaaccugcagcugguggaagguguccaagagcaggugaaugccgcccugcuggacuacacgguuugcaacuacccacaacagacugagaaauucggacagcuacuucuucggcuacccgagauccgggcaaucagcaagcaggcagaagacuaccuguacuauaagcacgugaacggggaugugcccuauaauaaccuccucauugagaugcugcaugccaaaagagccuaaguccccaccccuggaagcuugcucuaggaacacagacuggaaggagaagaggaggacgaugacagaaacacaauacucugaacugcuccaagcaaugcuaauuauaaacuugguuuaaagacacugaauuuuaaaagcauaauaauuaaauaccuaauagcaaauaaaugauauaucaggguauuuguacugcaaacugugaaucaaaggcuguaugaaucaaaggauucauaugaaagacauuguaaugggguggauugaacuuacagauggagaccaauaccacagcagaauaaaaauggacagaacaauccuuguauauuuaaacuaaucugcuauuaagaaauucagaaguugaucucuguuauuaauuggauuuguccugaauuacuccguggugacgcugaacaacucaagaauacaugggcugugccuuggcagccccuccccaucccucccaccaccaccacccccacccccacaaggcccuauaccuucugaccugugagcccugaagcuauuuuaaggacuucuguucagccauacccaguaguagcuccacuaaaccaugauuucuggaugucugugucuuagaccugccaacagcuaauaagaacaauguauaaauaugucagcuugcauuuuaaauaugugcugaaguuuguuuugucguguguucguaauuaaaaagaaaacgggcaguaacccucuucuauauaagcauuaguuaauauuaagggaaaucaaacaaaucuaagccaauacucccaacaagcaaguuagaucuuacuucugcugcuguugcugaaauguggcuuuggcaugguuggguuucauaaaacuuuuuggccaagaggcuuguuaguauacauccaucuguuuagucaucaagguuuguaguucacuuaaaaaaaaauaaaccacuagacaucuuuugcugaaugucaaauagucacagucuaaguagccaaaaagucaaagcguguuaaacauugccaaaugaaggaaagggugagcugcaaaggggaugguucgagguucauuccaguugugacccgagcguccccaaaaccugggaugcaaagacagugauucugcauauggccuggaaagacaggaaagccagucuccuacaaaggggaauggaagauccuggccucuaagucauagaccaaagucugcuguagaacaaaaaaaaaaauacuggagggcagagauagcaaaccaagucuccaaacaaugcugucaguauuagcaugcggugccgugggcauggaaaccuugccuuacuuccugguccuaaaagggagcugugcagauguggaucaacauuuguugaaaauaaaguauuaauacuuuaaaagucaaauaaaauauaguguuuacauucuuuagguccugggaggaguugggggggggggacucugauaauacagauaguaaaagcaguaauuucuuuaauguuauuuuucugguuaguaauuauuuuuaacaguacuuaauuacuguaugucgugagacacuaaaaucaaaaaugggacucucauuuugucuuuauuuguuaagauuaccagcagcacaaucauuuguagaaacuguauaaaaaaaaucuccuggucccuuaauuuuuuuccacaaauguuucuggcuuuggaauaguuuauuuauauuguauaucauaguuucaacuauagacaauuacaaugcuaauuuauuguuccuuggguuccccuuuguauaaaauagagccaagacugaagaaaccaaauauauguguuuacuauagcaugucuucaaguuagugaaacauaguucagggguauagaagggucuuaaugauuaaaaccauccacuugauuacaugucucaaaacucccaca

SEQ ID NO: 401 - RNA, 1888 nt, Mus musculus
uucuucucaccccagccugcaacagggaggaagccauugacuucaucugagaggcuguacauaaacaucucugaaccuggggcuccaagguccuuugcauuguggaucagaaaggcucucucuagugacacagaagaccccauguugcuacugcuaaggccaccaagcuucuggucucccaugccccucggcuccugccacagcuguggauccgugccucuccuuuugagcuuacaggguucacagcacaugcuuugcagcugcaccacccagcuagaggcuagaggagugcagcaagcugagagcauuuccgcccacaucagaaggcagagagaaguuugcggagagcuacaaugagcccuccaccaacugcuuuacaucuucuaggccaagauuucucagucuuugccaugcaucauuggaugggagaccacauggacagagcucuguggugggagcuggccuuaaaaaaaaugcauggguuuuaggcguaagaauucuuuccuuaucuuugcuuuccagcagcucuguucaacacaucucggcuccggcucugauuccugcucucucuuaggauuuuggggcacuacacacauucugggcucagggagaaaaggcagagaaaggagagcuaguaagagcuugaggaaaggaaaggaagggaacagagaaggagggggggagagggaaaaagagagaaggagggagaagggagggagggagggagggagggagggagggagggagggagggagggagaauaggaacgugaaugaauacaucaaccaagauuuucuuaaaacaucacaauauaaaagcaaagcagggaaagaaaaugggaaacaauuauaagacaaaaaugugagaaucugggauuaagggaaaaucagaaguucuuuccuucauccacagcuacccauucucacugaaguucagggaacagccugagagguuuuccaccauccccucccacuaacgugccagugggcaugagucagccaggaucuuuauuuuugcuucugccuccuaggugacuuuuuccuuaaccugccccaccuccuacacuuggaccauaauugcugcccccauucccuuuccuguucucugucuacucacucacccacuccagcaagcaucccugaucacuuccuccuucaagcuagaacacuccagucaccaugauaguccagucacagcacccuuuaacuguuugcuuacaagucuguuuucucuucuagagcaugagaugcugucaagugugggauuucucuugccuuaguuuuugugcccugagauacuaugaccaauggcaaaaacagcccacagcccucaaagagcaaauacaggaauccuccagagggagaaaguuuuccuccacauauuguugcuaucacaaaaucugugcugcucuaagucaagaaaacagacaacucacuucuuaaaaacaaauuauuucagaacaucacuguauaaacuacauguguguguguguauacauauauguguguauauauauauauauauauauauauauauauaguaccauaauuuuucauacuucuugucuugaauuuagcauguuucauuuuuacacuaagaauuuaugugguagccagagaaaccccaaaauucaauucucagcuuuguaauuuuuaguucagaaaaaaagggggugguuggaaaaagccucuuucuuagaaauacuaaccacgccuuucauuuauggugacuggcauauguuucaacuguagaaccaaugccucuggccaagagagagaccuucugaaugguuuggaucucagcgacacauugcaucucuguaaugaccuguuguaaaaccagagaaacugaagaagaggaggaggaauaggaagaaaagaacaagaag

SEQ ID NO: 402 - RNA, 418 nt, Mus musculus
ugugguuggaagcaucuuuauuuuccuaugggcaucugucaucaucuucuuccggacacuugccauucauuuuggugaagaauacuccaauaaacuuguuauggaaucugaaaauguaguuuuuuuuuuuucaugcuaacugggaccgagacuucucucugccuaaaguacugauauggaauccuacuggcagucucuugaagcaccauguucucaguuagggguaacaauuguuccugugugacuuagagcaucacaaguuuggggaggaauggguguuucccaguuuguuuuguaaagagaacugagacugcuuuacacaccacuggcccauaaccaccccuaacuucccucacaagaaacuuuugaggaggaaggcagagggugguguuccucuuuccuuccacacccccgaaua

SEQ ID NO: 403 - RNA, 4878 nt, Mus musculus
gccccaccuccggccccgccucccaccgcgccggcgccauggccgcccaggggaucuggacgcuggcgaggguaucgcuugggaggccaccgccucgggccgaagguuuccgacagcagcucaacucaacccucgguucgacuuccgaaggagcccgcggcggcuccgcggccgacucguggggaacgcccgaaggagaaccaaggcauccagcgagccgagaguuaacugcagcggagaggcacaucgucgagcugcaccgggccgccugcgcggugaggcccgcuccagccugccccgcgcgcggccucugcgccugcgcgcgcccggccacccgaccccgaggcggcccggccgggagguguuggaccuccggccuggggcgggucggccuggggcguccgcucagaggguccugcgagaaacccggucgcacuuuugcguuccggacagagaggugucugcccugagaugggaggcucgcgaggcucgguuuuugaucugcgucccagcuaaaggcuugucucgguuugugugugugcgcgcccuccagcgugugaguguguugugugggggaaaugggugcugaggaacugaggguaggacugagcucuuacagggaacguauguaguacagacauguugccugugcgugauaacucgagcagccugccauccagugacuuuaguaaugcaaacauaagacagacgcuuuacauuuuugccccguguccucucauccuuugccuccaguccaagugagcgaaagaaauuauaaucaggcaaguuugcauuuuuccuuaggcauucuuaaaucaccuuuucuucugguuuauggauuugacaauugcuugucaccaccaauaucuaaccuuaucucccuucaguuuccugacacuuuagaauacaauaguuugaagauagcauuauuuauauuuuaaguuuuauaaugauguaagagugacuuguaauaaaucuguguauuaagcucuguguuuggcuaguacuugauaagaccacuuauuugguuuggcuugagacacaggcagaggcaaaccuugaacguuuccuaaaguugacacucagccuugggaguaguaugucccaaaaauccacugucuaaccccuucauguguugcaagugaauaaagauuuaucgaaaaauuauugacagccuuugaccguucuugcuugugcucuuauuuuaaguauaacaaacacaugcaguuuguuuccacaagucaccauacaaauaugguuuguaaaacccagaagucuuaucauuuuucaaggcaaacaacaguggccuguauagauugguucgaucaacauagcaaaaggaaggcaaguauuugcaccggggaacccacaaccuuuucaucagugggguuucacaggucaugugacuguccaggagaccagaagcaaacccaaaaacaugcuugguauauauagcucccaaaugacaguauuuuuccaugccucaagggagauagcgccuuaucgugcucccauuccugcacuggcuaucuugcuuuccauagacaucuugcucuccagucaaagcgucagcaaacuugccucaucuucguugccaucuuuauccaaggcucauuuagugagaagaaauuguguguaggcagucagcaaacuuagagguacgccauccacauguagagcaaccugcuaagcuuccggaucgccagauaauugucuccagaaaacauccagaagcuaagcgaagacuauaaaggcuuugcaguguuucguuuauuugccuuccaggucgucaagcaugagcuuugugggaggagaaagagaaaaaaggaaaugagguucugacagugggucauucuaaaguaguguugggugcaucuggugccacauggccuugggauuugagagcagcauugggacuugcuaguuucuuaacugcccugaucuauuugugcagcaaugccugagagugaacccagacuugaacuaaaauauaaguugaccugaaugucaaccauaaugagugacaucauuaaguauaacgcuggauagcugaaguucuugaugaccaaauggaaacuguuugccagaggccgcaaaacugguacaugccuugcaucccaacacuaaagcagacagguugguugugagcuugaggccagccugaucuacaaaucugugggccaggcaaggucauauaguuagagcaucagcgagagaaagagcaagggagagagagggggauaugcaugucagaagaccugcugccuucaugcauauuuuaaugaaagucuauaggcaggagugauacacugaguuucuaauggucaaagugcuauauaaaaacccacugggaaguuccccuauaaaaucuggaggcuaagaaacaucauuaaugugauauacguccgagggaggaguuacaauuugccuuucccugcacacacugugcuuugggggauuuauuuuuuuaaaucauaauugcauauaagugggaaaugcaucccugaaguuugaagugguauccuggaaguugcuguugaucaagcuuauuaagccagugaguguuaauguggcaaaacaauaccuucucagucaagacuagaucuaccaaaacuggcgagggagaggacaagaaaaccguggaccuugcagggcaguaacacaucgggaaggucuagaaaauauucaauaacagcaaaggcaaugcuucucugugaggccuguuuggcuuugauuagcaccuuuucugugaguuuaaaucauuauccacauauuguaagcacugaaauuguaacugccgcuucugagugcaguucauuuccagccucuuaagcucuuaaagucaucuaaaucaccuguuauuaagcucguuaccuagaagcagaaugaaaaauaucagagcagcagccacauaguugucgcauacagaggaguucuuguuuuuccacccacuucucauuuuacucaaaacuguaugcuuuucccuuuaaucacauacaguuagcuuauauauaacguagaaaugcacgugcucuuuaauugcaaaugccacuacaauuacuggaaaagaaauuuaauacuguccuuuuaaaaaaaauuuacaaucauuuuggacuaaaaauauuacuagggagauaugaugaacauuaacaaagauugauguauuguuuuauuacucuucaggcuggccagcuaagcuauauggacccagcuaccggcuaugugguucucacaaggcuggcccacuugcagagaggcgccugcuguggcucugccugcagacacgugaguaacaauucucgaauuacccuggcaguuugcugagcuucuguaacuucauaaauaccuauuauuugaacaacaagucaaauaaaaaagcuaaauagaccuagagugugcuuuucacaagcuguuuuagcaaaggacaaugaagcuguuaguaccaacacaggaccuuuaaaguuaauggaauuuuguaacauuucacugcaagcaucggcuccuccaaaugcuaagacuugaaauucaggggagcucuuuauauaucgaggaaagcuuucacgaagccugaaaggcaggcacagagggcaggaaaagaaaccaaaugaaaaaaaaaaaagaaaagaaaagaaaaagaaaaaagaaaacuguugcagaccagcuccuaaaaauacugcuaccuuaagaagcagaaauguucccaguauugaaggcggaucuugaaaugauaagacuucuuccuucccuuccauucccucccacucccugcuucacauucuuucccuuagcauacagaucugagugcuggcccucaccuugcuauaguucauaguuuuucucugucucugucucucucuccaugccugucccuaucuaugucucucugucucugucucucucuccaugccugucccuaucucucucucugccugucucuaucuccuguccuucccuucuccccuucacacuucagucuccgcuuucuucuggucuguguuuaaacuguguuuaaaguaaucaugggcuagauuacuccgaaguuagugcuauaggucugaauaugcuuauuucaagagucucaugccuaugcuuaguaaucaaagcuaaugaaccauuccuuccucuuuucugugcaaagaagaaaucagaguuuguuugcuuccuacuggaagaaguaucccugagguacauuguuguuauguuaagauuauaaccagauagcaucuguuugcagaacauuuucuauguuuuccuaaaagaagauguuauuccuuguacuaguccacuuucuaauuaaagaccagacaguaaaugcucuuaagaacuguggacaguguucugaaagucagccuucacuuuugugcagucuccuggcuaugccaggaacgguuucuaaucaaagucauaagagcaucaugucaaucucacacccguggauuuuguaagaauugggguuugguaauaaaauucuagagccugcaaagauacacuuaggaagugguuccuggauccuaauuagggcugcuuaaccaaaguuccauuguacucuuuaguccccaagacuuauagauccagugauuuaaaacauugcuaaccacacuuuuuuccccaccaugagaaauguacuuuccuacaaugacuguuaaauaauuacauaauaauuuguuauccaucuuuuucaguguccauauggccaagucaaugugaaagauccaucuaagaagaagcaauucaacuccuauuuuuauguuugacaacaacuucaucucuagucugucaaauuaaguguguguuuuugaaaauaaagcccuaaucuagaaugaccuguuacgaauauuugaacagaguuaauauuaaauacauauauccaaaagaagg

SEQ ID NO: 404 - RNA, 215527 nt, Mus musculus
caggagugaggcggaagucagagcauccacucgagcucccaauuugcaaugaaugggagucgugaugugggaaccccggggcagaagugcuuucccaggccggggaucgcaggagccggugcccaggacagcaggagggcagguccugcccggagcccgcgcggccaggugcagccgccgggcgcguccccgugcgcccccucccccucccgccgacuuccugguucgcggaagguggcgaagccgccgccggccgggucgcgggaaccgagaggcgggggcaggggcaggggcgggggcggcgucgccgcggugcuguccccgcgaggccgcggagggcgccgugggccagccgccgcucggagcagcgcgucccggacggcgugcgggcgugcgggcgcggggcgacggcagccccgcagcgacaugugaccauggaccgcaggaccaggugagcggcggcggggccaggccuccgcggccccgggugcggccugcccgguacggcccgcugcgcggaggucggcgcuaggccgcaaagccugcccggccggcgaccggucuuccccgggccgggucggccgugcgccgcggcgggcgggcgggcgggcggacgggcgggcggcucugcgagcggugguuagggaaccgcucccccggcguuaggaucgccgugguucccuuuagggugauuuuucaggguggccaggguugcuuucugaugcuuucccuucguuuaaaaugaaagcgguguuuguuugugcagccgcugagugugugugcugcuugcagagugguauaugcacuaagguggcucuucaccauuggccauuuuacuuguagggaguagguaaaaagcaauuugaauaacgguggcggcucugcuuggaggugucuuagagauggguauuugcagcuuuuucucuggaaacuuuacuuugggaagaaaucucgucuucuuugaccgcccccuccucuuccguucuaccucacuguguguuagagccacagugaaaggcccuguagauugcagagaaguauuaccgagucaggauuuauuuaccuaagacaaauucuaaauaucuuaugaagauagaaauguuacacauuuuagaauauuuccuuuaauauuugacaccauagaggacagggugauuaaaaaaaaacacacaacuuacucuuuggacaauuuauuguacuaugagggaauuaaaaaaaaagauagcuggagcccgguuuaugcucaugaaacaaguuaauagcgggugggaugaggaaguggagaaguggauauuuauaaauuaauuuguauggguugucuuucccuccaguucuaaagaaugucauguuauauauauauauauauauauauauauauauauauauauauauauauauauauauuuaaaaucaauguuuguuuagaagugagagauagcauuaauaucuuaaagaaauuauguauuaaacaagccaauguacaaaggcacuagucuuaacaggguaauugaaauauacaccaucacuuuugugcauugugaugucuuuuccuuuaacaguccccugccucucccucccauuauggucaaacccaaggcuucaagcacucuagggcagauacugugcacuggugagcuacauccccagacuuaaucuuauaccuucugauggaaagaaacucuacaauaccaaauuuuuguuugcuuugaguaucucacuauauuucagucugccuuuugaaauguaccaaauaaaugggcuaagcauguaguauaagaaauuaggaagaaaaaaaaaaaaaaaaaacaaacccaaacuaguacuugugaaggaacugaaacaaacuuucuguucuguguguguguguguguguguguguggggggggggauuuaaugaggaggccaauguccaaauuccuuaaaaauaguugauauuaagaaaauaauuuuuguuagguuuuguuaccuuggagugugugaacagcucucuacuuugagcauguucaaguacaauaaagauuucaggaaagccuguguacaauauccuaucuauggagagcgugucugugagucuggaaucagguuuuuauccucuggagaaaacuggccagccuauguuagaucugugacagugugagaggaugcuuaaggguguacuggcuuuccauuuuugauucaggagggugaaaauacuacucuacaguguucuuucccacauugauuugcugguacucugagaugggcagggugcauuauaggugagaaagcauucugacagcugacacacuuugcccccugauccagaacuccaaagucugagcuauaacucuuaucaaacugauaaaacauuuucaugucuauuuuugcuaccaagucgggaauaucauagaguaugcugagacaggaauaagacuagauuuagaguggugguguccucgggaggcagaggcaggcaggcagaggcaggcagaucucugaguuugaggcuagcuuggucuacagagugaguucuaggacaacaaaggcaacacagagaagcccugucccaaauaacaagaaaaaaaaagucaguaaauuauagggauggaguuuucaacauggaaaggcuuugggcuuaauucuuagcaccacaaaagcccacauguauaggaauauccuuguauagaagcuuuauagauaauggcuauuuuucugugcaaaguaaauauaacaagauucucuuuauuuuagggaaaauccagaaagaacuuuugacuugguauugaaagugaagugucaugccucugaaaaugaagguauguguguuucuuuacucccaacguaaucgaguguguccagacaaguguuccuacuguguucugccggagcaugauagugucaggaaccugauagcuccaggugucuauuccacuaucucaaauugcuagugguaaaagagagcuaggccuuugcuuugggguuguagaaaucacggaugcuaucugugcagcuuggauuucaaccugcagcucaguuuuguuccccguugacaaaacugcccuuguucuuggugggaagggaugcuuuugccauuuucuuucaucuguauuugaaaagucagcaccauuaaacagaaaauaacacaaauucuccugcuaguaccaaaggcaccuucagcagucccuccugauguuucuggagugaaguguguaggcugaguagccucuuggguaggguuuauucuaguugcacagcacuuggggagguaaacauggguggcauaacuuggaagguuuucauggucagaccuauacacucuuauggaaaaacaaauauuuacuuuuuaaaguauugugacuucuguccaucuuccaucacuuuugcuauaacaucuguauguuugggaguggcguaucagucacagacaaaggggcaucucguuuuugcuuaucuugugcaugguaugucuucauggcuguguguaguacagggcucauuagcaggauacuuagccccaaauggcaaggccaguaagugugggguuuucuggaaaccaguuagccauccugaagccugggaggaaaguuucugacauucuuaguccgaagucagcaauuauauacucuuaaguaauuuggcuccgcacaccuuaaaauagaggagcccagcccaacccagcuguggugaaauaggcaugccuaauuuuagguaggaaaucacacgcauucuuggcuccagaaugcucgugugcuucauuucuggucugcuggaacuacagcucugcucagguuugcaggcuaacaagaacuccuaagguucuccucaauuagagaaaucaucuucauugcucucuaggucauuuguucccauguguucuccccaggcacagccauauccucugugcaguuugggaauguuccagcgaacacacacacuuguguauuaguuuuucaaacccuacuuaaauuuauaguguauugaugguaugaguuagccuuaaaagaacuaccaugauauuaaccucagguguguggagcaaugcucaucagauauguuauacaacaggaaagguucuuuugggaagcaucggcacuuuaucauuguguguguucuucaggucuuauaaaagcagucuuauaaaaguaugaaacugcuuccuauaacagcugguuugcgcauguguuagagaguccgagaccuucguguaauggcucugugguuuuguccuugcuuccucccuucgcuccuucugcuuuuuaugacugguuauuccaguguacagcuguuacuaacuucuuuuauugccaucucgccuuguggcugcuguaaagucagugcuuuccagggacgucuucauuuguauuuuagcaguuuauauggucuggcaaagugggacauaucauaaauggacaagguaaacaauuucagccccuccucaagcuggucaguccauucuuugugccugugauuugugaacacaguagugucuauguuccugugugugagugagugcuagcacaugcuugccauagugucuguguagaggucagaagagaauuucaaguguuggcccuuaccuucuaccuuguuugugauggggucucuguuguucccagcuccuguguauaccaccaggcuagcugcccuuggcuucuggggugggcuuggggagguugucugucuccaccuccuguuuccuccuggagcugggauuacggaugccuacuaccucacugaacuugaguuaugggaaucugaacuuaggucuuuacauacgggaggcaagcucuuuacccacugauccaucuuuguagcucagagaauugucaggacuaccuccaaucaaccccuccccaucccccaacugggacauuguuagagacugaacuuaauaccacaugcacauucuaugaaacuuggaaccaccgagcuggagcuucagcuccucauccauuguacagcagcuucuaaagacuuagaacuucuuuucuucuuuuuuucugauacuguuucucacuaucuugacuacuguaggucaggcuggccucaaacuugggaucuuuguacuuuaguuuccugaguguuaggauuggggugugccacuacaccuggcuuaaagacuuccuuuaaagcuauuuucaaccacaucaaaaacauuaccuuuuccuccuucacugaugcuuuaaaucuuauaaauauaaugaauauuuuagguucuaugaagcuauaaucuuuuauguccuaaaaagucaugguauucauaacuaagugggcucuauagacguauaacuuuaugcuagauugagagauugaugugucuauaaucucuuauuaauuaccuuuuuuauugguaaacauauaaagggaaauauguggaaauucuuugaaaaguauuagcauauuucuuuuuuaacugucaauacuugucuguuuuaucaagacacuggguuguauuuuggcuuguuuggaaguuuguuucaucauuaugauccacuuggagacuaagccauguaaauuaggcguuugacagucugcauaagagggaugccauugggugaaucauuagcucuuauuaugaaauuacaguccuaucaucugaaggguuagauaccuuguggugucuagauggcuaucagcagaccuuggaaggggagaaggagggggccguggcuuuuuuuuuuuuuuuuuuuugagacaggguuuuucuguguagcccuggcuguccuggaacucacuuuguagaccaggcuggccuugaacucagaaauccgccugccucugccucccaagugcuggguuuaaaggugugcgccaccaccgcccggcuggggccuuggcuuuuaugacucuuucuuuagagccagaaauuuucuuugcuaaaauccgucagaaacugucuuguugaaccucaguggccagaguugucauggcuaugaccauuacuuaggaggacaucauugacccuguagggauggagggcuguggucagggucauugugauuggccugcuaaguaauuugcaaggaguagauacuaggagacuagccgaaguauucuuuguaaagggucguugagagcaccacuuuguucuuuuguuggcuuauuucaucaaauagaaaaugugcccugggucaacauuuuuacucuucaugucaaaauauuugauauucucauucauuuuuucaucauauauauggucaaauauaaaauuaaaaaauaaauuuuauuucucuuuaugugaauguaugugugcacaaauuggugccuauagaagucagaagacgguugggaguccccuggagcuggaguuccaggugcuugugagccaccuggccuggaugcuacuggaacugaccuugaguccugcaagagcaacaaaugcucuuacuuaguuggggacucauuucucuaguucccagagagaagucacuaacuaacuguuuugguucauuuggauuugauugguuaguuggugaacuauagcuugacaugcugucucuucaucuagucuguugcagucugcacuuguuucaaggcauuuuauucuuauuucuggacacaacacauuuuagaauacugcaaaauaaguuaguuuuguuuugauucucuacaguuuugaagcuugcucugagagaacugauuaugggucucuguucagccucugguuaauagaguuguuucugguaaugucuucauguuggcuuuguccucuuuuuuuuaaauggagacuuuccugguaagauaaucuuccaguagcuuguauuccagagcacaguggcacgguuuauaucuuaaugcuguucuugguggcucuccaagccuuugccacccuucugcucgcccacuuucccacagaggcagccagggaaggagagagagcagagacagccugcuggaguucuaauaacaaaacuuaugcuccucugcugacagcacuuucuccaaagagacggacauuucacagaaaugaaaacuaacgcuuccuuagucagagaugccuucucuaaggcuuuccuuuuuggcuucaggauucugcucucucuguguugugcccuuccauccccguugcuaacuguaagaaguagcagcagcggcagcagcuaauauuuauggaguguuuacuugaagccaagcacaagucuguagaaaaaaaauguacgagguucuuuuguuuguuuguuuguuuuuguuuguuuuuucgagacaggguuucucuguauagcccuuacuguccuggaacucacuuuguagaccaggcuggccuugaacucagaaauccgccugccucugccucccgagugcugggauuaaaggugugugccaccacaccagguagacgagguucuuaagucuuacagaaaucuuaugguauaggaaguguuacucucuugaagaaauuaaaagccuagggaaaugaagaaauuugucuauaguacuguccccaugcucugaguuuaaucacugucccagugcucuggccuguuuuuauaucgugagggcacaaaguauuaaugauaugugcuacaggucauuuaaaacucgaauccuauguguuuucugaaauuaauaaauuaauuauaauuccucuuaaagcaauuaccacacuuuuccugguacaauucucuuuauagacugagaagauuggauucccccucuucauuuaugacuuaugucuucaaauuaaaugcuuuugaucuaacacuucuaguuauuagcaguuucaaacauauccuuaguaaacuuuguuuccuuuauuucuguauuauuuggauuauuucucugaggaucaagucccuuugcuacaggguuuuuuuuuuuuuaucuuauuuuacuuugaugagaucauccaacuugguauugaauuaucuacuucuuaaaucuccaacucauguuaauaguuugacagcauucauuuucuuaaaucagaaucuuaaguugaauaauuuuuaguuuccccuguaccauguagaaaaaagcauuuauuagccugcauuucacuauuuuuucucgauagugugaugauauaguuugcugcauauuagcauuuugggacucacuguguucauaaagaguuuaauagagucaugcguagcuauagagguagcuugauuaagugucuguuuaccuucuaguaaauuuuccaugagccacauuauuuauuuuccuaagagaaagcucaccacagacucugccauccugagugaauacaggaugaaaaaguguaucaauuggauguaggcuagugcuggccaucggaccacaugcugagacaguuaauucagagaccuacuugcagaaguuauuuuaaacaacaacugugcuuguagagcaauuuuaaacacaaacuggguauggcaguacaggagcacuagugaaugaagaaagaaagaaagaaaugcaaaggaaacaaaaauggcugcucuuggguuucggcaccaaaugaaaaaaagaauuaaaaaaggaaaggaacuauggcuauuccuaggugugguggaggaguaaguuuauuguagguaugugcgagaacauagagugcaguuagaguggaagaguccagggcaugucugaccagacugagcugagccacaugaggagagaggggagcuagcccaacagccagcaggcaaccaaaaugguuguauuauauagggaaggacaguccuuucuaccuacuggaaaguucacgguaugguaggauauaucagucaggaggacccugcaaggaggacccuguaacuuuuagggacugagggaugcagagacaaucuggugucacucuccacuuuguuccagguuugaaaccuaacagaaacauauuuguauauagagugggcauugcaguaucuccugcauucucacauucuacuauauagugagaccacaucuccaaagacacacacacacacacacacacacacacacacacacacgcacacacacacaccauggagauauuuugauguacucagugcguagguuucucauaucaaguauuccugcuucccuuccucuucucacaucacaagaauccagucagcccaggaguagaagcgcuuuaggagauuugacguuccugaccagcaucagaaauucugcaagucaaauggacuuagaaucccugucuuagcauacuuggucucugugcauuaacaugugcgugcugugcaaguccuucucuauccagauguacuagggcauauuagggcaaucuguacuggaaauauuuauauacuacuauguugcucaagaaaacgaaacuacuucauuuccccguagauacuaacugggaacaaaauugacugugguucuuuagaaccauauucguggaauaugccauuuccccaguagccaguagugcagaguucuuucauguuuguguggggugaggugguaggguuucugcccagagcugcugcccguguaguguagguuaaguaccacuggguuagaugugcuccuugugacuuggggagggugcaacugaauuucguacuccaugauguggucuuaauagcugcuuuaguuguuucaugucuuuugcugccccuguagucugagguugacuccuugacuuugaauuuugaugguccucacugugauguggggccucaggacccccacuuguguucacuguccugugcaauacuugugacaauagucuguacccaggagauuucucuuguguuuucaugcuguuuccugucuuuuccugcaaauauguguguuugauuugugagucugaggcaauauuugucuacugugguauacauuuuuacacuuaaacacuuaagauucuuguguuuuaagauugaauugauguugccgggcagugguggcgcuugcuguuagucccagcacuugggaggcagaggcaggcggauuucugaguucgaggccagccuggucuacagagugaguuccaggacagcuauacagagaaacccugucucgaaaaaaacuaaaacaaacaaacaaacaaaagauugaacugauguuucaggcaaagugggacauuauuuguauaaaaauucaugauaaguugauuuauuucagauaacaauuaauuguaucuauagaagaauguguauuaguguaaugggccagucauuggcccuggauugaguuuugagaggucuuuauuuaggaggccauagcucagcaguaaguucuugacuagcaugggugaggcccuggaugacauuaaugcucaggacaguagaaugaaucggggaacuugcaguuuccuagaggggaaguugcucuguuguuuuaacaguugugagccucucucuuccuguggggcuggggcaguuaccugcuacccagggcugcgucaaucccaagcacuuuguuagaaaauuacccagcugcucccccccaacucuucaaaugacacaucaagugggugggugucacuugaaggacuuuuaugaguaaguuuacagugaggugugaacaacugauagacagcccucaagggaacauuguaaauuaaaaaaagccuuguaaacucagacuaauuaaaaagauacagucuagggcuggagauguagcucaguggugagaaccuggcuggcaugugcgaucccucgguuaaucugcaucacagccaaagcaugacaggagauaaaacggaaagcagguguggcuagccauaaaggaacagucuaguuggcucuuacuggcuuucucccagcuucauuaauguucgguaauuuuugaauuaguggcuuuaauaaguauauaaguauauuuagaauauaugugcaguaaauucauuaaauuuucuuauauguauaacuuucccaguuaauaaaauaaaguuguagcaucauaguuaaaggcccucaauuauguucuuauuugccugaguagacuucaagcuagauguuuuauagaaauagugauuaaaaacaauauuuggcauucauucauauuuggaaauauaccagguaucuauauauucaauuaucuuuacuauuauuauaggagauagagacuguucuuuucaggaagauaaauggaggcugagaaagguuaaaucauuuccccaacaugcacagcuucaggagguaggccugggauuugaaccuguuucugugcuauggagcccaagcucuuaaccauuaggcuucucguaaaucaguucuucaacaugagugagauauuucacagugauguuuauaaagccaggcauuuuuggaaaucccuaauaauuuuaaguuuggcuacaauuguuuuauuauuaauuauuauuuaauuuuaagauugcauuucuuuaucauuuagagugcauguggacaugcacgcuuguaccauggccuggguguggagaaggucagaggacaaucugcaagcacauuuacucucugagccaucucacugucccagaguuauaguaugguauuccuauaaacaaggucgagggaagaugugccuaagcaccaugugaauguuuagucuucucauuccuuccagggagcuuuuccaugugccaguuagagucaggcacagguaaaaagauggcauuguugaauggggugugucacuuucaaauuauaauaaugcaguacaggccgugguauguagcaguaacacgaaguuacccaccccgcuccacacccuguuuuuguguguguuugaggacagggaaucugugcggugacggagggugugguuaguagacauuccccagcaucacuugggugguaggugauuaucguuuuccuauuuaaacucuugggaaugauucagaggagauagacuguuuugguaugaacacauguaaugcagugguccucagccuguggagcgcaacuccuuuggaggauugagugacccuuucacaggggucccauaucagacauccugcauauccgauauuuacauuaugauucacaacagcagcaagauuacaguuaggaaguagcaacaaagcaaucuuauggcuggaguucacugcagcaugagaaacucuauuaaagggucacgguauuaagaaggcugagaaccacugagcuaaagagaaaauccaagaacuccuccggcuaguguagugcaaccugucuuggcugggcauuacuggcucuuccaggcuccucaguguguacagugaguuuagcacugggaaagcaccugucgagcugucucaggagucuuaguauuugaguguauuuuuuuguagcagugccgggguugagcucuacacugagccacauccccagccucugggcuggacaggcauugcucuccucagcuggcauugaggauuuacuagagguugcucaucaaacuugcuuucuuuauaaacacguaguuuggaaaaugaaguuaacagaauuucaaaacaacaccaacaaggugaagaguaauuuaggccacugacauccugaguguuguccacuagauuuucagcuguugaagucaagugcuggccucacuugagaccuugggaaguuguauaugaaugaaugguguucagaauuacuuggcaaaagugaaauuagaauaagauuuguacuccucaagucuaguggggauuuugaaaucuuuuagaaaaugucaauguaaaagacugaaggguugcagaucuugaucaucacaucaaaugggugcuccauuuaagacauuuuaaaguaggacugugauaaaccacagacugugacuugguaggcagaaaugauaaagaucagacaaggcccuuccucuuucaguuccuucuuauuugccacucgaaccuguaaaaaaaaaaagcauauagcuaucaggauaguauauucagugguuaucugucauguguaaguuuccagaaauuagucauuucagaaguagauauuucugggguugguagaagaaaugcaguccuauaaggguguguuuggucaucacauuuauaauuaauuaccaucaagcaggcuuaauacuuuguuucccgagcagcugugaaauauagccaacuacuauuuauuuaugugccuucuaggccuuaacauuagcuagauuuagacuccaccuauucagguguguuugugcuugcaaagauuuauuauuucuaauuauguguaugugugugccuguguauggaugugugcacaggaaugcaggugccugagggggcaccucagggugguguuggacuugaacucuaguccuaggcaauaguguucaaccauugagcaaucuguccauccauauagguguguuuaaugcuuaggaacaagacauaucuuuagggucuguguauuguguuguuccugagauaguaugcauaaaaaugcuuuagaagggaauuagaaauaguuccuguuagagucuaaguauuucaggucccaguuauggagcaggaaauuguaaauauuuugggauugcuuuuaaagaucuugaauaacuuaauuuuuuccuauaagucaaauaguauuucuguaauaguuguaaagcaacuaaugaacuuaauuuauuuggauuaauaaacuguuaucacauuuacuaucuaucuaucugucuaucuaucuaucuaucuaccuuacacacacacacacacacacacacacacacacacacacacacauuuuauuaccacagaggacguaaacacuaaguuuuggugcuuauuguuuugcugacacacguggcuucaugaugaauaccugcagugcaaucuugacaguaaggggcagcauuuuuaucaagauuguauguuuacugugaaaaaaucuagauguguuaauaaagaaauguaggcuggaaauugauaggaaaaauuauaacaugcuaauguuuaauggcaauuauaguauuuguagugacaucgaaugcuuauccuaauaauaguaauguugacaugcauuacuuguuuugacacaggauucaaauauguaaauauuugucugauuucagacucacaguuaaagacauaguuagauccauaguauucugcguacaguguaucauuuugcuggguauggccggugaggcaggugugccuguccuaacccuuugcuguugccgugccuuugauaaugaaugcacuacugacuaggagcauguuauuggccaaguccuuugacuugaauugcuuucauuuuuauauuuguaagaccuuugcaugccauauucaguuuuuaugagacccaagaacauaguuguggagaagaguuuuguaaauugugcugcugaacguucuagaagcagaaguguuuauuugguuccuaagcucuguggugguuaucuguguuaagauucuaaucgcuugaauaagaacugucaaccuggaagaaggggcagcuucauggaagucagcgacuggcuucuuccaccucuccuauuuaguguuguggaagcauuaggggcagacugaagacucugagcuauucugagcucagaaauuaguuuuguacuacaagagaaauuuggcagagaagucugcaucaccauagugauagcaccaguuaaacuuguguguguuucaggugagacaaggaagacauuagcuguggcucugcccuuccucccuucuccuucccuucugugcccuccucuccucucuugcccccucccucauauucuagcacuggggauaugauccuuggccuugcgaugcuagggacaugccuugccacugcuguaccuccacccggacauaccuuucuuguucaucccccgccccaaauguucacagaugcaaauccuaguaagaugggaguaccuuauguuuguaaguugucaaacuucuaagagucaauguugagaagcucacaaguuguuaugagucuguugagagugaagacauuacacaaguaaaggagaguaucaauugagggaucugagguaaucagcuaaguucuauaaaaaucaauccuaacaagagguuaugaaauuuugggaaggacuguuuugcauuucagaguuuuucaaaauuuggaauauuuuuggguauauguauguguguguguauguguaaauuuuaccuauauauaaaauaauugaguaucauuuuagauuuuaaauauauacauauaauacauauauacacacauacauacauauaauaugcauauucauacauucaugugccauaucugggaaaggaaccaaaauuuaaaauaagauuuaauuuauuuauagcugaaguuaauuuauaauacauuauauauauacauauauaauuuuuuuagauuuauuuauuuauuauauguagcugucuucagacacuccagaagagucaguucuuguuacagaugguugugagcuaccacgugguugcugggauuuuuacuccggaccuucagaagagcagucgggugcucuuacccacugagccaucucaccagccccauauauaaauuauugaagguauauauacauauauaugucugugcacacacacacacacacaaacacacagagcuuguuuauaccuuuugguguuuugagacaaugucucaguccugaauuggcauggaacucacuauuuaaaucaccucugguaauccuucugucuugguacccaagcgcuggguuagcgcucgaggaggucagauguggacguugccaccugcgaugccgugcugaugcuuguggugucagaguuugaggguguguucagaguuuuggauuaggaaugucagucuggacugcaguuuauaauuagaaagguaguaaaugcaagccuaucuacuaaugacaucacgucgacaucuggauuuguuuauaacuuucuuucuuuuuuuuuucuuuuuguguuuauagcauuuuuauucauaauagccagaaacuggaaacaacauugcuugaauaaagauuggauaaagaaaauaugguacauuuacacaauggaauauagcugucuuugccuacuguggggagcggguguggcggcagucccaaaggcgccagagacugcagcuaagucauaugacuugcaccugacuuccucauauaagacacaaacaucuugagugcugcgcagguguaccaggauacaggugaauccaauuugguggagauuugccccugcugcccugauuagcugaagccucgugacuggcgagggggcauggccugcugugcguggaugggaacugagaguauaaaaggagugagaggcccaggguucgggggagauauauaaacaagggagauauaaaaacaagggagauauaaaaacaagggagauauaaaaacaagggagauauaaaaacaagggagauauaaaaacaagggagagauauaaacaagggagauauaaacaagggaaauauagagaaagaagaaacaggacugaauaaacgugugcagaaggauccuguagcagcgucguucuuccuggccaguugagcacgcaacaaguggugccgaaacucacgggggcuggugagauggcucaguggguaagagcacccgacugcucuuccgaagguccgaaguucaaaucccagcaaccacaugguggcucacaaccacccguaaugagaucugaugcccucuucuggagugucugaagacagcuacaguguacuuacauauaauaaauaaauaaaaaaaaaaaaaaaaaaaaaaagaaaaaagggggaauuguggggagcggguguggcggcagucccaaaggcgccagagacugcagcuaagucauaugacuugcaccugacuuccucauauaagacacaaacaucuugagugcugcgcagguguaccaggauacaggugaauccaauuugguggagauuugccccugcugcccugauuagcugaagcugcaugccuggugagguggcguggccugcugugcguggaugggaacugagaguauaaaaggagugagaggcccaggguucgggggagauauauaaacaagggagauauaaaaacaagggagauauaaaaacaagggagauauaaaaacaagggagauauaaacaagggagagauauaaacaagggagauauaaacaagggaaauauagagaaagaagaaacaggacugaauaaacgugugcagaaggauccuguagcagcgucguucuuccuggccaguugagcacgcaacagccuacuuucugaguucuucuuucuucacccuucuccacuuuuuucuucuaccuuuucaauccccuacuacuauauaagagagcaaaaaggauagagaggaauggaaagagauuccugaauaaagucagggguuuggaaaggaauaacaucauuagacuacuuccugcugauugguggcuucaaguuucuugaggcaaguuguuuauaacuuucuugguuaugaaauuuaauuggagucuuugaaguaagauuuuguuaaauuauugauauacaucuuuuuuauggguaauauaauaaauuucauggagcuuguauuugucaaacuuaauuugcuuaagauuuuguacauuaugucucaguuguaguguuucucaauuuuauuuauggcugccauagaaaaugccaguaguugugugguacaccugggaaauaggccugcagugacagggggucacucugcugggcaggccaggguugcaugcuccuuauggucucagucucccccguuacugacauacacuagacauuuccuuccugccuuuguggugagaaccuacuuuucccauugcuuucaucgagugaaagaguggcagaacucuacagugagaauugacuuggaagaauuugggcuagaauuauggcguaauaagcuuuuugagucuaaguauguauguauauaugcguguauguauguaugcauguauguauguaaguuugcuuguuuguauuuguuuauugguuuuuuugaggcagauguucuuuguguagccuuggcugcaccaccuaccucugcuucccaagugcugggguuaaaggagugcacuaccaccacccagugagccuuaguuuuuaaaaagucuuuaaacugagagcaauuaaagccccuuuucuuuuugucauaaagcugugauagcugugaugaguaauagaaauagcaaaucguacaugcgugcguguacaugcgcgcgggcacacacacacacgcacacuuuuuuuuuuuuuuuuuuuuuuuuugagacaggguuucucuguguagcccuagcuguccuagaacucauuuuguagaccaggcuggccucgaauucagaaauccgccugccucugccucccgagugcugggauuaaaggcgugugccaccaccaccugggacacacacacacacacacguuuuaaacaggaauuuucauuauaauuuaagcaggcacauucuuuuuaauauucccuuucugcacuguaugcguagauacauuuuuaauauauauugagguaaugacacaguauaccagugagggcuuuugauuuuaaaucuuguacaggggagaauuguaggauuuaacaaugacaauaaaaauuaagaauuauaaggaugcuuuggccuugacaucaaaaucuacaaaguagguaauuauauuaaguuugcuaaucaugauuggcaaaacauucuguuucucagucauguagcugcuuucuucgggauaauccuucauuauuuaauaaaauaacuuucuucgggauaauccuucauuauuuaauaaaauaacgugucugauaccauuggugacaaguuuucugguuuuccuagaugucuguagagcuguugugaaaccugacaacuugucacagagcugcuggccauggugaaaaugugaaucaggacauuuaagugucugccacaguuuuauaccaacuagagccugaaaguuuuauuguugagaccucacuuugccucauguuccuaggugguauagugcagugguucuugggugucaccgugaagucaucugguaagauggcuggacaauaugcuguguaucuuuuugggacacugcuucuugucuacaagugugaaagaacagcauguucuuuuucuuggagaccuguuguuauuuccuuaaguguaauucaaggaagcacagccucuguccccagaggcucugcacugcugcugguguguaggccgcucaauccugcucacuuggcuuucgguuuccguuucuccuccuuguccacuuccucuguugauuccaucuccucuuccacguucuagcuggauguaugucaucuucugccagugugcggggaggaugcauugcacuggucacuuguucuuccaccuuuaguuaacuucuguuuuaacugucguucugccacuauaggagugugucuggucuucaaugaccagcucugucuccagacauugaaagcauucuguuuaacuucuguucaaagucucuguggcacauuguuccacuggaugcuuguucaucugcugaacauacacaaaggccccccuuucgauaaccauuucaauuauacuaguacacuggcuucacugugcugcuucuguagugcuuagcugaugcuugcuccuggccacacugccguuuugcuguagugcuuagcugauguuugcuccuggccacacugccguuuugcuguagugcuuagcugaugcuugcuccuggccacacugccguuuugcuuuuugcucauccgcccuucacucucuggaguccccuucccuguucucuaauauuuucucucuuauugucagaucaucuuuuaaaaugucacaugauguuaaaggaauguguagauaacccuauguccagcgaccaaagaagugugcaauuuagugagauagaaauaaauuuagugcuuacuaaauuagauuuuuaaaaaggcaccacaugggacugcuucucucauaaagacagaauucuugagaaccaaguaauuacaacuaauaaacuaguauacucugcuuuugggugagugcacuucccuacuguuacugugcuugcugaauacugccacuucuuguuugaagauuaccgagagggugaugggaagagcugcucugaaucagccaggaaaaccauggcauuacagcuagccuuuugucuuuguguuuuacuacauagcuuuuggggucuccagauuuaaaaaaaaaaaucccuucaacuuuuuuaaugcuggauaagggaggaggaggaggagugauggaacauuuauuucccuaugacucucuuccuuucacuuuuggcacgauuuuaauaaacacucaacacugacuaaguguuacacugaagggcuauuuuauguuuaguauauguaugcuggcaacauugcaucuaguagcuacagaagaccaguucucccucuggcugugacugacagcaggaggcacccagccagcuucauucccacggucaaucugugcugugcuucacguugcuuuuauugcagcucugauauaguuauggugacucaugccgucauguauuucuuucuguuuuauuaacguuuauuagauagagcagcgaggacagagugugggucccaagggcaggauggaacacaagaagcagugcaagcaucucuugcuuggugugugcccuugcugcggcuccacuugggcaucuuguugugggcaucuugaaaaaguggucaggcagcaggcacacaguucucuccauuaaagaggcacaugagaaccuucugauugggaacucauccaggcgcuugggcucaaacauacgguucauaagugagaaaauccacaaaggugagcuuuccccuuguaaacuguggaauuuccccaggaguaacgacaacguguguuuaaguugcguagguagcuauuccuagcacuguggcgucagacuuucaggccccugcuguagcagagccauacaaguugugaauggaaguccaugauucgcuuucuccugaugcccacuccugucuuuucuucuuuagugucaccacacguguugugcuuaccagugagguagcucaagacugcauuacuccaggugauccuuaucucaucugugaaguugaaugguuagggaaauccggaccaagcuugaauuuccuguccagccauugacucugaagguagucaggagcauccccacacaugccuauuucugcucauagcugucaucagugcacuccaggagcaugcagaugaguggccagcccuaggguauuccaguaacccagaaccauagauggccuaugacaacaguuaaggcgcaggcuuucucuuauuccuggguuaugguauugucuggcugauuggcuccauggaagucccaguucugcauugcauuuauauuugugugguguucuguugugggaaauacugaaaaacugaaccggccaacucucagugggccaggucacacugcugugcuccugggggaagccuccugccgcccuaaugggauuggacaggggaaauccgacaacaguguucuaguaaauuccuuaagucaaauuuucaaaugcaauaacuaacguuaguguaacggaauuucauaucccugguguggugcuguguucucugaaggcuuuuggaugagcaugugcuaauggaugguaaugcuggccuuuuacuaauuugcccuccaacuccgaaagucagauaguuuucucuuuugauauccuguauaauaucucccccaauuuuuuaguaugcugcucauauagguauauuacuacuacuaaaauuuacaaaauaucuuuccuaauuauuuauuugauuuuuaugucagucauguaauagacauuaaaauguugaagaaacugguguauaaagaugaagugaccacacauagauaacugggaaacuuuaguucuaagauuuauucuaauuuuaacacacauaauuaaaaacgaguaaacuaugaguggccuagacgagucacuugauggacuuuaaauagaaugaacuuguucuugcugagcuagguuggccaugaauaccuuauauugcugcuguaugucuauguugaucugugaguguaaacacuucuaauuuaggcucaucauauacaauccaaaugaauaagaagauaauaggaaggaacuagaggccacuuuaaaugccguccuaugagaacaucauggcuaauaucuuguuauaucuuuauauaaaucucuggauuuauauauauaugaauauauaugugcaucgguauuucacauugucguaaauggucucaucacuaacugacaguuuaguuuagacaucuuugcaguucugauuuguauguuuugacauagugucucacuauguggcucuggcuggcuuggaacucuauguagacaacuuucacacucagaucugccuuucccugcuuccuaagugcuggaguuaaaaguguucaccaugccuaggcucccucuaguucugaaaacagauaucuauuugagauugaauugcucugagaaucccauuguuugaaccugcuauucauguaucucauugcauguggguuuuuuuuuuuguuuguuuguuuuguuuuauuuuguuuuucaaggcaggguuucucuguguagccccggauguccuggaacucacauuguagaucaggcuggccucgaacucagaaauccucugaaauccaccugccucugccucccgagugcugggauuucaaggcaggguuucucuguguagcccuggauguccuggaacucacauuguagaucaggcuggccucgaacucagaaauccucugaaauccaccugccucugccucccgagugcugggauuaaaggcgugcgccaccacgccuggcuauauugcauguguauuguuauauacuuuaaauaaauacuuagggaugucaguaacuuuuaauacauguuggcugcuuaucuccucacaaaaggucuguuccuuuauucuugugaguucuuugagaguuuuuguacagugugcuuuggucauauucauuccccuccccaaaguuuuucagauccaaguccuuucuuuuacccagcuuucugucguguuuuguuuugacacauucgguuuguguugcucaaucuuggauguguggucuucauucuugggagagugguccauuuaccagggacugcaguuucuagagaaaacugucucuccuuuuuucagcagcuagcaguucugccaucagcuucauggcuagguaggauugugugcccaaguucccuguucaucccaugcugggauuuggucuggcuugggcucguucagguuuugcacaugugccauccacugcuucaggcaucagcacuccuucagcuccuucuuuccuagggagcccguggagggcugggaagauuauauagguucccuuugugcuucccaaaugaagguugagggaugcaccgauccuggcuauguuacuagggguuccuuuacuacuguguccagucagcagggaugcgugcccuuuucugcacuucauaagcucucugugcauucaucagugcucucaaccacgugagguuucaccccuuguuuuaagaaauuggcgaaauaguuuacuuugguauauaaaaauacuucacuauuucaucaguauuaaguauuacucaagcaguuuagaucauuugauagugauaaucuuugaaauuacuuucaaacuuugaaacuuucaaaucuuugaaauuacauuguuuucuaaauguacauucauucauucaagucuaguugaguagcauauaccauaaaaucuuuaaguauaaacauuacuuuaaaaauaaauuacauuuuugugcauguguuauaugcguggaugcaugcauggcauggcauguauggagcucauaagauacccagugggaguucguuuuucuuucuagcguagagguucuggggaucagacucaggccaugaugcuuugauagcaagcaccucuaucuaccaagccaauucauugccucagaaauauuuuacuuuuuagagaagcuuagaauuuaccaggaaauaaugacugucuuauaugcugaguuugaaacuuaugggaagucagaguuuccauacauuucuugcccuacagaugcacagaguuacacagaauggcaugugaguuacuaaaagcaguggcucucuauugacauagcaucuucucacccaauguccacacagacuucauuguucauuuuucuggacauguuuaacagauuuauaaugcucucuguccaaggccauaccaugacguucucauugacacuccauugucucugcagugacagauguuuuacaucagucuggacaauuuuauaaugguccacacucucuguuaccgcaugacacacacaguaguuucucggccugacaaucuuaucuguuccugcugguuagcuuccucccaaguuugaauguaagaaaggcaggugacaaccuccaguguuguuacucaaagguugcuuuuuaaaauuuuuuuuuuauuuuuugagccuagaauucucacuggccugcaauccauguagucuacacuggcugauagcaagucccagggucccagggauccgcuuguccccuccucuccagccuugggguuacaggugugcaccugugggcucugagagucuaacuccgguccuuacgcugcauagcauggacuucagccaccaagcccccguccccagccccaaaguaacuucuguguuuguugcuuucaccgaagauuuauagaacacuaggaaggcaucagagauguuucugauaaaauugucucguuacaaugacaccuuaacuauguagagaaauucaaguuaauugaauuaaaugacuauaaccauuugacacuaaagaucuauuugcugaacaaucuuaauuaugaauucaauuuuuuaaacagauaaauaaaaaauucaaauuuuuuguauuuuucuuguauaauuuuggauaauuugcauuuauuaaggaguuuucuucacuuaauucuaaaauuagaugggacaaagcugcuaauauaauuucuuacuuuaaaauuuuuaaauauuuauucauuuuauguaugugaguacacuacauaaagucgcucucuucagacacacaccagaauaaggaaccagaucccauugcagauggcugugagccacuauguaguugcuggaaauugaacucaggaccucuggaagagcagucagugcucuuaaccgcugagccauuucucuaauucccuuauuuucaauuuuugcagucacuggaucuggaaagauccgguuugcuuccaagauugaugaucuguguaucaucccugucuuuaauaguguauccuaggugcuaaccaacuagggaucugguuuauuaaaacaguuguuuuuuuaaaauguuuacauuauuauuauuauuaaaucuuuuuuuaacaguccaguuguuaucccccuccggguccacccuccgacauuuccucauccccuuccuccuccccucucuacgagguuguccccuccucacuccaccagaccuccucccuucguggcccuuagaucuuuuguggauuagaugccucuucucucacugaggccagacccaucaguccucugcuguauaugugauauggggucuuauaucagcuauuguaugccgccugguuggugccucagugucugagagaucucggggguccagguuaguugagauugcugaucuuacgaugggguugcccuccuccucagcuucuuccauuuuucucuaauucaaccgcagggguccccagcuucuguccauugguuggguauaagugucugcacuggcucuuuuagcugcuuguugggccucucauaggacugccaugcuaggcuccugucaggaaguaaaacaguuauuuuaaucuguuuuguuguuuucugcucauuauuauuuuguuuuuauauuuauuuugacuuuaguuucuuuagggcuucuugauuuggaaaccgagaccacugaccuuaaauauucucuaauacagugguucucaccuuccuaaggcugugacccuuuaauacaguuccucauguuguggugagcucacccauaaaauguuuuuauuacuauuucauaacugauucugcuauguuacugaauuguaauguaaauauauguguuuucugguggucuuagggaacccugugaagggucuucaauacuacuaaagggguuacaacccacagguugaaaaccacuggucuaauacagacauaaaaacauaauuuuauuuuuaggcaguaguucacaucaacccauaaguuuggauauuugcuuucauaauuauauacuuauaaauaucuucuaauuucuacugugucuugcuuuuaauacaugcauuauuuagaaauguagcaaauuuccauuuuucugguauauuguuacuauugauuauaauuuuucuuuuuuuuuucuuuuaauuugagucagagcauauacucuauauacuauuaguccucaaaaauguguauucuacuuuauggcuucauaauguggcuugucuugcugaagauuaugccauaacuagaauuuauauccugcaguuguggaguuucccugguguauaaaugucagguaaaguugauuggucguauucuucaaaauuuuuuaugucuuuucugacauuuuugugucuuucaauuacuaagagaggaauguaagaauuucauaugugguuguguauuugagucucauguuucagaugcuucauuuuugcuuuaugcacuuugaaguuauuuugugagaugcacaguuccgauggucaccuccuaugcaugcuggucaagugaucgcgcugaguugcauccccggugccuuguugccuuuuguuucaggaccucuagguuggccugaacuuaacucugcagccaagucauguucgaauuuuugauucuucugucucugccuccugaguagcagguauuguaggcuaaugucccagccccggccucggccccggcuccaguaguuuauuuuaugagcuagcucuuuuaauauaugcuguuuccuuugucuuuaguaauacauucugucuucauuuaguuucauauaaauugaauuccuuucuugugauuaauguuugcaugaaauucuuuuccuauuucuguuauaaaauuauaugaacuauuuauaucugucgguuaacauauuugaguuuugcuuuuauaccuagccugacaguuacugauuauaguuaguguguaguacauuuacauuuugaugcauuauugauaugguuaggaugauaucugccauuuagucauuuguuacuaguuuaaaaaaaucgugccaguuguuuuuuuuugguggggguaggaacaaggagauuacuguggagcccauccuggacuccuuagaaacucaugaucuccugccucugcuucucaagcgcugauugacagggugugcuaccacgccagccauagguuucaguggugccucgguguacauguuagccagucccgcccugcgugaugcugugcucccacugcugcuuucagugucuccucugcauggggauuuucagagaagugacuuuuccaugcuugucugaguuugucuugucucccugggcggggcucuuugaucuguaaauuuauagaucauuguuuuucagcgauuuuccugugcaucuuuuuauacaucuauguguauugggaacauacacagcucuugcuuguuagccuaucugaugccacuccucaagccuugguggcccuuugcucacuuggagucccuuugcgcugcugcuuugguuuguguaguuccucccacucuguucaggcucucugaucuacacaguagcugccagucugcuguuagacccacggagugacuuguuugacucaaagauguuguuguuuuuaaguucuauguauucuauaugguucuuuaguuuguuuuaguccaguggcucuuuguuucuucauucuucugaucuuucuucuuuaugccaguaaagguauuuuuacuauucuauaauauuuagcuuaauuuuauauuccuuauaaugaguuggcuacuuuuaaaaaauuauuuuacuauuauuauuuaaaaaaaauauauuuuuuugagacaggguuucucuguauagcucuggcuguccuggaacucacuuuguagaccaggcuguccucagacucagaaauccgccugccucugccuccagagugcugagccuggcuuuuuuuuuuuaaagacuuaauucauuuauuuuucuugaauaaaaacccuuaugugguagccacagcuggagccuggguccucugaacagagacucugguguggguuuucacaagaugaucagugaauuccugauaaggagacuuggugaacagucuuuuuccagaggucgggggucggguagguaggucuuggagaugucaucaaaggugguuuuagcaaaguugccuucugacugaugugcagcagucagucaucuauaccggccaucaucaggagcuucuugagcacaggagcagagacaaugccagugccucugggggcagggaugagacgcaccagcacagagccacagcggccugucauguugcauggaacaguguggggcuugccagucuuguucucccaguagccucucugcacagggaugaugaaaagcuugaccaaggugauggcuccuccgauggcaguggcaaccuccuuggagcacuuaacaccaagaccaacgugaccauuguagcccccaauagcgaugaaugucuugaaccugguccgcuggccagcccgagucugcuucugcacuggcaugauuuucagaagcucauccuuuagggaugcuacauugagagaccuugucucaaacauccaaaaacaagcaagcaagcaagcaagcaaucacauucccccacuuguuaaagggcuguggagauggcuggggcuccagaacgcaucguucuuccagaggaccugagugugcuuccgaaccgcccaguuuuagcuucagugauaacucuaguucacguaccccuuugccaucuccacugggacuacgcgugcuuguggugcacauaauguuaguuacaugcacacaaaacacccauacacauaaaaaaaaagcaccuuguugaagauuauucauuaauacaucucuauaugggauuuauuuucauacugcuuuaauguuuuaacuuuagaaucuacuugaaaucacuucuuugcgucugcuuucaugaccauugucccauugauaaguauauagaagguggcaucauagucacucugugacucauuuggcuccuaucuccuugguugaguugaagugcggguuauauggaguaugagccugaacuaugcuggcuguuguagcccagggcuuggcagauacuagugcuuuggugagaggacuuggcagcaaugcuauuuuguaucagccagugguguuugaucuugacugaaagacucuagcucuacccacacaugggauaaugauuuacuuccuuuauccucuuuccuuuguaacuuugagaaaucucaggaaacagagacuuuuuguuagggagagaauagucuuuauguguaaagcuuuggcuucuuuuguugucggagcacagaggcucuuuaucuuucuguccacuggguuuauuaugcauuaaccuagacaugagcuuggcuuuccugcagcauuacagggaagggcuuuuggacaucauaaaggcgagugacaaugaccaaugcucaucuguuuaggagaugcuuuacaguguuagucugcagucugcccuguauccauugcugcuguggacagggccugugagagagcucauuucaaguucuuccugggcaugagaacuaguugcaugacuucgcagauaguauuuuuuucugccaaagcuccuuucuaaaacaaaauguacugccuguuuaaugccccuuuaguauaagcacuuuuaaguauacugugcuuucaacuacaucugaaaugaucacagcuaggauuucaucuuuuaguuauugcaucuuucuucuuguuccuucaguugcagccauacugguuuacuuguucagccugaaacauggcagacaguccacuugaagcaucuuaccuucugcccuugguagucaucaucuuguuugccuggcuuauuccuuuacagucuccaaagauccucauucucagugagagcgaauuugaccaauuuaccaagguuucacacucccuucuuagggacucuugauuaggucaggauccggcacaaguagagggcagugacuauugugaugacauuagauuaggccugaugguacacugcaucucucacauagauacauggcauugccaacauuaccuuagcacacugcuaaucugugccauuuaauaggagaaacuugagcauccgaggcuaucuguggggcagacuggaacuaaugccacauagugaggaauuacuauauuaagaaauuuuauuuaugcaucaguuucaaagagacaaagaauggagggcugggugugggcucugcauucauuaaaugaggaagcuguuuucagaaugaguaacgcagcaaaaauaugguagucacaaaaggaagggcacaaaacccgcagggccuuggauauaauucagcgaucacaucuauaaagaucacaucaauaaaauguuuguuucuuaaggguaauuucuauggcauuuauaguauuuaucacuucauaauaaaauauagugauugggcaaaccauuuugugucuuugagucucaaaaugaguagauuggauuagauauuugauguacaauuugauuaaguucaggaaacauuuuaaucugugguuuaugaauucuagagaguugguagaugaccuuacuuucauuuucuaauauauuuuauuagcaaaagucuaauaucuauugcaaagugaaugugacauaguucauguuaaagugaauguaaacugcugggcagugcuuccaguccugcuucuaacaggaagugugccuaauuacgugaaaacuaacuuaaugacuuuuauuauuauuuuuuaaaguagguuugauagugaagacugagacaaaucucagcuuggacuuuuaacuuuacauuuuuacuuucuuacuaaaagccagguuaucuuuuaaaaugcucucucuggagcuagcagaauucucugcuaacuagagaaacauugagucaggcuuauuugcgaacauguagcagggcaggaccacuccgcccuuaucacuugaagagauacaguugcuguaccgaaugagaaucaaauuugaccuaaauuugguuuguuuuauuuauuucuuuaccuauuuauuuaugaucguuuguuugagacggggucuuauauuuagccuuugcugaucuggaacuugcucuguagaccaguuuccccuggaacucacagagaucugccugucucugccuccugaauucuaggaucaaagguaugugccaccccaccuggcuaagguucuauauuuugaaguuugaaucuuguguaugcagagauaagaaacugaauuugggcuggggaggugacugccaguaacaugcuuguggugcaagccuggggaccucacuuugauuuccagaacccauauaaaaacaagugguguauaccagugucuuagggcuuuauugcugugaagagacaccaugacuaaggcaugucuuacauuuaauuggguuggcuuacaguuucagagguucaguccauuaucauuguggcaggaagcauggcagucuucaggcagacauggugcuggagaaggagcugagaauucuacuucuugaucuaaaggcagccgucaggagacuaucuuaugaggcuggaacuccugggugcacacugaguggagcuuaagccuaggagaccucaaagcucacagugacucacccccuccaacaaggccacaccuacuuuaacaaggccacaccuccuaauaguugucacucugugggccaggcauucaaacacaggagucuuugggggccaaaccuauucaaaccaccacagccuguuacuacaguauuggccaaguagagacaggagaauguugagggcuggcugaauagccauucagucugaaucagugaacuacagguuuugcugaaaaaaaaaagguagagagugauugugcauugccucagcuuguagcuucugugcgugcacacauacaagggagcugaaauuuauauuucaguuuugauaugaggaagugauguuuccauuuugaaacacugucaugguuuugcuauuaaggagagaacuaucuguguaucuugugcauuuucucauguugcuuucuggaggggaaaguccauccauccauccauccauccauccauccauccauccaucuauaugaacuugcagccuuuguucuaaaaguaccaggggcacacagugacacuagaguccaaguuaugcugguguccagagccagcuuugaagaucacauuuuuuuuuuucugguccuuucuccaccuccuguguguucgaggauaaucccuaaagcuguuuuucuaaaucagcuuucaaaacuguccauucaguuuuaaucuguguucuaaagaauaauggccaaucugcugggaauggaaauccuccaaacagaagccugagagaauguggaggcugagaagcagcugguccaucuggagggugcuacucuguauaguuaucuagggcaccaaguuucuuuccccuugauuuucucuuauuaucuaggcuuuucuucuuggcuguugagucaaagccaaggcacuaacucuaaguucaagucauaugacaggcaagaggaguacuucagggaggaaauuucuucggaggucaggcaggggcauccuucauacaucacuuuccuuguaaaggacuugguccuugacaaugcuuagccucacuuaaaaggagacuggaaaugguagcuuuuucucauuggucaagugcugaggaagaggggaagaguaccuuccuuaagcugacaggcacuuagccauucacgcugcaguagugaacuggugccuugugcgccuucaggagcucacuccagcuccaggcgucugagcaccuacauagaagcagcacgggcuacauugucaguucuuugccuaaaauucuccuucuuucuucuuucuuaauuucaaaaugcaaguugcugcauauuucagggauuuaaaaaauuacaaggaaggaagauagagaaaugcucaaugcuuaagaggacuggcugcucuuguagaagacauggguuugauugcuugcacccacauguagcacaaccaucuauaacuguagucccaggggaccugacaccuauucugaccuucacaggcacugcauaaauguacagcacagacacggcugcaggcauucccacacacacauagaaaauaaguaauaaaauauuaccagggaaagagugaugggaaguagcuaacucuucagauucgaauugagcuugccaaaaauggccaguuacacuuacaguagauaaacuaugaacuaaaauggucaguuacacuuacaguagauaaacuaugaacuaugaugaagcuguaugaaaaugccagcugucccuggcgauguguccuguggaucacugucaugcguuauggcuuaggcuuacugugcuuuaugcuuacuaugguacacugauggccaccaucaagcugguucauucucugguguccacugugaugugaagugcacugccagccucugucaugcuguugccuucucugaugucacagugaugugcacugcuggccaacaucaugcuauuagucucucuuguagaccuccuucaucucauauuucuccuuucacuacuucccuuuuaaccuuccuuuccuuuccuuuccuuuccuuuccuuuccuuuccuuuccuuuccuuuccuuuccuuuucuuuucuuuucuuuucuuucuuuuuuuccuuccccucuuccccuucuucccuuucuuccccuucuuccccuuccccuuucuuucuuucuuucuuucuuucuuucuuucuuucuuucuuucuuucuuucucucucucucucucucucucucucucucucucucucucucucuuucuuuuuuucuuuuuucuuuuuuugguuuuuugagacaggguuucucuguagcccuggcuguucuggaacucacucuguagaccaggcuggacucaaacucagaaauccuccugccucugccucccaagugcugggauuaaaggcgugcacucucuaccaccaccaccuccuccuccuccuccuccuccuccuccuccuccuccuccuccuccuccuccuuucuccuccuccuccuccuccuccuuucuccuccuucuccuuccucuuccuucuccuuccuccuccucccccuccuccuccuucuucuccuccuccuucuucuucuucaucuuagaaugagggggcuggagagauggcucaguggauaagagcacuaacugcucuuccauaagcuccgaguucaauucccagcaaccacauagugguucacaaccaucuguaauggaauucaaugcucucuucugguguguuugaagauggcuacaauguacucauauacauaaaguaaauaaauacuucuuuauuauuauuauuauuauuauuauuauuauuuaauuggguauuuauuucaauuacauuucuaaugcuaucccaaaagucccccacacgcucccccacccacuccccuacccacccacucccacuucuuggcccuggcguuccccuguacugaggcauauaaaguuugcaugaccaaugggccucucuuuccacugauggccaacuaggccaucuucugauucauaugcagcuagagacaggagcuccgggagucuggguuuggguuaguucauauuguuguuccaccuauaggauugcagaucccuucagcuccuugaguacuuucccuagcuccuccauugggggcccugugauccauccaguagcugacugugagcauccacuucuguguuugcuaggccccggcauagucucacaagagacagcuauaucugggaccuuuuagcaaaaucuugcuagugucagcguuuggaagcugauuaugggauggaucccuggauauggcaguuucuagaugguccaucuuuucgucucagcuccaaacuuugugucuguaauuccuuccauggaguacucauauccauaaaguaaauaaauaauucuuaaaaaaaaauccuagauggcuuaugucuaacaacagacuuaaaauuuaacaucaggagaugagugcacauuugauuaauguauauuauaauacauuaaucaaaucaaggccacaaacacuucuguaucauugguuauuuuguguuuggagcuuauucuaguuauucauaaaauauauaaaguuucccgucaaugguagucuccuuaccaugcugcagagcuccagaaggugucauucuaacagaguucauuauaccucauuguuaaacccuccaucuauguagcucagcccuuucuguaugaaccucuaguaaucacuaauucagaucaacauuuuccagcuuccauuuaugagagaccacauacuguauuugucuuucugucuuccuuaguucauuuaacaaaguacccugcaguuccacuuguucuuauacagaugaaaugcuagcauucucuucugugaaugaaucauauuuuuuguuauuuccauuucauuuaucuauuuaucuguugacaggcaucuaagcuggugacaucuuaucuaucaugaauaguguagcaaugaguaugguagagcauguaucuuaaacauguugauauucuuuuccuuaaaccauaguagacuuuuaaacauuguuggugugggaggaggguucgaagggauugaugucaggaucucgugugugauaaggugagauuuagucucagcccaguuuuuacucuuuucuugagaaacuuccauacuauucuucauauuggcuauacuaauuuaaucucccaccagcacuguuuaagaauucuuuuuccucaguaucuuuaccaacauuguguuuuuaaugcauaaguaggguuuuuuuguuuguuuguuuguuuguuuuaaagacaugggaucuugguugaaagagcagccaguguucucaacugcugaaccauuucuucagcccuugauucuuuuuuauaguuauuauuuauauuauucauguaucauagauuuaaccaaaugcuguuugguuucauuuaauguuuucuuuugaaauauauucaaauuuuguagauuuuuuuuccuauagugcuagacaugaaauaguucacguuuuugcccaucauugugugugcauuugguucugugcucuucaccuugaaagcuucuuuccuagguucggauuugcaugagauccugaagugaagccaugcuucuuuaagguagacauccauuguguucaagcaucgaugauuuccuagagcgcaucuaucuaagagugcaucuaucucucuuguuaauuaugaugugcauuaccaccugaaauaauuauggauaaaagguucuauuguuuggaaacucggggaaucaguuuauauaaucuucuaugcagugauuugauucuuaauaaauaauggcacucaagugcauuaucuuagacuguucuuauuauuccauaagguuucuuauauauauacauauauauauauuuaaaauuaaccuacuguguuagagaauuuugaaaccagguaaaauauuacuuaaccacauuaaaagcaucuacuuuugaacaucaccuuuaugauuguagucguuauaauuuuaaaugucauuuguugcuguggauguaguuuauaugauuauauucgaauaaguguaguucuucucauucuauagcagauauuccugaauucaucugugauuugacauggacaaauuuuuuuauugccucauaugaccugauuuguucaauguauucaguaucuuaaaauuaaaaauaauuuauaagucaguuuuguauuuauggauuacucacuauuucuuuuccaauucauaaucauaauuaauuaccuguguuuguuuuucagcauuguucaacuuuauaaaugaauauuuaugucaaaagauaacaaaauugugucuuuugacuugcauuuugauuagucucuucacugauaaauauugcaauaaaaauuggaugagaaauaucuguuguaaaaacugcacauaaaagauaauuaauuguaauuuuugaaugggucuuugguuaggcagauuuuuaaacauagaagaaggacauaaucaagccuguuuuaggaguauauacagacaagggcuauauguuugaaaauaucuugacucacccaugugggaauuagugacugaaacuguuaaggcaaugagcucaaaguuuuuuccuucucgcuauguuaaacaacagaguuuuaucguauggugaaauaacaucuucaucagguucucaacaggaugccuuaguuaauuuucagcugagugccugacaggauuuucucuuuggcugccuggguggaugagagucuagacccggagaagcuuucaggguucucaguuucauaaucgugcauguugaggagcagcagccuccucugauguggggcuccacgcccaaauaacagggacaaagacauagccuuuguucuugaaagaggagcuaauccgacugcagcacacugugaaagcccauuaugggaggggaaaagcaucucuuggaaggugaaggcuuagcaguuuaaccucugaccauaaaaucaugcagaaagcagaaaauguguuaguacagcagagagggacgagggauauucaugaaggucugugugcugagcuccuaaaagcaggucaagugggugacugugagagaucgagcacucgaauccuaauaagaaaugcagauucccaagugugguuuuugauucaauaugcucaagcaguuguuuaacuuacuuggaagauccuguacagcagagcccaguacagaugcacagaauggaagaggaaccauuuucucuuccucuuuguccagagagggcucauugcagaccuuugucauguucugauugcuuacuguuugccacuguggaccaaagccuugucaccuauuuuccucauuguuugccaugcuuugcuugcuaauaugaugguauauguucacagaaauaguaucgucauauuaugaggcuugauuuggcccgugucccuuuggcauuuauucuguuaauacaaagaucuccuagaggucagcauuguuaaacagucaaagggaagagcuuguugcaacuuuagcgugggaagaaccuggagccuucuuuugaaccuguguuaauguugugaagacuggcaauguaaagggagauuaggaaaaccuuaaauguuaaucccugacaguaugaccgauaugaacuaguuguuuaaccuucucuugcccacacugguccuccucagauaggaguuuuggcaauagauuuaggcccuagauuuggcaauaagaaaguauguaaguuauccugagaguagccguguguagguuacagguuagucagauuugacuauauucuaaaaacacguggugaaaggagauaaaguauguguagaaggggaggaagggagagaugguacuggcuguaaccagcacugaccaggaggaauaaugggagaaagggaaagggggaaggaagggggaaauauaaaguggacaaguuagguaaggauuucuauagugcagcuguaggguaaugcucugaguuuaaauucuaguccaaagcgguaacuauaaagauucacuagggaucugggucugguggcauauaccugcaguucuaguacuuaggcugagccagaaagauuacaaauucaaggcuagcuugggcuguauaaugugucccaucuuuguuuguuaggggauuaccauguaaaacaaguauaaaagcaugaugccauaugaaacaaguggcuggacauugguagguucuuggugagggaaagcguauguaugcagagaugaaaauggcaguaaccugucauuuugguuggugcauuucuucucuucaccauggcuaguauaucuuaugucauucuugcuuuguacuguauacugcaugcuaaugaugacaaacacaguuaguuacaaggcuuccuagguguuagagacuguucugagcaaugugagcucagaacaugugugcaugcuuguguaaaagucacuuuuacucuccuguaguaauuaucuuggaagcuuacugucuuucugcuaaccugggccuaguccuggaaguucuggaagcuucuccauacaguuuuguucaggcauaggauguuuucagcuucugacacuugcuguugaaauaaacucaccucuucuaguuauuucugaacucaguagcugguucaacucagcucuuuugacccccauuccucucuuaaggcugacugauucaauagggcuuuuucucaguuucuccugaauugcucuguuugacuucaaacugacucuaccaaucuguucugaucuuguggaucuuuuucauucucugccuuucucuuuuuccucacucucuaaccugucucuguacaauuaucccagcaaaacugucuucucucuuaaguagcuucccuuuccugucucuccuugugggaguugggcauauccuguuuugucaaaucuuucucuuauuugucacuuugucugccacugaauuaaacaccacuuucaaacaugaguguuuccuucuacgaaguuuugccuucauaguuggcauaguuuggcaguagagguguguacugaggcagugucuauuuuccagcucuagggauuaaacaugugugcuaagggcuaagccacagcgcaacugagaaaagguuuuuuuccccccaauauacagucucuggguucauggugugagcaaguguccugcaaugugccugucaucagugcucauccuacgucccucaaggaagcugcuguugucacuauuacuuuaugagguggaaaucaaggcagaauauuaaggaauuugagaaagacuacauguuacugcugaaguagagugugauguguccauauugagucagccuuccgaacuuagccuucugccuaccaaacugaauuaguaaggaauuaacugaagguauaauuaaacaugaccuaaaauguuaccuuucagaugauuuuucucauuuuauaacuuuauuucuuuagaacagcucgcucuaauagaagcuuguugcucccuucuguaaagggaagacuggcaaauguacauuauuguaucucaugaaguuucuuuuguuuuauuuucuuccaugauuucuaguugauguuuauuuuuauacauaccuuuguauuuuuuacaucuuguauuguauaucuugugcauacuuccgcuuuuauauauaccuuuguauaguuacuuuugcugcuccagauaacagauucuccuuguucugguucuuuuaugaauucuuuuggcuguggcuacuuugaggaaguccguggaauaaagcagaaguugguucucagaccccucaguggccaguguucugugggcuguuaauugcuuaucccauggaauuguugggugucuuaguauuguguugcucugaagggaugucaugaccauggcaacucuuauaaagaaaaacauuuaauugggacuugcucauaguuucagagguuuaaucuguuaucaucaugaugggagaaguagcuugagaguuccacauaagcaggaagacagagacacugggccugucuugagcauuugaaacccaaagcccacccuaguaacacauuuccuuuagcaaggccacaccuacuccaaggccauacuuuccaaaaccuguccauuacugccauccucuaauaacccucuuauucaaauaucugcaccuauggggaccauucuuauucaaacuaccauaugggguuauuguauaauaucaccagcauuugugaaagcuagcauguuccuuuaaagguaguaaauucuauucaauuuggagauguuuacauaaauauaaaugucuauaaaauuaaggcaucucaaaaugucauuucuauaauauguuuguggcaauuauaauuaaacaaguuguuucugacuuuaaaaaugcaaaguucaaguaaacugguuugugaccaucugcuauauauuuauuuuuuugcauuuuugagagaaaguuucaugguuuauucuaugcugaccuugaauauucuguguagcuggguuagaccugggacuugcagcaauccuccugcaucaaucuuacaaauugcugggauuauaggcauaugcaucaugccuguucauuucauuuuaaaguauaaccuuggaaucagcaagaauuacacguguucuccauauuuaguaaagaacauucaaaugaacauagagaacacacugucuugauucuaaaagccauuagaacagauuauaaaaaaaucaaguaugugauugguuccuuuuugauuaauuuauuuuuggaggaaagauuuauuuauuuuuauuuuguguuugaguauuuugucugcauguguguauguuuacuuugugcaucacugguacucaaggaggccagaggagguugucagaucgcuggaacuggaguuguagaugguuccgaguagccauguggguauugggaauucaggucuucugaaagagcagccaaagcccugcugggcagccucuccagcugcgcuuuaguccuaaagaaggcucaugguuggagagaugacucgacugcugagaccuucaucuccugcagcaaucaguucucagcacccauauugcucaccagugccugaacuccaguuccaggcgcuagcuggcacccacuucugaacuuagagggcacccuguacucaugugugcgcacacacacacagacacacagacacacagacacauggacacgcacacacacagagguacacacacaacugaaagauagugaaaaaucucaaauuauaauguuuucuuucuaauuuaauuuuucagugucguauucacauuucauaugaguagaauagauaguaccuguugcccugagaaauggcaugggcucugucuccuacuacagguuugcguuuucuguugugcuauguagauuuacuucauucacauuaaccaaacauguuggaacacuugcacaaauuaucuaaaugcauuuaaccuugaaauaacuucaaaauaucuuuucugucuguaaggaaggaauauacuguuguaguaaauuauaggauuagagagauaacuaagugguguagagcacacacuacuuuugcagaagagccagguucaguucccagcauccacaucaaggggcucacaaccaccuauaacuucaguuucaggggaucuaacauccucugaauuccugggacaacauacuuggugcguauaaauuuagacaaaugugcauguacacacacaaaauaaaucuuaaaaauuauuuucauucgaggguauaagggacuuuugggauagcauuugaauuguaaaugaagaaaauaucuaauaaaaauuguuuaaauaaaaaaacauuuucacucuguuuucuaaauucugugugcuguaccucuguuucucaaagugcaggguuuggauacugugaguuacaguuuccaguucuugcagguaacgauuauuuuuauaaagacccugaauugagagagaguaaguggaagcuuucaauuacaaaaccaaaaagguuaccuuuauguaacaaccauuagaguguaaaacaugauuuuugccucagaagguuuaguuaugagaagaugaaauauuuuaauuguauaaugcaggugcaggcaguggacauuauuacaaaggcaacaggcugcagguuaggguuugggaaggccucauggcuuaaguucagagcaaugguagaucucccacaaaugugcaaacaggaaaggguuucuagaaaggguuucacuguguuagaguguaaguuaauccuuggacugggaauaaaugcaugaaagauaaggugccugggcugaguaacuauucauaguggauaggaagguaggaaucaggaaguacagaaucuggccaccauaaauugucuuaauauauggagcuacguauuguuaaacacugacucugauagaaucaucaguggcaagguccuuaaggagcuuuuguccaugucagcaguaaggacucugaacauuuuuaaauuuguuuccuauggagagcauguguaucuuaggauuaacuucauggcagcuguugagaggagccaugugucagaaagacuugucagguaaugugaauucagcgugggaugaagagagaaaaggaggcauggagaagaaccauguuaaaaaaggacuaagugauuaggagcugauuagauauacaggguaaagaaggcaaggagguaugacaaagcuuugccugccgccucuuccauuccugcagcgagguggacggcuaagcggcucaggcagaaagagguggccagcaucuaucuggcucuccaugaagaagucugcuugugcuuggggccucucuccaugaagaagucugcguguacuuugggccucucuccaugaagaagucugcuugugcuuugggccucucuccaugaagaagucugcgugugcuuugggccucucugcaaagguuucugcuuccucugugacauggcagaguugaaggauuggaacuagaaguguuucugauugggugauuuucagauuuuuguguaucuguacagaauauuuaacguugcuaaauagaaaauuugaaagcccaaaugcuguccaauagaaagccuucugaaugugacacuggcacugucugcaugccacucugugagccauaguaucuaugagugauugaaaucugaagagcauaaaaauauuuccuuucuuuaaaacauuuuuagauuuauuuacuuauuuagauuaguauuuuuauuuuauuauuuauuuuuauuuuagauuuuauuucacguggaugaguguuuucuaguaugcauguaauuguaacaugugugucuggugccagcagaggucagaaaagggaguuguaucaccaggaaguagacuugcagauaguugugaguugguaugcggguuuugggaacugaaccuggguucucuagaauagcaagaaguguucuuaacuagagaacuagcucucuggccuugagauuauuuucuuuuuuauuuaauuuaauuaauuaauuuauuuugguuuuuucaagacaggguuucucuguguagcccuggcuguccuggaacucacucuguagaccaggcuggccucaaacucagaaauccaccugucucugccuccugagugcugggauuaaaggcgugugccaggagugccuggcaagauuauuuucuuuacaagaaaauuagggcagugauucuaauguaaacuucucauuugggggaaguaaaaagaaaaaaaaauuacagaugccuaauaauguaugcacuggagccaagggaaguacagaaaaccuuguuuggggaaguaaaccaaccaaccagaugccuaauacuguccuccccggagccgagggaucauguucuggaagugauguuccuuagguccuucccuugucaagaguugagaacacuacaucccauauaggaagugaugucugagggaaaggaagaagcuacagaaugugagguuuguuuuaaauuacugauggaaacuacucauucuccucuuugccauuuugugcagagaagcaaaggauuaaauuauuuuaagauuuaguuguacugucaugcggauuaggaggaaguaguuaggagggaggcuggaagaccuggagccaccucuggguauauagggaagauacacagccaugucugcuuuagugggacaaaauggagccugaugcacgugggcaggccuuccuugucaccagugcugugugaauaugcucaugcguucaucugacaugcucagcugccuccuaaccguggugcccuccuggagugucgucucaggguagcuucccaggccaaucccugguuccgaacaguugacugcacaauugacucuuuuaaauuauaaccccaauaaguaaggauuaugcaguaaggaaaauggauugaaaauugcucuaggacuuaauuauuaguacauauguucagacugcugguuuuucccuuucuaggaaguuaauccuggcauuauauuuauuagucaaaaugcugacuucaaggguuaaagauauaugccuauuuucaguuuaggacgguucugaauaccuucuaggaagaguuuucccaagguuauuuuauuuuaucuuuuccucauuuuaaaaaccauuuauucuauuuuaucuuuuccucauuuuaaaaaccaguuccuuuuguguuggcugauuguugcugauuguccugcccuagagagugguuggucuacccaguauuacuccaucagcgaaagcugacuuugccaugucugugagguauuaguguaaacagcuucuccauuaaggccuuuuucuuccccacaaugcgguuuugucuggugugauuuuguacauguguuguauguggugguucuuaugugaaucugcacuguugugccuggaagccccuccuuccugggacucauccauuaccucuggcucuuacagucuuucugucugcaguaaacucuuugcaacagauggagauugaaguuauuuuuuugugcaaggugauaaauauggauccaauuuuauuuuucagcauauagacacccaguuuucccaagaacauuuguuggagauuuuuuucuccaacauauauuuuggcaucuuuaucauauaaaaucgcuacaguuauggauacucaguuuggauauuuuuauuuuguuccuuuggucuaugucugcauuugugcuggugccaaauguuuuuauuacuauggcucuauggcucuguauccauccauccauccuuccuuccuuucuuucuuccucccucccucccucccuccccacccucuuccucccaggguuucucuguguagccuucacuguucugcaacucacucuguagaccagguuggccuugaauucagagaucugacugccuauuuucuauuaccuuuccauuuucuaaagucuuuuaaaauauuucuugagagggagguuuaaaguuuucauuguggaaguccuuuacauucuuggugagguuuauuccuagauucucugaggcuauugugaaugcuauguguccacuccucaguguguuguugguauauagaaaagcuauucauuugugcaaguugguucuguguucugccacauuguuaacuuuuguuugucuuuuaccaaaugcuauuccuuucaguucugaaaguguauuuuagcuacauuccuguaacuauaguuuuuguguaacacacucuuagagguuuugaguauuuauuccacuguuuuauguuuuucauuacuucucugaagaagucugcugucagaccuauaaauacaauaaguuuucuuucuuggagguuuuuagaaauagcuguaccuuaucuuuguagugucacugugaugccugucuagugucucucucgaaauccuucuuggcuuuguugugguuucucacucugaauauuugugccucaucagcuuuggggaaguuuuuaguucuucucauauuaucuccuuccuuuuccacuauacacacuccccucuuuuggucuaauccuuuagaguucuaagcagauuuauguuacucugcugguucauguuugccaacuuuauacuaacuagagccaucuuggaaggaauugccuuugccaaacuguccuguuuguguguuguggggugucuucuucaucacugaugugggagaguuggggugcaauuccuugugggcagggcuacuuccagcuguucgggggcugagcaagccugaggauacaagccaguaauggucagcaccuguccuuccagggucuuugcuucuguuccugucugcaugcuucugccucuagcuccugcucuggauuuuuuucgacacuggaccagaaccuguaugauuucauaaacuuuuucaucuccaaguggcucuuguuuaguguuuuaucauagcaacagcgaaacugacuuagaaaguuaacuuucugugcuuuauuuuucuaaaccuuuccccuuccucucccccucucuuuguucuuuguuucuuccccucccucuucuucuugucccuguguuuuuuuucucucccuucucccuuccuccuuucuugucucuuucucccuucuuuccugccgucuuuucccuuuuauccuuugggcucucucucuccuucucugcuuucaucucccaaugcuuccauaacacugcugucuuuuaugucugucucaguuaacuacaucucaugucuauuuagucugccugccugccugccugccuucaaguucauuuuuuauaauuaguaugauucugauucugaucucuucuuuauugugaaaugacuaaaaccucuguuauguauaggaguaugcucuacuucauuaccuuuguguuaaaaaugaaagcuugcuccaaaguugugcuucaaaucauaauccuugguguaauaugaacauuguuuaaauuagcuaugaauaaaugaaucuacuuuaugauagauuaaauuuauauuucagaaugauaaaguuauuucuuguaacuaguucaaagaguuaaauauacugaauauuguggauaauaguauguuuuuuaaagucauaccuuguacaaagaaucauaaacaacuaacaguaacucaaagcacugugucuuaccuuugaggaaaucaugaagaugggugaugaguccaagcugcacuauuagcugggucugucagguuugcaucacagagcaucuuuccacaaagcaagcuucucacuuuuucuucugucuucuuguaaaacuuuuguguuggcuuuuaaugauugguaucugaaaaaugucaaaacauugauucucgguugugggccccuugucauagauuaaucaagauugaacaucugugcuacagcaauucuuuccuuuuuuguuuguugauuuaaaaaaaaaaaaaaaaacaacaaaccucuccugaagggcccuugggacagauggccccucacuguugaugguucgauuaccaugaucacccacagcuucagaggagugcgaagaaaagaaauugcuuucuuugucaagguguuuucaauucaauucucacccauuagcccuguuuggcuaaguuuggaauuacucuaucaggugauugaugagggcuucaucuuaucauaauaggucuuguauaaaaggaacggaggaagcacagugauggaccugauauguuacgugcuggguuauauuuucgugagguucuuugaaguucuauuuccauuguccaguuggaguuugcuaauauauaaguaaaaagagcauucuuauuuugaguuaugaaauggauuuuauaccauucuagcaggaacauuuaguaaggcuagaauuauacuuuugugcguaugguugcaaaaccuacaggaguggguggguuauccagguggcuguuuagaaugaggccaucaacaagggaacuuugaauuggacuuuaugugauaauugcuuaugugcauuuuuaagaaggugaaaaaugagcacauuuuaagcauugcuuuagauaugucuauuaccuuguaaagugauagauaaccgugggagcgguuuuugcaacugguuauguaacacauuaaaacaggguuuucacuccucugcaauuauauauaugauuuaaacuuccgguuuuaaaugaugacuuuauuacugacauacugaaauggaguuugaguacuaugaguacuguuagccauuucuaggucucccuacauguacucaguuacuguugaguaacuuuuauugaguuacuguugagcaaacuuuuucuuagaaugaacaaguuaguauuugguuugcugaaaauaucuucucuuagacaguaauaaaauaauaaggcuugugaaugccuucuaagccauggcccugugagugagcagagagcuguguuuguggcgugcagcagagcaacagaagcagacaccugugcccucccugcugcauuagugucucgcguggagacaaaggauacacagcucuaggucuggaugcagaaaaggcugggggagggcucuccuucauccagaaaauuccaagauucugucuuagcaugaacucuuucuugaaaaugugaguuaacaaugaaaacagaggccuuggcuuuaugucacagguguucucuguggacaucuguccuccugguuauuuagauggaacuaaccaucuaaccagcauaagagaaaucaucucgagaaauacagcaaaaaguauuccucacauagcuaagaguguggcauauagaaagaucccucuugauaaucuagauaguggaaugccugcacacuuacguauacccuagggacauagggacuguugaccuaaguguauagauggacacauguaaggcuguaguccuccaugcuugcugcagaagugguacagcuacaaaugcuguguaacauuucaauuuuuuaaaaaaauuuauuuacuuuuaauuaguuauuuucuuuauuuauauuucaaauguuauccccuuuccuaguauccucucugaagacccccuauccccucccccugcucacuuuccuuaauuccacucccgcuuccuggcccuggcauuccccuauacuggggcauagaaccuucacaagaccaagggccucuccucccauucauggcugacuaggccacccucugcuacauaugcagcuagagacaugagucccaccauguguuuucuuugauuggugguuuagucccagggagcucuggggguaccgguuaguucauacuguuguuccuccuauaggguugcaaaccccuucagcuccuuggguacuuucucuagcuccuucacuggggacccugugcuccguccaguggaugacugggaacauccacuucuguauuugccagccacuggcagagccucucaggagacagcuguaucaggcuccugucagcaaaaucuuauuggcaucugcaauagugucuggguuuggugguuguuuaugggauggauccccagguggguagucucuggauagucauuccuucagucucugcuucgaacuuuguaauuccuuccauggguauuuugguccuccuuccaagaaggaucgaaauauccacacuuuggucuuccuucuucuugaguuucucguuucacugggaccuagaaauagaauuaugauguuagcauuuaucaucauauauuuauuauuuuaaaaauauccaguaauguuuuuuauggcaucaucuccuaaugcaauugcugugauugauggugguuuuccuaguucugugaagacgugcauguauaaguacauaauaaagcacacuagggguuggagagagagcucugagacuaagagcacuugcuucacaaacagaaguguuggaguucggauuuuagcacccauauaacaagcugggcauccugcaggcaccagcaacuccagcacuggauucuguguguauauauacacauaaauaacucuucaaaaaauacagaggauucugaauuacugacauagcuuagaguauuuauagcuaguauauauuaaauuccucaaugcuaauucuuguaagauggauguagucuaguauuaguucuucaggugugauucuuguagaaugagcaggauaagggccacauggagcuuguuagacccacguaugcuggauuagaaguucuguggauaagagccaacauucugggcuuuuagugagaacuuuccugguauuuuuguugcacacuguuguuaagagaacugcuugccagauccuuaagaaguuaauaaaguuuuguauuagugauauguuuuacaguauauauuucaauugucuuuguauuuguacacauuuauugggcagcucugacaucucaauagauguauuuaauguguuaugcuaagaccuugguaauuggcaugccuaucaccugucauguguuaacuuuuaaaauaacuuguacaaacaucugacuauauguuuuauugggauugaguguacucuaauuugaauuaucagaaacgaauuucuuuuuuuaaaaauauugcuugugaucuuaaaauguguaauguucuauaacucauaaugcuuuuuuucggaguggguaugugaaucccagcuuucuuugcauuacuaaauugucagagugagugauaucuuuccaccaguucuguaaagauaugcuuugcuguggugcaugcuggggaaacugcaaagcauugauuguucugaucuugggagcuucaacuggucccacauaacuguguagaaugcuuuccuaaacccuuuauauaacccaggguggauauaaagucacaauaauuauuaguuugaaacacuuuggcagauaugacagaaauuaaaauuuuuacuuuggucaucuaaguauaugcuuuuaaauaugcuuacacaacagcacuuguacaagaagggcauuugugugauacuuaggucagcagaugaggcuguucuucacuuuagcccagagucggggaagguagguugauuuuguggauuucagcauggucucugguggugacagaaucauccugaugcagugcggggagagucagcacucccagggccauagcuuguuauuucacuugugcuuccauuuuuuaucuugcuucucagccaugcugucuccaaacagucauacggcugaaaacacaucuuuuaaaaugcacuuguauauuuugguaaauacauagcauugauggauuuuacugaaaaaguuuacuuuuuauuugaaguuagaaugugauaacuaauucauagucauagcuacucacauauuuaagcucucuuuacaucaguuauggcugacaaacuugacuguugauuggaucuaccagauagcucucccacuuggcuauugaucaugaugggaaaucccacuuuguuggucuccgaugccagauuaaacuguuaccuaaacugaacacuuagcaugaacaaccaguuugcuucagagagcuuccuauagcaugaagguguggggaggaaccagcaucucuauacaauccaccacaccaguuccucaaacuuacucagaauugcacaaccuacauccucguccuauaagagcagaaaacacucuugcuucuauucgagcucuaggcuguugugcugcuuaggauuccacucuccuuuugucuuuugaagggucuugugucccuucuuugcuggcuuuccacuaagucauuguuucuugccaguaugcacaaauacuuauuguuaucaaagaaagggaagucuagcugaaucuucuaccucugccuucgccauguacagccuugcuuaguucauuuguuuggacacaagccucuugcccagugcuuaucccacagcuucucugucugccucucucccuggcccuacuguucuuccuauggcuuuaugucuguaacuguggcugucauucugcucccaucaccucgcuguggcuugcagcacuugggaauuuuauuuucuuuuaaauuuauuuauuuauuuauuuauuuauuuaugucucaaauguugacccccuuuccaguccccuguuguagaguuccucccccaucucuccuccccuuugccucucagaggguccccuccccccaguauuaucagaacccugguguaccaagucucugugggauuaggcucauccucucccacugaggucagacaaggcagcccucugcugcauauguuuugggggccuuggaccagccaauguaugcucuuugauugguggcucagucacugggagcucccagggguccauguucuuugacacuguuggucuuccuaugggguugcuauccucuuccauuccuucaguucuuugccuaacucuuccauagggguccccaccuccauccaauguuuguccguggguaucugcaucugucucagucagcugcugggcaaaggcucucagaggcuaggcuccugccugcaagcacagcauagcaucauugauagugugagggauuaagcagcagcacugaccacuucucugugcgcugaagaagggacacuggugaguguucccacccacagcuccgugaggggcccaaccaaaacacagggcacuaaagacacuauguguuggguguauauaaaacaaaggaccuucaugucuagcucaaaucuccaggacauuuuguuuuggauaaguacaccuuccaaaucugcaaagcuucacuguuccagcuucacuguucuuugucaguguuuucaauaaacuguucuuacuaaacaaaacaaaacaaaacgagugugagggauugaugccugcugaugggauggucucaaaauaggguggucacugguugaccauuccuucagucuuugcuccaucucugucucugcauuucuuuuagacaggaccaauuuugggaccaauuuugaagguggguugguguccccaucccugucuggcuacugcggguggucuucaaacuggaaaagaaauuaaaguaucacuauuucagaugauaugguaguauauauaagugauggaaaaguuauaccagagaacuccuagagcugauaaacaccuucagcaaaguggcuagacacaaaauuaacucaaauuaaucaguaaccuuucuuuauauaagugauaaauggcuugagauacaaguuagggaaacaguacccuucacaguauccacaaauaacauaaacuaccuagguguaacuccgaucaagcaagugaaagaccaauaugagaacuucaagucccugaagaaagaaauuuuggaagaucucagaagauggaaagaucuuucuuguucuuguauuggcaggguuagcauagugaaaauggccaccuuaccaaaaacaaucgauagauucaacacagucuccaucaaacucccaacaccguucuucacagaucuuaaaagaacaauuuucaaauucauauagaaaagcauaaaacccagaauagcccuagcugucuuuucuucuuugguugcugccacuucucugacuaauccagccccccccccuucauuuucucucccugcuacauucuauucuuuuucaaauuuuuauuuuauuuacauuccacaaguugccccuuccuaaucacaccucccugaguucaucaucccauccccccuaccccucccuccucugagagggugcucccccacccagccagcaucccucuucucugguggggggugggggcagugggggugggggcagugggagacugggguggugguggugguggugguggugguggugguggugguguugaguuucuacaggauuaagugcuuccuuucccacugaggccagauaaggcaguccucuucuaccuaugugcccucuccuaggacuaugcuccuugguuaguggcugagucucugggagcucccagggguccggguuaguuaacuguguuguuguuccuaugggguuuugaucucucucagcuccuucaguccuucuccuaacucuuccauagggguuccugaccucaauauaauggcugacuguaauuaucugcaucugucucagucagcugcuuguagagccucucagaggacagccaugccagucucuugucugcaagcauaacauagcaucaguaauagugucugggguuugguguucacacaugggauagagcucaagaugggccagucacuugguggccuuuccuucagucucugcuccauuuuuggcccugcauuuccuuuagacaggaacaauucugggucaaaaauuuugaagauaagggguugguuccaugacucaacugggggccaugucuaucuaccggagguagucuguucagguuccauuucccuacuguugggcauuuuggcugaugucauuuccauugaguccugguagccucacccgucccggcucucugagauuuucuagagguuccuccuggcccccaauucacucuccuugcccugagggcuucucucuugucucccgccuccaagacccaauccuguucccauuuucccuccucuuccccucucccacccagcacccagguuccuccuucccaguuccucccaugauaguuuuguuuucccuucuaaguggguuugaguuauccacacuugggccuuccuucuuguuaagcuuccuacggucugugaguuguaucaugggucuuccgaacguuuuggcuaauauccacuuaucagugaguacaugccaugcauguccuguuggaucugaguuaccucacucaggaugauauuuucuaguuccauccauuugccugcaaaacucaggaugucuuuguuuuuaacaaggacauaugcucugcuauguucauuauguucuugauaugguaaauuuugcuuacuuuuacagaugauacuugguuuuguuuuauucuuccagucaucauauauacuguuucuccagucuauaauauucucugcugcccagauuauccauuggugaagauuagauucauggagcuaauauaaugucacuuugcaggaccucuuuccuaguuagagguaauauucuuauguaacaucaugaaauuccaugaccaaaaucaaguuggggaagaaaaggauuauuuggcuuacauuuccacguugugguccaucaucgagggaaauggggcaggaaccuggaggcaggagcugaugccgaggccacggaaggaugcugcuugcugauuugcuucccuuguguuacucagccuacuuuuuaaaaacagaacccaggacuauuaauccagggauggcaccacccacagugggcuggagaaaaaccucccucaccaaucacuaauuaugaaaaugucuguagcuugucuacagccggaucuucagaggcguuuucuuaacugagguuucucucagaugacuccagccugugucaugcugaggucaacuugcccacaaagccugccauucagagacucucugaauugcuuacauuuccucauggcuacuuuauuccguuguccuuuuccccucccuccccuuucccuucccucucuccccuccccccuuuccuccccuuccucccucuuccuucucucccuuccuuugcccucuuucuccugcccaucucuuucucuccucuacccguuuuuucugcagggucucucuuuguagucuuggcuauccuagacuuggcuggccaagaauuuaccuguuucugccucccaaaugcugugucauacaucacacacacacacacacacacacacacaaaaucacacaaucacacacacacaaucacacacacacaaucacaaucacacacacacacagagagagagagagagagagagagagagagagagagagagagagagagagagagaggcaggcagagacagaaagaaagagagagacagagagagggggauuugagacagucugucuguccuggaagucacuauguagaccaggcuggucuugaacucacagagcuccaccucugaggucugcuucccaaguacugggauaaaggcauggaccaucauaaccuacuuguaugugcuuucuauuuaaugucucucuucucugcaaaugagauccuguuuuaacuucacgauaguaucucagauuauaggugaaaaaguaaaaaaauacauuuuccaaaaguuacuaauuuuuauuuaauaauuuuuauucauuuauuuauaagggacaauuguuuguuagcagcauuuuuuggauuuaucaagugaaagaaucuucaaguugaguugaauuguccuauaauaaucuuccuaaaagaaugcuuugcacaaaacuuagacggucugugacauuuugcccaugagugcucuggagaaucagaaggcaguggguuuaguuuucaaugacauagguagaucuuaguuagaugggcgauaaggauauuuauuauuggcaagacuuugagguuaaguucuccuucacucucagccaacaaugcuccagucuuaaauagcuagcuguauaaugagacugggaaguucucacguuugauuccacucuccuuguauauauacuucauucuacaauauaaaugaaucaagcauggaaaaaccuauauccaaagagcuugcuugagaaauggcucaguagucaagagcccuggcuguucuuguagaggaucccaguuuggcuuccaacacuuaccagguggcucccgacugucuauaauucuaauuucaggaaauucauugcuuucuucugaccucccugggcaccgagcacauauguaguacacauacauacaugcaggcaaacauuuauauacauaaaguaaaaaucaaaacaaauuaguccucaaccaaaauacaaagguacuauauucuaauuuucccagaaguauauaguaucugcguugugguuuucuaaauccuuauuuauaaggaaacuauaaauuuaauucaucuuugaguuccucagaaucagagagauuuuauucauuuauggaaacuagaaacauuuuuaauccuuuuuuugguaguuucauguaauccacacuaguaucuucagguauuuuaauuuuuucauuaagggcuucauuauacuguaaaacauggugcucauacacaaacaguaguuuguugcuauccacaggucuacugauuucaacagaauuuguguccuuaugcugugauucugugggaauggagcuccauguucuucccgucagcaacagugcgucuagguaggaugugcagucuuccuggacuguggcuguggggagaacagcacaugucccccauggccgcuccacagccgcacccacaguucucaucccuucaccccuaagaucagcauaaaaucggcccugacagaucaggaugaggaccugaaguaauccgcaggggagagaaaacucaugcuuuguuggaaguagcaaaauuggauuauuuuucucaggucuuuuguuccuuagcacuacucugaaaaguugcuacaaauauguaguugaaauauaaccacagaagcaguaacuaaauuaauccguuucuaaugucagugcacaggauucuaauacuguuuugcaugcugcugaaggaugagauuauuuuaaugaaaauaaauaggauauuuuccacuagacauuuaauccaauaaaccuuuccauacacucauuuguuucacuucuguggaaguauaguauauagagaaaaagaauggaugaacaaggggugugugaaacacgaggcagcgaaaucauacuuagugagugcagccugcagggaagagcacgcucuguaaaguggccuggauggagcgaugcugugcugcacggaagcguucugugcucugugacaagccugcuuuguguggugaucuguuuuuauuaccaucguugacugucauacuuuauucaugaaaauucuccugcauacuuuuguuuuaugacauucaaaccuuaacagccuucagcuuugguaaaagugcuacauaaaccucuacaauuugggaauguaauuaucuacaggaccugcaagauaauucugccugcugguuuucaguuggucuuugguguuucucacaugaacgucagaaauguaaacauuuguuguaugugaaugaggaugagugauugaugucuggcuuugcaaaauuugcauacauuucuacuauauuguuuuauacaagcuguuuuacauggcuuauuuacauugauuuauauggaaaaauguaacuccuuaguuauuauuaauuuaaaacuuuuuguggaaaguaugguuuguuuguuugaaaguuaaaaucuuagaaaaacaaccccguugaacuuucauguggaaguauaacauuagccagggaaugcuuaaaagugucgcuagcuguuuaauggauuuuagaauuaacaguuaagaaauucugcacccugauuuuuauuuuuacaaauguaguguaaaaugguggcaguugugaaauagagcuguggguguccacugacuggguacacagaguggggacggucuuugggccgcugaguucuuggcuuggaguggaguuuagauuuugucagacuggcagcacuaggcuugguaguuuaucagcagccuuuuccagaaaugcuguuaauccaugucggugaucuuucaagucccauuugaaauguucagcuugaguuuuugucagaauuaaguauauggucaaaauauuuauuaguacuacuuaaagcuaacaauacuaucauuugccaccuuuaaaacaggaacuucagaaauuugaaaauaaaaacuuaauaugaauauuuauaaagcuguugauuuguuauucuguaucuagaaauuaauauagauuauauuuguuucauaaaauauauugcaaaaucaaauuuauuuaaaaaacugucuuaaaucugccuaguagcuuauguauaacuuaacuauuacucuagaguuuaaauaugagaguuuaaaacugauagagaacugaucagauauucuuaauuggaauguaaaauggaauuuuugggcaauuugcuuugguuuagucuuugagguuguauauuauuauuauuauuaucaucaucaucaucaucauuauuuuacuacuuuuauauuuuuauuuucaauccaaucuaguguuuuuauaaguaguuauauugaaaauguauuguucagaaccuuaaaaucugagucaugcaaguaacuagcuuacuaaaaggaaugguuuuaguaauuugauuaaguuauaaauuucccuugacucuguuucuaagauuauuuaaaccuaaaugucaaaauauuuaauuuuauaaaaaggaaaugaauuaccauuguuauugaucauuauaagacuguuagcaaaauuguugccuuaaacaucuuccaaucuuucuuaguaaucuaugucaauuguuugcagauccugagguauuguggaaauucccagaggacuuuggagaccagguuggaaacauaauuuaaaaacauuuuaaguugaaauaucacauuauuaguaugaacuacugguacuguauaugaauagcugcaauuauuuuuucuugaucaacuuugagacagaaaacguguggagaacauacagaaguuuucagaagugaccaaauggguauuaacuugguagacaaggcuggccuggaauucacacagaucccgcuuugccugucgccagaaugcuaggacuaaaguuguguaccaccacacugagaguguccucauggucuuuacaaauuuuauuagcauuguuucauuguguagaacacuagguuucauuauggcauuucaaaccuauguaaauacacuuugauccucuucagucccccguuguuguagccugcuccccacauccgcuauucccaggcugguccuccaaagacuccuucuuuguuccuauguuauuucuguugucuuuaauuacuacuguuaauauaugcauaaauauguaaauauaaacuuacugagucaaguuagugucgcucaaauguauguuuuagggcugaccuccugggacuggauaacagaucaaggggcucaucccuggggaagguugauuuucucucucuuagagcucauucauugccuguagcucuuaaucuaguggugggugggccuuuaggagaguuugaucauucacauugucauguggacuucauuagccugaaccaggucuuguuugggcuaccauauugcugagguuucuccuuaaucuuaaaccccagcucggaaguuaauucuucuaaggcuuucuugagcuucuacagcaaccuguguauggucuuguagccccuuuauauacaucaaagucuuaccuguuuccuacuucacugucugucauuuuuuccacugguuuccacaugccaccauggccggcacauaauaaagugugaauuaauguuuggguugcugagugagugagagauuaaagaaaacugaguaaacucacuauagguuaucuugaccacagcgggaagacagguaacuaguguuguaggaacuacgucuaguccaggagcucuguguaagcuucaguuuagaaagcugucagggcuaugguaaauaugguggaguuucaucacaguaugaaggagcgauguagcuugaggaguuugcagauggaagguuagagugcucaccacugacucagugacaaguuccuaccagguuccuccuccugcuuuuuauuucuguugcucuuagaaauacuguugcaaaaggacacacaccagagucacugucaucaugucaauaaguuagcaauaugcugguccuguagcacauccuguaggaaguaucuggaaaguuuaaauuauguuaaguguaucaucgggaaagaaauacuuuuucauguaugccuuuuggcuguauccuuuugaggcuuucuuaugugcaggcugcuagcuagcugccugacagucaaacucugguacuccacagucuuuuauguucaaccauguguagcugucguaccgugugguguagaagcaaugcuucuuaaacaugugaccauuuauuuauucaucguucucucccugcuugauuuaaaagggauuuggauaaugcaaagauuuucacgauuuaagcugaacagcauugauaucugaauauuuuguaauuuuaucuagugugaagauuuuuauuuaugaagauuuaaaugauucagaaauaauuuauugauucuagcauuagaaaaauaaucaaaaccaguuauagacuauuaaauuauuuuuuauaacuuuggguguuuaaaauaaaccaauuuuuauaugaaaggaaauuuuauuucacuacucuuaugggaauguauaugcauacauaugcauauguuucuguguguguacauaugacaaauugguuaauuguuuaaggauauuaggauuuauaacaagaauagguaaauauaaaaaaguuuuaauugcauuuaggugcuuacauuguuuuauauuccaaacauuuugaaaaauuuuaguaaccuuaaaaugucaauccuguuuugucaguaugcuuuugguaggacuauacgguguuauauucuugcuguguugcugugccucaagaagagagccagauugucaacucuuacaaggauauuuauuuccucugccaguaaaauguuagagaauuuaauauaaaacauggccacacucuuauuuuacuguauacauguuuuauuuugaauuguuaaaauuaaaauuuuuauugacaacugugggaagcuaauuuggaaagaaaaugauauuuucuauguuugguuuuacggauuagguauuugcuggcacaaauugugguuucacaaauuuguaguaaauaaguauuuaagaaaccuuugagaugauguauuugcaucccuguaaaaaugauauaacugcucugcugaagagugaaaaguuucacuuuagugaggcucuaagagguagcaucuuuauauuuauuugucagugaacuuauuagauucuaacucuacaaauuauuuagcccagauaggaaggccucacugugcccuacagccuauggaaauaaagucauaugugauacagguggaaauaaaugcaaguuucuuagagaaauguuuuugucagcaaaaggaaaguugggcuuuaguucugcgugugagagaugcagagugggcagugacuuuuccagagugauguaacccucccaaacagauugggcagugugcaguccuagcuggaggguuugcucaggcuauucaggacucuacaccuaaguuuuuacuuaaaaaagaaggcgaagaugguugacugugaauagauggaaaccacguuagauaccucgcuguuucuugauggaaguaaugaguauucagauugacaggagcuccuugguucacguggacuaugcuacugugugaucugcaugcuacuuuaaaagcgagucuuaagaaacgcuuuaggcuuagguugaauugggggaagaguugagucuccacuaacugaucucacccuucugugcuugauuaauuguuugcuccuuucucagugcauccuugguagauaagcuuuugaaaagaaugaaguugcucacugguauuuaaagugucugccugcaaugcaguucgggaaagcaagugaugugaggcuacuuuacuauuaaauaauuuagauuuaaaaauauucccuaucagcuaaagauacuggacuuggucagcauaugguacuagccagccucaugcccacuagcucuuuuguugucuuguuauuguuacagggcuuaaugacaguuguaagccauggcuggggauguggggguuagcccucccuggggagaaggggaggaaacugcacuguggauuauggaaauauggauuggucucaaaagaagccccccuuuaaagaaaggggcucucucaaagaaaagcucagagaaacuagugaaaagacgauggaauaugauguaaaaaugaucacuugaaaucuuccuuucauucccagcugcuguauuuuggagaaaagaaacacauuuguauauuaagggagaacuaaaagauccagaugaauagcauuauuuauuagguauauuuucauguugauucagauaaauuaugugcauuuuaauagauuuuacauaugccaggcauuuuaaaucuugaaaguauaauguuagaauguuuaauaugaacauuucaaggagaacucuaauuuuggcccauuuuauauagacauauuugcaaaaaaucagcuucuagguucuuauacaauauguugacuucuuuaauugcuuguacuagugaauauuuuauuuaaaaugugaauuguuuucuuuuaaacuuaauuauccaaauauacaauuugaugcuuaucucauuuugcuuuauccaugauuauaucuuauuuugauuuguacugaauaauaaaacauaccuuuaucuaaaccugcuugccuagacuaaguaacaguaaauucuaauagucauauuuuacaaaacauagacacagggauucaugaagcuuuacuuaguuuuugcuauacuuguacacaaagaaaaucaagcuugugaauuuugaaauucaaaacuagugcagacuuagcauucaggugcaggacagaggccucugggagggagaccauagcuuuaaggccaaguguuuccaauguaacuguccuagauauucuacugcagcuagcaggaugcagcuccucaggccaggguggcguuaagaauacacuggugcaaauaaaucugcgaggaaggaagguuuaaggucaaggaucucagaccccuccauagugaaaaacauuaguuugauaaccuuaaccauuauggcuuuuuauagcuauuuuuguucuguaagagauagguaauauacugacuucuuuuaugguuuuauaacuugugauggccaucuuggaccauuuaaugguuugcauuguaagcugaagaauuaaaaaagcuugucuuggauuauugauugaauuaacucaagggaaaaacuuugacuagauuauugaucagcuugggaauaaggaggaagaaucaugucauauagcuucaagcuuuaagauuuagggaaugggagaacucacaagaauuuaagguacaacaucugguuuaaacaacugccagagaguuagugugaaauaugugaacuaggugugaagaacacaaaaguaaccggucuggccaugaaaaacuaacugugugcccaugcuuccugcucuugguguaaaaggaguuaauaaugauaaugagcauuuaaguaauuaagcaucuuuucacaugcuucauuuaugccuuaggaaguaacuuaaggcuaggaacaucauucagacgugacuucuugauugccauuguaguucaaacuacacuauggaagacucauuuagacaacaggaaggaugugucuacacuuuucccuggugucuuuguuguguaggaauaaguacaugagauauauccacuguauuuugugagcuccagauauugugagcccugagcaaacuguuuaguaggccucuggaacuuacucagcuugcacaacugaaugguauacuaucucuggucagcaccaacuacguugugcuuuggaaaccuugccguuuuagaugcuucuuugaauuuucuaaaagauguuuauuucauuuagccugauuguccucagagucaaucuaugaucuuuuaugauagaaaaaacagcauaagaaccacacaauaucaaaugaggugaaaaccugcuuaguacuagagacuaaggggcaacauaggugggcauugggaaggagcacacuggccuauggccaacaugcacaaccugaccuaugaagauaggucagcuuuuguguggcaaccuacaggggacuuuucugagaucagggugagcauucacgaaggaucaccuaaggauguuaccaguaccucugaccugaccucaaaaaggaaugcccagguaugugucagacaucagugagccccagaaaggaauuccugaagacccgaggcagaaauuggcauggaagcuggauuguauuagaauucuauacgccuacucaguccucucuucacuuucacccuuuaauacccaguuucaauuuaucaggcucguuccacccugcucuguucuagucugcuguuuagcuccuuuauucuucuuuuuccuuuuccuguuuuauagucugcaggauauugagauuugggacagucuaauuguuauauuaguuuucugaauuuaaacaucucuuuugaggguuucaaauauacauccaagaaagacaauauguaaucuacuuuccuccaucuaaugugccccaccucuaacuucauuuuuuaaauuuuugcucuggccagcucacuaaguugagcugccuauuggugcacgugcaugaggcaguccacaggagugugggaauccuauuacucaguggucacauccucaaacaaaggugauucuccaccccccagcaacuauccacugccaauaacaucaguaagaggccgggccugggguaaccacagcugcugugaaugcgugagagugauagcuaugccaugucuagaagacaguuuuucauagcauuucuucccaucuucuggcucuuaugcucuuucugcuuccuuuuucaaagaguuugcugagcuuuggugcacaugugcuuugugcgcacauguguguuugcgugugugugcgcgcgugccugugugugcuucuguguguguguguuugugugugugugugugugaguauacagcugucccauuuagggcugaacacucggucucuuaugugaaauaccuugaucuuaacuuuagcucacugcaaaaagaagcucucuagacaagguuaugaacaacucuaguuugugaauauaaauauuuagaagacaguuugauagcaugacuauccaacagaauagaaauagcaggcucuacccuugggccuaugaccuuuagagccaugaaauucccuccuguggaguaggccucauauccaaucaaaaagcacuuaguuauccuauaacaguagugccagaauuauguuagugacccccucauaucuggaaggucaguguugcaccaugcauguccaguacuugauaagaccacuaauguuuuccuuucuuagaaggcugcauagcacauuccagaaucaugaaaacaagccaacagggagcuguuuccuggucaauuugagccugacuucucugucugacagccaauguguaugaugucuuuaagaguagagucuuucuaugugguuauuuuggauaaccaaggacaauggccauaaacaguguugcucuggaggcuugugggcauucccuggccaauaacuaguaggaacuauuccauuggcuuuuauuuaauaaucugugccucuuggagcacagauuauucacccaugcaaagugaaccuugugaacccucuuuauaaaaaguuguaauuggaaacuuccuuauucuguauaggcuuucuuuaauauguccuuaguuuuaguugucauaccuaacaucucuuccucuugcccaucccccaccuucauccccauuuaaccuuuuaacuccccuccuuuguuucccauguauuuuaccaucccucuaauuauuuuuuggauugcaauuuuaucuuguccuuuuguuuucccuuuagcauaaacuaccuccuguccaucaagccuugucaauacccccuuuuucucuuucuuccuguuuuucucuccuccacauacuguugaggucugagcauaugaaguuugaggucaguugagagaggucagaguaguauagguguagacugacauacuuucuccaucaacacggugcuaauaacuagucuuacucugguuuuauuuuccuuuuugccucccacccauucauaguaacuaauguacaauuguaugcuucaguguuaucaacauuccuuuacuucauaaacgcuuagccauuaggugugauuauuuuuuacaacaacuguguuuucauaguggucuauccauugauaguaauuguuucuaagacagucgucucucacaauaaugcuggcaucccaaagaguguagcaggaaaaaaugaagccucaaugucacuacaaucucgauuauuuugaauauugugaauauuucguuauauaagcaugauuaaaauuguaguuaaaauuguaaauacauagaauggagaaagugcagggagaauuucaaguaaagccaucaaaugaaacgccagguucaacaguaacagcagauuuggcagcagaaacuuaaaugcacaaggucuuggacugauguauuccagaucuuuaaagaaucucguaacggagacuaccagcccccccccccccaaaaaaaaaaaaaaccugucuguuauccuugaagaagaacuaauuuuuccugauaacagacuaugacuucuaagcuguaucuucaaauaucugaacuacaugaagcacucacuccuuaaacugaaaagauaaacacccucagaagcuggaggaauacuaaagcaugcaagaauaaguaguugagcuaaugagaaaaggcaauggacgaaaucuuauaaaaccaacaguaugacaggcaguaauauaaaacuuuuaauaauucugaauaucaacagcuuugguuuccuaauugaaaggcacaaacuaggagguugguugagaacgcagacuccauccgucuuucuguugccccugagaaguguggcucaccaucaaaggcugccuuacgacagaaaggggcaaugccuacaguacagucagugcagccagcaagcacacaggcaagugugcugcuccugauagacucacuucaagccagagcucaggggacaugagacagcuacuucaugcuuuuuuagagagacauucaucaagaggacguuagaauuuucuguuuuaaaacuuacauuauuugggaacuucauuauuugaguacugucuuuaagucauuucccucauucuucuuuuucuaacccuucuuccaacuaccucacaaauuauuuuucuuuauuguuacauauguuaauauaaaucuauaaauagaaucugcugauuccuuuuaguguaucauauauuauauauuauauaaucauuuauguuuuaggauuaaccaauugauacuaaauaacaaauuagaaaguucuucugaagggaagaaugguucuucuccucucagaaauuauuuccugccuguagcucuacaucuaggcauaguagggucuugugggaguucucccauccacguuggcaugcccaacuaaugucugguguuauccuuguucaggagugguuaggcagccacuuugcugagauuuuuauggguucaacuuuccugucauauauaggaaacacaaucuuacaaucauucuguccucugcucuguguuguuccuugagccuuagguguagggaaugugguauagauguaccacuugggacuggcacccugagcugcuugcuaucugugucuugacuaguuuuggauuucuguaauagucugagauucuucuccuucauuuugccuucucuguaauuugaagauuuggacuuuuuaugaugucucacaauuuccacauguuccuuuccaaugcuuaaauuuuucauauuuuuuacuuauuggucaaauuccucuacuuuauucccaggucuugauguuguuucugcuauuugauacacucuacuuuaagacuuuccccugagguuuuagcuggguuauugacuuucucaauuccaucuucauuucuguuuaaguucuuaucagcauuucuauuucuacugaauugagguuccagaugcugguuugucuuugucaucuuauucagccauacauuuguguuuucuuguucaauuuuuuagucuucacauacucaguguugguuuuggacuagagaaaugguguguacuugagcaauccucacacacucuggcauagcucagguaacacagcuugcacaugaggccaaacagauccagcuguuuggaccagagccaugcuuucucucuuaacacacacugaauuggaaucccuccuuuccucuacuccaaaaucaauacugaguauggaaaggauuuacuggucaguucucgauacccagucugaaaucaaaagaaaagugaacaagacaaggguggaguuuauuuucauucuuuaugcaacauaguacucaaacucuuagcaagaguaaggacagaagagaaggaaauaaaaaugagauaaguaugaaaggaagaagucaaagucuccuuauuuggaagagguuagcuucuacauaagagagcaaaaggcuccaccaguaaauucuuagaucugaugaacaaugccagcaaaauggaaagacacaaagaaaaaauuaauaguauauaguauaccaauagcaaacuuccaagaaagagcccaugggcauguuccauuagcuguaguuaugccagacaguagaauaccuugguguauaucugcuucauaaaaugaaagacauaugcaauuaaaacuuaucacaccuagcuagacuugguggcauaugacuuuaauccagcacucuggagauuaauguuagauugaucuacauaguaagaccuuaucuuaaaccaaaaccaaaacaacagcagcaacagcagcagcagcaacaggaacaacgacaaccacaacaaacccuuuaaaauaaaaaguugaagaacauacuaaaaauggaaagaccuuccagacuccuggccugaaaaagagcaauuuggugaacacaaauaucucaacagaagcaaucuaaagauucaaugcaaaccucauuuuacacagaaaagaaaucucaaagucauacgguugcauagaagaccccccacccccaguaacccaagccaucauagcaaaaugauggugauggugggacuucaaguaauaccacagagccacgcaacaaaaacagugguacuaucagaaaacacagaucaguuaaauucaaugggauguucaaauguaaaucuaaacaccuguaguugccugaauuuuacaaagaugccagaaauacaaugguugaaagagagccucuucagcaaauggcacugcgaacacuggauacucacgugaggaauaaaacuaaaaucuccauuuuugugucuguccaaaaaaugaacuucaaauggaucaaagauguuaauguaaacucuagaucacugaaauuauuagggaaaaggaaaguauuuuaaguuguagguauaaagcagaacuuugugcaaaggacuccaguugaucugaaauuaagggcaguagccaauaaaugggaccucaugaauuagaaaucuucuacacagcaaaggaacuuguuaaugcaguggaaagacaguuuauagaaugggaaaauauacuuauaagcuguacaucugaaggaaaauuaacaucagaauauauaggaaacaacuaaucagcaagaggacaacucagucaauaacagcuaaugaaauaaguggaguucacagaaagauucagugggcucgugaaaauguucaucuucacugcaauucaaaacuccuuugaaauuccauuucaccccagucaguacgguauucaguaaggaagcaaaugacaacauacguuguugagaguguggggguguggacaaaagggaagccuuuuuacuguguuugugggaauguaauguugguggucacuauggaagucaguauggaggcuuuuuaaaagugugaaaauaaauccacuauguaaguauuuauccagaggacucuaaggucacauacugcagagacaaugugugucaguauuuacuacagcaauauucacaauagcuaaguuauagaaccagccuagguauguaucagcagaggacuagauaaagaaaacauuguauagauacacagugaacuucuuugucagccauucagaugaauauagguauguguaauucaggcucauagauuagauucaaggucaauuuugugaauaaagccuaucucagaaagauauuugcauguuuuuuucucauuugugguuccuagguuuuauauagauguauauaauauauguauacauugauuaaaaaugaaacugcuggagaacaaaggggacuaucaggagggggaggggauaaaaugaggguggucagaauggagugcuauaaauucaagauaaacaguauacacuuguaugaaaaauuaaaaauuauaaacuucaaacauuaaagguauuaucugauggaauuuuugacuaaaaacucuagauccuuauuuguuuuauauauauuuucauacuuuucuuuguuuuuucaucauuaacauauuuucauacuuuuuaaaagcuucucuaauuaaaugcaugggagguauagaauuaugccuucuguugccagguacagcacucaucuucuuuuguguguaagcacgcuuuggguugugaauuagaucaaucugaagugacaggagacugcagagaugucacugucuaugacacacacacacacacacagacauacacacacacacacacacacacacagacacucacacacacacacacacacacacacacacacacacacacacacacaaucuguucuaguuugcuuuccauuguaauuuggggaggaauggcuuuauuuuaucuuauagcaugcaguccuucauaaagguacaucaggacagcagcagcaaccuggaggugcaucgaaacaggaaccacucaggagugcugcucaucggcucccucgcuugccuuauuuagcccagauccaccucccugccccuggguggcacuaugaacaguggacugauucuucccuucucagucguuaauggagaaaacaucccacagacuugucuacaggccaagcuuauagaggcauuuucucaguucugguucccuuuuccaguuguccugaguuugugucaaguugacacaaucuuaccagcaugucucuucucaauacauuccacacaucuccucacugacugcaucugccucauggacguacugaagucucauaaugaugauuuauugcgaagucaauuaggcuaauaaucuaaacuauauuaauauaaaaacacacagaucugucacuuaaggauggguaaagaugaguuuuauuucuaacuaaaaacacaaaacaauaucugaucaggcuuagucuguuuuugccccuagucucucaaguuuucaauagacucugaguuuaaaacauuucuuaaaggauaugauauuuaaaccagcucacugucauuuucuauacccucucuggcaauaaggugugucccugauucagucaccacauguugugugccugucuucccuuagaagaugggguguggaaugugucuggcagucucccuggcacuuuccucagaugcccugucacaucucagugcucauugugggucucuagcucaguucucuuacucaaaguucuguggcugagcuguagguuauuuuauuguuguuguagaguuuauagaccccucuuauaaaguacaguuagauagaaugauuguuauuacuacauauuuacuugaaauuauauucaaauauuaucuuuagaaaaccaugcccuuuuuugaaaacuuugaauuaaaauugccaaauagaacuuauuuuguuguaaaagugauuuuggacauuuuuuuccauaaauuacaauuauggauauugagaaauauccucauauaauaguauuuauguuuauauuaagaacuuuaaugcaaauuuauuauuugauacuguuauugugcagagccuuacaaacauaaguuuacugaaauuuccugugugacgaucauuugaaagcuagugagacugaauucuggugcuuccaugcaugucuguggcaaggcugguagguaaccacuuccuuccaugguuaguucaggaagggguuguuggucuaguaagcucuagaaaagugaguguagagaaguuuuuuccucuggaugcuggacacugcugcuguguccuugugagauguacugaaagcucauggcucauucuacaagcacauggaaaggaccaaagccagugugcuuaguagaguaaaccaggagagaagauuccugguuccuggagggugcuguugaguuaaacagugccuagauaaccugccuugucucucugcucuguguguucagcuguuugcuguuauguacccuguugaacaguguucuaggaucaauuacaguuuuaaucggaggagcagugauuuccacaggaagccuucaggauugggcauucugacccccagaagaggggacccaggcacuccaaccugcagccuacccaguuguggguguuucuguccuagcugaaugaagucucagaaguggcgguuuggagguuaacuauggggagcaggcauugacuuagugguuuuggugaaugauugguuauguacgggagagaggaggggucuaaaugaugccacacuauugguuuggguauguuuagagaggauucuaucacugucuauuucaagggcuguaacucagacaauuucaaccuuaaagaguauaaaugugagagguuggacuauuaagaaagugaugugugaaagaauauaugaauaauuguagacuucauaaaaaugccuaagcuguaugaagucauuuguguagaucagauuuguuaugcagaacaggaaaaaggggaguacggaacuucagagagcacuaccguuuguuccugaggaagugguggggaaguggaaguagguuacagaaauggugacuuucaccuuacagccuguccaaagcagaucuagggcuucgucguggacuuuagaauauuuaagaaacaguaguuucuuagcugcuguuugagcuuagacucugcagggcagcuucccuggugagcagacuguccaucuaacaggguguuuucucuuucacagcaguggcuucuuuacaaagcuacaagugagcuacauacucaguaaagaaguuuccaugaauuauuuccaaucacuaauaugauagcuagcugucuuauuuuggaacuuguacagaauauccauuauugcccgugguacuuuccucuggauaauuucguauucuaguucauucuuuggguuauuuuuguuuuuaucuuugacauauguuagcaauuaucuuuaugugagaauaauauauuuuuauuaaaaauauucugaaacuaaacuuuuucuugguuaauaaaauuucuguagaaauaaaaauuuucaguagcacaggaaauguauuucguguuuauggugaguaguauggcaaaccuaugaauacauaucuagaaguaacucuaugugaguguguguguguguguguguguguguguguguguguguguauguguguguguaacagagaaugagaauauaaaaccucaguuauuucuaauauauguagaaauaucauuuucaguuaucacuaugauuaaaaugacucaaggagcacaagcugaaucggaacccaucucccucucuucacccccccccccccauaacucuaguuuauauugcaccuguaauuaagaagaaauccagucuuaggaguggcaggacuucagccauugaucuggguguccccugcuuauacugucagcagcauagcugcucugucacuggcagagcugagaggaggauuuuuuucuauacuguuuauacacuccucuauagaccugcuggcugguugaauuuuaaagagugaggaggcuuaaagacuuguccccugagggacguuccugccaguugggaagcgagcuguggcuguuauggaaagaggggccuuuguggaagacuaaggcugaggggaggcguccucuuuaauuugagcauuaaaauugaugugaaauaugcggcuaauauacauauauuuagaggcagauauugacuuugaguguuuuuuuauuguuuccgaauuaugugcuuaauuuuguaggacuuuaucugaccauuauuuauagguguaguaaauaugguaaaugacuuuacauuaugagacacaagauaaugaugaagcaacagucaaauaaaaacaacugucuucguuuguaauaaacuguuuuuuaguaauuuauuucaugucuagugacuucuuuaauuauauuuagcaaaauauuaucaagaguaaaaugacuuuuucuaaacaugggccugugcuccaacuuuuaauggcacacauucauagcaagccuguguacuugcccugaggcugaaggcuuguuuucucuucuuacuggucugugcgugagcucucuugaagcuuuccuagguauuccuacacuauuuuauuuuuaacuaauaauugcacacacacacacacacacacacacacacacacacacacacacacacacacugcuucagguuaagaaagucgaugggaaguacucaagacugugauugcagagguguauguguuugguucugucucaguuuacuggguguuagcuuuauugggaaaaggcaguuguagaagugacagauuugcuaagauauuugcuccuuugcuucuuaauaggaauugucuucagguucugcuccuuuauaaaaucucugccuuuaguuugugugaugucuguaauuaauuguagguggaacuuuagauucagagucaaacuuuaaugugcugcuuagauacaucaaaauacaucuuccguuaucuuuccaauuaucuguuauuugcauuuuguuguaauuuuuaauaaauauuaucucuaaaucuuaaugagauuaguguuuuaauaaaacauggauuuuucuauuuaaauacuuaauauuuagcuauauuauaauagauacuuguauuaaguuacacauuuaagagggcuauuugaaauaaauuuacuaacaaguguuuuaagauauaaauguguauuuuagaaucuauacgaucuuugaauauuuuuaacccuuguguugugggacguacagaguugucaggccucuuagucauucauucugcugccaacuccauucccuuuucucugccugcauuuuaauugaaacaacauuuauauuucugagccagaaucugugaaaagucccuguggcuagccugugguacuaguugcagcagacacagcuugcccauauggugcagugcuccuugugagacccauauggccuuguugaaggggaucccagcggggaugcaaaggguguuaauacccuucaggccaggccuuucccuccuggggcuuccgggcauugucagugcaaucugccaaagcacacacuuaauuccuuuuuaauaaucaauuauuucagucugagaaccugugcuuuugucuuaaaaauacuucacccaccccuugaaaauaucucaaaaaguuuuaacugcauguuuaaaaaacauucuaaagcacccucuuuauuuugaauuugcauuuuuaggaaguucugcagagcgugcccaaguucuguuuucccuucgauguggaaagguauaguacaaguuacugguuaagauaaagcuauucuuugcuagcacacauuucaaaaugauuaaauauacauuuuaagaaacuggcacauaucuuuguuuuucuuguaugcaaauauggcaggugugagguuccgaauuagauaaugcugacaguaaaaucgccuuucagguuauucuguccuuugcuucuccaccauggccagauagguguucuuaaaauaaccugaccacagguuauguuucuucuccuuauauuucagguauagaguguaaguacuagcagagaaaaguaugucauuggucuuugauuaugaucuucagaaggucuuugaaacagggcuuuacugcucgcuccagguucaucccacuggaagagcauuugugagugcugggaacuuguuaguuguuucuaagaacagcaucacacaacagugugcuacugagggcggcugugggaaacuucccuaguagcuucaacaguuccagugugcuuauauuuuacugccaacacuaacugaacuuauaugcagcuggaaguuagcauaauagagcuuucuuuagaaauaaugacauuuauguuuuucaugugacugaucaguauuaguuguauuuuaagaguguacuguaaaaaguuuuuaaaaaucauuuuaugaagauauuuugccaaauauuaguaagacugaauuuuuaguauauagauugaaaagagaucugauaguggguuaguugauacuaauaaauauagcugauaaaaaguuauuuauuuacuuuauuucuggagaauuaguuguuuuaauuucaaaauuauaguauuacaucaauagugaaaauaaaauagaggaagaaaaacugaaagaggauauuauaaaucuugaaaacuagaggacauauuaaucccuggaggauuuauuugacauguauaaaacuagauauguacuuguccuggccauuuauaugugaacuuguuuaauaacuguuguuuugugacaaaacaauuuauaguuuuagaauacugguaguaauuuauuuaauuuuaaaaucuauaugacucuuuuaaaaccaaaauuuauguuaucaauauuuuauuuuggggcaaagaacaugaaguccuauugugguuuucugagccacuaucuggaaguauguugaugcuuuuuaagcagaaguaaauguuuaguuuuauaucaucccuuaugcugaagugcagcauguaauuugguuuauucuaugcauuuuaaaaucagauaaaacucauaaagaccaaccacuagugggcuucuuuagcaggaguugucuucuuuuaguuggaguuuaauuaugcagcuuauugauaguucuaaaauaaugcuaagaagauaacaggagugcuuggcgugagguccguugggugggaaugucaacagaagaagugacucagggugauggugcucaccuuuaaaggaugcaccaacaugguuugcuauacaggcagucaaaaaccaggaaaagaagaauaauuagacaagagaagggcugcuggugaguguagagacugaaucugcugauucuucuccagagugaggaaccauggcugcaaccucaugauagauuuuauggguaacuuacucuucugaaaauuaggaugaauuuugacuuccacguggggcauuuguguugcugugcucucccauaagcuguuagaagucuuguaaugcuugacucaugacucaugaguugguuuauagauucaugacccuucuaguugcagaacaucauucuagcuuuuauuacccaguauuagaaaggugaagccaaugacaaguaagucuucuugaaaguuauccucaagaaaaccagcacagauuuaauaccaugauauuguuaugucuuaagggugucucagaaucaaguuggacagcacuuuaccuucguccugacagacauggaaaguaagcagcgauuuggguucugcaggcucacaucuggaggcagaauuuguuuauguauucuuaggugaguaauuauaaucaaaacauggcuacaaaauagauugugucuuuguccagcuauaucaugcuugagaucucaaaaaauaaaaacaaagcaacuuuucuuaauuuuuuaaaaaaaauucuuuacuuguucagucuaaauccaaggaagguuagaaauagucucccuucuguaccacauacagaguaaaucgcuuuccaguaacauaauugaauuguucuuaaaagaaagaauaaaggauuaguuauugugauuuauuucugaaaaucaaauauuaacaugggaguugugauauguguaaguaggacaacacuuaguaaaguuaagaugcuuuuuucugucauugauacacaugcagccuuugugacucaauugugguuuuaaggcaaagauugcaaacuuguaguugggaagaaguuagagaauauuguuaggccacuggguguuuuaaaaagcuuaaaagauguuguuaaccuuauacauuuuaggaaguucuauguaaaauuuauauuccuaauuucuuuagauaaauagggagggauaucuguucauuguaaaucuuuccuaucccagugaagaugauaagcuggaaauagaagggguuuuaggaaugugaugaucuugcuagauuuuaugguggcaguugaaauaaaaggcauuuaaacuuaguuccuguaagaugucauuguaaacaaagaauccagauguaaccuauaaaaaguacaauucuuuauaauuauaauauagauacugccaauucuagauucaacagaugauaacacucaauuuauaguuuaacaucuugugaggaaagcauuguuuauuagucacuuuuguauggaugugauacaaccaaacgacuuauagaaggauggguuguauuuuggacuuaggguuucagagaaagaaauaagucauuaucaucaugguagggaaauauggcagcaggcagcaugcaucaggcaugaugagaggaacagcuaagaauuccaaaccggaauguggaaaucagagagccaacuucaauggugccaauguuuuuuaacucucaaagcccacugcuugugacauacuuuguucagcaaggccauaucuccuaagacuaccaagacagccaccaacuggagacuaguauucagaaguauucaaaugccugaaugggggccaucucauucaaacagcacauccgggcauacaacgaguggcuucucuguucauuugcuauugagcugccuuugucagucagugagagcccuguaugcuagugcaugccuauaauaguagcacuuggaaacugauguaggaggauugcaaauuugaggugagucucugcuauauagugagaccuaggauuuaauaaaaacacuccaaacaaauguuagagugggguaauccacuguucccuauuguuugugauaacucaccagagaauaaguuaucaacauuauuuguuuauauuugauucugcauucaguaguuuacccaauuaccuucaaguugaauuucagaugcuauuuauaauuaaagaguuugaacugcuuucuuuuuuuaacucaaaauauuuugaauauguugaaacuauaaauaagccuaaauaauuacugaauacucaacauaguuuaaauaaguuucuacuaguuuuuacacauaggaaagcuacuguuauuuuaaaacauguaaaacacaauauacuacuuguuaaauaaaugagaaaaauauguaguguaagccaguugucauuaauuuguagaaguuacuauguugucucaaacuuguacauuuuggagaguagcugaauauuuggacuccugaguuagaaauaguuuuaccugcaaaaauuuuauuauauuauguaaauauaagaagugaaaauugaaauuauacaugucaguaagauaguauuaugguaugcaucauugauuauuuguuuuuuauucaaguaaucuuuuauauuuauucucuuguugguugucugacagugauucugguggcucaggaguaggauguuucacacgaggaacagcuaauuuauauaauuauccagcaguaaauaagaaauguaauguugugacaacuuauuuagaauguugcugugauuaaaugaauaagugaauguauuuaaguuguauucagauuuaucuuuucaaaaauaauuuugaagucuagcaugagaagaauuauagugguuuggugcuagcuuggccacucugaggggugguacuugaccacccaugaaaucauugaaaagauugauaaagcuuuaaauacucuaggagcuuacuguucacuuuaaaaauguguauuacaguaaugaaagcuuuuuuguauuugucaggaaacccugaaaccuuagagacuggugugcuugauccuacaaggauggucauuauauuguacuguauguaacagaaggacaguuuuuaguaaauucauguaauaaguugguaggaguagauagaggagcacuuagguggggcuugcuagcaacuuuauaguaaacaucuauuauguugacagaacaauugaccaagcuuccaaagaacucacccacagagaaaauguaagcagcugguuuuacugagggucggagaaaugaugagcacgugaaggagggcagguuugcccagcgugguagggcuuuccugugauucuagcagugaggaacuggaagcaggggccacugacgguuuagguccagcaucgguuacauagugagaccccguguugcaguaccacucccugaggcacaaguuaaguaguuuuaaucacugcgaggagacguggaugcugucuuacauacuccuuguaagaugauggcauaguccugugaaagaaaacuugauaauaccagaguuuugaacucuuucguuucuuguuucuguaguuuuagcucuugaauucuuccagagucuguagaaauguuuagcaguguugaugguaacaagcuuuaaagacgcagaaacuuuauuagugucacuuaagcuuagcacauagggcauacuauacuaaaauauuauauauaauuuauaagccaauuuaaauaauaaaagaauuuaguuuguguguguguguguguguguguguguguguguguguaugugucuaagagcucuuucuagcagaaaguuccuucuguagguccagguaguucugcuaucccuagcaucuaccuacuuuaccccuggccuccaagggacucuucauagucugaagagguguuugaagaauaacuaaaugaaaagaucgagaaaaggagaguuacauauguggaaaaaaccauaagcaaauauaucguagcuuaagagaauaguuuauaauaugauuuaaaaugauaaaaaauucaaaacaauagucauagcgcucuaaguuguuauuuaacagguuauguguuuccauauaaaaguuuauuuguuuuaugaaguaauucauaaaaauaacucuauuaguauaugauuguaaauacuuguaacaaugucucagagaguaaaauacuuguaacaaugucucagagagugugugugcccucagcuuuugaccuuugcuuuaucauuucgacauugcagcacccgaguaauacaggaaugugaugucuucuuaucaucaaguucuggagaguaaccaagaguauugacaauauccugugauauuuguguguggggugugucucugggacuugguuagccaauaucucacauacgggcaaaaggauaacccauuauuagucccguuguuuuguuuuauuuugcuuauuuauuuuuugcuaguuuuaauuuguugucuaguugggguuuugucccauuauagaguaacuacauuuauaaucguuuguauguuucaggaaaccucugcaguaauuaguuucuaucugacuguuugaaaaggccuuuaguguuggucaucccuccucagcugcuauccugcuucccgcuccguuuaauuauuccuguuucccuuuuugugucacuguaucucuagucuuuuuuucacacuauucuccugauuuuuauggcuaugccaaguaaaauaugcacaucuaaaguuuuaaugcugcuauucacauaugagagaaaacaagagauuuuuaucuuucuaggucuugguuacuuuagucggaaugcuuguucccaguccuuccauuaucugugaaguucauguacuggggauugcuauacacacugccuggagagaggucaucugccucacccacguguaaacccugccagcuacgaaugacugucuuggcgugagaguaacuucuuacuuugugaugauuggauugaaggcuugcuccacuagauggaacccaaaccuagcaccauuaucaugcccgagaaccagugccuaggucaguccuaaugcccuaagagggaacguacuauacuuauucugcuaaacgaacauagcauuaccaggacucuugauuauugacuucuauacccacagauuagugcaucuccuagccuuuaucagagaagcauuuucauucaguagguggaaauuaaaauggggauccuuaagugaucaacagguagagaauaagagauuguaggacuguguguaucacauuuccugccacccuaaggcucaaagaucaucauagaagaggggcuaaaaaauuguuaagagccagaaauggcgaugacuacaaggaaacaaugcugucaaggcacaacaaggaagaugcccauaagaauucauagugauuuugacaguuugcacaugaugagugcaaagccaagccagauaaaaaucccagcguggaauagggagguaagaaguacgacccuaggucagggaacuauuggucauuuauagcuuuuggagagggaaauuugguuuucuuuaagaguaugacuucugguagguagacugaccauucucuccaaggcagacccugcccuaaacaauauuuacacaacacauacuggagugaauagauugauugaaugaaugagagaaacaaagaaggaaagaaagaaagagaccacaaaguuggguggguaugagugugaggguggauaugggaagaguuggggugagggagggauaaaugugaucaaaacaaaaugaugaaauucucaaagaauuaaugaaauauuauuaaaauuguuaaauagaaagagcauacgaauugguuauccaguacuauauggucagccugaaaacacauauauacaaguaacaauaucuagacugaucaguuguucaggaauaaaacagauuagugcaucuccuagcccuuuucagaucgagaagcuuuuucauuuaggagguguaaauuacaccuguguaacaacauuuaaugaaaagggaggccauggaguuuuacagagaucaaagagguguacauggaagaguuggagggaggaaagggaagggggcaggggaaaugauguaauuauacuauaguucaaaaaaaauaaagaaaauauuguaagguuauaaaaauuguuucauguagaauuuuacugaucuaaaauucuaagaugccaucauuguauaggugaucaaguauaugagaacuuuagccauuauguuagaaauuaguaggaauguauccagaucaucuuuggucagguagauauauaugguguauuuucaggaugcaaguuaucuaacuaguguugcagugggcacggcaggcauacacuagucagggcagugcuguagaauuaagggcagagaugggacaauuguauucugugccauugaaaguuaagaugaggaugugagugaccucggacagaaaagaacugcacugacgggugacugugacaguuaagaauccaacuuuagugcuuuuuucugauuuccauguaaaauggaaaaguguuuucuugguugaaaauguguuauacauuucuaaaacuuauuaccuugaagcaagguacccuguacacugaaaauauaccaggaaaaguuugggauaaugcaaacauuauauacacguauaacauacauuacaugcacauuucaagcucagagucaauaguaauuuuggugaaagagccagggaaggaguaugagucacuacagagcuacccgguuucccagaccuucguguuugucgcaggcuccuagucgcugagugagcagcucuucagauuaugacuagaugcuaaggacgcguuacgagaucuuuacagugagguuggaaaagcauuugacguggaauuuuuguacuuaauacagcugaaacuuacugaagaacuugcuuuuuuucagcaagucauagagcauacacacaggucaaaaaaaaaaaaaaaaaaaaaccaaacccaaacccuauuuauauuugugacgcaugacacuugcaguaugucauuuaugcugcagacuucuguccacauguccaaagauguacuuacgagucugugcaguuuaucaggguaaaguauaaaguaacugucaguauuuauaauuugcagaauacauggauacuuuuaacgugguucauaagagcuccuguaacugucgucuucuuguaacagucacuuuuacucuugucugcugcuaaguuggaacugcacgcaggcuacuaaauccauggguugcuuuucuucuagaaugauaauauuugcaguuaaugcuucuuauuuuauuuauauuguuuaauuuuuagaagaaaaagugaaaauucaguucaauuuaauauuaaaaugauauuuaguuugaggccugcgugucugaguuaauuuucuguagugucuguccugguuuaacaagauuucaaagcuguccucagagaucgcuaacuuaggucuuauugcuuguguuuagaauugcuuucauaugcuagcaaagauucaagaaauacucuuccaccucuaauuucauuaacaaaaauuuacaacucuaaaaacgucaccaagaguucaaacugaaacacucuaaugagguaggcagguuuauguuuaaggcuuucauauaguccccuuugguaccuguaacucauaccaaacuugaagacuuccugcucuuccuuuggacaaaucuucuggaagcagaauguuucaauuuuacacauuuugugucaauuuucuaguggacaaacagcuguagcccccagaagcuuuccgguuugguaaggaaaggcaguugccuuaguuugauuugauugcucugcauuaaguccccgcugaucucucagacugcucacaauugcuagacuauuugacaaagagcauuuccuuuccuuuauuuaaccuuugaccuuaggauguaaacauuuuacuagcgccauaguggaaauccaaguguuggggagucuucugacgccgccagaugaacuuccaaguuuguguaugcgucugucuuuugccuccuguuuacacuggaaauuuaaaacagucucacaguuauccuuuagacuucugccuguagaacuguaaauuguuauguuucuauauuugcaaaucuuuaacagucacacaguuuguugaugagcuuacauguuaacuuugaaaauacuuaaaugaaaaagcagauuuguuuucuacauuuuguugaauguuuuaauuuucuggcauucuugugcuugguucuaaaaauacguuugcaaguaggggaaaauaggggagaauuuaaguuagugguaaucaguuuaagaauuuauguuagugaaaauuacuuugaacauauauugcuuagaaauuacacaagaaacuacaaaaauuaaacaacucaaaauuucaaacccaucauauuucuuacccuugaagacauauauggcuuauaauauuuauuuuauguguuauauuaaaauaaaaaguagacaaaacacucuuuauuuaaaaacaaaagggauguuacuuauuuugccacaacccugugaaauagaaucuuguuaaaacacuggacugucucacucuccgugcagcaccgggaagugcgguuagugcaguuuucuguugagcacgcgcuuccucuaugaguugugaguuaaguuuccuucggggaucagucagguaaaagacccaaaugagaacuagguuaggugccucagccaaggaaauugaggacaauacaugcucugaacagcacauggcuggcaugaaggagcaccucucacuccaggcuuuuguuagcggaauauuguguggccagauuccaauuauuaugauuucuaguggaaaaagaaaaugagauuuuuccaagguauuaucugagauuuagaaacugacaguuuauuacgugaaacaaagccauagaacugcugguauagaaaacgaagcccugggcuggcuggcugccacuacagauggccagucugcagccucugcucuggaugggugcagaauugcagaagaagcagaagaaaaaaaaaaaaaaaaaacccugccuuugcuuucucguguuccuaggcgcauaccuggguguuuacagacuaauucuaauuggugcuguuuuuauuaaaaauugugagugauugauugcaaugagcaguuugucacugggaccagcauaugcuugcacuugguucuuuguggugauaguauauguugaugugucagggagugaucuugcggaaaucugugucuuaguauuucagaaguacauuauguuaagagaaaacugucggcuugauaaugucauuacgaguauuauguuuaggcuugugcauuuacacacauggauuucugcuaucuuuaccacauuguggcuauguccuuuucuaaauuuuuaacaauauaaagaauauacaagcaauugaaccuagaguuagcaaggauuaccaaauuguuagacaaaagaauuaaauugaucugagaaauuuucaccuucuggacaaacugguuuaaaagguauaaaaguucucucuuacuccugcuucucucucuugccccuuguucccccuccauucucuuuccccccucucuacauggccauggccggccucuacuucucuucuuucuccuuuucuuugccuuucucugccucuaauuacucucuuaacuccccuccccaugcccuaaauaaauucuguuuuuuacuuuauuuaaaaaaaaagauauaaaaguacugcuuugaauacuaaacauacauuucggccuuugcucaguggagagagacuacauguuagcuuauuuaagcuuaguaaguaguggccaaccauaauggugaaugccugcaaucccagcauuugggaggcugagucaagaagguauaccagacuaggacauguaucaagaaccuauuuccaaaaggauuaaaaguugagaacagaugacucauugcaauugauuuaauugucuguaauggacacggacucaugauacucaggcaggcugaguagagagucauucaaguuggauguacuaugauaugacaaacuacucaugguguauauauuuuuauugcuagucuuccuuuuuuucuuuuuuguuuugaacaguaauacuuguuuuacccuaggucucugaccuauuuagucucaggagugggcuuuaaaucauaucagauauugguugguuacuuucauaagcucugugucaccauugcacucauauaucuugcaaguagggacagauuagaggcuuucuagcugagcuagcauuugcauuucuccuuugguagcauguagaguacuuuccaguaccaaagcacuagcccacagugguuaaggcucuagcuuaaugguuaaggcagcaguuugacuuccuuguguucaaugaauuguuuagguguugucuucagcuauagagccuugcugucagcuugcagccguggcaacagccuggguucucuggggcaucucaugagcucucuuuggugcacaacucaacuagauguaacucaucccuggcacacugguacuggaagcgucauuuggugacaagagauguccaguuggggcucugucucccuguuauuuggugauuucauaaagguuaccuuuauauauguauguauuuuaggaagcuuuacugugguagguuuucauggcccuugaucuuggccagcucuccccauauucuguccuucgccucccuguuccuucaccucucucugcuaauccucccauuccaguaucauucucuucccugcucucuguccauccaugacuaccuauucuguuuuuguuuuucugcccccuacggagaucuagcuauacuuucuaaccccucacucuauuuguaaccucuguguuccauggguuguagcuugcuuaucauuaaguuaauaacccaugcacguauauaagcaaaugcauagaguugucuuuuugggucuguuuuuuucuaguuccagccauuugcaugugauuucaugauaucauuauauguucaagagugguacagguggaccuugagauauaggucuacucccauuuuccugaggcacugcuacacugauguccauaguggcuguaaauuuauauucccaccaguaaugguugaguguucccuuuauuccacaucuuugccaacaugagcugucauuugguuuauugaucuuacccauucugacagauguaagauagaaucucaaaguaguuucaaccugcauuuuccuguuuugacccugcauuugauuaaggauguugaauguuuguuucucggucauuugaguuucuuuugagaaaacucuguuuagauccuauauuauaucuuuuaaauuaaauuguuuucuugauauccaggcuuuugaguccuuuauauauuuuggauauuaguccuuaauuggauguguaguugauaaaaaucuuauccuaucuguggucugcugccuaguccaaaggacagugucuuuuggugugaaaaaacuauucaauuucuugagucucauuuacuaauuguugaugucaguacuuguguuaauguucuucuuuucagaaagauuuuuuuuuucuaugccagugaguuuacuaucucuccuaucagguuuagcguaucugguuuuauguugaggucuuuguuucauuuggaguuaaguuuugugcagugugguaagucuggaucuauuugcauucauccaguuugacuagcaccauuuuuugaaaaugccaugugaaguauccauagucccucuaccacaauaaauaccacaguaaauaucuuuccauacugucaagcagugguugaguugagauagaaauaagucauuuugaagaggcuuuugauguaaaaaggaaguggguacagcuaagaguagggaauggguaaaaaaaaaccuggcuguaguucuuuucuguuaucaggaucaaccaguuauaaagaauagcaacucacuuuccauuuaccuguuuauuuauugauucuaaauuuccagugcuuuauauacauuuaaauucuucuuacaguuacuugccaugguuugaaguauauuauaaacuucuaaauacucuggcagauuacuuggccaaggaacugguaagcugauauuuuuuucucuauuguuuuauuuuguuaaaauaugcauuacauagaauggacaguuuuugccaguguagauuauaauuuuaugguauuuaucacagucauauuguuuuuaaccaccaauacgacacaucuaaacaaacccaaacucuauauucaaugaauuauaauuuacuauuucauuuucuucucuccccucucaacuaccaugacaucuauauagcuucuuuuucucuuucuuucucucuuucuuucucucuuucuuucucucucucucucuuucuuucuuucuuucuuucuuucuuucuuccuuccucccuuccuuccuuccuuccuuccuuccuuccuuucuuucuuucuuucuuccuuucucuucuuuuccuuucuucccuuuucuuuucuuuuaauucuuucuuuuuuuuuuuuuuuuuuuuugguuugguuuuucgagacaggguuucucuguguagcccuggcuguccuggaacucacucuguagaccaggcuggccucgaacucagaaaucugccugccucugccucccgagugcugggauuacaaggcaugcgccaccacugccuggccuauauagcuucuuaaauggaggcccccacacagguggucccuugucuguccuugcuacugucacuuaacuuaguauguuuaaggcuccaguccugugccauuguuguacagcuggauaauugcaugaguacacuagagucauuuccucacuuaucucuuaguagacaugcaaucggccuugugucucuugugaauaagacauuaaccuggaugauuguucgguugccucucucauuagaccuacucaauguggcagagaguuuuccaggcauacauaaauucuuuaguucaaacgaaugaaacaacuuauucuuguaguuacauuuggguuuguucuauuuccuccauaugucagagguauaacuauggaguauugggauaauuguguauuucacuauuugaggaaaaaccauacauauuauuuucugcuauggcuuuacuauuuuauauuuccauuaguaauauccaaagauaucuuaaauucuauuugguuuuauauguuuuaauuauuaaaggaucuucucuuuguuucaggaagaggauuugaaugaaacucuuaaaucacucuauaaccacccaguaccaaaggcaaacacuccugucaacuugagugugguaaguacuucauaaguuguuuucagacacaguucauucucacugaagaaugcacaucugcuccaggagucauuugccaaaaucacccuguuuccaugaaaaugucaaagaugguguuaaccuugcuuggugcuaauaacugaaauccauaaauaauaaauauauaaauguacacacauacauguaugcacacaugcccacauagacacacacacgcauaucuacaauaaggugggcaucacaaaagaaacuugucuaguaaugugcagaauuccgacuaaaaugcccuugucuuuccuuccaugcaaauguaccuuccaggguaguuaugaucccuagagcuguggucagcauuugugugaacaacaagccucugugccggcuugcugaagccucuuagugaacuuucccugucacaucugcuuagguugaugcucaggaucucugggggcugguugacaucaaaaguuguugauaacagaguauggagguuucauucauaucuuuuguuaauuuuucaaauaaaauaggcuaacauuuauuguuauugucauuauuucuuguuaauauguuugguguuuuucucuccaagaucaaggaaaaacauuaauaggccaagcaaauuauuuuaggcaauucagcuugaaauguuuauuuguguaagacauuuugcaguuuugagugauaaugaaauuguuuugcucauaaaauaacagucuucaugccuguauugcuucuaccaucugcaaauagcaguacugucguaaucuauuccugaagcccccacacgcagcaguuugauucagauucuacacaguuccccuuaagugauucuucuaguucauucucauaaagagugucagaguaaacuuucuuaaacuauaaaguucuuuguuaaaaaauuguaauuccucaguuuguuuguuaaacaaaguuaaacauuuuuaaugaaccuguauacguuugguauucuaggcaaccacucucccucagagacacauguuaaauuaaaagaaaauuauuugacauuguuuucauaaaguauauuuugaucauguuuuuccuucuucaaacucuuauaucaucccugaccuuccuagguaccccauuucauucuuucucucuuucuuucucucguucucuccccuuuaucccucucccucucagaaacaauaacaauagaaauggaaccaaaaagaaaacaaccaacaaaacuccacaaguguaacaaaaauacuuuaagaaaccaaaacacacacaacaagaaaccaugaagucuuuuuuaucuugguuagcuacacauggguauggggacugcuccaaagugugguugguacccagugacacuccaguggagaaaacugauuuuccuuuuccuaguagguaucuauuacaaguagacucuuaguuaggugucucgggaccuuguguccauucccuccucucaguacuuggucuccucaggcucagugcaggcugugugcacgcugacacagucucugguuucugugugcugcagucauuuugggucuggcagacgugguguauguacuuggagacaucaucaccucuugcugcucaacuccuucugcuccucuuuugcagagaucucugagucuugaagggagcacuuugauaaauacaucccauuuaggacugagcacucaggagucucauucucugcaccguguccagcuuugggucacuguguuaguucccaucuauuuuaagaagaaucuuaccugaugaaggcugagugaggcacugauggauggguauagcgauagcucauuagcagucauuuuauugcuaaguuccuucaacagaauaguaguauucaguuuuucauaaggaaaaccucuccaugagauggaccccuuuuugacacuacuaaaaugacucagaaucuuaaauuucuuuauauauaauuuugagacagaguaaugaguguaugguggcucugugcuucuggucuugcuggcauccaguuucuaguccuucugucguagccccccaaauaccagcauaccagucuguaacuuccuguuucauauagaaaauuucuaaacuuuuggcuuccacuuucagguucaccuacuuagcacuuaguuuuacuccaagcuuuuuuuuuuuuuuuuccugucucacuauuuuaucucauucuugucuuaucauucuagucagcaucuuaagugaacacuauccuuuccauucacugcaaagcccuuugucggcugacuggcucuagaaccugcccuguuccugcucuuaugaaguccucuccacacacuugaccauguuuguucucuccuuugcugacuuugcuccguguguuuucacuugcugcaaacugcccaaguggauagaauugauuuccacuggagaagauggaauggaaagccaggagaugggaucuuuuuuuuggggggggggcuguuuuuucuuuucuuuuuuauuuuuuauauuuucuuuauuuacauuucaaaugcuaucccaaaaguucccuauacccccacccugcuccccuacccacccacucccacuucuuggcccugguguuccccuguacugaggcauauaaaguuugcaagaccaaggggccucucuucccaaugauggcugacuaguucauuuucugcuacauauuuuuuuaauucaaaucugaaagucuucagcaggcauagauguuucuaucuaaauaggcuauuggaaguauauaggaaaagcuaagaccugcucacccagacaggcuaucaugaaaaagaauggagauuaugugagaacuagagaaaaguccaaguaaggagaaacucaagauucucaagucauugagauccaaauaauguagagaccauaguuagucagauugcaguagagggaugggagaagugagggcagcagaagagccccgaaguuaugacaagaagauaucagucucucaacuauuguuuuuauauauaauccaaacacuuuguaaagagugaugaaacguguguguguuuaauuaaauaauagaagcagcacuuguagaggguuaaugaguauugaagauggacucuggagcgucagaggugacucugcauuauagacccuugcuauucuuguagaggauagcuuuaugcccaggacccaaucaguggcucacuguugcaucuaacugguuccaggugaucugaugcccaucuuuggccuccauagauaacuucacauguguacauaaauacaaacacauaucauauaaauguaaauaaaucuguacucuauucaagucuguuacuguauuugguuuuggugugguacucagggccauguuguccacugaacuguguuccagacccuuauuuucuuuguaauaaaauaacuguaccuguugaugugcuauguuguaauauccugcugauucuauuaaguaguuuuagauugaauacaugaauaaaaucaagguuuuuuugucucauuucauuuaaugaaacauucuccaauuuucccauauuaccacaauugacaguagucugccauguuaguacaugugcauaaauaaaauuaccuuuagaauguaugucugcugguggaagcuaagggugauuuauuucuuggcuauugugaauagagcuucucugaacaagggugugcauucucccugcauugaacuugggcugcagcuuuacugcuguccugucuuuugagugcauacucaagagucaauugcuggaucaauaggacauuuuggugugacccuuuggagaagccuccauguuguugcccauagugguuuuguguauuuccauuuccaccaacuaugcaucaauguucucuuuacgguuuccucagcaaucgcuccuucuugucugcuuuagaguauuugccaaacuggagugaaguagaguacugcaguuuuggcuuucaugucucuagugcuuggugcugugagacaccuuucuauaccugagagcaguugggcuuuuggauuaagucuauuauauuuuccaaaucuuguguacuuguuuucaaguuacuuauuuugcuuucaauagcagauuacuaugcaccuguccauuaaugauucgaggaauagaguacuuguugugaacuagcccuggagacuaauuuuaucucacaguuaaaacugaugcucuucagcaucuuuacuggaauucuuagaaguaauuauugaucaguggaauauugaagauuuuaugaaaaguuaacauauaagugauuuuuaaaaaguacuuuaaacugauucaauauucucugccuuucuacacacaguucaagacauugcacaggacauuucuagaauagauuagcaggucagaauuuagaauuuccuauauaaugaaugucacucaaauaauauagcaacauggguuuuccucaguacacaggaauguuuuuguguaagcuuccccuuuggaguaaaauacucauuuuucuuucauaagaaccaagagcuauuuauugccagugagcaaguucugaaagaugaccccucacuaauuccggugagugaacagggcgcugacuucuaucaucucucuucugagaucacuaugccuuuaugauucacuaugggucuuuggaaaauggaaacggacuauuaacaguaaucaauuagaauauguuuucuguuuauucuuucuuucaccuaaauuucugaggcacauaauaugaaaaacacagccaaauaaagguguuuaauggaccuaaucuugcauuuucucuuuucaguaguaugcugaaguuauucacugcaugaaauuccugucacaauuauuucuugucacaagauaaucuugugacuuaucucauacuguucuuccauccuggaaaauuaugcacuaugacucugugagacagccuuugacuaguucagcucuguucaaaauacuguugaacauuucucuuccuaucuuuagauauaagaauauuaaauuauucauauauaauuaaggcauuaaaaucauuuagcauaauaugaacagaaaauagagcgagcgguuggaugauugcacuuugauuugcauagauaauauguuucuuugggggguuaguggagucuagaggcucaguauccuuuucauguaaauaauugaugauauugcuuuguuuauucuggaagugaauauuuauuuauugguguuuccauaaguucauaguuuuggauagcaaauacauuuuaaaauuucaguuauugaaagauuaucuucauuguucuuuucugaagagcauacuuguuacaaaauguauuuacuauaguucaucauagaaaccuuaggagcuauuuuauagacucuucaaauagccugcuuuuauuuuucagucuacauaaauaauauuuugaaaauacauguuuuuagauauacuuauauauauguaaccuuuugguaauauauucuuuuuugugcuaauacuugugagauucuuacccugcuucuggccaauuucaaaggcuccuauuuugggagccucacuuuugaauccuuaaaguuuuuuagaucugccgugucaucugacacucucccccauuuaccaaguccagaaugguagucuguagucuucaauagucaauguuuuuuucuuguuuuuauuucaaauuguauagaacauggaauguaaucuuuuccuccugugcuucauuucugcuaacuagcacuccuguuucaucacaccugacauaacuggacucccaacgauaccggagaguguaagugucugcuuucuacuucuaaaacuguucuguuacaaaugucugugaccaagguggucagcuuagggacaagcacauacacuuagcuccugagcauggcugucuguaaugugaggaagcgucaaggcauggcuucuaccagugggaaagaaugauaacaggaaaauuuugcccuuugcagucaucuuauuaaauggcccauugaauuuucgacuuccucuuugugaguugguuuaauccuuagugucccgguuguugauggccugcuuuuaauuuaaugcauaggcauuuuauuagauuugaggauauuguaagaaauaaugcuuauuacauuguuaauuguagcuauauuggaaauacuuugugcaucucaaaaguuauacaaauaggagcacucacaaauaaguagaagugauagauaucuuuucauguuguuugauaacugcgggaaaggaaaagacucucuuuaguuuuucuuagaacauuaaaauaaauguguuauaaaccaucaaaugaaaggaaggucagcaggaaggguccugcagucacuguauugacucaggugggugcuguuuuccauuagucacuugcguuuaccucaggggagugcuauuuucauacauuuucaaacuauuauagcauucgcuuucucaaacauugaguagugaaugaagacagagaauagaaauguaaauuuuccuuguguacauguguggaugaguucguguguguggguacccauguguacacguucauguguaugugggugcguaaggucagaagucagcauugauguccucuauuacguccauuuuguuuugcgauagaggccacagcugcugcucaccagcccuucugaaacccaucugccuucaccuccaaagugcuacuuucuuaggagccgaggaucugaacucaggucgucaugguuguguggcaggcauuuuaccaacucuaccaucucccaagcaccccaauuguaaauuuucuaguaucaauucaagacuaucaaauuaaaacuucaagaaagauaagucuuaugaauuccauugaaaggguuuucauauaaacccuaugaaaaggcuuugcaugaccuugcucuuacaaugugggcucaggauaggccguccaagcucucaggucuaauaaugaauccuugcccuuuguaccugauaagcacugggucauggaugcuuacuauggucagacucagauagccaugaucuggucacuugaaagucucacagacuuacucuccucgucuuucucucuaguuaccucuccuacauucacuagcaaacuucucauaguuucuauuuuacuuuuuaaauuuuucuauuuuuuacacacacacacacacacacacacacacacacaucacacaugccugccugccugccugccugucugucugucugucugugugucuaugagagggagagaggcgggggaggggagagacugagugaauuuuggguaggucagaugacaaguuaagaguguagcccucuccucccaccauguggguuccaguuguugagguuagucuugaaggcaagugccuuaccugccaagcuaggcgagagcucuaauuucaucuuuccagacuauuauuuucaaauauuuaaggaagcaagcauucuauuaaguccugguuauugagaauauaaaaaauaaauauuuaugcuaucacuggcacacuuucccacuguccuauuuaaggaaacagaauauaaaauucacaguguuguauauugagggcaauaccuuuccacauaaggauggccagucuuugugaugauaacaaaugcaguucuguuguagguugcaaagguaauguuguguagggaguugagucagaaggugaaagaagcaucagagaaaacaggaagcaagccuccucccagcagcugaacaccacucacugagccuucagcuuuuauuuauuugagaugccaugauugccaauuugucuuguaagaucucugccuuuuacagguuugagagauggaucucuuauguucuugcucaaaaauauuucagccuuuuggcucuuuacccaccauccucuacacauucuaugcauuauaauauuugcuucagacagacccuaagaauguagcucaucucuguuuuguuguuguuuguuuuguaguggaagucuaacagguguagucuaacagguguauugccuugaggaaucaaucacaaagguguauuugaccacaguaguaaaaaggaagccugcuccgauguaaaaccuacauguuuucuuuaauaaugaagcaaaggccugcguauaaauccaccuucuccauuggguacaaaagaugguauuauuagaaguggcauucauuaaaaauaauuaaaucuaauacuaucugcugacauaagcacaguacauucuacugucauuuaaaacauuaucuacucuauacaaguauuucucaaacgacugcuaaauguauaaaauguuuucccuuguauccauguguaugguaguucaaacaguucuucucccucgugcagagaaaccugaccgaguacuuuguugccguggaugucaacaacaugcugcgacuguacgccagcaugcugcaugagaggcgcaucauuauuaccucgagcaaauuaagcacuguaaguccuucacacuugcgccuuugacuaacacauauugagugcuucacaaaaagaccuaaacacgucugcacauuuagaacugugcucuguguacuuaaaagacaauaucuacauauuuuuaauauaugguuuuuaucuggcucuugaaguauaaaggccugauuuaaagaaagcuucgcagaugcauuaagucaaguuaauuauuuuuccuuaucaagagaaaagguggguuuuuuuccccccuuuuaaacucucuggaguucauuuuaguaccuugaucauguagagaacucuuaagagcuauuaugagaucuuuauuauucacuuguagcuuuuuccauuggagcuacuugaaugacacugugggccaugauaauagcugcuccuaaccagguaauagcagauucaucuuugucgccucgcagggccuaggagggaauccuauaauaguucugguuuggaggagcucuucaggcugauaauaacuuaaaagucaaaguagcauuuuuaucaauugcggguuuuauggcacuuagucugauauucuccuggaaggucuucauuacugugaaaaaggcaagaauacaagggcuuucucaggcuauagaagaggacucaaaaguauuugcuaguauucauauuuucaguucauauuuuuucauuaaacauaaaauuugaguaguuuugaauucaaaauauguaaaauaauucaagguauuugaauaaacugugauauauuaaaaaccaucauuaaauguuuuguuucuuccuacauuuauuuuauacaaaauaaaacuaccuucaauauuuuauucuauaauagaaauaaaauucagcucaugucauccccauuggguccugggagccucuugcuuuccuggcaucugggacuuucuaguggcuacccccauuuccucaucccccauugcuccacaccuccauucaauuuccugacccuuuauacuucucccaucuccucccacucuuaaucgugucucaccuuuuucccuccccuuccucuuucccuuccaagucccccccuccuccaccuccuguaauuuuguuuccccuucuaaguaggacugaagcaucuacaauuuggucuucuuucuucuugagcuucauaugucugugaauuguauuuuuggguguucugagcuuuuggguuaauauccacuuaucacugagugcauaccauguguguucuuuugagacuggguuaccucgcucaggaugauauuuucuagauccauccauuugccugugaaauuucaugaauucauuguuuuuaauagcugaguaguacuccauugucuaaaugcaccacauuuucuguauccauuccucgguuaaggcacaucuggguucuuuccagcuucuggcuauuauaaaucaggcuguuaugaacauaguggagcauguguccuuguuauauguuguuggagcaucuuuuggguauauggguuugcaaccccauaggaagaacaacaauaccaaccaaccagacaccucagagcuuccagggacuaaacuaccaaccaaagaauacacauggagggacccaugguuccaguuucauauguagcagaggcaucgauaggaggggaggccauugguccuguggaggcuugaugcccuagcauaggggaaugcuagggcggugagguggcagugaguggguagguagggagcucccucauagaaacaggggggaagggggaugggauaaagggggauaucauuugaaaugcaaauaaaaaauaaccaauaauguguguguguguguguguuuguauguaugaaacaaacaaaaaauucuuuuagaaaauuguagcacuuuuagacuacauagaguuuuggcauucuuccagguuaucaagcuaauguuuaacaagguauguauuuucuugugccagagaguuggcucagugguugagguuaagaguacuugcuuuucuugcagagcauucgcguuuggugccagcacccacaugguggcucauagugguuuguaacaucaauaugguacacacagauaugcaggcaaacuuuacauacuuuaaauuaaaaaaaaaagcaaaacaaaaaaccaaugcauuuucaaagaaguuaaaucuccacccccaaccuaaaagcuauuggggauccaaagucugaaacaaaacauguggucauccuuugugugagcuacaccugcacccgagagucaaacucaugcaaacugcagauacagagugaguaacauuguuagaaucauuaccuuugaaauugaaaauaugcucauauugaaaauaauuguauguaaaggaauuauauggagauaugaggcgacagcaucaggacguaaguacuagagagugacucaguuaguguuuccucugagagcugcugaggaacccggcugacugauucucccuuggccauucagggcuggccacucacaugggcuccuucuugaucuucccuuucucacuucucauuuuccacacauaauuuuaaaauucuaaagacauuucugacaggaauuauucucaugacaaagauuauuauaagagcugucuuguaguuuuaggaaguaauucauacauacaguauuuuugugccugccacuguccuagccaaauucagcaguaagacaaccaaggccaguuugugucuucauauaaacuggcgugcaauccuuaaacagcugaacaaaaaaggaucuguugugucauguggaccauggaauguguaccaaguuauaagagauaaaaugaguauguccaagcuggcggugagugguagguuuguguuuuguacaaagugaguguguggauagacuacaucucuaaugagguagaacuuaaacaaauggggaccaagcugggaaugagcucuuugggugaaauauaaugacuguuuaggaaaacacaugaggaaaucugaauccaggcuuuagaaaaauacugcugucuuucuugguuuuuaauauauagcccccucuuaauggugggguaaccuuuauuugacuuugcuucuucacaugugaagugagaggaacagccaucucgaugugcuugguuggcuguugagaguaaggagacacaccaauaggaaaugauucggauuaugucugcaugguauaucuggucagugauuaucaauguaacauuguuaguauucuggacuuauuauuuugaaaagcagauuuuaauaaagcuuguuauuaaacagaauuauuuccaguguucacggugggccucguaucaauuguuuauggcaauccaugaaagcuccugguuccaucuuauguuuuaguucucuuuugcuuucauuucugggucauuugggcugauaaaauaagcauaauucuaauuugcuuuuguaaugucuucacccuucuuaugcaugggaaggggcuuuacuaccuugaacaguuuucuugcauaugcagucugaauaaaugcaagugcuauaaacuacgugcagagugaugcagaaggucagggucuuauaacauaaaguagaggaacauuaguuuguguguuuuuuaaauguuuaaugaaaucacuaaaacgcacaaaggaagaauaauugccuugguucuaaacuuuuuuacauuuuguauuuucauauacuauagauacuuugucgugcucaacauuaauuuaugaagcuguguuucacagccccugguuacuuuguacagcuguaguuggcauuugaguugcuauuaagaaugaauacacacuaaagugccuuaacauugauaauuuuauugcuacuuugugagauuguuuuccuuuggccauuacucuuucaucauacuuuucacauaaaauagaugccagccuaggaacuugcagggggauuuucacuggugucugguaguaguaaaucagauaacuugaagaugauuuucuucauagaauguuugcaauuaagauaauuuguaauuuucaugaagguauaaacuuuauaauuaguuuuaaguuaugcaaaccaguuaucaauuucuuuauguuucagaacuuauaaugaguccuuucccauuugcagaacuguaguauaguguuaguacuacuauauuuuuacgugcuuaaguguaaugaguuaggacaucaccaguuuugcuuguguucuuugauguauauauuguucaguacccagaauugcuucuggaagucucaacaagcuuguugauuuuaugcaugcuguaggcaguccuaauguuuuaagucagagugaauccuagcagacuagcacaaccucauuuuaugguuucauauauucaaagcagagaaauaaaucaugauucuauacaguuguaucaguugacuuauugcuguauugugauuguagaucuggaggacugcuguuuaaagccaugucauggguucucaaaucagucaggcgugaagccuugucauaugccucuguaauuguaccucaccagacuuccucuaacuagucagcuggggcugugcauuuugucucaaacacccagcuggccagcaucugacaagagcucuuucucaucauccugucaguaauauguuaacuaggguguacguuuaugguuuguagaagcagguaaaagcaguggaucucuugaaagcagaugucuaaauguuagcacuauugugaccaacauauaguugguaaguaucguccucuuaaugauguacccauaccauuuacagacauuugauuauagaugcguacuauuucuggaauauuuagagugagugguaugcugugagugcuggaauuguguuaauaaaguauacguucuccuuuguuauugcuguccccaggcaugcaagcauaugcuuuucucucaccuucucauuaauucuaucaagggcauauguagaaagacaucuugugaucagaaaaucagcuauuagauaguaguuuuuaagguuuugacuaagagaguccagagcauuuuaacaucauucucuacauuggauauauuaauuuuucuucucuuaguggggacaucuucauuuaacugaaacuucaaccacacugugcuuuucuggagauuaagacugagcaguuguugagagaacagaacgcacccagguuugcuuccugauggaaauuauugaagugcuuuugcccuggguuuaagaugguagcagagaagcacgguguaaacuuuggaucuggaauuuucuuagaggucuucuaggaacaauuuuaaauuuugcauuauccuacaauccccauauucugaauaaguuccugaaacuguggauaaugacugcuuaccaguguauuauguacauauauacgcugccccucugaacagacauuuccaucagagcuuucugagugugacuaagugggagauggcugggaugaggugcuugugaaacacuuugcaggaaggcaugugugcagggugcugcuggugcugguguggugcugggggaggagggggagagcagggaaaggagggggagaaagaggaauaagaggaggaagaggccuuuuaaaaacucucagcacuauuuccccugucucacaguuucccucuuuuuccagggaagugugcacccuuuucuggcugagcuuagcagccuuugucuuuuaaaaauacacaguuggccuucacuucauacaucaggagguuuuauaugacagccauggcauccuguuaguggugcauucaguuaccaugcagauucuaccagcuuggcuccuacaaugcugcucaccacagcauugaucuuggaggauuucugguaccucaauuagguuuuauauagaaggaugaugacuugauuuugugcuauugauuauaaacaugaaguuuaagaaaagaucuaucugucugucugucuaucuacuaucuaucuacuaucuaccuaccuaucaucugucucugucugucugucugucugucugucugucgucuucuccguucuuugcccaaacugcugcugaagauaacuugauuucuguauuuguaugguuucuucuuuuuuuaauucuuauguuggaguuuggcagcauuuuucuuuugaugugugcccucugguuauaaacugucaagcaccugacuguagauaccgaacucaacauuuucacagagaccuugucuguuuugauaaucauaccuuacuacuuagggcugacuuggucaaugaccucauccacuccugcaucuuccccagcagagacgccuagauccugcuucugcagcuccuuuucucugaccccuggcuccauuccagcugcccacugucuuaguuaagggaacgaucacuucucauggacauuucuuucaguaacauauauugaucaccaacaucucaauuugcauaagauauuaucaguaucaucucuguaacagugcauaguguguuagucaucguuaugagcaaauaauuuaaaaugauuuaauuaucacucauuauguuauaaguguuguugaugucuaaaguagauaguugaaaaagagaucuuuuaaaacucaggcaaacuuuccauccucauaaaacuaguguguaguuaaacuaaucugucugacucucaaagaauguguucucaaccuucaugcaguuuugcccuuuaaucaugacuguuauaaaaccaaauauaucuuuaugcuuuuuccuaguauuucaucauucccacuaaugaacuuuagaguuucauaauuucauuuuuuuaaaacaucugagcaacauuccauaguauaaaugugcauuuucuuuccauuuaucucuugaugaacauuuaggcuguuuacaguuuucugccuacuaugaauagaguacacgugcacacacacauacacacacacauacacacacacacacauauaugguuaagcuauugucucuguaguaggacagaguguccuuuggguauauucccaagaguagaauaccuggaucuugggccaaauguaucccagcuuccugagggacucugugcuggaccucucgucagauguggucgcucucaggagacugucucuucaggcaguagucaugcacagcaggcuuuaacaaaaggacauuugagugaauacaugaaaucaugccuuucauucuugcccagguguguuuucaagguucccccugauaaaacauucuaguuuccagcuccucccauccuucuuacuccugaacacguccuauacucacugcuaggcugauguugaaguaucagugaaauccuugagcuuuuuuauuaaguugcaauuucuuaacuucaaaauuguguuuuuaugcaugagaggccaauuuacauguagacuuuguguuguuguuguuguuuuuaacaauuuauuuauuuauuuauauguaugugaauauacugcugcuaucuuaagacacaccagaagagggcaucggauccuauuacagauggaagagcagucacugcucuuaacccuugagccuucucuccagaccccuagacuuuauuuuuuuaaaugauggguuuuguguauguguuuucuguuacaggauguuaauuuuuaaagaagcugaucuaaauguuaaugacuccaggaaaaagugucaauccaucuugaacucuuuuuaguucugcuuauuuauagugcaauguugauucuuguucagugugugagcugaccuggcuuaggauucuuuuggccuuuguauaguaugagguaaauguaagacucucucucaguaagacuaguuuuguauucacuguucauuuucaugugcuccauaaaugaaauugcuguguuuguuccuguaacuggcccugagacuguguuugaugcauguggcaucuuguccaugcaucuucauuuucauccugcuccagaaccucagaaggcugaguuuuucuugguagagugacaccgucuuuuguuccuuaagcaucuccaaguuagucauggggguuguuguugucuuguuauuaaaauuauucauuuauuugcauugagauaguaucaagaauuacuacagaaacacccuuggcucuacuucuaguccucuuugcucuuguuuccuuuugucuguugaaaccagucacugcggccaguggccaguacuucuuuagcaaauagauuucauggcuggggguaaucuuaucugccaauucagaaacaguucccuagucuacuaguaagcuucagcugucgauuuuuuuucccugauggagucucaguuggagauugccucuaucagacugguuuguuggcauguuaauguaggagugcuccgucucaugaggacagugccaucccuauguaggagguccugggcuguaaagaaagcuagcugagcaagccaguaaaugguguucuuccaugggcucugaaccacuuuaugaccugacuucucucagugaacugugacuuccaaguauaagcucaaauaaaucuuuuacucugggaguuaauuugaaauaguuaacaccccaaaacaaaggaagagcuuuauguuaaaagaaauacuuggcauuuggcaaauuuuucuagaaauagguuauuaauuagaguauugauuucuuuguaaauugaucaaaacauuuuaaauuaaucuauuuacauuuugugugccuguaugugcaugucugugugccacaguguguguguguguguguguguguguguguguguguguguguguguguguaaguuagagggaacgugggggaaucaguucaugccuucuuugauguggauucugaggaucaacucagguuuucagucuuggaggcuagccucuacugauucaucuugaugacuuuguuaaaauucuuaugucaguuacuauguaugaagauguuaaaaguuacaaauugugauucuguagugguaucaaugaaacaaagccuaucauuuuaguagaaacucuuaacagaacuggggagacggcucaggaucuaugaguugcuuuugcacaagcaugaggaucugguuugagauuccuaguaccuauauaaaagcugggcugugauggccacaccuauuacccuaccauagaaggggaggagacaggcugauccaagugacucacaagccugccauucuaacuuaaauggugagcuaaaaguagaaggggacccccccccacuuuuaaggauggagaacaauagaaaacuauaugugauguuugcuuuaggcuguacaaacucaugcacugcacacacuugugcacacacauacauaccucaugcacacccucucauuaugagaaauagaggagggggcauggcacacuaaauucacuucaguggcagucaguuuuucuuuuaagcuauaccugauauauagaaauauaguuugcauauuaauuaacaauauaaugggauuauuugaucuauauuuuaaauauaaaaauaugagauuaaaacaaaaacuaugauaugaauguuggauaagauagaaugacagaggaaaagaguacaagagaggguaccagagucagagaccuucuuauucauauacuuaggaguucaaaaacccacucaacuggaagauauaaaguaggcccagaggaccuuuugccgacccgugcagacccugggcauauuucuucugucuuuguaaguucauuugaguuucgcucacguugauuuagaagaccuuauuuauuuggucuccuccauuuccucuggcucuuacauuguuucuacacccucuucugcuaugauuuaguacauuuauaaacagaaaaaauuuagggcacauaacccuuuuucccagaaaaaaaaauccaaacuaaaaaaaaaaaaaaaaaaaaucuuuuucuaagugggucagugcagaaagcuuccccagucagcagucaugucuaguuccugugcgcugguguuagguggaauuaaagcaagucuggcguuugcagucacugccacaaagaaaaacacacauuggguucuuguggaaugcaaagaugguucuugcuacuuuaguucauaaaaaggugaauucuugaaaggauuuuauagcauguuuaggcuacauuaugugauuacuauaugucuuagucaggguuucuauuccugcacaaacaucaugaccaagaagcaaguuggggaggaaaggguuuauuuggcuuacauuuccauacugcuguucaucaccaaaggaagucaguacuggaacucaagcaggucagggagcaggagcugaugcagaggccauggagggauguucuuuacuggcuugccuccccuggcuugcucagccugcucucuuauaaaaccaagacuaccagcccagagauggucccacccacaaggggccuuucccccuugaucacuaauugagaaaaugccuuugaguuggaucucauggaggcauuuccucaacugaagcuccuuucucugugauaaccccagcuguguuaaguugacacaaaacuagccaguacacuauauguaacucucugugauacauguguauaauaugcacauacguguguguaauguggagaagagaaagacauucagaggaaacaagauauagaauaaaaucauguuugcuaaaguaaaaugacaaaaauaaaucugaauaaagaguuucuauacaguucuuucuggugacaaacaguaauucuuccauucaguuuuuuuguuuuguuuuguucuuuguuuguuuuuguuuuucuaaauaaggacaaguugcaugaaugucuuaucuacaugggaaucccacaguccucuaauugcacucuacgugcuugagaggggagaaggcagauuugaagauucaagggacuuuguagugaaauagaaagaaauguuccuucucuggaccccacagacagugaccccaaaugguacauaaagaaaauguacugaaauuacuauugaacaggcuuugaaaugggaaccaggaagcaguggguuuauuaagggaaaaagacaaguuggggaggaagugugcuugauagauaguguggcagcgguuagaaaaauccaaggaguuugugaggaugagugugacagucagcauggauuguacaaggaauugaaagcauuagcgccuugaagcagcucauguuucggccauugcuguagcucccauuccacuuucacuaaugcucauguuuaguggguguguucuagaugacaagugugugucagcuuccugagagacagaaaaacaucuaaaagaagaaaaauuuagucauuuggcuauguaugagaagcuagcacagugaccaugaugacaugaguagaacuguccaaagauuaggugugauauaaaaguagaaaguauuuuuaggaaucaggcagcacacaguuugcccuauggagucugaaugugguccuccaacuuuauacauagaccuugucagagggacaauauuacuuuuagaaacugauuaaauuaugagaugagaacuguggugguuugaauagguuuggcccucauacacuguuugaaugucccauugagagugguacuauuaagaaguggggccuucuuggcguagguguggcuuuguuggaggaauugugucacuguggggguggacuuggaggucuccuaugcucaaucuccacccaguuuggaacagucuccuccugcugccgauggaucaagauguagaacucucagcuucuucuccagcacaauaucugcccucaugccaccaugugcuaccauggugauaauggacuaaaccuuugaaacuguaagucaaccccaauuaaguguuuccuuuauaagaguugccauggacauaugcagcagaaggcugccuugucuggccucaguggaagaggcuuggugcaccagggugggggaauaccugagggggggcacccucuuagagguggaggaacccuggaagaguggacuggaacagggcagcauugggauguaaauauauaaauaauuuuuauuggauauuuucuuuauuuacaguucaaauguuauccucuuucccagucucccuaccucccugaaacauucuaucacauccuccccccacccccacugcuucuauaagggcguuccacuacccaccuguccacucccaccugcccgcccucgauuccccuacacuggggcaucuauugagccuugauaggaccaaggaccucuccuuccauugaugcaugacaagacuauccucugcuaaauaugcagcuggagccauguguaguccuugguugauggcuuagucccugggaguucugggggggucugguugguugauauuguuguucuuccugugggguugcaaaccccuucaacuccuucaguuccuucuccaacuaauauauuagggauccugagcucaguccaaugguuggcuaauuuuaccaaccucuguauuuguaaggcucuggcagggccucucagaagacagcuauaucaggcuccuuucagcaauaaauaaauuuguuuaaaaaaguuaauuggaauaaaagaaagaaagaguugccaugcucauggugucucuucagcauagaaacccuaacuaagacaagaauauucaugaaaggagucugcacacuucccuuauguauuguugccacaaaggugucaaguguggagcggaaacauggcucccacuagacaaugaaucuaccagcuccuggaucuugacuucccagucuccagaccucugauaaugucuguuuacaaauggguuauaaauaaugucuacauauggucuauucuaaaauaguuucuuagagaaguucuaauggacuaucaugcgauccuaggggaguagagaagagaaugaaauguaaaauaauauguaauuuuaacaaagauuuuagaaaagaaaacaaagcuacuagacugucuucuggaguggccauuucaucugcauccaugccagaaaugacugaaagcugcugucucaggacgcuuuuuccaguguggucagugcugugggcuuuggccaucaguggagauagcaguguguugagugagucuuuccuguuugcuucuuucccucaugaagugugacagcucauuugccaucggaguguaguauuugaugaaguguguuaaggucucaagccuauguuuauuaaguuuucuuauugcugaggucuagagcccuuuguuuauauacacaaauaaaguccccuuucagauaugucuuucacugcaguuuaugagucagccccuccucugugcuuucuccuucccucuuccccuccccuccuucuuuccuucuguuccauuuuuuauuuaccaaauaaaucuguaggguuugcuuguuuuucuggugguaaggauugauucaagggccuugcacaugaggguaaaaugcucuaccauugagcuacaugcucaaccccgagaacauauauuugcuuuuaauuuaugcuucucaggucucucugacauguaucaugcuuuugguaucucaucaaaaagucaagccccagggcauauagauuuuucugcuaugcuaccuuugugauauuuauaacuuugcauuuugcauugaggccugugaucuguuugagucaaauuuugugaaaggcuuaaggcuugacucaguuuugaugucuaguuguuccaaagcuaucuguugacaaugcugccauuaugcaauguucuuuguccuagaucagcugauuguauuuauguggucuauucuggacccucucuucuguucaguacaucugucugugcuuucacuaguaugaaccugucuucaucucuguggccuuacacuugcguuugaaaaccagauagucuguggccuccaaccuuguguuucucuuguaagaauguguuccuugcuauucuggauuuugcuuuucaaaaaguauuagucaacuuauagauguacagagaacaaugcucugggguuuugauuguauugacucaguagaucaauuuuggaaaagcucauaucuuaaagacacugucuuucuauucaugggcaugggcuaacucucugauuacuuuaguuauucuuuuucuuucauaauugauuugcauuuuucccucuauaguucguuuguauacuuuguggguuuaugccuaauuauuuaauaaaugucuuauggucguauaauguggauaugaaucauugggaaccuguucauauccuuagcauguaguagaacaccaggaaaagauuguagcauaaguacuguguucauguaggcucucuaacuguaaauagcaccauucugcgggagauauugauaauugcagagguuaugcauauguggagauaugggaggucuggaugguuuguucauuuugcuguaaaccugccuuugccauauguaaaauugcuauuuguccaaacauuucuguauaauauccacuugguucaaauauuaaagaaauagcugauggauuaaagacacuaacuaacuaguaggaaagcaguggagacgcucagcccugucgcuagccagacaguaaccuuaggucguauuaauuuacagaaagaccauugggcuguguuuuuuuuucuuuaagcguagagcuuuacuaauuguaaagcacacaguagauucuuccuccuuggcuugucacacuggccucauucaugcucacacaaauguccugguguauauaguucccuuagcacuccuugauugucauuaacaacucagugcuauauuuacacgauucccacucuuuaaaauuguggaagagugaaauguagacucugccguacccugcaguugauccacuuccugccagaucucguuuccucccaucuucggcaugcucuguccaauccaaacagccuccccauugcucuguggagagacagcauauguuccauggcaaggauuuugacugccaugcuucauuugcagagaguggucuccccagguucacaagacuguuuucuuauuucacuuggccccauucagucacaucagaguuaucccaaaguccucugucuacacagcgucucuguuauucugcacuuccucuccuuuagacuucuuccuggcauuuauaacugagagguugaugauccuuugucugaaaugugcaguaccagaguguuuugacuuuuggaauauuugaagauacguuauaaaauauuugaguagaacaucugcgucccaacagaauucauucagcuuucauaugcuccuugguacuuuuaaacaguaauuuuaguacacaugcauuuugacuggaaacugcuaugugaggucaggugugaaguuuuccacuuaguguuguguuggcauuuaacaaaugaaagaauuuggagucuuuugggguuuggagauuugagauaaggaugcuuaacuugcaaaguaugauaaccuugugguuagcuuuccacuagauauguaagcuucaugaaaacugggucucuguauguucaacguugugucuuugucuugugggauagcauauagaaggcaauauuuuuuuguugcuauaagcaaagaaauguuaugauuuuuucugauuucauaacuaauagaaggcuuuaaaacauuuagacuuaaucuuuggaaauauauuuuugguagacuauauacacaaugagccaucugguucagauaggaaucuuucacugagaauaugaaaugacuucaugucaucuaagaacaaagaguguuugaccugugacaaagaguguuuauaccccauccacagaaaacuuuuuauguugaucaucaggcacucagaccagcugaugugagcaggucagguaccgcaggcacugagaccagcuggugugagcagucagguaccacaggccauguagcuugccagccucuaagcucuacgucugguagucugagugcuagauuucauacagccuacauguguguguuuaguuucuuagugucauuuauuuucuuauaauugugacuuuauuuacauguaacuuugcugucuuuucuuuaacuucaugcuauaauaauugcucaauuuuaaaaauuuuacagcucugugcacuguugguugaauagugcauauuggaucuuuggucugucuucauaaguauguucuugaaugucguacuugagaagaauuuuuaauuauuauugcucucauugggaaaguauaauuccuuauagcccuaccuacauaacucugaaguuuauauauaguggauaaauaaacuccauuguuuauauauucauucaagugaugcagugggguuucuuaagacagacaugagcuaaaaagagauugucuuguauucuuaccucuuccucuucucucuucuuuugucuggaaaguuuccaagggcuguauggcaguucuccuccggcaggcuugauuagcaaggguaucgcuugccaaaugcuggacagugccgggaucugugacgcagcauuuauggucuuagaagccaucuucuaagaagccaaucccgcccaccacacaaugccauugcuagcuggugaagguugcauggcaugcuuggggagcccugguuuguggguaggguugcugcagggguccguugguuguuggacguaugcacucauuauggcagcgccuccucuuuagauaagcauuuccuuugcuucacgguucuuuucucaauaacaaaacuuuccuuuuuaaaauuuaacugagauauuauaaaaguaauuuguuuccacauuaacaaaguauauuaugcuuuucaacaggacguaaacucucuuaacuuagaaagacuuaaaaugcacuguucccagccagcgucugaaagcucgggagaacuggcaauguggagcuaagccuuguucucacucagucacuaaucugcuguagcccagccuuguucucagucuccaaucugcuuuaugaucuacucagauccuuggucuguccuuauuaaauacaaguauucgaaugccuccuaguggcauaguguuggcuguaauuaaggaauuaaaaauaauguuuauugaaagagugcucugagaaacugacaaagcaacugacacugcaaggcacgggagugcuucuggcuugguaucagagucugagucagacugcgcuauuugucacauaacauuaauaaaacaucucacuggaaaauacauaauauacaugcaaaaggugauugaaaauuguaauguuuuuauuuuagaucacauuaucauaauugauuuuuauugaauaaaacuaauuuacacuuacauguagaacaguggugcuguuaaugagauuuugauugcuuuguguccauguauuguuuuaaauguacuuauuguguauauauuuugacuucuuuuaaaaugacggagcuauuuucuuauguaaaggauaugguucauuuucauauaguuuuagaaaauucuuccuuucaaguuaacuaaauggacuucuuugggaaccuuaacacggagacuaccggaaaauacugacacagugaaaaagaacacuggauuaauuacgccuuuaaucaccaagaauauacuuuauaacuguaaucauuuuaaaaauaaaagccucauagaaaauaaugugaaugaagauuaguuagggagaaaaaaaaugguaucccuuuguuaagcauuaaaauucuuuuaauuaacugcuugccaaaacacaacaauuaaaauggcaauuaccucuaaaguagcaacaguaauugcagcugcugugauauaaagcuaggaaacaaaauguuaaucuggaaugagcaguuucaauaugaaauuaugauauacuuggcuuccugcaguacagcugucaagcuugggcagcucacuggucaauagugacauucugugugucagugagcagcgucucuugauacccuaacccagaguucacacauuacugaagcuccaacugucgagcgcuccaguccccugguguuagcgccgcuuccagacucuccugacuggcucauggcucauuccuuggcaguuugcccuaaugauaucccucaggggcucucagccucucuucuucccauauuuaaucguguuguauuaaucugagugaugcgcaaacugugcugcacaaauugucauuuccuacaauauuuucuaagagacucacugauuuuuuucaguucagauuuuauuuauggucuaaaguuugacgcuaaccauguuuucaaguugaaucugcaugugauucccaaggagacucuuuugccguguguuuucagaggggccucugagacacggacuuuacauguagaguuggugagaacagugugagcugugucacuguguaaaucguucuaugaugaucacucauccaugauaccuggaacaugccuuuguguuuagagggucagcagcuccucauuacuguuccccuucugugaauuuuaguuaacugccugucuccauggaucggcugcgcuacucuacccgauguacuggcaacacauauauauccccgugcuuccuccacaccugcuggacuacugcugguaagcuggccuuugccagaguucaccauugggaaaaaaaccguuagauuuggucaguauagauuaaagaaaccacagaaacuugauuuaaugaguacuuuaguauguaucagagcauuuucccccaaagguaaaaauuuagauuuggcaagcauaguucuuuaaauuuugcaaauuucuucaauaguuauguagaaaaaaaaaaaacgauguguaacuaagaaauauaauuuuauauuguggcacaaagauuucacaaggguucuaaucuacccauaaucccauuugcucuaucgggguuagcuuucauaccuuuaccaguggcagccuuguccuucacaucuuucuuuagaagcacccuaaaaacagaguauagucaaagagcuggcuucuaagacaaggauuuuccgagucugguauaaggcaaaguuucagccuaaagcaaccaugaaaacaguguguaaaguaugagaguaacugugagaacuggccggcuuuagaaacggcucccagugcgcucaguaaucuugauuucaguuaggccaguugacacuagaacaauguccaauggccuccuuguucucucagacuggaauauagcaaggcuuguauauuguaaggcuagacaaggaguagacuucggagcagaaguuucgacuguauuuggugaagcuacagaagagcuagaauucagugcaauaguuuugguauugauggagaaagaauuguuuucguccuauaaacaccugcaugcagagcuuaauuuuaaauaaauugguugggauuucuuucuccaaaugaugcauuuguauacaugcaugauucacacacacacacacacacacgcacauacacacacauacacacacacacacacacaaggcaggggagagaaagaugggaggagaagagaaaucauuuguuauugaugguuuccucauaucuaaaagccaauauugguaaaaaucaaaguucuuuggaauugaugguaguuacuuaaaauuuuucaagaaaaauauuauuuaaagguauuuaaggauugugauuauuuaaauagaccaucuuucuacacaggcaugguagguguuguauuaaguuucugugacuagccgucuucagaacagugcauguacuugucccgacugauugcacugcuguacuguguaucuccagaguggaggaguagugcugcccaugcugugaaguagguaggcagugacucacuccugcagcucuuuccuuggggaacuugaaaggaaaaauaguuuuggaaacuacaggauguaauuuaauuauauugugaaguguaacacacacaaaucuuaaguagaaagccagaucaaugaguaagcuuuucuguuauucauuuuagaguuuuccuuugaccaacacacuuaaaaucuuuuuuucucauucagagaauguaguuuuuucauuuugacauagacaguagauuuuuauauacaacauucuagaacuaaacauuuaaaaaucucuuuccuaaaaguuuuauacaguuaaaaucauuuugagaaccaaugauagaauuuuugcaauauuuguggcaucauaauuuuuuuuuuuucuugguaacguguucuggcugccuuugauaacacaccuuucaggucaauucucugucauguaauuuaaauuuaaauuuucuacaaguuaauuuaaaaguacucaaccaugcacacauucuuuccaacacucuuucuugauucugaugcagccgucaagucuuuccugcugcuucuacucuaaguagagaagcuccuccccuucucgccuguuacuugcuugcuugcuucuaaugcuuagaaauaguccucuuaggacugugguccaauccucagagcauccaggacagguacuccuuaguucagaggagagaguaguguccauacagggucuuacuugaaacuuucugagccuuaaagucauaugagaguuucagcuuucaucuauucaucuauguaauuuccuucucuuaucagaaaauaugguagauugagcaguuuccuaggaaaaugauucucuauuuauaucauugauauuaggauuauacugauauaugcugaaggaagaaaaaaauauucucaugggucucaaggucauugagcaaauaacucacaccaaguuccaaauggggccacauuuucugaguacauguaucuugguuaacuuuucagaaugauugggauauugcaaaucuugaaauaguuguggauccauaaaauauauuucuguuugcaccagguauuggugaugcgcccuagacuuuggaggaccauaaugcccucuugugaccauagaugaauaucacaucuuguuccuuugacgguuuuacuacauuguuggucuauccaucuauucauccaucuauccucccaccaacucacccacucacccauccaacauuuaaagaccaccuacuuggcaagcugugaaucuguaaugcaaugaauaagcuucuuuacuuguucauucacuggaauuagaaaauauauguacguagcuauguaugcagcucucuguacacauccaaguauagaauaguccuauaacucuagcagagucacacaaaagagacaaagguggcaucuggagcaguagugacagcacucuugcuauguugagaaaugcucuugggaggaagugacaucauuuguguuuucuucuuaagcaaaacaacaguacuucaauauggcacauuuauugucagauacuuaaaaacugugaaguauaucagaagaaguguggcuguagaccaccaggauuauaauaaauucuuaucuguucaguugguacuuaaguuggucauuuaguuggcuucccugauuauuucuuucaaauauucaaauuuagcuuugaagaaaaaaaauuuuuaaaaauucuuuuagacuacgugauugcugcaauaguaugugucagggcaacuucuuuaugaguaaacuuagaaaggaaaaaagugauuuugaguaaaguucaaccacaaagaagaauuaguuuugugcugucugcacugucuuuuuuaaauaguuucccagacagacagcaggcccugagacagccuuacaugugcacaauagagcaucugggucagcacugggcccuccugauucaccaaagcccucaucaaaguaggauggccagcuaggacugcaaagugacuguccaggagagcuggcuugugccacgguaggauauguaccaucgagugagaaagaaacaccaauccauuuggcucuaucaaaacugcauucugucauuuacgauuuuagaaaauuauacugcaguguauucaagcaucuguauguuuuggauuuugcuaaaaacuagugagaaaaaaauaaacuauacagcgaugcucagugaucccacuugucucugagcuacgcuaagcaaaagcgacaggcaaugugaauuacuagcguaguagugaaauuuugcguguacacaguaaugagaaguuacauggcuccgaguuucugggaucuuggauauauagauuacuguucagucacucuuaacugaccuuugaacauucugagaugacuugagaggucgcaauggcaaggcugucugguaacaucagcuguuacugcuucucugcagcaaggugcagaggagacugggcuuuucuguguccuaacagugaugcucagagcauuagaagagccuuugagaagcaggauuuguguuagugcaaaaggcuaaagaucagagauaccuauaaaagaguucucaaaaguguguuuuuaaaaaguuauuuguucucauauuauuuauuauuucuauggacauccgucugcacucaugguuuucuuuuugauaauuugaaauuucaagaugaauacauugcaucuucuauuuccuaacaaugauuucuaacauuucccuaguuuguaugauagcauguuaaaaugacguagcaucuguauuuucugcuggaguguaagacccaggaggaagugugucauuguuucucacggcauccaaguuucuuuccuggugccuggaucuuguaugguucugaaguuaugaccugaaauaguuaauucaaagucauuauuagacuuaacguuuuuuauuuaaacuauucuaucaauaacaacgaaagucaaaugaaugugaaggugcacaaggacaagggcacagaggggcugacagugucuuccucgcugcucuagagcagggagaacacagugauaaagccuaugccugagugcccgugacaucauaggucacugacggagagauguguguaagggaaauggagauacuucugacagucauuuagaauguauuugcauccaguaccuuugaccuacacccugauagucuucuuaaauaaaauguuauuuagauauagaacuuuugacuuaaaaauaaggguuuuagagacuuugauauaaaccauucuuaaauguauuaauggcuuagaagauuaaauuuaacuuuuguacauuacauaauuuugaaaaacuauaaugucuuaugguagacugagcacuuuaauuuuugagcauuugaaugacguuaauguuguuucaguuuuaaugaacuauaugaaucuauacacacauauauauuuuuaauuuagugccccaaugccauaccugauuggaauacacuccagucucauagaggugaguaucuuuuacaguaagauaguuauaaaacuaauuaauuagaaguaauagauaaaagagguuuuuuguuuguuucuuuuaaaagcauauuugacuauuucuaggauguaugagauugacauuauagaacuacucaagggaauauuuucagaaagugucccucaaauaaguucaguugcuaacguauacuggucugcccugugacaccaugaaaccuaugggagugacugugcuuuaagucacauggucagcuuuaauaagaaaauuagcguucccuguuggaccagugaugucuuacaaccugagacuuucuguaucuuauauguguacaauauuuugaaauuaaauuuuauauguguaugauucaccaagucaguuuucuuuuauacuucuuuauuuccaguuuaucaguugauuugccaaaugugaguguagcauacuaaugauaaacauauuaaucagacaugguggcucauucuugugguucaaaucugagcuaaagggcugagcaaggguuacccuagugcuaggcccgccugugaaguaaggagaagacaaagaauguccuuuccauggucagaguuucaguccuauuguagaagauaaaguuaguagggcuuuuuucccccugucauuucaucauuucaaaaaaauuuuuuuuuuuuuuugcuuacuuuaucccuaaacuguaacuccuuaaacuuuaaacgcuuggguuuauaaucugugagauuucuagacaggacuucuuauaagauuggcauauuaauuaccaaaagguuaaaacguaaggcuugaguuagccgaguggcaucaguaugcucgcugaugucgguuucacucuaacaaaugucuugauugcugauuguacagaaucacuuuaguaacucagcacaguugcuaaugagcacacugacgaguuagcugugcuuucccuacuaguuuccaguacuaggcuuugcuugaucucagaagaugauguacuaaaacggagccuaauucucuagaaaauauuuaauuauagaauucuacucucaagauuaggauuuuuuuucgaaaucuaauaguucuuuuguuucauuguuacuaaaguuuaaauuuuaauggauuuuaguagguuuaacauuuuuuaguauugaagucauagugagauaaauuugugacuccuuauauuuuauuaauuuuaagaaacuguuauaagccaaggaugauguauauuaaaugaaacaugaacagauagguguuaucugugauuagauuagguaguaacccaaauuuuacuacuuugacuuucauuuaauuaauuacucagauuuuuauuccuaauaaaguuugauuuuuaucauuucuauuuuaaauguguuaauaguacacauaauuuuauaauauauuuacuuagagaugaaaauuauuuaaaauuggagagaguacuuggugaucuuauguuaauuuuuauguguggaauauaucuacaaccaccuuuaagacaaauaauuagucuuuuccaaauuaugauggaugaggaagcacauuagguauuuaauuuaucacauauguauuggcuacuuauaaagaaaguuuaaauuuaaaauaauauuuugaaaaauuaagauauaauuaaaucccccucaaucuuuuugaaauugauuuuugaguuuguuuaauauuugaaaaggacuguuuugaagaaaaagaacauucaaacuuucaguugguuucuuuuaugaagugggacuagagcgcguagagcugccacaucgucugugcuuuguuuaucuaguuuaucagccuguguucagcuugcugacaggggaggagaagaugcaguugaacuuccuuuaaacuugguacauaaggaacuugagaguaggcucaguaguuaagaguacuggcugcucuuguggaggacucaggcucaguucccagcacccacauggcagcucacauuugccuguaaagucaguuccagagcuucugacucugucaugcacacaaacacacaggcacaacaccuaugaccauaaaaucacaccucuggacaguuuccuuagacuacaguaagaugauagcucaggcuucuuuaugucacuaucaaacagauugaaaguaaccuuuggauuuuuuaguuuuauaaaacauguuuuaaacugaauauagguaguuggggaguuaauauuugagacaacaaugaguuacuuucugccuuuuuuuuuuaguugcaacuauuuuuuaagaaaaaucuaaaaaguacucuccugguuuuaguccuaacaauuucaacuauuaucauuaauuauauaaaaaccuccaggcucuaaagcgugacuuuauaacauauaaacuuauguucuuugaaauucccuuucauuuuuuuuuauauaauuguuaguaaagaaugcugguaaaguuucauuucaaaauacaaauuuauuucugaaguaagggaaauaaauuuuauuuuuccugaaccccagccuucugugugugaaguuaagugcugucuaaguccuucacugaguaauuuggaagcuacagacacaaaggcagccuugcuuguuuucuugggaaaguucugugauugcugcccugugccauuacagcacaccaguguguaaaauguccauagccacagugucugcaaacguuuacucuaugagagaacucacacacucaagaccgcacguucauuaccagcuucucacucuggggccagcauuauguuccuacuuuucugaagaaaauucuuuucauguguuguuuuaaauugcaccccacaaaagauauaaaacuaugagacagaggcagaggugucauuucugacucguaugccuagucagagaaggguuggcuuacauguacuguggagagaaacaagagaguacuaguaucaguacuaggacugaauuguaaucuacuuucccccuuuugcuuaaauuaauuuauuuuaauauuaaaguuuuaguuuauuuauuaguaaugagcagauuuuuuauguuuauucaguaguuucaugaauaaaauuuaauaauuguuaucugccuuaaaaacuaaaccaauaggaaagucuauauaucacauuaauaccauuauucagacguuugugcuaaugucaucaaaauggucucgaugguacacagccauuacaucugaauguuuggauauauucauuucugacuggaaaaauagauuuagcguuuuguauuaugucagcuucuguggcaugagacaaccacacugcuuuauaacauacugaacauguuauaaaagagcauuauauauuuuugcuuauaaauuguuauuaaauuauaauuaauauauauauaauaguuauauauugaaaucuuuuaaauauuugaacacuugaaaguaaaaggaaacaaauauauuuauagacauguauauugaauuucaguuuaaucaccagaaaaaugauuuuguuuuauaauaacuuggagguagcaucuuuuaacucuaaauuuguaguaauuaugucuuuugcaagacaaauuuuagagccaaucucccuugagaauacacagucuacguuguggauuucuaaccacuuagaagugaugaugcacuuaacuaaaaguccaaagugucuuguguagaaggacacauaaaaauacuguauugaaauuauuuacuaauucacugguaaacugacaugaauguggaauccuggguuuguggcucuaguucauuccuugagugcaucacuucccuuugaggaguguugugauaauacuagauucgguaauuuaagaaauuaugugaaacagagagaauaaacuguauuuccccuuuagguauaauuagauaaaguuuuuauacuucacuauuauuuguaaacuuacugagauauucuuacuaaauuucaaacaauauggaaagauaggccaagcucagagacuguuagauuuuauucuuuacaggaggaucugauugggaacuacaugguaguagucucuccaucagcuuccgauuucacuuucaggccuacucauugauaccuauugguagagcaguauaggaacauauuuauucacuugaaauguagaucaguacuguagucguaguuauuauaaauauaauuauuuauauagauauuauauaaucuuuccaguguauucaugcuaaaauagauuugaagcuggaaacaaauuaccauaucauaggauugacauucaaaugguaaaggcuacaguuuuuauauuugauguaccucugccuacuuuacaaguuuuuguugagcuaaaucuuuggcaguuauauuaauuugguaguagaugagcaaguuuuuaaguggaagcauuuuagucaaaucucuuugaaugaguuauagugaaauuuucuuucuaagaaagcaaaguuguuuacauuauuuuauaacguugaauuucucuuuuuaauuuuccuaagcugacuauacuaagauaauauuuuuguuuccaaaugcaucuuaauuuuguaagaaaaauauauuaagguuuuuuuuuucaaaauuguguuuuuuaaacagagagugaaaaauaaaucauuggaagaugugguuguguuaaauguugacacaaacacguuagaaucaccauuuaaugacuugagcagccugcccagugaugugguaaguccaagggguauccguggugaacaagaauguuuguuguugaacccucaauuuacaguuuuucacuuuguaucugaaccauuaaagucaguguauaugaggauuguaggaagaaucaauguagguucuauuuuuaauauuuuuuccuuuuggcaguugagauguuaaauggaauaccauauuccuuauuguaaaaugggaucauaauuaaaaagcuagaugcauucauuagguagaguuucuuuaaacaucaagucucuucaucucaucuuaaucauuauauuacaaaguaggcauucugucugccuaguggcaugucuugcgaagaaugagagaguuuuugaaggcacgaagaagaaggggccaauuaucggcuuuugcuucccugccaccugccagcucuuucccuuuuaauuaaugaucugauggcacuggucaauacaauaagaaaugcuuguacaguuggggucagaaaauucuggcuuugaucucucucaacuuucugaaacauuuauuuguuuucucuaaauuauuucaguuuuauuuuaaucuuuccuguccugcugagggccacaagaaugaaaaccuacaguucgucaucugcuuuggcagagcaaagaaugcuuacuuagaauucuauuuguaaauuaaacugcaaacccaguuugucauaaaagacauuugauccuuuugaaaugacgaaacuguccuuugucuguaaagcugauaaauuaagugccaguucucuuugggucuuugaucuugcuguguguguguguguguguugcgcaugugugguguuagcagcuuuuaauaggauauauucuguauuuuguguuaaguaguguaaaauugcaguuuuggcucuuaugcucuuuaauauaggccaaaauugcaaacuagugcuccuucucuauauauuuaaugguuacuuaaauaucuuaauagcaucauucuaaguuuaaaauaacucucuucuuaaaaagaaaaacccucaaaugcccauucuuuucaagguuauuaaaauuugagaauugaaaguaaacuuuguaauauuuuucuuuauuauuaaagaguuugaaaaagaacauuaagacuauccaauuuaaaaaaacaaaccaguucuaaucuagcuuguucuuauagccaguggaaggaaaaauggaaauuuaauaucaaagcaagauuacuuaugcuuaucaauaaccaaaccauucucugagcuuuaagcucauuaaacugaacuguguucucauugcaguaaaauuguucugugagcaauccacacucggagcagugggcacugaugcugccuuguuacgcuaaggcagcgggugcuucuucauggaguugugcaggcugcugggauggguucucaguauucccuagauagugacauuacgaaaacagcauugcagcuuuucuaaccauucuucuuaggcugugcacauuuccuacucuuacgcuuuaggaggaagggguguuuaccggagagggagagaggaacuuagccuuucucuccaugauauugaaaucuguagaguguacuuagcucgauccuggagacaagccuuugaaggcucagcguaaugggaauuccuuugaacugagaaguacuucucuuauauaauuuuuuuguaauuaagauauugauuuaaauguauagagaugcuaaccagcauucagaguuguacagauacaaaugggagguuacagaagagucgguaugcaguuuccguagcaccaaccacaucaggcugacugccccgugagccuguagguaaaagaagccuugccggccagccccgcagauugcagagaagcugcugucuccuggccucagaggggccgauagcugaagacgugguaaauaagagcuccgagauagaacgagagccauuuguugaaaauaggagguguauuaaugcauuccuaaaguauuuuaagcuguuguucaaagcaucucuaauaagguucucauuuucauguuuuucaggacugcccuuuuagagcucugggggauacacaauaaagcauugcaacacaguuuaaaauggcaaauguuuuaagucagaucugauaaacuccugaaugauaacucaguuuuuaugugugaucuacauuaauaaauaguuuugaagccugaaagguauuacuauuggcauuguuugauuaguuaauaaguuaacugaaauuuaaaaggaggcccuuuuaaaguccuucugcaaagcauuuaaacuaugcugcuuacaggcugggugacugugugcaugugcacucuauuacugugucacauugaccaguggccauggcugcucaaaggucaguggucacaguuguccugaauuacuggcccuuuucuccuguggacccucuggugcguugcaugcuguaaucuucuuaauggcuucauuccaauauucacacauaauauuuuagauuuauugacuguuagaaauacuaccacgccaguagcacuuccgcugcucuuaagguauuuaaaauuggaaaaauaaaucaggcgagcuucaggaauccuuuguuuuccuuuugggagggaaaaaaaccuuucuuccuguuuucugacaagaacacuuguuuuuugauuccaucauuucacuauagauuuggaucaucaaaaaaaaaaaaaaccaacaaaaaacaaaaagaaggagaaacaaagaaagaaagaaagaaagaaagaaagaaagaaagaaaaaaaaagaaaggaaggaaggaaggaaggaaggaaggaaggaaggaaggaaggaaggaaaaagaaaaccaaagugaacccccauguuuuauugugaauguuaauaaggacauuauuucacagaaaccuuuugaagacagugacacacugaagcacgcaguuguagcuuguauugugacuuuauuuuagugauauugcauguagacauuuucaaacauauguaguugggauauuuugaaaugaagaaguaaacuuuaggccuaaguaaccaucaaucaaaguuaguguuauuguaguguguuuacgagaguggagaaaaggcucaauuauauauaacaggagaaaguucaaaugaguucauuuaauuucagaaaaugaacuacugaaaccuuccauuucauauauuuauaggcaaauuuaguuuaauuguauagcaguuaaaauuuugugucuuaguuuuacuguucauuuuaauuuuaucauuauuaauauuuuauaauaauuuagaaaauguuaacuauucauaaaguaagaacauagucaauuacuugcuggaaaaucaggcugauaauuagaauuauaguaugauuuaugaaauauguuuucaagaugaaagcugcugagaagugacagcugacgaagcagcaauaugcauaaccaccuuucgaugacuuuucacucauuaaagagcgcguucuuguuuuagguaagacaacugaagcacaggaaggcuccuguuacuaggcagagcuuuaguggaugagguugguccauguaucugugucccaaauagucgagcacaguuccucacaggagcugucaggugcguuuaugagggauggguagcuuguuugcaguuucauucaaaggcagcucgucauucuugccuugugaaaggaaucagaacuugauauauuugauuuaaaaaauuucagcaccauuuuuuaggguauuuucaucuugcaaauaguauagcuggaaaauauuuuuuccuaugauaggaauuuacaaaaguaucuacugccuuuaaauguuauuauguauaauaaucaguauaaauaaaaucacaaacaucaaacauccacugugugccuauucuaacuuaggggcuguuauacuagaucgcuaugcuugguauaaaaccuuuuaaauuacuagaauaccaggaagugcuucuuauaaauggacuuauguaaacucuuacucuuguuacccuuacuuauuagaaagucucgugaaggaaugugcuaaugauuuuauuaugaugugaaaaaagaaaggaacaauuuuccacuugucaacaaaaauccugaggagccugaagaacuagagaaaacccccaaaacacagauguuauauuaaauuuuugaguagcuacauuuaaaagacuuuauuuguuugggaaucaguuuagaaaagcauuggcuauuucagaguauuuaaaaauuaacuuaaaauuauaaaguauauaaauuagucucuuguggucaugaauauuaucaauaaauguuuaauucauugacuggauccucuaacaugaaggcuuuaacaaguuaaaugucacaguauauguuauaaagaagauagggcccuugagagugugauauuaguuucagguuggucacaguucugcuauaucucgauuguacugaauggucagugaggucuaccaaaugcuugcuguagucuauacuggaaagauaauagaacugucuucaaauuaaagcauaucguggagaccauuuguuucagcuugucccugcagaggcgugugcguccucaccucagcucccaggagucagguguccguccccccucugccgcgccagccucugugcugugcuuuauaaacuaagucagcguuagacgagugaguacugaugagacgcacaguuacacuguguaaacuucucaacacagaaguuugcuuuuaaaaaucucacuguaguuauuauuagaauauuauauaagaauacuuuugcuuucugaauggaaaaaagaaagaaauccagaauguauuuuuuuccuauaguacaauguauaauacauuuuauuucuugccugacuggaaaagcccacacuaugaaggcuuucuaauugugaaaacuuaucaucuuuuaaaaugacuacuuucuuacaggugaucauuuuaaaagaagaaguguuuuguuuguuaguauguaaacuauuacagauguuacuauuucucuacucuuuucuuguauaguuuaaauauauagggcucaaauauaagaagaagacagggagaacuagaaacaugcccucggugugcuuauggauauuucagggcucuuuguuuucucucacuugagugagaacuagacaaagccuuagugaaucuccucuuuauaccucucuuuuggucauuuaugaaguuuaguguuugcugccuuuuggugucuauaagugcucaugaaguccaugagcuuccucaggccuuucacuugaaaggaugucauuccccaccccuccugcccucauugcucucuacaucugcuguauuaguggcaugcuucuguuuucuuacugcuuauuaggagggccaauggaauggcaaacuuuccuuuucaucuuucaaagucuucuccuauuucgucuaguccuauaaagccuugacucccauuccugaagacaguauuaugcuguggaaugcugagcacacuuccuuggaaccguucuaaacuuugcucaugucguaaugaacgacauggugagcuuugaaaggagcuacgauccugacacucgucacagaugcucugcuugagagaacuagaguuaagguaacauccucucugagacaggcagguuugcuuacuucacuuugaaacauuccuuggcucagcaugcauuuaucagucaccuccugugcacucauauccugccgagagcggacacuauagugguaaauaagaaaacacacauugcgguuuacaggcacuuuacuuugacggugauucaucuaguuucauagauguagacaaauguuauaaaggaaagaaacaggugcaguugaagagauugacauggcacuucuaguucacugagacauggagaauagaccuguucuaggcuuagauucagggaaaaugaauuaagcguuagccuuuauggucccuaaaggacuugccuuucaugguaauguacaggguuuugaaagcgcaauguucuucucuggcuuacuaugaccauuuccucauggccugccuggcaacugaugaugugucaguucauugaaugcuaaauuucagguucagcaguaggagaaacuccaguuuggucuaugcccuuaucucuacgagggacacucuguugcauaacacuguuucuacuuuaagugauaaaucaauuuggguacagguuaauaugucauagcacagagaauucaucagucuugcucaaaauauuucuuucauccaaaaccgaauugucagacccgaaaacacauguacacguaacauuauacagacugagaaaguuauauuuaggaauauacagguggauacauaaaugcguguaacaacuauuaaugaaaaaggagguccuggacuugaaggagaggaaggaagaguauaugggagggcuugaaggggggcaggaaaagggaauacuauuaugauuauauuauaauauccaaagugcaaagcaaaauauuaaaaauuauuuauuguauaagaaguaaaaggagcguugauccaaggagcgaaguucugggaggaagcuuccaucucuaaggcacagcagccccuccagggcuaagggauccgccccauuauuuguuuucugcuuugcuucagaagaaaugagaaaauuaggcaaggcaugccuaccccaguucguauucauuugcuugguccuacacuaagucacaaaggaaauagcuagguuaugcaugcuuuguucagauuuaggacugccauuacaaaggacagggagaaugggugacuggauacugguggcuaucagcucuacagccaggaagcugaagugaaaauaauuuuggcaaggcuuagauaccauuuuuauugacacaaacuuacauaaacuuuucauagcacagcuaagcucauuguguuuuuuuccauaucaguggccuacauagugaucaaaguaugacucuuuuaaaaauuuauugucauguguguguacauauuucugaauauauaaauggaaccuauuugguuauuuuuauguguacguuucuagggaugaucacuuguuauugaauaauuaauuaugcucuuuccacucuuagaauuucuuaguucccgggguucuuuauguaggguugagacuuugggaucgcucugucuguguuaccaugccuguugggguucuccuuguucugcucauguugagcauucauguuggcgagaccuucuggcuauaccuucuaacauauauaggagucucagccucgcagcaagcccccucacccucugcuccuucuuaggcagugauuccugagccuuaggugcaaguguugucuuguagaugugucauuugggacugagcgccacaaugcugcacuuugaucaguuguguuuuucuguaauugucuccauuuguugcaaagagaaguuuucuuguggagggcugaaaauaacauuuauuagcaaaacuuagaguuagguauuuagcuguuuuaaugaagugcugauuuuauacccaugacuuaaccaccacuagguaauuagccaagguaugcauguuauuuaugguuccuugggguuaggccaugcugaucauuguuguggccaaacauuuucauccugacucuuuaccaugaugcugaaaauaaaauuagaauaucuagguaaaggagucauuuuucuuuauccgaaugauguuauagaagugaagagaaccccacacuuuuucucuuacagacacccugcagacaugcccguccuacagacuuacugauuucuuugcccaguugugauggacacauggucccacgcucuguaccauuugcccuguuacuuguggacuuuugucuuuuuuucacagucacuucacugcuaagagggacaacgugaacaguuggugucaauauuauugauuuugcuguaaacucccacugcuaaaauccugcuucuaaugcuaggaaugguugcuuugacacccaaauucuccuuaugucaagggaaucuaaacauguaagaugagaaauaaaauaguuauuucuaaaguuuuuuucauucaauauuuuuugaccuuuaaauauguaacuagacugaaaauauauuuauaggcagaaaagugucucaaauaaaguguaauaaggguugugauguauucuuuagcaaguuaggguucaguauagcuacuuuccuaaggaaaaaaacgacucauguuuucuuaguguaacaggauuugugguagccucauagccaaaggucuaaauauuuuucugaauucugaguuauauguuaauuaaguuuuccaauuacauaggaagauguacauuuauuucauaccuaaagguagaagcuuggaacuaaguagaaaaugcuauuucccagagcagauauuacaaaggguucagaagagacaccgucagauuauagauuauaaacugcuaaaagcuaauuagcaccaaagggcaaugguaaccaguguugauuuacugcagugaucuaaaggccagugaacacagcaaggcucaauauagucaguuuauauuagauuaauucacuucuuucuaaaauggauuuuuaaaacaauuucauuugauagacuauuuauugagcguuaguauccacacauagaaaucuugaauucaccugucccucagccccuuggagcugcuuagaucuacugacaauuguggcaaaauagaacaaggaaagaaaaaaaaucuuugugauguacuugaaauaauacagaaauaaacaaagaaaaaauuaucauauuucuuucugagaaauuuugacccuuacauauuuauaugaaauuagauaggaugaccauuuaccauaacacuaaccaagagaaacacgauaagauccacacuguguaugcaugacaaguucuguagaaaucugauuuacaaauucaaagaagaggugaaauugauuuaaugauauauuuuauuuaauuccaugcucaaaauaguguuucacaaauauagugaacauaaaauauguugugagguuaccuugugugcagaauagucuagauaugaggucuccuuuauacuuggagaagauauggacuuggauagggagggacauuuauuugcucaugugacugauggcugccauuuugggaaucauaauuauagagcagggacuuccuuuuucucuuuucuuuucuguauccuggaugucugcaaagagcucccaagcauucaccaggugacugacuguagaagugaaggcaguguccuccuuugguugggaagggcuuggugcucugacaaauucucccggauagcuuggguagugauuguacaguccagggcauggucaaggaaagacugcaguguaugaugcuugcaguuuccacgacugcgugcugacgcuccuaucaguacugucaccuuguuucaugaagaacugaaaugucaguuuuacugaacauuauaaaucgaggaacuuuguuuugcaaagauacaagggauggcuuuuguaaauacguaguuuuucauuuuuuuuguuuguagaaaauauguuaaaaacuuaacuauucauuuagcuuucauaauguucuuaaccacuguaaguaacucccuuguaucauaaucuuuauggguagaauaauuauugaauccauauuuugauaauugccucuauuuuuucuuuaaauauagaaaaauaacauuucgaagcagaauaaaggacuuuaagucuaacauguguuugugaacugcauuauuguuuuaauauguggauuaccuaaacugagguuagauuugaaaauaaaagcuuucucugaaaugaaucagguuuagcacuuugugacuaaaugaauuaagcucuaaacuuucaucugaaucuguggagcuuggauauaaauugaaaagaucacagcuauggggagaagaccuauaccacaaaggccuuucugcauagauuaugaauaccauaacucgauaauuuuucaaaacuauaguuauaauuggacccaaugggggucuguuucuuugaugagaucacaguaacugugacuuuacacucgaaaaugucacuacugugaagguuuaucaccuguagagcuggucuucccucugaugcuguguucauuucucauuagcauuauucaaaguuuaguuguuaauuagguucacacuucaauuacaaucagcaucuacaagaguagucaggacuacuugaacaaagaaauaaaaacauucccacuugcauguauguaaaggauaagugauaugauuguauuaccugggagucuauacagauaauaugcuguguuaggagaguaauacaguuaaauuuaacuaaauuuauuuuuuauuucuauuagaaauuagacuugggaugcaacuucacauuuuucuuuauuuuucauucauuauuuuauucauuuacaucccagaugcugccccugucccccucagaguucuucccccuccugccuccccuugaccacagaggauggccccuacacucuucuguuuaaaacauugauaaggaaugaauauggaauuuuguguuuucaugaguagagacuuucguuuuuuauuuugauugacaauaguuagugaaaugaauaaaaagaguaaacacccugagugugagcccaauaaaagucaguccgugggcguagcugcagagcaccugaaguuagaaagaagauagaguuggcaggaaauauuguaauaauucaaaaguuuuucaagguuugcagauucccagauaaacuaucucuguuuucaaaacauucguauuuguucugaucacugauuaauguaucagugauauagaacuccagucuagcauguggugguaagaaacaggggacacgggguuugugucccaaguuuaccccagaguagccagucguggaaacaaaguaguuccugccauuugccccaacuucuuuuuauuucuaaaugagagcaugaauguuuuucuuaggaaaaugugaugaaauuuaaaugagacaauguaaaacacuuuuauuacauaauuuucuacucaugauauggucucuauaacuuuaucucuucucucuugucuucuguuaaugguaaaaagcgaaaauuacuuaugcaaaugaugccuccaaacugaaaauaaaauuguaaaugaucuugcaggacucauaacaaauaacaacgcaccacagaaacgagcgcuccugagccagcuuuaucuccaaacaaguagacacacguuauaauugcuaaaaaucugcagaaaagugccucacaagcaguuuacuguaaauaauuaaagcuuauuuaugucaagaggccuugggagaaaaaagagagcauaaaccaauuugcauuagcacauugcuauccucucucgcucuuguuucaauuaacagagcagcaggugcucugugcagcuaaaaagauaagcuaucugggaggaggauggauuuuggcugaccugcagacauugcgcuuugccugcugauuggguucguaccucgcuguaccaauuucugagguguuaauuuaacuguuccucucugccaugcaggucucggccuugaaaaauaagcugaagaagcaguccacagcuacgggagauggaguggcucgggccuuucugagggcucaggcggcuuuguuuggcuccuaccgagaugcucugagauacaagccuguaagcaauccuucaucacuguuguaccugcuuuuccacagacccuagaaugaggcaaggaaaaggaaacaucuuagugucacagcugagggacucgccauggcucgccuuuaaaacggaaaacgugcuucaaagauuauuuuugcagcaaggcgucagcucccgcuaaagcucuuuucacugucacuggcuaagguuccccgugaucuuugccugucaucaacuuagaugucuagaaguggaauauuuacuucugagugaauugauaauuuauguucaaguucuuaaaaucauuuaccugaucuuaaaaucaccaugaaacucaacagauacuagaacuuauuaacagcuuagugagggcagggacaaagcaggagguaagaaaauccgcacuuuaaaucauggcgauauuugaauauuuaaugucuuccugguucauaacacuuucugaaauggccuugcccauuuagcauaucuugucacaucuccccuuuuauuuuaauucccuaaaauacuaaauuauaucccagaauuuagcugagcuagaaugguacaagugaagcccacuuguuucucucuaagguugcuaggcugacuguauaaacgauccuuaaaagaccauucuaggaccagaugcuuaagaagcuaaugugguuuuacauuuguauuuugugugccaccgcaugcauguggaaguuagaggacaccuucaaggugucauuucuucccuuccauuguagaaguccugcacauauggccucagguucaugcauuugggggcaagcaccuuucucugguccaaauguguacauuuuaaggguaagacacauuggauuaauaaaaaguaacacaauggccugccauugcuagauuacuuuuaacccuuggucuauagcauguuuggaaggugaaaacuguugugccuuccugcucugucuuccacaguugauaugcagaccuguugaccauaaccugucuucuuaguggcucucaucauguagcucuugcgcuauuagagaauuuuuaguggaucaauauaucuacuuccugucugucuaucuaucaucucuaucuaucuaucuaucuaucuaucuaucuaucuaucuaucuaucuaucuaucuaucuaccuuccuacuuaccuauguaucaucuauaucuuauuucuauauuugucacuauaacaaaauaucugccaaaaucaguuaugaaaagaaaaggccuauuuugcauuguaauucaggagguuuaagucuacggugguccuauaugcucuugggaauccgaugacagggaucauacuagggaguaauagugcacacauaugacugggacaugaugaagagaaaggaggaagggguugcguucuguaugucccagucaagggcauuccugaaugaacagaaauccuuccguuagguuuccaugucuucccacaggcuuccauuuucuucacagacuaauguccauuccuuuaaucuauaggccuuuggggaauguccaaccauaucacauauagucuuucuaauguauauacauuugaagauauuaaagaauuuuaaauauuguaccucacugcuuauauaauguggaaaaucuuaaaaauucuaagagucuccuuugaaagaauggaaacaaccaucugaaugcaguugaguguguuaucauucauguuacgcaagucaaagaaaggugagcuugaaagacaaaaauguguuuugagcccacguuuugaucuaccuccauguggccaagaaagcaguuggauuagacgaguccuuugcaaucuuagagcccuacacccagugacacaucuccuccaacagggcucacuuccuaguccuuccaaaacacuucuacuaacucugaacuaacuauucaaauauaugggcauuuggggccauucucauucacauuaccacaccucacuuccuggcccuuaugggcuuguggccauaucacaauaccgaaugcauuuaggucaacuucaaaaauccccaugguuuuuuacagacucaacacaguuuaaaaauccaaagucucuucugagacccaagggacucuucucacuugaacccaccguaaaauaagaaaucauaucacauaauugcaacauacaguggcacaaaauauaccuuaucacuccaaaaggaaggaauuugaacaugggaaauccugggccuaugcgagacugaaacccagcacuacaaacucuaaagccugaugucaaagggcuuagauggcuccacucuucuagcuuugcuuccugcaccacacuuucuccguucugcugcuuucacgucuaccguguagcucuccuugacugauaacccauggaucuggcacccauaauaucuugggguuuccgacacaaaccaagaauaucauagcuucauucgauggucucucaaggccucucuuuuaagggacuccagugcaauaugccuggccucuguggcucuucuuaacaauggagggagauucuauaacuccguuacucauguaucuuucacaguucuaaagcccacagccauguggaggacacugccaaguuugacuaccaacccuuuagucacaucaaaggcagcucucauuuuguuguuuauguuuaggagcagcaaaucuggccuuuucaaaguugaaaacuuagcuggguggguggggucuugcguuguguuuacugcuuccuccauucccuuccagaccaggccuucuuuagccuucuuaguuuucagcacaagccugggcuccaacauuacauuuccugauguucuuuuucucuuaagcuguguauucucuauuucuuuugcuccacuuuuuccuuuugauugugaaccugccuaagugcaauuaguaauaacugucacuaagguaggcuuugagguuucagaagacucaugcaauuguccaugugccccaccccuaccccuuggccuuauguugugaaucaagaugagucaauaguagucugucuugaauauuuguccugaaaucaccucuaccaaggaaaugaguuacuuuacaguuuagugaauaauuaggacaagagcagaaagcugucacauucauugccaaaauaucacaagaacagucuuuagcccaguugcuaauauuguuccucucuaaaaccuacugaguagcgccuccauaguccauguugcucucagugguacugucuuccuagcucccacuaggauguccuguuaacaacauuuaaccacuucccuaguacaggucucauagucuaccaagucacuccaaacccagcauuguuaggccuaucagaacaauagcucccuuccgggggccagccucuguccuuacuuucuauugcagugacaaaaaccccaugcuugcacucucagaggguuagagugcaugaugguggaaugaagggauagcugagagcucacaucuugaucuagaaccacaagagagacagacauuaaaaggguuugcauguuuauuucagaacuuauuugaucauuuauauauuugaccuauaucuuugauauauuuuguuaggcauaagucaaagaaggaucaaguauagaaguuauacucauuucacgaucuuaucucuuuucaucaauauauuuugguguccuuaguccaauagaagacagcugcgaaguuuaacaagcuuugaguauggauucuuugacuagacauugcuuuaaaauuuuuugacuggaaccagguagggugguauucuccuguaaucccagccucagggaggcugagggaggagcgucaccacugguuugagauuagccugguuuacucagagucccagacuagcauccaggacuacauagcaagacacuaucucaaaagguuuaagggauguuuauagacuaguuaguuagucuugccaacuuuaucagauuaagaaacagcuagugaggcacacuuuuuuuauguuuuugggaaccuuuucugaagggguuagcugagggagaagaaccagcuugaaagaggcuagcaccgucugauagacuggcaccuggucugaaggaaaaaggagaaggcuugcuaaguacuagcuuuugcuuucucugcuugcuagccugcugugaugucaguauuaagucuuacacaugugcacacaugaaaucuuagugauuauauugcaugcauaagaccuguacaugauuaagccagccagaauaccagcacaaaucagguaaaauguucugcagucccaucuggaacugagaagcuauugguacuugauggcuuccagaggagggaaaauacauuuucuucagggaugggaccucugagaugucauguauucuauaauaguuggaccugcaucuaugcauguguauacuggcagcauuacguggacuugguggguugguguaggggaggagggaagaagggagggcaaagacuacucaugguaggcuagauagaccugcaacucugcguacacugacaguacuaaguagacuaggugggauagagacagaggcaguagagguggggcccagagacuacccaagccacuacaguaggcggaccugcacccacacaagcacuggcaguaggaccauaaaguggagucacuguuggaauuuaccaaccauauccauucugacccuuagaagggguuuugggucagauuuggaguugugaguuacagaaguccucuggugcuauacacagaguuuaaugcucauucuagugagaguucaggagaccagaauacuaagaacuguauaugguaaaggccaggcuuuugauaauuuugaaggggaaagaggaauuuuauuaggaauugcucuauaggccauucauguuguguucugccaaagaagcuggcuuauuuuacuaaugacccacaaauuugaauaugacugaguucaaaauguuguccucccacucuuuuggaauacaaauguuugcugcauacaguuacauguauuuaacauaauucauagggacucacagguaagagauugccuugggacauaaagaagacuuuggccuuuuggacaaaguugaaacucacaaaaaggaguugcauugacugaagcucacauugggagguacagagaaccuaauaggggaagguagacuagaaggcuguuugaccgccuguucucuggcuuaugguggugucuuauaauauuauaagacugaaaacccgaggagggggaccaaacuaaaggaaauagauccauuggagacagauguuuugaguuguagucuuagcaaggcaccaguugaguuuguguauuaauuucuggccuggcuuucucuguccuuacaccauucucucugucccuccuccuuccccugccccuacuccucuccuucccuucuccucuccuuccccucccccucuccuucuccuuucccucucauuccuuuccucuccuccucccucugucucucuuuuguuaaugauuuuuuuucauacaauacauuuugauuacacuuucuccuuucccagucccccucagauucuccccagcgacccaauucuucacucuuucuuugccuuuaaaaaacaaacaaaagcuccauaaaagcacaaauuggaaaucauaauacacaagcagaagaccaauaagaccaccccucagaaagcccaagcauaguacacgagacaaacaaaucguuagaacgaccacggaguuugugcuauguuggcugcugacugcugagcauagagccucuggguaguauauccaggagaccuccacugaugaaaacuaacuguuccuuugcaaguggcuaucaguugcaaguuuuuuuauuagggguaggaaccugucuuucaguucugggaccccaucuagcuuuaaucuaugugggcucugucuaugcugccacagucuugaguuucaugugugcaucugggcuucuguguccugaagaaaucauuuucuucgaguuucccucuuaacugugacucauuguuaucagccaccucacauuccugcugccaggaagcuacacugccacaccuccuucaucacagugauaaccucucuuugguuaaguuauuucagucagguacuacgugacgaugacauuuaaaauaagggguaugggggauauauagucucaaguacauuaguguuuuggauuuuguuaugugucuauuaccuacgacacacauagccucucucuuaccacuuucagucagugccuguagcucucccuggaaaauauccuauuuucuugacaucuguacccuagacucuauugcaucuuaggcuacagugaauccaacuuacuagcaauuugucuuuacuuuuuucugagaccuuggugcaagccucaauccaauaauuuuuccauucuguauguuuguauaaucaacaccacaugguuggcaccacucccacuugccuguguaagauguaucugggaaucuaggagccagccauuggugcagucaucucugaauaccugcaugacuugauccagcaaaacagaucccuaggugucucugagcaggaugcccacgcaguagcacucuguguucaggcacucggguuuuguuuuguuuuguuuuugcagacauuguccuuuuagaugaaaguauaaaaaacgaauuuggaaaaaacaaaacaaaaaaaaaaaugaaguuggauccuuuaacgggugaagucuuguccucuacauccccuugcuauagucucugauaucuaaaguucucaaagaauaaauuuuuaaaaacuucugcgaaauaaguguuucugaacuccaguuucuuucacucauauauucauugauucauugacuauuuauucuuccagugucaguaguuaugaugcuggcucugguaacgugaauacaguagauacaucuuuaacaggauugucuuuuuauuuuuuuuauuuuuuuuuugcuuucguuuguuuuguugcacccuuaaaugaaguuuuuaugggaguaguaaguauggucuacuucauuuacccagagauuauuuguguaaacccauccaguuuguaugcguaagauucagaaaucuucuauagcucuuucugucaaaaaucacuguaaagucuguaauaccauuuuugagaugggucauugucuggugagcguuaguuuaugacgauacuugauagauuauuccagccucccucauaguuuguauucucccucuuuacuacacacgucaccaaagacuuagaaaaacaauuaagaacacugagguccaaugagaugguucagcugaucaaggggcuugcagcuacgccagaugaucugaguccuguccucugccuuccaagugcugggauuaaaggcauauacuaccaccaccuggcuagaaauuaaauuuaguaguauaaaaauaauaauuuaagaaaagcccccagccaggcauggcagcacacacagccaugagugauggaugagcaagucacacaaggcugcuguggacacauccagagaaacugcaucuuggauuucaucuaaguuuuauguuuuauacuaaggccuacaugcggcuguggcuaauuuccuugaaaugguaguugugugacaucauuaauuccaccagaaaaggcagcaauugaaucacacuguuacuagucauuacuuuuauccacgucagagccaauuccuagcauuuuacuuacagacuucuuuaaucagagcacugagucucuuuaacaauuaaauuauaauugauaauuuucagauuuccaguaugauuuuuaaugccuuacugaaaccuuaggauugcuaaaaauuucauucuagcgagugaauugucauuagucuucacucuccuuuugaacaugaaauacaaucacuuaucuguauauaugucaaguaugccaagugggcuguggaaguguugggggaugggcauugggaggaucagccagcaagggauggcucugcagguguaugagaauaacugauugcucuugcacaggaccuauuugugauucccagcacccacaugaugauugccaagcacccguaacuccagauacagguuaucucaugcugucaucugcaucaagcauauauauaugcaggcaaaauauucagauaucacauacaacaaugaauaaaucugaugugagaaaaauguuuaaaaaugucuaaucagcaagaaaaguaaacuggagacuuuuaaguuguuguaguauacuugauauuuuuauacuuaaaaaaucaagcaaccaaugguaaauauuugcauuuaagugagauugagcaguuuuaagagcauagggcuucccuagaggacuaguucucucugacugaccuuuuauugaugcccgcaacaucuuuacuuaugucuagggcgagcccaucaccuucugugaggagagcuuuguaaagcaccgcucaagcgugaugaaacaguuccuggagacugcaguuaaccuucagcucuuuaagcagguaagagucagccuacacacauuugcucuguacagggaacacugcuguucagcacauaucugcugcccuaaaacugcauccagguuuaaaacaaacaaacaaacaaacaaacaaucauguccugagagaugucuucucugaaucaggagguugucuuuguaugguagaaagaaugccugguaguccuccugcggcggagcacucuuguaauacuguaugcuguugaaaugcuagggagggugagaagggggacagcacaccaugcuuggcccugacaucaucuaucuaucugaguaacagugugagacugagcaggcuagauuuaggggugugugugugugcacgugcaugcgugcaauagcaauuaaugagaaaaaguggccaugaauuugaaagagagcaaaaggggaggguuuggagggagguaaggaaagggggaaugauguaauuauuauuucauaaucucaaaaaugaaagaaaaauaucuucaauggcucagaaaacguugauaauugcagggaugcacuguagaaggcuguauaucacagaaauggaucugcaugcugaacacaccgagaucaucacagauaauccaacugauaauaucaauuuaaaucacagcuauugucuauguccugaguuuuguucaagacauuuaauuauuauuucagaguagccaagauugacaucauaauucagauauuuuaauuuauagagacacuaggucuuuucuuuuuuuaaagacggggucucacuguguaccuuuaccuggccuggaacaucauaugcaaacuagguuguccuugaacucacagagaucugccugcccgaugucucccaagugcugggauuaaaggaaugugccucguagguuguuguuuuuguuuuugcuuugcuuugcuuuuguuuuuauguuuguaugaguagguuauaugaguuuuauauaucagaaguuuacagaggauuuuggaggccagggaggucagauguccucuggaugcuaaaaaaugaacccugcucuucagccacagcaucaagugcuuuuagcuccugagcucugugcagccgugggcaguguguucuguuuguuugugcugugaccacaaaucucuuagaucagucuucuuaguuccuguuuacacggucuccauguacuuaauacuacuugauugucuuauucugcagugcaauuuuaaauauaaaacuagcucugcaugcggcauguacccacacccagacuguguuauaagcauuucaaagcuagaauccaaacaucaaugccuuugaaaagcaccagacuaacaaaacuguuaaugcagaaaaugccauccaauugaaaauuaccuucaaauuagguaugaauucgguaucaaauuagguauaaugaugaauuaauguuauucauauuuugaugaauuaaaaauaauuuguggcuaauuauacuuugugguaauauagcugucuuuuaaauaguuuuaccucaaggagaggcauauauaaauuuagaacagagaucuguauauuugcuaagaugaaguuguuccuuugagcucccugucucuuguuaucuccaagcugaugcgaaguuaagugcuagagcauaacagugcagcccagggccaucgugugugugugcgcgugcgcgugcgcgcguguguguguguguguguguguguguguguguguguguguuucaucuauuaagaagcuauacuacaugccauuauuaaaaauguguuaugggcuauugagaugacucugggguaaaggugcuugcuaccacaccugacauccugagugcuagcccuguuauaacaguguaacagcauccaucccauuaaagaagaauaaaaucacugaaguuacaggaaacauuuaucuguagguuagaucuaaguauccuugagcugaagaacuauaugaaagagaaaccaccaagaauacagugcauagagacaaacauuagauaagguagaaagucaggagaucgaguauauaagaaauguccauauaccauguaauuccaguagguagagcagaaaacagcacagacaguagcugcaagagucagaccugaaacagugaaaugcuacguaugauugauuugcaaaguucaguauauccaaauuaaagaggggauuuauauccacauguaguaucagcuauaagagaguagaggaauagaaagggaguuuuuaaauuuauuuuagacgcacaugaugcagugcucacagaugcuagaagaggcuggcagaucccuggagauugugagcuucuccagagugcauguuggaagugaacucggacccucuggaagaacagugggugcauuuaacugcugagccaacuuucuguaguaggacccuacauuagggaaauaaauuaauuguaauaaaaguaaaaauaaaugauguaaaaauaucacaaaguugugcauaugugcguguugaguacuuuuucaaguauccaaaugagcaaacauuauauuuaugauaugauuauacuauaugauaaaaaugauaaaaacauaaggcaaaaaccaagcugaagugauuguggucuuuucuguagcgauaggcugugcugcuuagguuuuuugucaaccuuaaacaugcuggaguuaucugggagggaacccucaauugagaaaaugccuccauaagauuggcuguaggcaagccugugggguacuuucuuaauuagggauggaugugaguuggcccagcauguuauagauaaagccaccucugggcuggugguccugggugcuauagaaagcaggcugagcaagccaguaagcagcacuucuccagggccucugcaucagcuccugccuccaggugucuucccagaauuccugcacuacuuccuagauaauggacuacaagcuauaagauaaaauaaagccuuucuuccccaaguugcuucugcccauuauguuuuauccuagcaaagaaaucccucacugagauagaagcacagagagagauauuuaaguccuguuaaauuauuauuuaauuauaguaucuuauauuuacuuugaaaacuuuaauugacaaaacuguuuaacaguuaugacgugaugcauauucacauagacacauguaugcacauaugcaggguggggcgaucucacucugcuagguaacucuaaucugacagagcuuugguagugagcaugcgcaaaauuuacucagcaaauuaggaguaaauacugacuuaucaugaacuguggcaaccaugcugcggaguaguucucagacacuuguuuuauuauuaacaugcccuguguugcgagucccugcucuccuagccuagccugcagcuaagugguuucaggugcuaggugcuuuccuauaccaucagcaucgacuguugaguuuuuagauucaauauuaauuuugguauuuuaugaaggcauuuuuuugguuaugucucuggauuaggcucuaauggauugaguucuuauuaacguuugacuuguaaaucccucugugucucugcuuccccaucugugaugggaguuggacuggacugcuaagccccggcugccuuugccucuuacauuacaugauaccaugaaauaaacagaaagcuuagagagacgacaguggguuccauuugcauuaauuccugcuuagauaauaaauuuggguggaauuccagaaauaauuccucaaauccaugauuuugacaucaccauacuucucuauauuacagcuuuaugaagaguuaagccauauuuuaaguuucuugccuguauuuaauacuguacuaauacaauaaggaaauuuuuuuguguauuauuuacuacuaaauccacugguuaaaaaaaguuucuuugcuuauguacuucccaagguuaagaacauggcugaguuuagcaucucaaaucaucuuaaaucuuaaaaucuagguuuauucugugagucuaagaccucuccaugaccauaggcccucuagacuggcaguguagauucuguuaggauaucugauuaauaguaaacgcucucuaauuuacauagacaguucacccccacccuccaaagagaaaaacaauucggcuuaugcaauugcuaacucauuugaggaagaaaaugguagggaagauuucaguuaaacauuugucuuuuacuaaucaucucaaaucuuucuuaucuuucauaaucuaauauaaauauguauuuacucaacguuuuuauauaacaagugcccauucauguauagauuuacaaggagaauacauuuugaguauaguuuauucuuagacuguuucacguaugaauacuggcaccucucagccaucucccagucacuuuucaucucccagucagucacugaggcccaccaaggcaccaccaaggcuuuuuccacaaaccugucuuugggauucacuuccgugaguuugugucaucugugugaugagggacuuggagcucucuguuggggccuggugggcucaguuacaagugcauaacucuccuagaaucugucaguagugagugagcgagugaguagaguaguaagcagggccuccggagcccuuccccuuccagagcccacugcagaaagggccaguauuguguaggcccagucugggaaaccaggguacuuuuuuagaauaugggaaagugucuauauauuaugaugucuacuguuuuuuuuuuucuaaaacaccucuauaaaguauauuauauauuuuaaagcaaaacaugucaaacaaaauacugcuuaaaucaccauccucugacuguaguuugaguguacacaaagccaaaaguaaacucacaacccauccugugucuaguaacaugccugucccacugucaguaccuucuguuuuagucaugguagucuagaggacagagauuauagaugaaacucuguccgugccuguaauacuuauccuguguugcuguaguuugucucuuuugcauuccugccuucaccuuugugaagcauucccuaguuuccuauguucccuagcccccaaugucauugaaucugcaguauuuuucuaugacuguguuuucccauuuuguuaagaguauauugaucauuuguuuugugucaggaagaaucacuuuaaauaguugaauuucagcuacuuucauagggcugagaaucuuagugaaguaauggcuagcaaacagaagauaugaaaaauacuuaauaaguggaaaucagagaaggcuccauccaggcaccagcucggcuucucugcauucggugaucucuauggauguuguccugggcaguggcacuccuauguccacuugcugagagugacccucugcccuagugucagcuuggguuguugggagagcuccacuggacccccucauccaaccacucaaccaaaugcaacccaguccugcuacugggagacuugccuggcaauaguaagagacuucggacuuaguguccugcauuaccaggagucaccacguccucauagauuguaggaaguuuccacugcaguguuuuucacacuacugcccacuuagaacccccuccgcacucucuuccuacauuccaucucuuccccacuucaccugcaaaucuauucuguuuucccuucccaagggagauccucacaucuucccuagagcccuucucuauaccuaaccuugaugcaucuagggauuaaagcuugguuauuauuuacuuaaugacuaauauccacuuauaagugaaugcaugccuuacuuguuuuucugggucugguuacuucacucaggaugauuuuuuuuuucuaguucuaucaguuugucugcaaauuucauguuaccauuuuuuugaaaauaguucacuaauacuccaugguguaaauguuccagauuuucgcuauccacuuuucuguugcauguuauauagauuguuuccauuucuugcuguuaugaauaaaacaacaguaagcauggcugagcaaguguccuugucguaggaaagaacauccuuugcuuaugcccaagagugguauagcugggucuugaggcagauugacuuccaguuuucuuuuuuuuuuuuuuuuuuuuuuuuuuuuauuagguauuuagcucauuuacauuuccaaugcuauaccaaaaguccccuuuacccacccacccccacuccccuacccacccacucccccccuuuggcccuggcguuccccuguaccggggcacacaaagucugcguguccaaugggccucucuuuccagugauggccgacuaggccaucuuuugauacauaugcagcuagagucaagagcucagggguacugguuaguucauaauguuguuccaccuauaggguugaagaucccuuuagcuccuuggguacuuucucuagcuccuccauugggagcccugugauccauccauuagcugacugugagcauccacuucuguguuugcuaggccccggcauagucucacaagagacagcuacaucuggguccuuucaguaaaaucuugcuaguguaugcaauggugucagcauuuggaagcugauuaugggguggaucccuggauauggcagucucuacaugguccauccuuucaucucagcuccauacuuuguuucuguaacuccuuccauggguguuuuguucccacuucuaaggaggggcauaguguccacacuucagucuucauuuuucuugaguuucauguguuuagguaauuguaucuuauaucguggguauccuagguuuugggcuaguauccacuuaucagugaguacauauugugugaguuucuuugugauuguguuaccucacucaggaugaugcucuccagguccauccauuuggcuaggaauuucauaaauucauucuuuuuaauagcugaguaguacuccauuguguagauguaccacauuuucuguauccauuccucuguugaggggcaucuggguucuuuccaguuucuggcuauuauaaauaaggcugcuaugaacauaguggagcauguguccuucuuaccaguuggggcuucuucuggauauaugcccaggagagguauugcuggauccuccgguaguacuauguccaauuuucugaggaaccgccagacugauuuccagagugguuguacaagccugcaaucccaccaacaauggaggaguguuccucuuucuccacauccucgccagcaucugcugucaccugaauuuuugaucuuagccauucucacuggugugagguggaaucucaggguuguuuugauuugcauuucccugaugauuaaggauguugaacauuuuuucaggugcuucucugccauucgguauuccucaggugagaauucuuuguucaguucugagccccauuuuuuaaggggguuauuugauuuucugagguccaccuucuugaguucuuuauauauguuggauauuaguccccuaucugauuuaggauagguaaagauccuuucccagucuguugguggucuuuuugucuuauagacagugucuuuugccuugcagaaacuuuggaguuucauuaggucccauuugucaauucucgaucuuacagcacaagccauugcuguucuguucaggaauuuuuccccugugcccauaucuucaaggcuuuuccccacuuucuccucuauaaguuucagugucucugguuuuaugugaaguuccuugauccacuuagauuugaccuuaguacaaggagauaaguauggaucgauucgcauucuucuacaugauaacaaccaguugugccagcaccaauuguugaaaaugcugucuuucuuccacuggaugguuuuggcucccuugucgaagaucaagugaccauagguguguggguucauuucugggucuucaauucuauuccauugguccacuugucugucucuauaccaguaccaugcaguuuuuaucacaauugcucuguaguaaagcuuuaggucaggcauggugauuccaccagagguucuuuuauccuugagaagaguuuuugcuauccucgguuuuuuguuauuccagaugaauuugcaaauugcuccuucuaauucguugaagaauugaguuggaauuuuaauggggauugcauugaaucuguagauugcuuuuggcaagauagccauuuuuacaauguugguccugccaauccaugagcaugggagaucuuuccaucuucugagaucuucuuuaauuucuuucuucagggacuugaaguuuuuaucauacagaucuuucacuuccuucguuagagucacgccgagauauuuuauauuauuuguggcuauugagaaggguguuguuucccuaauuucuuucucagccuguuuauucuuuguguagagaaaggccauugacuuguuugaguuaauuuuauauccagcuacuucaccgaagcuguuuaucagguuuaggaguucucuguuggaauuuuuagggucacuuauauauacuaucauaucaucugcaaaaagugauauuuugacuuccucuuuuccaauuuguauccccuugaucuccuuuuguugucgaauugcucuggcuaauacuucaaguacuauguugaaaagguagggagaaagugggcagccuugucuagucccugauuuuagugggauugcuuccagcuucucuccauuuacuuugauguuggcuacugguuugcuguagauugcuuuuaucauguuuagguauuggccuugaauuccugaucuuuccagaacuuuuaucaugaauggguguuggaucuugucaaaugcuuuuucugcaucuaacgagaugaucaugugguuuuugucuuuuaguuuguuuauauaauggauuacauugauggauuuucguauauuaaaccaucccugcaucccuggaauaaaaccuacuuggucaggauggaugauugcuuuaauguguucuuggauucgguuagcgagaauuuuauuaagaauuuuugcaucgauguucauaagagaaauuggucugaaguucucuaucuuuguuggaucuuucugugguuuagguaucagaguaauaguggcuucauaaaaugaguuggguagaauaccuucuacuucuaucuugugaaaaaguuugugcagaacuggaguuagaucuucuuugaaggucugauagaacucugcacuaaacccgucugguccugggcuuuuuuuggcugggagacuauuaauaacugcuucuauuucuuuaggggauaugggacuguuuagaaggucaacuugauccugauucaacuuugguugguaucuguccagaaauuuguccauuucguccagguuuuccaguuuuguugaguauagccuuuuguagaaggaucugauuguguuuuggauuucuucaggaucuguuguuaugucucccuuuucauuucugauuuuguuaauuaggauuuugucccugugcccuuuagugagucuagcuaaggguuuaucuaucuuguugauuuucucaaagaaccaacuccucguuugguuaauucuuugaauaguucuucuuguuuccacuugguugauuucaccccugaguuugauuauuuccugccgucuacuccucuugggugaauuugcuuccuuuuuuucuagagcuuuuagauguguugucaagcugcuaguaugugcucucucccguuuuuucuugaaggcacucauagcuaugaguuucccucuuagaaaugcuuucauugugucccaaagguuuggguacguuguggcuucauuuucauuaaacucuaaaaagucuuuaauuucuuucuuuauuccuuccuugaccaagguaucauugagaagaguguuguucaguuuccaugugaauguuggcuuucuguuauuuauuuuguuauugaagaucagccuuagugcauggugaucugauaggauacaugggacaauuucaauauuuuugaaucuguugaggccugauuugugaccuauuauguggucaauuuuggagaagguaccaugaggugcugagaagaagguauauccuuuuguuuuaggauaaaauguucuguagauaucugucagauccauuuguuucaucacuucuguuaguuucagugugucccuguuuaguuucuguuuccaugaucuguccauuggugaaagugguguguugaagucucccacuauuauugugugaggcgcaaugugugcuuugagcuuuacuaaaguuucuuuagugaauguggcugcucuuguauuuggagcauagauauucagaauugagaguuccucuuggaggauuuuaccuuugaugagaaugaagugucccuccuugucuuuuuugaugacuuuggguuggaagucaaucuuaucagauauuaggauggcuacuccugcuuguuucuucauaccauuugcuuggaaaauuguuuuccagccuuucauucugagguagugucuaucuuuuucucugagaugaguuuccuguaagcagcaaaauguugggucuuguuuguguagccaguuuguuagucuaugucuuuuuauuggcgaguugagaccauugauguuaagagauauuaaggaaaaguaauuguugcuuccuguuauuuuaguuguuaaagguggcauucuguucuuguggcugucuucuuuuagguuuguugagggauuaccuucuuguuuuuucuagggcguuguucccguucuuguauugguuuuuuucuguuauuauccuuugaagggcuggauucguggagagauaaugcgugaauuugguuuugucguggaauacuuugguuucucccucuaugauaauugagaguuuggcuggguauaguagccugggcugcaguuuguguucucuuagugucuguauaacaucuguccaggcucuucuggcuuucauagucucuggugaaaaaucugguguaauucugauaggcuugccuuuauauguuacuugaccuuuuucccuuacugcuuuuaguauucuaucuuuauuuagugcauuugauguucugauuauuaugugucgggaggaauuucuuuucugguccagucuauuuggaguucuguaggcuucuuguauguucauaugcaucucauucuuuagauuugggaaguuuucuucaauaauuuuguugaagauguuugcuggaccuuugaguugaaaaucuucauucucauccacuccuauuauccguacguuuggucuucuuauuguguccuggauuuccuggauauuuugaguuaggaucuuuuugcauuuuccauuuucuuugauuguugugccgauguucucuauggaaucuucugcaccugagauucucucuuccaucucuuguauucuguugcugaugcucaaaucuaugguuccagauuucuuuccuaggguuucuaucucuaguguugccucgcuuugaguuuucuuuauugugucuacuucccuuuuuaggucuaguaugguuuuguucauuuccaucaccuguuuguauguuuuuuccucuuuuucuguaaggacuucuaccuguuugauuauguuuuccuguuuuucuuuaaggacuuguaacucuuuagcaguguucuccuguauuucuuuaagugauuuauuaaaguccuucuugauguccucuaccaucaucaugagauaugcuuuuaaaucuaggucuagguucucagguguguugggguucccuggacugggcgaagugggugugcuggguucuggugauggugaguggucuugguuccuguuaguaagauuccuccguuuaccuuucgccaucugguaaucucuggaguuaguaguuauaguugacucuguuuagagauuguucuucuggugauucuguuaccgucuaucagcagaccugggagacagauucucuccucugaguuucagugcucagagcacucucugcuggcaagcucucuuacagggaaggugcgcagauaucuuguauuuggaccuccuacuggccgaagaagaaggcccaaaacaggaccuuucucagacaguguguugcuuuggcaguucccaggugguacagacucucaccuaagcagacuaaauuccuaaguuccuuggagucccgggaccaagauggcgaccgcugcugcuguggcuuaggccgccuccccagccgggugggcaccuguccuccgguccggaagguggccggcugucccuggcccacacagggugcugccucagcgccucugugcuucugccuguuccagaagcugccaggcucucuggcgcacccucucaccugcucagaccaauuuccuaaguucggcgggucucggaccaagauggcgaccgcugcugcuguggcuuaggccgccuccccagcugggugggcaccuguccugacuuccaguuuucuaagaagcugccauuuugauuucccuaguggcuauacaugguugcacuucccaucuucagccccauccuccuccccacccaccaacaaugaaggaguguuuccauugguucacguccucaccagcaugagcugucauuuguguuauuguucuuacccauuccaacagauguaaauuggaaucucaaagaaguuuugauuuguauuucccaggugguuaaggaugcugaaauuuucuuaaguguucuuaagccauuugagauuucucuguggagaauuuucuguuuagaucgguaccccauuuuaaaauugguuuauuugggguuuuuuauauguaauuucuugauuucuuuauauauuuuggauauuagacuucuauuggauauagaguugguaaaacucuucucccauucgguaggcugcugauuucugauuguucuacugacagugucauuugccuuaaacaggcagcuugauuucaugagaucccacuugggcucagugccuguacucuguggucaguuaccuguucagaaauuuaucuccugugacaauguguucacagcugguuucccacugucucuucuaucagguuuauggugucugguuuuaucuuagagucuuuuauucauuugaacuugaguuuugugcaggauuauaaauguggaucuauuugcauucuacauguagauacccuguuugucuagcaccauucacugaagaugaugucuuuuuuuccccucuauguauuucuggcuucuuuaucaaaaaucagguguccauagguguguagauuuaugucugcaucugcaauuuggucccaucgucuauuuuaaugucaguacgcuguaguuuuuauuacuguaacccuguaauauaacuugaaaucacagaugcccauaaaguuggcaguucuuguuuggauugcagcagucaggauuguuuuagcugucuuggguucuuuguuuuccauaugaaguuaagaauugucuuuuaaggucuguaaagaauuauguuggaauuuugauuaauuaauggggauugcauugaaucuguaaaaacccuuggguaggaugaccauuuucacuaugugaauccuaccaauccaugagcaugggagaucuuuccuucuucugauaauuucuugaguuucuuucuuaaaagacgaaguuuuuugucauacaaaucuuucauuuguuugguaagaguuacuccaagacauuguauaucuuuugaggcuauugugaaagguauuguccccucuauuucuuucucaaucuguguuuugcauagaggagggauaccuauuuauuuauuuauuuuauuuauuuuuuuuaguuacucuuguguccagccacuucauucaaagcuguguuuaucagcuguaggaguucccugguagaaguuugaggaucacucauguauacuaucaugucaccugugaaauauaauauacuauaauauauaaaauuauacauuggcuucuuucuuuccaauuuauauucccuugaucuucuucaguugccuuauugcucuagcuaauaauacugcaacuaccauauugaauaaaugugaagagaguggaaagacuguggauuuugguuuugaguuucuuuucauuuaauuuuaaguggauuuugguuuugaguuucuuuucacuuaauuuuaaguuggcuagaggcuugcuguaaauagcccuuauuauguuuaggucuauccuuuauuccuaauauuuccaggacuuuucucaugaaagaguauuagauuuugucaaaggccuuuucugcaucuagugagauaucuuguguuuuugucuuucaguugguuuauaugauggauuacagucacugauuuuucauauauugagccauccuuauaucucuguaauaaaaauagcuugaucaugguggaugauuuuuuuauguaguuuugucuuuaguuuaccauuuuauugaguauuuucccaucuuuauucauaugggaaauuggucuauaacucuuuucuuuggugauucguugugugauuugagugucaggguaacuguggccucauaaaaugaauugggcaauauuucuucuguuucuauuuugggaaauaauuugaggagcauugguguuaacuuuucuuugaaagucugguagaauucugugcuaaaccguuuggccuuaggcauuuuuauuuuuauuuggaaauuuuuaauggcugcuuguauuaccuuagugcuuauaggucuauucaaauuguguaucugguugugauuuaacuuugguaagugguacugugguaaaaauuguuguuuuuuagauuuuucaauuucauggaguauguaaugauucuuuggauuuccuuggugucuguuaggcccccuuuuguuuuugauuuuguuaauuuggauauucucuuuccgucuuuuaggucguuuggauaaggguuugucucuuuugaugauuuucuaaaaaaaaaaaaaaaaaaaaaaaaaagcagcaacucuuuguuucaaaauuuuucuucauuguucucuuugcuucuauuuuauuucaucucucaguuugacuauuucuugucaucuacuucucuuagguguacuuauuucuuucucuucuagagcuuacagauaugcuguuaaguuguuaguuugagauaucucuauuuuuuuuaauguaggcacuuaauacuaugaacucuccucuuagaaccauuuugauuuuuucucauagauauggguaugauguguauucaucuucauuguaugcuagaagucuuucauguuuuuccuuuauuucugucuuggcccacuuuugaucaguagagaguuguucaguuucuaugaguuguaaguuuucaguuguuucuguuguugauauugaccuucaaugugugguagucugauaggaugcagagaauuauuucaacuuucuuguauuuguuaaaccuugcuuuguguucgaguaugcgaucaauuauguaggauguucuaugauaugcagagaagaagguauauucuuuuguguuugggugaaauguuccauaaauaucuauuaggucuauuugguuuauagcauguuagcuccaguaugucucuguuuagguuuugucuugaugacccgacucuuggugaauauaugguguauugacauuuccgacuaucaguguguaaaugucaauauaugauuuaagcuguaguauuguuuauuuuacagaaaugccugcacuugugcuugggguauaaauguuacgaauugaaaugucaucuaagugaauuuaguuuucuuauuauauuucgagcuucccuaaaguugagagcacaucugauuacaauguuugccuggaguuuccugcacagaauucugccuauggucagugcuaacuaagucagaggaaaauuuaucuguaacacuuuuuuauauacauagggaauucauaucuaaaauauucauaaacuacuguguuaaucacaauaaaguauaaauggugauucuucgauuaggauggaagauuacuauuucaaugaagaaaaguuuauuuaguauuaucuaaggagaaacaaaaucacagauaaugugcaguaaauaaauauguaaauaauugcauucugggaaaaguuuugaccaucaaaccccaagaaaauagucauucuauuuuuuucaguaauguaacaauucuaucaaauuguuauuauuggaagaacauccauuuguaguauuuaucucuuuggaguauuuauuucuuuucauucuuuuuggucuacaguguaguucaagcuuaauguuucaaguuccuuuauagaacaaaaagacuuuaauuuucuucucuucagcucuuacauuuaccaaauacuuuugcucuagccauaaugagaugguuggcauguauucugugacaauuauguuauaucuucaugcuucugagucuaaauuauaauagaggacuaaaauauugaguuaugacauaaguaaauaaaaaugagcuuuguuaaaacugacuuuauaguaggugcuuuuugaaugccucuucuaaucugucuuacuauucaagauagucauauguaaccuggcuccacuucugaacuuauaaagccaacuccagugguuaacaacuugggggcagucuaggcuguaguugcaugcaguaggucuuuauucucauucuaagaauagccuacugaggaaauaaugccugugugcuuauuaucaucucuucugcucugaguauccucucccuggcuggcauuccacagcuuggucuuuagacuuacuagugucucuuuccuguuuggaccuucucuccuuucagaaucccuuuccucuuaggaucuuuggaccugugccauauaacauuucuucuuuuguuugacuuuuuugaguuauaggcucuuuaaugauaugaaugacaguuuauguuuuaaguacuucuauauccuaauauguacuuaauauguauuuaguaguaaugaacaaauuaaaaacaguggagcaacuaucuacuauauggaauaugccuaaaaaauauugugacaauuuuaguaucuaaaaaaaucugaaguugaauauaacaaaacucauuuuauaaauuaggggauaucugcaguuucuuguucuguagaaaugaaaaaccugcaagauucuuagcucacuacaugaccccuuuucccugacuugguaagcuguuggauaaaaggaaugggucagaagccaaauacguuccuuugauguuaacuagggauuuggggagauguuuaaaaagcuuuuaacuuaaacaauaaauugcuauaacucuccaguuuucuuauugaccuuugucaugguggcuauucccgggacguguuuugcugcuaagagcaacacuuacaugacuagccccgaugguuccugacucuugcagcauuagguggcaccggucguauaacccacaguauuaaaaggaauaaagcagcaaaugaggcaaaggggcacacacaccacuugggugcagaagaacucacagggcaauagcauagcaguacaaaagacguacuuugaguucaaguagcacucaaaauggcugucaguccuccuucaucagaguccuagagagucugcaaaacaggcacauuauugaaucuuaccuuuaaacuugccaauuuagaccugccuucaaaccucagagucaugaagucucauuaacaagguagagacagcuacuacgccuucucucccuuuuccuccauucugcagaauauaugaauagccucuguaagacaucccugcucuggaugggaugucuuagagagagcaaaguagggaugaaccuccuucauuccuagggggagggagugaggcaacaaaauaaauacguagagcucuaaguuguaaguauguagagaaaugaacagagcaggacaagacaggagaaaugguacuggcagaggcaauggucuacauacacaccccugucuguaccugcaucacuuaaaauaguguggucugagcauaagcagugcccuccugugggguaaccaaaggcagagccccaaagagauucaggcuguuuguauaaugcagcugagagcuaauagcaguggggaacagacaauggaacggaaugauacaucuguuuacaugaggaggccagacaauauuucaaaagucuuacuauuaaaaagauaaucauaugcuuucugaggcgggaagaagccagacaggugccagugucacuuaagugagcuuggugggauuguggauaaaaauguucuuacaagaaugguguuucagaaacacuauaaauucaaccuguuuauuagauauucagguaagauauuggguaggcaaacagauaaacaagguacaagagaaaauuggacuggagauaaagaagcaggguuccucagcgaauagaauagaaguguuuuuauaggcaaggucagagcaggggagaguaggcaggagcugugggagggagagugguccagcagugagguggggcagaaaucugggagaacuuggcaaguaaagaauuucaagggggcuaaacugccagugcuccugguguuaaucaaauaacagcggccuugcugguguggagguggagauggugauuaaaggccugagggagaggacauggaggcuggccugccagcuccucugccuuucuuuaaggagcuucagaaguggacuuagggaggugagaucagggauaaaauaacaacccuccugaguauacuuucuuucuccacucaaucauuuuuucucuuuggugaaauuaggaagcaaaaucaucugccuagacucuagggagcaggaaaugucugggcauugaaguauaaagaugagaauaauuacuaagccaucucaucacacuuuuaguauauauuuuucucuuuucuccuuuuauugaaaauagauguaccugguuuauccucccucuccuacaguucuccccaucuccucuuccaucuggauaccuuucuuggggggagggcgggggggcggagcagggcaguguggggaggaugcugcagggcugggacagagacagacagaaagagacagagacagagagacagaccaggucugacauggacuuuugaaaccucaaagccuaccccuagucacacacuuccucuaacaaggccacaccucuuaauccuucuaauccuaucaguuucauacccuggagacuauacauucaagccauucuuauucaaacuaccacacuugcuaaauaacugcaccacugacugcuaucccuaacacaaugauuuuuaagaguuucccccacaaaugaaauacuauacuuuaaauaucaaagucaugaaaccuaauuauugacaucccaauuuugauaggugaauuaaaauuaaauauuucuguccuguguagaccguaaacgcaauggaaaguucauaaugaauuauuuuggguuuuuagauuuauucuggaaauacaccaaaguggggggauucaguaaaggaaagcauacauuuaucucuuagagcuggucagcugacccuucauuucaacuuuaaucugggaaucugaccagaacaauacauucaaaaaacauuuggggguggggggggaggcugccaugauguauauuuucuaaaauguauuagauuuuccaauuaauuguauauauaauugcauuuugaaacugaauuuucccuuccuuucucucccuccaaaccuucccagauaccuacuuaccuuguucguuugugaauuuauggccucuuuuuuuuuucccuugcuggauuuuuaugaauaguacuauuugcucaagugacuuuaaaagcaaagauuucuuuacauuaagacgguuuccuauaaaacaacggugugaagauuagaaguguuuagacagauuuuagugauaccaggaucaaaagaagagcaagaaacucugcagccugagaauguuuaugucaugaacugcgucacuauuuauguucugccguacggguuaacaagaucuauuucuugccacuauugaagauguagaauagaaauaguuccucaucuuauauauaaucucacuugucuugagaacuguguguaguguaucuaucaguuuguacgcgugugugaguauacuugucugucugucugucugcauguuuguggaguccaaagaacaacuucagauguugguccucaaaaaccaguuucuuuugaugguggcggcggugagagcagugguaauggggugugugugugugugugugugugugugugugugugugugugugugugugaauuuuaaaaacguuuuucucaccagcuaucuccucagccccaugccaguuuaucacuuuauaauuuuuuuuuuaauuauaaaguucaaugugccaucuuucaaaacaggcuuuaaaauuguauugcaaaucuauucguugcuuaucugaggcuauaucuaucauuacugcugacagcacuacuuguuauuacuagcaguaaaaaaagaaaacuaauuuaaaacuguuuuucagcucucugaaaauaacauguuugcuaaaugaaauagucacuauaacucaaacaauauauuaugaaaucauuuuuuucaacagaaaucaguuugguuuuguuuguuuguuugguuuuugguguuuugguuuuuauggggugugugugugugugucugugucugugucugugugucuauauaugucuguugggggggcagggguuguuuuacuucaaaauuguaugcagcuuuaccuaaaacuguuuggucucuugcacacucugaaugguugcagagacaccacagugggguggccacaagccaagucgauuuaggaaaaauugauuuaaaaggaaaagcuguuauugaacuagacauuguuaaaagaguucagagaacuugguguucagcuuuccccuccacuaauacccuuuuccagauaucuauaccugcugucaauauguguauaucugcauuuauaauuuaucuguguauuugaagacaucacguacucugugcacauugaaaagugucugauucucacugacaggauguuugcaaaaucagugcuagcacaugacauuuaucaggcgacauuuuaucagguguuugcuggccccucucacucgccuacuuacaugaacuagcugcucaugcucagaagggcacaacccuagagagguucaggauuuaucucucucuuuuuuuuuuuuuuuugacuuaaacuauuccacucauuuaauaaaaugaauggauuauguucccuaaacaaaauggaaaaccuuuuaaaaagucuuaaacucuuaaucuuuuagaauaaauuaaguccuuuaaaaggauggcuuaguucguucucuuugcaaguaauauauugcuuuaaauuuauuaucuuccuuucacccaauauuuuaaaaaaugauucuuaguccauggaauugcaucucuuuaauuugauuuauacugcuauauuaaaacaugugcaagugaaauuuuacacgucuuuaacugucuuauuuucaaauuaaucacuuauuguauacagugaagacaccaacaucauauuacugccuuugaucucuagauaaaauguugauaugguauagcgauguaauuauuuaccuuuaaagucaaguaaaaaugcauggccuuuaacaucuuuugagccuucuuuaucccuucagcugcauuccauuuaaacugugugucugggaccaagcagaguaagacuguguuccaacgagcacuaaaccacagcaguaaugaagacuguaugcuagacauuugugccaagcccgggugucgaagaccaccgcucucacucgcagcuuuucucuguugucuguaguucauguguaguuggggcuucuugggcuuuuugccauacucuuuggcguguccauugcugucauuuuuguucaccucguguuugggcagucauguuggugagacuuaauggguggagcuucuaauauuccuaggagacacagucccaguccucgcugcuccucuggcccuuacagucuuugugcccucuguucagcaccauucccugagcuccaggggugagaguguuuuguagauucauccauggggacugggcuccacaacucugcauuuugucugguuguaguuuucugucgugaucuccaucuguugaagagagagguuuccuuuaugagaacugaggacucuccucaccuguggcuaucaggacaaguguuuauagauuguuguuaggacuuaugcuggcuuaguaaaucagugguuguagacuagcguccaguugccaugaugucacugguacucgugcauaccuagguucccaguacuggcacacuggcauagcuucccuuuccuuaaguaaaucuuaacacguugagagcuguccuuuacauguagugugugccacuucuguccccuuaggguuauuaugccaugcucauuggugaugugguccuagcuggguuagacugguugccucuccccucaggaaguuuccauggugccuucucauacuguaagauuuaguccucaggguggaggcauuaguguuaauuccaaaucacagggccugguggcucuguauuuguuauuguuguuuguuuguuuguuuguuuguuuuuacauuuuuaauagcccuuggaaugauuuuuaucauuuucauuaauuuauuuacuuauucauuuugcaucccaguaucagccccacuucuccucccagcaccccccauagcuccucccaccucucccccucuccuccuccucugagaagggggagccccuggguaucacuaccccagcacauuagucacugcagaacuaagcacauuaaguugacccuguucuucaagcgcauggugucuucaccaacagacacucgccuucugccuccgaguacagugaaggcaguuguauaagcuguauauuuggggagucucugacagccguggccagcaacuuaagaaaaggcuucuggacgggugugguggugcacgcuuuuaaucccagcacuugggagacagagacaggcagauuucugaguucaaggacagccuggucuacaaacaaagugaguuccaggacagccagggcuacacagagaaacccugucucaaaaaaaccaaaaagaaaaaaagaaaaagaaaaagaaaaagaaaaagaaaagaaaacgcuucucuuuuuugcaaggugguuugauucuugaauuaaacauuaucagccuggaagaaaaaaguuuauuaaaacuauauauguauaucucugcagagaauuauauguaguaugugguuuucuuuuagguaaauuguuaauaacaugauuccuaugguuguuuuugacauugcuacuuuacucauuccccucauuuuucucuauuuacaaguaauuuuuaauguuauaaaaaugaaaacuuaacauuugaaacuuuuaaauuucaguuuauugauggucgacuggcaaagcuuaacgcaggaagagguuucucugauaucuucgaagaagagaucacuucggguggcuucuguggagguaaagauagccuugagaguaauuaccuagacaucugauuuuugugucugucucugauauaugucuuucuuugggaagauaauuuuguaauuauauuuauguacacaaaaguuaguguacaugcaucccgguuuaguggcgaguguuuuagccuuugucuuuuccagcuuggcaaugcaagccacagacuuaggacccaggauguagacuccccaguagccacggaucucauuguaucuuucauuguaauugguccuaauagcuuccaccagcuuagccggagcacccuugucuucugagguaaccugugugaaggcaauaguggugcacaucuuccuguggaccgggcgccccagccuggccuuucccuugauggcgcaguagggcacccccaucuuuccacacagggcaggcagaaaaaccaccagcucaguggggucuacaucaugggcaaucaccaccagcugagccuucuuguucuccaccaaggugguggcuguauugacauggaguuauuagucucuuaguugggauguccccuuucccagcagcuuucuucucaguaugggccaguagccuuugcuucucuuucuuugucucuggccuguacuugugggcaagcuuaagcagcugaguagcuguuugccuguccagggccugaguguacugguuacuggcaggagggacuuugagccacuuauagaugaugggcuuugccgcugcagccugauguagcggggccauuugacaaaguguguuagauaucuuuuggcuggauguccugcccaaugccaaaguuuuugggccuuuucucaaacaaagaaccuuuuggccuccuguuucuugaugacaaguggggggccagggcccccuuuuuccccuuggcuuucuuucuuuuggggaucuuggucugcuggagaagagaacugucuuuuaaacaauuguuuucuccuaaacacacaguuuuauguaggauuuucaucuuauaugagcuaugcuaugggcuuauuuuuguaauauuaauuuucaaagcaggaagguugugucauaaauuauuaguuauuagcucuaauaaucucuuaguauuguugaaaauaacagaaaaccaaguaauuuauaaccuuuccccguuucccaccuaaugauagcuucuacuggaaagugauggguucuggcggucugagugaguuugggacagagacucugguugaaauagugcaguguagugcagcugaaaaugcaggaaugccuguaugcaugcaugcugccugcuuccggaagugggaagugggaagcuguacaauucuuggucugcagacaacaguaggauuagaaaaguuuuaacuuuaccauuccaaaacuagaauccauuccaaaugugaguguccaguguuguaguauguaggcaagcaaugaguucugaguugacgugcugucagcugaugcucugcucuguaguccuggcaugcagaguccuccagugucuuagugauucuuccaaggaggauugcugagcgcacacugggacugcucuguauguugugagagccacgugaacaggauaucugcccuugcugucuugcuggguucauuuugaccucuuuguugguuugccuugauagacaggguuuuagucauuugaguaguuacuaaaauugagaagauaaaaauaaauaagugcauaucugcaaguuuugcaccuuacuuuuauucuuaaacacuaccuagugucugccauaaagcauagaaguaaaugggugaagagaauuuccucaaagaagagcagaugaacuuggcagccauaggccuucaccuaguagaugugcagcaccucaggagaggcacugagcuugggaaaguuaguuugucugacucagcaagggagcucuguguggguccauucagcucgcaucccgcucgcucaugggcagaaauccagcuucaaugggacuuuuguguuaaaaugacgccuuuuacuuuucaacccagacaagcaaaauauugucagcuuauggacacauugcuugaggggucuacgcaguauuuacauaacugcugucucauuaucuuuaugacccguggggcugguagcuuuuguagaauugaagaugacaucuugugacaguaaugggggagagcugugauccuuuuauacacuuaaauucuguaauaacugcucguccagaaaccacagaaagaaagagacauaaaggcacauaagaauagcuaauucauuuuauuuuuauuguguauucacuaaaaauagcaguguuacagugaauaugauggauauuuauauucuaucauagaaggauaugaggcuugguccauaucugauuuagagagugcgcuacuuaauuccagcuauuuauuuuaauuaaaauuuccaacucccauguucuaaucugagggagcaaauacuuaaccaaaaggacaaccuguuuccauaguuaucaauuucagugaauaagaaauuauuuuuaaaaauuaugccaaucaagugcugauuuuauuuguauuuuacauugucuuagaaauacauagauuguucuuagcaaaaaaaaaaaaaaaaaaaaugggugauucaugaagauuugaaauggaaaagaaaauaggaguucuuuauuauuauuauuuuuuuuaauuugguacuauuaugccucugcuguuuaggaaggacauugcaccccuuuauaaggcgacuccacuuaaacuguuuacauuuaugcauauuugggaaucaucucccugugguacuuugagacguguuuaguguuggucauccuccccgugcccccuucucuaccuugcucuucuacucauccuccacuuaacccagccugcucacuacugcccacccucuccuuacugccugccuucuagccccuuccuuccuugacauccagccacccagcccuuaccguugcaaccccuuuccuuuacaaagugcucuuuuuugaaacuaggaggagggagucccuggauaacuugaucugaucuguucuguuacuaagcaguucuagggguggcauuuggcauugaagaaacagugaaucaggauuuuaaauuccugauucuuaauuuuuguuggcugcuaauggaauuagccaucuaucggauggcccugcacccuagagguccagagcacaaccagaaaucuugucuuucucauuggcacguccuguuuugcacacuuuuacaguagggaaaugcagagcauguacaguagaugaaaacgucuuaugaccucuaaaagcugaauaugaacuuauuccucauaauuucaaguaagacauuugaccuccuauaacugcuaugcagguuuaucacaacuguuuccuuguuguuaauauauuaguuuuuuuuuuuucuggcuugacaauuauucuugaaccuuaaguuauuaucauacuguucuguuuucuuucugcuuucuaaaauucauuuuggagaaauaagcaccacaccuuauaauaguaaauaauguauaaccccuaaguggauaauuucuauguagucaugugugaggaagaaguagaaggcacacgaccugauaaaggugugugcacaccuggauuccacaccuggagcugggagccgggggacuugggaccaacggccagucucaguuuacagugaguuggaaaccagcuagaaaagacccuaucccagaaaguuuuuuuaaaaauauaaaaaaauaaccuaaaugaaagaugagacuugauugguaauaaaguaaaauguauuugaaaaauaaaucaauaggauaacaugaauguuuuucaucauuugguaaaggaaauaugcaccugaaucguuggggaugagucauaaugguuuugacccaggauuuucuuguucaauagaaaggagaaagugcugcaaaggaucauuauuacaaugaaguuguuucuugguuuuucuuuuaagugagggaaagauuugaaggauuaaauuaaccaauugugcauaugugugcaugcaugugugugugugugugugugugugugugugugcaugcaugccauugcauguguguagguuaguggacaacuugcaagauuuggcuuucagccacuacugugaugguucuggggcccaaacucagcucguuagucuuagcuauaagcaggcuaaugccuuuaacauccggcuagcucuguuguauuuucuuucauaaaacaaagauagaaccgcauaaaaagauacaugcuguauuuugugggguccuuugggcaacaguguagccauugagacuuuacuuuuaauggugacuuuuuuccuuuccuuuuggagauucuuaucauaaaaauuaagaaaguaguuuaaaaucuaacugaaaucaguuguuuuagaagacgauguuagauguguguuucuuuuuuuuuuuuccccaaagagggaggguuauuaguuuauguguaugagaguuuuggcaacaugugugugugugugugugcaccacauucacugcaaccuuagaggccagaagaguguuagaucccuggauccagagucaccagcgguugugaguuaacaagugggugcugggaauugaccgugggucuucuucaggaacaagugucauuaacugcucagcuaucucuucagcaacagauauguuuucuuuugucuaauaauaucauuucagugacuaaauaauguuauuuauaagugagcauguuuauuagcaagaguuuuggugcacguuuguguaucucuggggucuagguaguaccauacaucuggacaagaggacaaaggacaaccuuagauguucguuauuccucgcucuccauauaccgugguuuuugagacagggucucaguggccugugucucucugaggaaugugcucaugucucccaucccagcacuaggaugacaugugugugccaccacaccuggcuucuuuccucaaguccuguuucacagcaaguguugugcccugugggucuccuccucagccggaacugucagguucucuuagaaggaguucugagagacgagcucauucauacccauggcauccuuucagcgcguuuccuuccagccauaugguuuugcuucuagaaaguuagagacuauuuuuagagauaaaagugucauuuagucacauuaagauacaaacaccuauuaguguacauugcuauuuaaaaauuacaaaaccaucuuuuuuguccucgugguuuucugcauuucccaauuuccuguuuuccuugauucuucuccacacuugaaauguuuuaagugaaccuaacuguauaaaacaaacauuuuuuaaaacaauagacauaaaacuuugaaaaaaauauuuuuagaugucuaggcauguugaauuucaauaggcuauauuuuccacugcaaggcaaauauuuaaaugugagaauauagggaagccuuagguucaugugugaaugaagaacgaugcuuuuggugugaguucugauggccuggugcacucacucucaggaccugguccugguuuacaacaggccaguaaagggaccugcugggcugcugugcugggcugcugugcaugcugucucugggcgagcuguguuuuucugguuuuagcuuuuagugguuaccccuggcaucuaacuuuuauauguuccagggagcccgaggucauaucagcaguggguguauacagucaagguaaguguaugccuuuuguuucuccucuuuucacucuagaaagugcagagaaauauugagaaaaaguauucuggcuauacuuaacacuguuuaauuugaaauguguauguuuuaucacacuaaguaauuuuuguucaugcuuuguugauaauauaaaggaaauuuaaaaugaaaguguuuacguuagacauaaaagucuuacucaaagccaccauuugccugcacacuguauuauaggucacagcaccccugugcugcuuagguucugauagugugauacuuuccaaagagggaaccucagcugaggagaugcaucuaucauauuggccugugggaauggcugugugacauugucuugcuuaaugauugaugggccagcccacagugggcagugccgcccuggguaagugauccugagagguguaaaagagacagcugacuagggacuuggaagggggccagugagccacacuccuccauucagguuccugcuugagugccugcccuagcuuccauugaugaugaacucugaccugagugauguaauaaguccucuucucuugaaggugaguuucaucagugucauagcaauagaaagccaacaaaggacuagggugcaguaguagggucugauggggauuuuauuggauuacaauguuuuguuaguaugauauguucuagugaagaaaaucacccacagucgaagucuuuauugcccagcgucaaaucagcugaugaccaucaucuucugucuguugagaaacucuaaguuuguucugucuuguccaucguacucuuuauuccaaccuggugaugaaaugccucggaaaugaugcuuuacaccaacugaaaagaacugagcaaaauauuuacacucuguuuuaaaucauuauaaaauguaaaauauuaaaaaauaauugacauaacuucaugggucuuuaacuuacauauuuuucuauauuacugacaauguuucauuuuucuaggacagcuugcccacaagucuuuaaaaauguuucucuucuuucagaaaggaggugcauuguucaacacagcagugaccaaagcaacucccgcugugcggacugcauacaaauuuguaaguuuccucucugacuuucagacuucugcugauaaaauuacauguaugguguguguguguguguguguguguguguguguguguguguguguacaaccuugcaugcaugcauacauuuauuuuuguuuucuuuuucauggcauuuuuguuugagcguuucauauaugaguauuguauuuaugucacucugcuccuccuccuccuucuaguuccucuggugugacuuucacuccucaaauucuuggccucuuauuaaaauauaauuguuacauccauguguauuguguauguuuacuuaauuauaaauguauauaaguuacagauacaaccggcugaguccauuuaguguuucucaucgugugguuagggcuaaccuccugggcuuggcuaaccucauucuagagaagacagauucucuuucucucucagcugccauuaacuucuaguagcucauuuucuaggaaucaagcccuguuagaauuuuuccauccaccugcacaucauuuguugcuuaggcaaccauguuguugggauuuccugggugcagcuucccuguccucuguagaagauacuaucuugcagcacacauucugcccuggugcucuggcucuuagaagguucccaugaugcccguugagucucagcugugggguugugcuguggguuuaucagugggcugaguacccacugauaaacacugaguggugguucucaguguuuuugaccaguugugacuuuauaauguuaaacagggucucccacuagaguguggaccucacuaauggggccaggucgggcaagguccaggauccuugugaaccugccugccuuugccuuugagcacugugaauacaagugcagcugcguguccauccagcccuuuacucgucuggugaucgaaugcaggucuucaucccggcguggcaagcacuguuaacgucugagcuauugcuacaacuguuuuccauuuuuaaaauaagcuuuauaaaauguuuagaguucauaucaaacaaaauaaaagucuguuauuaaaauaauguuguauguaugggaaguuacuuucuuuauacaagcuaaauauauucuuguuuuacuuaguguuaucacacuuuguguagacuuaagcuuccuggaucacugugcucuugucuaugguggcuugggaacagugucauccuggagcugggacagcaacagugcaguguuuguaagacccagcacauagucaggaaacaaaguaaaggaggcuuccuuuugucugcuuuuaccuggaguacucugaguaaaaaucuccggugcagcgaaagccccacgauuaugaagcuccccgcuguccuaaguuggaccccacaauucauagccagacuggagacacugaaugauaagacaaacccuagcgaaauaugaagguagcgugaaguuguucagugacuuaauuuuugcuggaaaaucuaugggugaaauaccacuccccuagaugccugugucugaaaaagcacuucagcaacacucuaacauuucuucaguuucuugaagcuuacacaccuguccaaauaaccugacacugugauuacuuucucuccaucucuccaucuccgucuccgucucucugucucugucucucuuucuuucuuuuuuuuuuuaauuagguauuuuccucauuuacauuuccaaugcuaucccaaaagucccccauacccuccccccccacuccccuacccaccuacucccacuuuuuggcccuggcauuccccuguacuggggcauauaaaguuugcaaguccauugggccucucuuuccagugaugggugacuaggccaucuuuugauacauaugcagcuagagucaagagcuccgggguucugguuaguucauaauguuguuccaccuauaggguugcagaucccuuuagcuccuuggguauuuucucuaacuccuccauugggggcucugugaucaauccaauagcugccugugagcauccacuggaacucucuuucuuucuuucucucauuggucacaauuuucaguuaauaauggggauuagguacccgauugauucucgacugaauguuaacuuuuguguguuuguaugaaauacagaauugacccuuuuaaacaacaguuugggcuuaauaaaaugguaacuagaugaccucccuggaaauagugcuaggauauaauuuguuucuuuucuaacuaauauggauaguuagcaaaccuuauuagagauaaucuuacauaucuuuuuauuuaguaaaugauaauagaagcauaagaagcuugauacacuuauucucauuuccuaggcaaagagucacgccagacugggacuaaaggaggugaagagcaggcugaaacacaaggugcgucugccuucuuggucuucguacuuccccccugauuuugugugaguuuguagcucuacaagcugagauuucuguuuugauggcuuuuaugauaugcucuugcuuuguucaagaauguacuuuuuauaacaaguccucugacaacuaauucucagcuauucuguguguguucaccaaauaauccuuguauuguuugcauauuuuaucacagaauguggaguccuuaaaaaauacuuuuaguaggauguauguuuucauaaaauugauugcuuuuguacuacaauugaagcucuugcuucaagcugaucuuuuuuaaaaacuaacuuuggguugaaauuauucaaaaaaaugucaccauuugguuuuauaggaucaucccaauaguaguuaccacauugaggaauauuccuaauuuauuaaagaucacauaugauaauuugauuuugaaucuauggguauuccagguaucaugugaauguuuauaggucuauauuuauguucuugguuuauuuacaaauuacaucuuugcaauuuuauuaauaauuuguguucugauuuuuuacuuuugaagaaaauaaacuacuuaaaaaucuuccuagccaggcagugguggcacacgccuuuaaucccagcacucgggaggcagaggcagguggauuucugaguucgaguccagccuggucuacagagugaguuccaggacagccagggcuacacagagaaaccuugucugggggaaaagaaaauaauaaaaucuuccauucuaguaauggugaacauuuaucuuuauauaaauuuuauuucaauucgucaaaguauggauuauuuuuuaauuuaauuaaaucacacuauagaaaaucaugauuuccucaggauauucuuuaaaauuauacauauaguguuuuuucuuuuuauguuuaacaggcaaccuuauuaaugaaauaacuuuaguuuaaaaguggaguauuauaaaauaauuguacuuuucuucauguauaggacaaugaggaagaguaugggaccuguucugguuuggugcaguauacaccaguguacacuuuacacaaugaaaagggagagaacagagagaagcacaagcuuucccagguaaggaugcuugcccugugucccuggucucagauuacacaauuucaccaaguucuuuagaaguaauuugaaccauugauacuucucuuauucaaaaugcagcauugauggucaagggggagaguagugcacucaggacuugcauaauggagaaacaaauagcccuucugaaaaucccaucuuggugcagacauggaacaucccacccaguccagacauaaacuuauuauaauaguuauuacaauguuggcccuguguguaucuacagauaucguagcaccuauaaaagaaauagaaaauaaaaaguagugcuauucccaagccuuuugcauacggcuuacuuaacuuguguuucaucaugucuucaaagagcuuauaccccagugagucugggaacauugaaaugugaugaugugcaguacgaauagaguaacauagaacagcaagaacaaagugccuuuacugcaaacauaaaaugcgugacccagacauucaguacuagaacagcguuuggaaauccaaggguggagcucugugccugugguccugauccugugaugaggccucucgaucaucaugugguccugauccugugaugggggccucucgaucaucgugugguccugauccugugauggggccucucgaucaucaugugguacugacccugugaugguggccucucgaucaucaugugguccugacccugugauugggccucucgaucaucgugugguccugauccugugaugggggccucucgaucaucaugugguacugacccugugaugggggccucucgaucaucaugugguccugacccugugauggggccucucgaucaucaugugguacugacccugugaugggggccucucgaucaucaugugguccugacccugugauggggccucucgaucaucaugugguacugacccugugaugggggccucucgaucaucaugugguccugacccugugauggggccucucgaucaucgugugguccugacccugugauggggccucucgaucaucaugugguccugacccugugauggggccucucgaucaucaugugguccugacccugugauggggccucucgaucaucaugugguccugacccugugauggggccucucgaucaucgugugguccugacccugugaugggggccucucgaucaucguggcugcucacguuguaacugaagaugcuuuccuccuaauaucuuaguuaacagcacuguacacuguuggguucuuccccuuugugacaacaugugugacaggaagcugagucccugugcugccugggaucaaggaacaguucuguaucauuuaucacuagcugggaacaacucaaaaguugaaagaucauuuuuacuuaaaguauauugcuuuucuccauaguaaaacuaaaaacucaugaagccaaaccaucauagcaugggaacuauaugcuuguuuuuuucuguaccaagauauuuuauuugguauuauuauuuaacacuucgguucaaaugcugauaucacuaaaaauauugucccaagaggaaaacuguuuagaaaacuagcaauguaauuuagaguaggcucuggaaggcuuuaaccaauuaaaccuuacaugccaaauugugguugauuaggcaucuuuagaaaucagcuuuagagucaaauucauauuguggcugcaaagcuucuuuuacaacagaugccaaggcugacagccagacuagucauagcaaugucugugacucauacaagauuagggccagaacaggacaccggaaggaagggagggagggagggagggagggagggagggagggagggagggagggagggaggaaagaaggauggacuaauuuggcucacaguuuggggguacaguccacuguagcuggaaguccacauggcaggguuuaagcagcuggucccauggcauacacuaucaggagaacagaaggagagcugcggugauacucagcuccauuuuucuucucugguucacucugggaacacaguccauugagugguguugcccagcaguauagaaaaccuaaccaauauagaaaauccucacagaucccucggaaaguuguuuucgugggauucuaaacaccaucaauggggaaaucaagaggaaccaugucaacuccagauuuugucaucuugacacccaaacauaucacuuuaaaaccauauccuuccuuccaucuuuuauccucauaggcucauagcuauugcauaauccaaaaugcauuuagcauaccaccagaagucccuauagucuuuaguagugccagacucuuacuuucaucugagauucaaggcagucucuuaacuaguauaauuccaauaugcaguggcacagaauacgcaucccacccauaaaggaagaaagaugggauagcagugaccuggccaaaugagaccaacagccaguaagcaaacacuaacuccuuaagcuucaugcccuaagucugacucaugauagaaucaucugggucaaggccuggguagcccuucuucuccaucccugagaccuggagcacauagugucugcuuuaaaccagcugccgugcauacacucaguuuucuucagcuagugucucaaacacuuggcaucuucaaaauucgagagucugcacugugauuuauacuuugauaguuucauuaaauggcuccucuggauaucuuuacaggggcugcaacccugugacacauugcuucaccgcagugucucucuagaacuuugguguucucuccugacaccauuauuucucuuuuuugccugcacaaccaauaccuagugaauaaagcaagcugccaaguucaguugccagcugugcaugugccuggcucccuuggaaaacaauggcaucugcaucugucugcugacccugagaaaaaaacacaucucuagguaguuccuuuagagcauagaacuccuucagcaaaacucucaauacaucuacuuucagauaaacuugcauuucaacaauguggagccuaugacaaguuuggucuugcccucacaacacguuucuuauugucccaguguugaguccaggcgucuccuuaaugucauccaucucuguagcgaugcuagcuacuuuuaaaccugccucgucugcauggugaaguuugcccgugcucuuuuucuuaccacauugugcuuuuuccauguuuggugccacuuuuugcucucucuuacagcggaagaaagcaguccgcagcccgagugcucuccugccuuggcauuucccuccacccuaugaaugaauucaguccucuauauucagccucacuugaguuuucagaaaacaggcagaaugcaggcgauucuugaugucauuaccacacgaauagaccagcucggaucccaguagagccccugcuauuugaaauuucaggagccuguccucugugcacacauuccuuccugucagcauuccuaucuuccagcuccagcuagaauggccuucucuucucuacuuauagccuucaugggcuuuucuaccccaagguuucaaauucuuccauguucuuccuauacacacugcuccagagacugugaaccacacagaaggguugaacugcugcgguuccaguguucuuauuagucacuucucuaauaagaacaggacagucaucggaaggaagggagggagggagggagggagggagggagggagggagggagggaggaaggaaggaaggaaggaaggaaggaaggaaggaaggaaggaaggaagguagguaggucggucggucuauuuuugcuaugaucugaggucaggaaccaugcugggaaugcuguggacuguaaggcagcuggucacauagcaucugcagucaggaagggguggacugaguaccccuaagcuuccaucuuccuuuuuacucagguugugcccaaccugugggauggugcugcccacgugcaggguggaucuuccauucuuauuaggccggucaaucugaaacaagccucgaagaccugccaugauuauuuaaaugcucauaaaaucaacagucaagguuaauaaucacaguaccaugaaauguuuaugguaagaaagugcucuugcaugacugauuuagccaguguuguaguacuguaacaaaauacgugagcuugaguaauacauaaggaacagaaaaauacuuuguagauguuugaaggcuggagagccuggguaaaggcucauguguuauaaagacauaaagauaaugugcuacauuaucacauggcagaagggcaggacagagcaagaccugaugguggggaugggagcuuuacaugaauuucagaaggaacaaucgagccucaucagucauaggaaugaaggaguuugguagauuuuuuuuuuuuuuuaagaaagaguuuauuucaccucauaucuuacaguacaguaugaauaacaaucaggacaggaaauuaaacaugaucuuggaagcaggcacugaagaagucaugaagaaauacaauuacuaucuugugcagacugauuucuuauuccagcuggucagggauggcacuuacaauguaaaucaucagucaaggaaagacucaauggucuuuugccuacuagucaaucugaugggcauuuucucaucucaaguuuccuucuucagucugacuccuguuagacuagauuugaucaaaaacaaagaacgaaagaacaaaagaaaggaaagggaagggaagggaaggaaaaggaaaaggaaaaagaaggaaaaggaaaaaggaaaggaagauuuucuccaagaaccagcaccugguuugguugauucuuuauauaguucuuuuugcuucuaauuaguugauuucaacccugaguuugauuauuuccuguggucuacuccucuugggccuauuugcuucuuuuuguucuagagcuuucaggugugcugucaagcuguuagugugugcucucuccaguuucuuuuuggaggcacucagagcuaugaauuuuucucuuagcacuacuuucauugugucccauaaguuuggguauguuguggcuucauuuucauuaaauucuaaaacgucuuuaauuuucuuuauuucuuccuugaucaaguuaucauugaauagggcaugguucagcuuccauguguaugugggcuuucuguccuuuuuguuguuauuaaagaucagccuuaguccguggucaucugauaggaugcaugggauuauauuucaaucuucuuguaucuguuaaggacuguuuugugacugauuauauggucaauuuuggagaaaauacuaugaggugcuaagaagguauugauauugaugagaguggaguauugaagucucccacuauuauuguguuagcuuuauuaaaguuucuauuaugaauguuugugcccuugcauuuggagcauagauguucauaauugagaguucuucuugguauauuuuccuuugaugaguaugaaguguccuucccuauauuuuuuuauaacuucucauugaaaguugauuuuauucgauauuacaauagcuauuccagcuuguuucuugggaccauuugcuuggagaauuguuuuccaguccuuuacuuugaggaagugucugucuuugacacugagguauguuuccuguaugcagcauaaugcugggucuuguuuauguauccagucuguuagucuaugucuuuuuauuggggaauugaguccauugauguuaagagauaguaaggaauagugauuguugcuuccuguuauuuuuguuguuagagguggaauuauguuuguguggcuauuuucuuuuggguuuguugaaagauuacuuucuugcuucuucuaggguguaguuucucuccuuguguuggaguuuuccaucuauuauccuuuguaggucuggauuuguggaaauauauuguguaaauuagguuuuguuauggaauaucuugguuucuccaucuaugguaauugggaguuuugcuggguauaguagccugggcuggccuuuguguucucuuagggucuguaugacaucugcccaggaacuucuggcuuucauagucucugguaagaagucugguguaauucugauagaccugccuuuauauguuacuugaccuuuuucccuuacugcuuuuaguauucuuucguuguuuugugcauuugguguuuugacuauuaugugaagggaggaauuucuuuucugguccaaucuauuuggacuucuguaggcuucuugcauguuuaugggaaucucuuucuuuagguuagggaaguuuucuuacauaauuuuguugaagauauuuacuggcccuuuaaguugggaaucuucacucucuucuauaccuauuauccuuagguuucaucuucucauuguguccuggauuuccuggauguuuuggguuaggagcuuuuugcauuuugcauuuucuuugacuguugugucaauguuuucuaugguauuuucugcacccuucuaucgcuuguauucuguuggugaugcuugugucugugacuccugaucucuuuccuagguuuucuaucuccagguugucucccuuugugguuucuuuauugccauuuuuagaaccuggaugguuuuguucaauuccuucaccuguuuuuccuguaauucuuuuuuuuuuuuuuuuuaauuuugguuuuucuagacaggguuucucuguauaguccuuguuguccuggaacucacuuuguagaccaggcuggccucgaacucagaaauccaccugccucugccucccaagugcugggacuaaaggcgugcgccaccaccccuggcuccuguaauucuuuaagggauuuuguguuuucuuuuuaagggcuucuagcuguuuaccuguguucuccuguauuucuuuaagggaguuauuuagguccuucuuaaaguccucuaucaucaucaugagaugugacuuuaaaucagagucuugcuuuucugguguguugggguauccagggcugacuguggugggaagaccuggguucugaugaugccaaauauccuugguuucuguugcuuauguucucacccuugccucucgccaucuggauugauaucucugguguuagcuuguguugcugucucugacuguggcuucucccuccuguaagccugugugccacuccuccugggcaaccaguucucuccaggaugaauuuggguauggagaguacagggucagcccaggggugcagacagaaaccugaaggauccuguuccuggcuguuacuuggugccuguguccugagguuucuggguggguccccaggagcagaggugauggucuuaccugugcucacaaaugugccagcacuccuuggagaccagcuuucucuaggcaguaguauuugguauggagcacuguggcacaggaucagcuccaggugcagacccugguagaagaagugcgcucaucuaauaauucaguacacacugugucuaggauuuuccuagguaccagccguuaacagaagaaaaacauggaaauauucugaauucaugagacuauuuuuguggcaaacuaaaugauuccucuauuuuuccuuuuauuaagcuuauuuucauagacuuauuaauuucauauguuauuaucaaauucugauuguauuacuaaagcgcgucuuugaaugaagucauuauguucauagaaaauggccaguacaucacacacugacauuaaaccaggcagcccuuuccuaucugcucuucugacaccacuaauacgcucaguucuugacugcucacaagcuucagggcucuaaaucacucugguaaacuuuuuuuuaccagcucuguaauagaguauuuaaaugaugauauuuaccauagagaagagggguuuuuuugaugagaaaaaaacauuuucaauagaauuccuuaagauaaaaacauuuaaaucacaggaauccuuuucccaaauauguaagaugagagaauuuucauaugcuaauuauuaaauuuuccuuguauaacaggauaagauauuccuauuauaauuuacuaacuucuguuuuuucacauuucauguuaauuucuagaaauggauuuuuaaguuguauuucuuaagguauacaaaauggcaaguugguuauauuuaggcaaauuaaccaauaaacaaauucuccauugccuucacaggugacuuucugugauuccuaagagcacauuagaccuacauguagccguuuuccaauaugaguuacauuaucauuaaacugugauccuucccaacugcaucugauggaaaaauuaguauagagcuagaccugacuugguuuuaaaaggaaauugcuuuugacauucaguaaaauaaaauaucccuuuguuuugcuuucugcauuuuaauugauauauuguuaacaucacacauuauuuuccuaggcugcuauaagaauuauagauaauauaaauaaaauacuuccuaaauaauaaauacaauagguagucuacaguugguagauauacacacaucuugagugccaagucuuuuguaacaauggcccuauuagacuuucuccucuugugaaauuccugcccuuagucacuugacagcacuguggccacagaaguagcaggcauucaucuucauucuaagugggguccugacugccgacuuuagcguaugauuugaaaggcaauauacaucuuguauuaugaauaaaucucuugucuguaacuuuguaagaugguauuuguuuuauugucagcuacaauaaaaaaugacucugaauggauuugucucauuccauucugaguuuguuuauuaucggacauggacccaacugugaaaagaauguagcuuuuccaguuuccaucaagacuugccaaugaaagacuuuguuuuuauuuaguuuucagaauauuaaaugaaauuuugaucauuugaauuauaagaauguaucuuuauuuaacagaaggaaagucuauaguguggaugcuauggagaagaauuuaaauaugucuaucccauuacuuugcuugucuuuggaauagacuaugaaucuauauucuacccccaacaaauaguaauuugugugcuggucugcuaauuaguauggcuauuuucuguuuuguugaugaggcuuaaauaaaugucaaggguacagccaugaagagcucccaauuaggcuucacauuuguaaaauccagcccuuucccuuuuguguggagaugacaguucuaacagccgccccagccuaacaggacuccagggagaggauccuucucugauuuuauugaaaauagggccuguuuaguccagugagaauacugcuaccggucauggugcagagcaguuuuaauccuauguacuuaccuuuugucaaucuuauauuaguggaauccugaagaguuagugagcaauauuagaccauuaauucuaauucugccauaugaaauugucuaaaauguaauagaaaaauuuaagaauaagagaaaaucccuuucaauaauaaauuuaugacuaacugcugaacuagaagcuacuuuaaaggaugaaacauuuuuugccuuaguccagcaaucugucuaucucugucugucugucucucucucucucguacacacacacacacacacacacacacacacacacacacacacacaucacacucggcuaacaacuacacuagugaacaagugugagagcucagcgcuaccacgagucaacauuaacagauggacggcccuaagcaaggcauuucacugugacaaaaucuuguggaagaggcccgagcaagcuuuuuguugcuaagccugauuaaaacccuggcacacacaccacuuuuaacucuuucuugccugagacagaagccaguccacuagaguuucuccuuuucugccaucuagauaguuuauauaaaucucugcuggaaaggcuggccuuuccuuuaugguaaacaguguccuugacaauaaauacacacuaggaauggaguugggacuuuguucacgaaugggacaggucuaagagccuuguuacuaucccacgcuacaauacugguagccaugcuuauauauaaacuaguaauuugaaaugagaacaguuccuccuuaaguaagugaugaagaaauuuucaucauaagauaugauuaauaauuuuuuucuauauacacgcucacuuauaaugaaauuuugguuuuuauauguuaaauuguuuacaaaccauucuaacagaacuaaauagcuauggcaaguuuauaauuuauaaauaguauacuuuaucuuuaaaaauugugcccuaaagguauguauacauauauaugcacauauauauguauacacacacauauagauguauacauacacacacacacacacacacacacacacacacacauauauauauauauaucccacagagaauuguaaacaaaucauuucauagccacaguaggaugugugggcauaucaacaaaaucucaccauccuaucaucuucaaugaaaaugauaaucagauaauuuauguuuuauagacuguuuuauacacuacaaaugugcauaaugucuaccuacaaauguaaguaauuuaagugcaauuuaaaauacaaaacuuagauaugauuauaugauguagcuuauaagaaaagcaagaaacucauaugaaauuguguauaauuuaugguaacauauuaaugccaaaauuuuauuuauaagaguuaguggacucugaaguaaacuauaacuauaauaaauggcagcacuucuuguugagacauaggaaguguaaaaaguugguauaguugccacuuguagagauccaccccauaaucagcauccaaacgcugacaccauugcauacacuagcaagauuuuaucgaaaggacccagauguagcugucucuugugagacuaugccggggccuagcaaacacagaaguggaugcucauagucagcuaauggauggaucacagggcucccaauggaggagcuagagaaaguacccaaggagcuaaagggaucugcaacccuauagguggaacaacauuaugaacuaaccaguaccccggagcucuugacucuagcugcauauguaucaaaagauggccuagucggccaucacuggaaagagaggcccauuggacacgcaaacuuuauaugccccaguacaggggaacgccagggccaaaaagggggagugggcggguaggggaguguggguggauggguaugggggacuuuugguauagcauuggaaauguaaaugaggaaaauaccuaauaaaaaauggaaagaaaaaaaaaaaagaaugucacaaguucaaagucagccuaaguuaccuagcaugauucugaagggagaagccacuuacuucgucacaagaaaaaaguaauuauaagcaacaaaucaagaaaaauaauuguguugucauggguuagaggagaaauuuggcagguaaauauuaagacuacuugguuuuguuaaauaaguuuuacauaagacauauaauuauuacuuuuauuguuggaaauuauagcauucccaccaagccuuuccacguacccgaaccuguuuucccucagcuuuguggugucugucuucacuaaguguccauacauaucuacauguucuccugaguacagucuccucagccuauacauuauuacuacauguauguuuucagggcugaccacuugguauccauacccagccaguacuuuucacuggagaagccugucucuccccgucagcauuuguaguagccuguugucauugguguguuccuccuguccacaucagacaugucuguuguuguccuugcucaguuaguuguagcuucugauauuaugaggagacacaucuaucucguaguaagcucccugaaccucaugcucugcccucugcccuacaaugucccugagccuuaggugcuggauauuauuauuauuuuaauauuauucuguagauguauuccauuggaaccugacuccacaguggaucuguagugguuuucuguaacauuuuucaucuguugcaaagagaaguuuccuugaugaggggcgaggacuagacguaucuuugguauaaggagagagauuuaagauguagaguuugugcugguuuagugaggugauuguagcuccuucaagauugaugucuucacuggcacuggggagguggccaaguccagaaccaggaaugguuuccuuccuucugagcaggacucaugaagacaaauaacucuaagaaccaguuuugauuuucuguuuauuuuggcucaauauugaagguacuaugaaggucaauugcuaguugaaguaauagggaaauguuuuaaaacacuuuaaaggauaaaacuuuuugaaauacguuaagggaacaugaccauaagaaguauugccuaaauaaaagcacauuauagcaacgcggauuuuaggggcucuucauauuggauuuaacauaauuuauucuaauggcaguaacuuauacaguugauuuucuggugaaauacaguauugauaauuagaaagaagucaccuucuccgauggaacacuauuucuuucaaacauuucguauuugguuguaguuaaaauuguuucaaaaagaaaguggguucuggauugcaagcaugcccucuaguggacauucuguggaacuuuccuuagaagucaauuuguagugccaggcgcagaaggaagcauucaagccacccuucagaaacugggcuuuaacuucaauuuaacuuugcagaacaaugcuuaguauauuacaaagcauaauggaaaauggucauauuuguguaaauaugucauauauaauuuuuaaaaauuuuaaaguuuaacacuuuaauguuagaauuuuacucuuuaaauucauuuuccauaaauaacuauuauaaaaaucuugaaacaaagacaaaauauacucauuuuuuccauuuaguaaaucugguuaaugaauauuuccauuuuagacuuuauauagaaacauggaaacagauuuuucccucuguuuucuguccuuuaacuuuuuaugguuuuuuuuccccccuuccuauucagucuuucagaguucugaucaaauuaacaacaauucucuauuccaaaaauacccaauuucuguauaaaaauacccaauuucuguauacaaguucuuauuuucucucaagaaucuuaggauaaggaaaugaugcuuucuccugucuggcuuggcuugguuugguuugguuugguuuugcuuugcauuuacccccuguguggcucugcuuugaaguuugucagagaucaguugcugguauugguggugggaaaagccauuagugcacaguagcuagucccacuauaaauucaggaucuuugccauuucucaaaggaucacuuauuuauucuucuucacugagguauuuaauacuuaaucauauuguuuuuguguugacuaauaauuucuuacacugaaaagcuguaaaaccacuggucaaauuuguguuuucaaauguuaaagaccuaagggguagugggauuuaaaucacaguuggugucacccagcaaaugaacagcccuuaaaaccuggcuucccaauguccagcuugaagccauguuuguugcaagugcccauguggguaagugugcauccucugaguugagacgucuuaugccaguuguugugucuuagagacagccuccuggguauugccauugccagcugcucauagucucuggacaacaagcaagaguggacccuaaaguacuguuucugggaugaguauuuugccaaaccagggaucacuucugauuuccugcauucuauuugucaacugaaugauuuuuuuuuaaaguuuaaaaaagaaagaaagaaagaaagaaagaaagaaagaaagaaagaaaacuagaauagauuaaaagcaaauugaaaugagcaucuguuacggcacuggugcuuugauuuggacagaguggauguaucaucaaggagagucccguuuaacuaucugaccaucaggguaagcuacuuccuggcuuuggagaccaugugucuccucggaaccucaagaaguguuagucccgcuaauuuagcuuugaagauaacuugcuuccuuuuaaguucuuaagcaccaugauuuacaaauacaggaagacaucuauauucauucucugcccaucagccuugucauuuaauaggaaggaacagaaauaucugcguuuuuauaauaugaugaacacagaccagaauagcagcucugcccuguggaugguuugggaacauaaacaucacuccuaaaccacagccuccggggcuguaaggugaugguaaagugcccgccuccgcggaggccucuuccacauggugcuuccagagcucucuacagucaguuucacagugagguaauaguugcccauuuuauuuacaguaacaauccacuauacauggggguggggagguggagagaaagagagaggggagaccgagggagggagggagggagggagggaaggagaggagaggagaggagaggagaggagaggagagggggagggggagggggagggggagggggaggggagaggagaggagaggagaggagagaggagaggaguaguucuggggagccagagagucuccucuauggaaacagaaugcacugcacgcgcugcugcuggcaaggcucugcuuuugggugcucugcacccuacuuucuuguuaauguucuucauuucacuugcuuugcuuucuuuucucuguguguuuuauucaguuauggccaugucuuuugaccugucucagaucggugcugaaucugcuaaugaggucuggaacugauuuucaucuacuguaucaggaugguuuguuuuguuuucuaugaguuccacuugguucguuuuuaaauuuuccauuuuuugcuaugauucauuuccucaugcauuaucuauucauuaaugucucaaaauucuuaauugaauuccagacuuuauauauagaguguauuaauauuugcaucuauaaauaaacauguauuuucuuuuauaauggcauugauuauuacaagcagguaugugucuggaauuggauuuuauuauugauaagcauaucagugggaugcuaugaucuccugcuuuuguagaauacuuguggagaaaguucuagauucucucaguuuuccugauucauccuaagcuuucugaagguuuugucugccugagccacaugggaacagggcugaacuugguccaggccuuguggcuuuucuguguaucuucauucuuaggcaagccaugucccuuuacguccacuguagccuuuauggcagccccgugaguucaucucuguccuugugacagauuccucaaagaaacaauuuaaggaccauucacccacaugccuugcuucaugguuauacaaggcauaucaugacaacaguaucaugacagcagugagucuggcagggugcuucccucaugccagccccagagccagcgcagaagagaaaggaagaggccaaagaucagcuugucuucauggagcacccccuggugacuuccuuccccccaccaagccucaccaacugaaauuuccaacaucaccuccaccucucuccaaaagcaguggcaacuuggucaaguugucaucacaugggccuauagaggacauuccuauucaaacgcuuuccuuggagggggaguuccugggcccuccccagcggugucccuagggcuugcuguccuucacaccuguagggaauuugcuucuccacuuucccuaacagucuugggaaggguuucguuuucuaugaaauaaggauauagaaaaguguguugagugcccauccgcagucucugcucucaacuaccagaggcacuuugucuuuccagucugucucgcaugcccucccuuuagcaaauaaaguuagaggaauguguuuggaggaaagagcuagagacugcaaacacuccucccuuuggcuuggagauuccucgcuacucuuaaguugacacaugggccuauacauguccuuuauguaauguuugaacuuucgguaagcuuaucuccuuguuuguugccaaggccuucugacagaugaggcccaguuuccuugguuacugugaaucgggauucaaaagugauuauguuauacuuuuuagguuaucuagauuuggucauuguuaagaugggaguagcauucugcagaaguuuucugcaucuaaauggaaguaagaacuaaaauguaaaauucuuagucucaggccuguaagaucgaaugcuauuagggauugcugcugguacaaggaagcucacagcuaaguuguguuuugucugcauguaucuaugugagucaccuguuugccuggggccugaauaggucagaagagggccucagaauuccuggaaguagaguuugaguguuguuggcugcucuuuuugugcugugaacagaacccaggucguccucaagagcagccuguguaggugguagguaaaggagacaaggcacaagagcugacaaggaaugugagaucacuguaggcaacagcuggaggacuuguguguggucagggccauauccaaaucacugcugacagagccacuguguaccccugcucaggacuggccuuaucaaaggcuucauaagaccucagcuuuuuacccaguaccaacaggaaucaucagcucaguccauuugaucucacagaucaugagacuuguuagucuuucuaguccccuaagugccccaggaggcuguucagucgucaggccucagcgccagucuccugccucacaguguccugccuuccuggagcacuagcaucuccaucucgcuaggacaguccuugcuuuaaagucgggcuaaggcuugaccuuauaggcagucuuucucucucacaguuugucuggaccccucaggacacucucaugaagcauggcaauaauagaaauagugcauuaguggagucuccacaccugagacagaguccuagcucugucccuuucgcauucccacccaagucacugcuugcuaacaucgcacucaucaugcacagcaugggaaagugcucagcacaguuaguguagaguaagcuugccaaggaaaccucuagaacugaagaaaaccuucuguaaggcuuuaacugcgcuucaguugcucccuguaaacaucaaaaagguauuuuaaaguucuuugcaaauaacaaaacuacugugcauguucaaggcacugccguuuuguacugugauauuuucauaugccacaaauggguuuuaugcauaguaucagguguuugcuguagacuuuggaucagcaaaaagucuuucuggauuuugauugccucaacuccaagaugggacaguaucaacauguguucuuacuuuuagaagcuggagagaugacucagugguuuaguggugccuggguucaguucccagcucauaaagccguuaacaauacucaaaaucuacuuccaggaaaucugaaacccucuuccuccucaggcuccaggcauacaggugacucaccugcaggcaauaacacuuacacauacaaauaaauaaauaaauaaaucuuuuuuuuuuaaguaaggcuauguuuuuuaaaaaguuuauguaacacacacacacacacacacacacacacacacacacacacacacacaccuguaauccuagccccguggaggcagagacaggacugugaagccaaggccaguaugaacuucauagugagucugucuuagaaauguuacauauguuauuagaaucucaauucuguuucaucugcuuaugucagaacuguuucucucaacucucccacuccacccaccaccccacccuacccugcccuugagcuaagccgcacuuggccugguuaacauuguuugccaucuagugaucacagugguaacugcacacuuaccaggcuccucggcuuuggccauuuuagucugaugugcuucccagaaggcauugcagggaagauagcauucaacuagccugaauuggcuucuugaguucuccucggacauucaguugugugguucugugacuuaguccuuuccugugagaugguguguguuuucuuuucuuuaaacaguuccugucugcaucagucuuguuuaucucauucaguaucuacacagggucaggucuaggaagagaaagaaccacucacaguuccuuccauacugauagacauucuuuuucaauagcguagcauuuccccaccguccuaucgaggaacccucaaccuuguggauuuucacacacacucagugugcacuuuacauuuucacgaaagcugacuuguauuuuauaacuauacauguucaaauuuagauugagauuugugauguacaguucuaagucucauuuuuaauuuuuuuucuaagugauagaagcuuugcugccuuauauucuuuuuaaauauuucuuuucaauuuuuaaucaugugucugugugcaguaguuugugugaggguauguaaaugaaaucagaaguaucaguagcgacuagaauuaaaaguaguuguaagacacccaauauugguacugggaaaugaacucaaguccucugccaaaacaauauaugcucuuaaccacaaagugaugcagccccuauuuuacccccccaagguguaucuuuccuguguaauaccuccauccuagaagaagugguaacugcccaccuguauguaacccugagguguuuauuuccuguuugcaauagguuuauuccauagaggaaauauuuuuauuauuguauuuguaccaugaaaacagugaaaugcauaauaguugguguuuacugcauguuuguggaaugaagaagugcuaagaacuaaaagaaaagagaugcacccuuaccuugaagcuccgacuucaaguaagcugccagaagaagacaguugagcccagggccucugugcugcccucugucugggacugugaaucugguauugguucuucccugccacccuugcccacauucucacccccucauucuccugcuaaaucaauggugccucuagguaacaccagguuacguaguccagcugacuuuuuaauaagugugugccaccuagugaucaaaagaauaacugcaaauguugguggccccgaaaguagcaugagugccaugauaacaaacgucucguguuccccugacuaccccaguggagggaagcuguaugugugcuuacuccuucucaccaucuucuuaacacauggccuuccggagcccagggaauagagaguuccuuugggcucaaugauuguuaggucaaauucuuacgaagugcucucucagcagggauagcuuaguaggagcuaauuugagucacaccuuuugugcuuguuggugugacuauuggaguuuguuuaguuuuuauuuacuagacuaacauccauaaggacacaaagcucuguucuugcuaguucuugugccucagcacauagccuaaugcguggcacaaaaagauggcccuccauucuucucugagguuaugaaugggccucagggcacagaagaggcugauaucagccgguuaaauacucagcacaacugcgcuggauggucuuaugucagcuugacacaaacugaagucagcagggaggagggagcccgaaguaagaaaaugcacccaugagaucaggcuguaggcaagcuuguagggcauuuucauaguuagugauugacgggggagggccuaucacauuguggguggugucaucucugggcggguagcccuggguucuauuaaaaagcagacugagcguuccaugaggagcaaggccguaaagcagcagcccuuccuggccucugcaucagcuccugccuccagcuuccugcucuguuugaguuccugugcugauuuccuucagugauggauggugauauggaaguguaggccaaauaaacccuuucaugcccaacuugcuuuggucacgauguuucaucacagcaacccuaagacaagaaccuaccugcuauauaugcaaauauuuauuucuucaggaaauaucaacugcaugcuuuggaggaaggauaagccuauauuaaagaguaaaaucauguacauauuuuauuuagguuauuaaguguuguuuugcuuucaguugcugugauaaaccaaaagcaacuuggggagcaaaugguuuaucuccacuuacagguaacaguccucauaguggaagccaaggcaggagccuggggcgggaccauggagggaugcugcuuacugacugguuccacguccaccugcccaggggugacagacccacaaugggcagagccuccugcaucaauuaacaauuaagaaauuucccccugagacaugcccacaggcuaaugugaagaaggcaguucuucugucccuccuucccacaugugucaaguugacagucaagguuagucaucacaugaagagaugagggcaccaaugagacaagacaacaaacaauccaggggacagcacauagacagcaagaagcacgagcggcccacagugcagaugccaccuguagcuccagugucuccacuggacguagguuaacaucuacaaaaaaggaaaaugauuauuaguucauuuuauguguuucuaaaauucuuuugugaauaucuuucauaaaguacacuaguuaguagcaucucugugaaaauuaauagaggccugguagguaggaagugugaaauaacacucagauuuucugaugaaguucuuuucaugacuuaaguauuacguagauuguacagaguuugggugaaauacuggagagcccugaggcaggcaggcagcuacaggaugaaagugucuuggagcagccaggaucugcagcgcaaccgaugacagcgcuuccucugcuguugcugucccuguucugcaugcuguaugugacuuggagaaacuauccagcaucucuggucguaccucagcuuauuguggcgaucacuaggcucugaaaugguaaauggaaagaaccuaaccuuguguguaugugagaggccucuacaaagaacuuagcaaauauauugcuauguacuuacugcucaauauucuuaucuucguaaauagugacgauauuaacaaauagcagccaaguuaagcacauuuuacuuuccucguaguuugcuuauuuuguuuuaaauuuuaauuguuuuauuagaaaguugcauauguagaguucauuguacugacagugcaguauuguauuaauuuguuuuuguuguuguuuuuguuguuauuguuguuguuguuuugggaaagagaguaagauuaauuuucccucccagaacgaauguuguggucgauaguuucguuccuagauaauucugagaacuuuuguccaacugaagaaacuucaguuuauguggcaaacugacauggucuuagccccucaguacuuccucauccucagacuccugggggacucgcuacacaauucagucacaggucacaguguuuauccugugugucugucccucguugcuucaccuuaggagcauuggcaccaaggagugagcagguggggcucucuagagaucccagagacuuauuuauucuguagugcagcccagggagacaucugugggcuuggagacaagcagguccuccuuuaggggauguggccaagggcaaagccaaggcuaaaguuccccacccagaaggaugguauacgauuuugagcaccaugacaacaaguuuucaccucugaaugccauuacccacuugaaaaacccaaagcccuuuucugagguuauguccgagaagacaugggccugcuuccauggguaaaaggaugaugauguaaaaauuauaaccuuauuuuugaagcacuggaccauguauaauaauaaagagaacauuuuagaaaucuucagauauucuuuauauagcuuuagcuauagcagugaugagcucaaggccagucaccaauaccggauuauuuuuaaggaaaaaccuaaccaugaaucuuuuaaccuaugccuuucuuaagaugugugucuugaagauaagugcuuuuaagccaaaguucaacaaugggguauuuugaacacuaauaauaacuggugguuuaaaauguacuaaauauauauaagccaugacaauauuaaaaauaaccucaucuugucaucaauuuagagacugcuggggcaguggcucauuacucuuggaaauaaaagagcacaccaacaacuucuaugcucuuuuuguucuguauuauaucuuaauauagugcuaaauaguaaaggguuuuuuauauuuauauuuauauuuuuuuaauaaaauuuuaaaaauauaaaaggaauacucuauaaaauaacucuaauaaaaaauggaccucccaguggucaugacaggugaauggaaccaagugaguggcuaggcaagccacacccagagccauguuaacaaaauugaacaucacaugccuaccacuguguacuauaagacugcacauugccaccguggcuugugcucgccagaaacaggcaucagucagcugaaaauggagucuggaccgccacauaaacugccaguuuucaggaaaugagggugggcuaccauguuucagucauggcuggugcaaaggaaaggggacacugaaggagacuggggacauggcacuacaggcagcacugaccuguguaauucugacccacaaauuaaauguauggagauagucuauaugguguaaaagauuaaagguaacuucauuuguagaugucacaauuuuuaaauuguguuaaaaagacaucuuggagcuaggaagaugcuucagcagcuaaaagcucuucguggauggcucagguuuggaucuccaaaacuucaaggaagcucacaacagucuguaacucuaguuccagggaucugacacccuccucuggccucugcaggcaccaggcaugcagcaguacacauacauacauacuuacauacauacauacauacauacauacauacauacauacauacacucauacacauaagacaaaauaaaucuuuaaaaacaaauauuuguuaaaaauaccuagggcuggcaagacagcugagcagguaaagguaguugcugccaaggcugaugaucugaguucaguuccaaggaccgucauaguagaaggacagaaccaacucccgcagguugucaucugauuuccacauguuuacuguggaaugcaugugcauaauaacagaucagccaaucaacaugaacauuuuacauuuuagaacgucuaaugaaugcauaauauagcauuuucagguacaaaugauaaaucguuauuugaagaucuugcucuugagagugaauuccucggaucgagcacugagaccaucugaaaaugucacaaaugcaggaacuugggccccaacacuccagaagcucuggagauccagagucugcaucuuugcaacauuauaaaccacguaggagaugugauggacaacucucgaugguucuuuuaaaaaugugauaguugccuuguggaugcauggugugacuguucaccuauauaucuauuuccagcuacuacuggagaagcuaggaaguguugauucuuuuuaaaaugcugcuuuguucuuuuucuccuuguucuaauuugucagguuauuggaugacauucaaagcuuugaaaacauaugucuaaguauuuguuauaaaaaauuacauuguuccuuuaaaauuauuaaagagacauauuucaaaucaguaacucaacuuauugucaacuuuucucuccagacacacuugaaaaggccucauaagagccuagaugguacccuguaugaugaugaugaugaugacgaugacauugaacgggcaagcaagugaguccagcacugcgggacccugugcaguggcauggucuuuaggcacuaguaaaguucauguuugcucccucucaauguucaccaacaaacagaaauggcacuccuuucaccgccgugaggaaugaggcuuaggacaggggcagggcaugauagacuugaaaugucguguucuugggaagcagaguuauauucagagguguccaaggagugggaaagaugacagaugaacacuaggucagguugucaccccacacugagagggacaggugacauggggacagugguaacaguccagugagccaggggagggcuuaaggugaaggcaccaucacaggaaggaaggagguuuagaacuguuucuugauacaaagaauggagaauuguauaaacuucauuuuuuuaagcaauuuuaagauacauaguaauaaaauggacauccuacauaugaaauaaaccugucuacauaggagaauauuuauucuucuccaaaacaaauaagaaaaggacaaccauauagaauaugaaugcugcaaauauucuaaguguucaaucuaacguuucuaggaaauccccaaauccuauagcgugagacagauggagccggcuucagauuacugagccaugacauuguguuuauugcucuaauguguguacuuaagucuuuuaguauuugaaguggauguaugcauaacuguggagacuuugacuaauuuuuauuucucuccuuugucccugccuguccuucaacccucucuuuccucuuucucauuucuuccuuuucucccagucuugugucucccucucuuuuccuccccuuuuccuuccucuaaaccucccucccuccuuuccuccucuuaacccuucccucuccuuucccugguuucuuucuggaacccagacuagccucacacgugcaauccuccugccucagccuccaggcugcugggauuaaaagucaacaucacccucaccuccaguugugaccuuguuguuguuuugcuggcguuuguuguuuagcaagugaguugagacuccgccugugccgacugcccuaccuugugucuccuuucaggauaucuucugaagacggggaagaaacccgugcuuauuucuacgaaagcgaugacuccguugaagcccaggugaaggcuccuuacucaggggagauggacuuacugggugagauccuggacacgcugagcacgcacagcucugaucaaggaaagcuggcgccugccaagagccuggauuucuucagauccauggaugacauugauuacaagccuacgguuaguugagacacagaauuaaauggaaacccucuugcccuugcuaugguugcccaaucagauaaguaaacuuaguuuauagaagcauuuuuaccucuagguaaguacagaaacgucaaacugugguaaaaaguguacaucguacaucguacggauuacuucugcagcucacacugcugcugcagucacugcucuggugcuacccagugaugccccuuucugggcauagugacgucuaguuuagcauucacccuugugaaaacauuuuuaugugaaacauuccuauuuuuauaaaaacuccugagcuuuaaaaaaacacuguaauuaauaugucuuaaaaauauuuuuucuauuuucuuguuugaaaagugaacaguuuuaaaugaacuaaagugcuucaaaauaaaccuuuaugugcagugggaccccauucugacuggagaacaggacguucuauguggauuugacugugacaggugacaaucuaaacacauugaaaccagaguuuguggaguccccacccgacacccaucauuccucuucauggggcaggcaggaacugucaggauucagucagugcuccccuaccccugggguggggcucaggccccugcugaagcauggugaccuugcuugcaaagcagacaccacuaaagaaucacugccauuuuauuguaaguauucugaaguuguaauucccuucccagaacaaguccaacgcucccagugagaauaaccuggcccugcugugugcuucuggagaccagggagaguggaaucucgggcaggacgacagcgcccuccauggcaggcaacucccuccauccccaaggaaacgcguuuccucuggugggcugacagagucucuguuuauccugaaagaggagagcagggagaagccccucugugcugacagcguaaguggcccuacuguggugggaaagccagcuccgacuucaggacugcguucccagccugcugcuccugaagcuucccaaacagagagaggaagagcagaagugaagcaaacaccaggucaggcuccacuucagucagaggaucugucggugcccggccccgggagccgccagucgacuuuuguucccugggagaaggcuggcaaagaggacacgaagccuucaaaggaugucggacuucuccaagaaguagugucauugugucacaugucaugugacuuccaacaagauuuaaacauuucagaagaaagcagaaguggaaaccaaacuuagguaccaguagugggucaguugcuugccucuuggcuucuccggaggcauguggaauuccuucccugagaugggaacaguagagucacugauaggaauggcgaccccuacugcagucuaguugguuucccugucuguucaucucauggaucuguauuaccuguugguuucccagcguaaaacgaauucugcugugcuguuaaaucagguacuaacuuguacauaggcugaaaguguguuuugaauuuaagcuuucccaguauuuggugcuuaaugcuguuuguuuuauuuaaacuaagugugcguauauaaccccacauaucgccaguaguuacuguacuaaccuggcugagcaugaacugaucaagaugucaaaacugauggaaaauagccugacacugaugaaacuguuaacccacuaauugccuuaaucuuccaguuaugcuaaacauacagaugacgcgugaugcaaagcuugaaagaggaguuaucuuguccugcagagcagugaugccuuuuucuaccaugaacuaagcucaccauucuuuuccaguuucaaugcacucuagcagaaauaauuugcuuuuuaugaagacauguagccauguuuuccaagcaacgugaauguguauauuuaccuuucagugaacuauauuaagugcugacuuacaaugugaaguuaaaagcuucugcuuacaaagaagccccucaauggucgaucucauguauguguuaaccaugguucaccgcccgaaagccaaaugcccugcagaguccagauaggcuguuguccucuucucuuaacugacgugcugugaagaugcucauagccuuaccuuguguuugcuuuuuuaaagaauuaacuuuguauuuuaaauguucuucuagauuuguagaaaaaaugcaaagaugguacugaguugcucucugcccuggacccugucucugcuguuguuagcauccuauguuagugugcugcauuugcccuaucauugacucgcugugugguagucagagcucugacuguucccugcuguccccuuucuguucccuuaucgccucagcguucuagaguauguucuacgaucaugucuucugagguuccuccucacccugggacuucacuuucuuaguuugauggcuuugaaguuaucaggaauauuguucagauguccagcuccuguacuguauauaguauuuuucuccuuauuacaccgagguuauccagcuuugagggaggagaucacagaagaaaagugccguuuucagcaucugaaggggugugcugcaagcauaugccauguuguguugacuuugaacaccugcugggguucucuauucugaguguguccccugcaggcaagcaggaggggugcaggcaaagaagagaggaagggcaggcacaauagaauuauuuagggcagagaaguaucaaaaugcauccuuugugauucuccguggauccugccucccucaugauuacucuagcuuuggagcacaccugagagcacaugcagaucccuagaugugcagguaguguguuugaacacgccaugguucuagucuauacauccucaagugugaugauuacuuuucaaaaauugucuuuuuuuagugaaaaaaaaaaguuugcaaaaccauugaagaauuccaguaaggccauacucuaaaguauuuacuuaaagaauauaauuuuagcuagaauuuuaggagguuuauuuaacauaguccuuaaaauauuuacacaggucuuuuuuuuuuuuuuuuuugguauuaagugcuuuauucagucagcuaugucacuagaccaugaauacacuuucuuaaaacugaaaaauuaaaaguuaaacaguauaagcuaguacaguuguuccugguugccuuccagaaguuaaagguaacugcauugcugaagauaucauggacuucaaacccaggacuguguucuggccuaaaagccucuucccuggggacuagcuuucauaauacuguaagaaacuauaaaaacuucucagagauggaagcauccacuacuacacuguuugacacacacaggucauuuuuuaaaacugcauuccaaaauauaacuagguaguuuuacuugagguaaugguucccucuuuuguaguggaugguggagccuguccuucugaggaugggcucacuauagaagggaagauuuaauccuugucuucacacaauaauaauaugcaagguugugagauugugccuguauguguuguucauuagucccaguuuacugaaacaacaggagaguacacauggaagagcugauuucagcgggaaguggaaaaguuauugugguagucacacugcugggcagggguucccaccagauuccucaacagaauggagcgcuuuuaaugccauuuuucaagugaggucucuuuuucacaucagaacucauugucuaaaaaaaugagagcauccugacugcagcuuaaaacacuggcuuccagucuacuuccaugguaaucccauggccacagguuuguggcucucuaccuugagucagcuugugagauguucuacuguaacacuagacuauuuggaaacauuuauccacucacaaauaauguccuaagccacgaaagugaucugugccuuauguaacaagcaaaaacagcuacuuuauguuaaaaagaaaaacuguacacauuauuuuuaaauguccagaaaacuggaagcaaguaggugcuucgcaccauuaaaaccuugaguauuugaagucagcuuuuaaaugacacuucccaguauuaugauggaaacaguuguaaaaauaagagaccaucaggugagcucugaaauuuuaaaaaagggaauauaaauggaguauuuuuuuguuuuguuuugcuuugcccaaaccaaaucaaauauaaguucccugcuauugaaaauauguguuucuguuugcacugucauucuauauacugagcaccaacaacuggagcucccaaaauaaaucuuucagacaagcugcuucugagcgaugagagacuugacuaacucacagcucuggcucccgaaucuugugcuuuauacgccucuaaaggaacccugaucugugacucaucgagucucccucaggcuuugcauccaggccaggucaggggcuaaagauagaaggacaaaugucggucugcaguuguguuaaagugaagacguugccgaguaaaaugcaugggugauuaccuagucuugccaaucuuacuaucagcuuauggcauacugacuuuuccaauucagaguuaguaacuccuucacugagaaaauauuuauugacuuuucaggagcaagguauaaaaauuaaggauguaaggguacgggaggaaacaauuacccagcucuggggaaucaauuaaaagggaaaggaacuguagguguuaaaauaauaacuaauaauaauaauaauaauaauaauauaauaaaaauacaauaaggauguauuugcuuagaugguacucgcucaagaaucaacaccgagagaugcuuuuuaaaaauagcugcuuuauuuaaaguauguucaaacuacaaaaucguuaacucuuuuaguaauuauaugagccacucacuagaaugcugcuaagaucccacccuaaaggacagauucagaggcacugcuuggcugaguccuugcucugaccauccacacgaccugacauugucccuuugcaguacugauggccguuucccccaguucaggaguaacuuagaguauauaaaggaagaaccuagucauguugcugggagucccgauuuuacauuuaaaaaaaaaaaaucuugguaacaacauuuucuagggagccuuuuuuuucuuagcuaauggugugacuguuauuaagaugcuaugcugauaucuaauggugugacccaggaaugcccaugaaauacuuguugguuaaacaaagggaagauuccuggucaacagcaaauggcuguggacauucuugcagucaacagcugucccuucucugcucagaucuccaguucaaguucaucacuuucaugaguaaauugucuccugagaacuucagguucuggguuggugucagugagucuccaaucugagaagauauuugaaaaucagaaugaaaguucaaaauggaaacugaacccccuaaauguaggcucuccccaggcaucucuuaauguugguagucaguuuuuuagcagucugauucucugagcauuuuccccacguugaggccagaggccuauuagugucuguuuuuuaaagcuuccaggaauagaaacgcuuugcaacagccaguugauguuaggauuuguuuauaaaauagggaauuauguauauugagacagaaauauuuuauuuugaaacauaggauuuugugcaauauuuuucuugcauuguuuaguuuauauaaauaugcacaucugcuuuucuggcagauaccuuaaggucaugucuuucaguauuugccuaaaacuguauguagcaauguucuaugugauuucagaaaaaaaaauuacucuuucuauuauuaguagaaguguucuuguuuauuuaaaauaauaauguggagauugcauuauuguaucauaacgaacugccucagccacaauaaauaugcaauaagaaauuccuguuccuuugauuaguauugacaauacuguuacuuuaacagaaauguuugugguacagagugcugguucuaucuguguucauuuaacagcuacucugcagcacaagaaucuaaacgguauauuuaugugauaaccauguguauguagauuaugacauccuuugugaugagucuuuguugaggcuuguaaagggcauugccaauacuuuuugauuguaaauuaauuuuuuuguaugauguauaguuuguuuagccuuagagcuucuuuagauuucuacuuuuauuauacuugaaugaggcagaaagcacugugggcaguuuguaacucuggaugcaauaugcagauauaccaaaaauaaaacaagguacugaacagcagcgcuaauggaaugcguuauaauccaggaguuguguuuuucaagccacauuuuagugaaaugaaguaauugaagauauacagucuuuuaucuagacaguauagucucaaaugauuaccucuucaaugugucaaagguguguguccuuuuuaacuucuguaucaguccuuagcugagccuagaggaccauccauccucccuccucggaccacaugaugucuaggacagaacaaaucaacuacauugugcauauuaggugcacugucugugugaagucacuguguuuuagauagaguagcuuucauagguaauuuugagaacucuuuaauaaucauauaccaaaaacuaaaaacuaaauuuuuuaaaugaguuauuacuuagcugugccuaaaaucucuuagacauaaaggccacaugagggacucaggauugaauguuuccaaaguuuauguucauuccuuuagcuaaagaguuguuugcucaacauauaaccaguagcuuaaaaaacaaaacuaagcaaaacaaaacagaaaaccaugagcagcaagacacugagaugugcuucguggugcuugcccucgagacuacaguuuaucaucucuggacuuaauuacgauugggaagauguucuguauaaaauuauuguuuggaaguuuuuuaauaugcaaaauaaaauguugaaugaacucugcuuugccauaaaguacccaauaaugucgcugaaaauaaaauuggucacgaucaaacauuguguguggugauggcucuucuaacuaaccaguuguccccuguauggcuaccggagaauggcuuugaggacucagcuagcuucaucucuuauccuguaacugcugcaguguaaacuucagccucauucuuucugguugcccugucugggugccaccuauucuguucggaaccauuuaucagccuuccgguugcuguggcaaaaugacugacaugguaacuugaaaggaugagacgaaagguuuacugcagcuuaugguugcagggauauuagucugaaguucucugcgaucaggcagagucauggcagugggaucauaggcagggggcugcucaccccagggcaaagagcacagcauaguaaacggaagaggacaaaccuggauauacccccaaggaugcagccccagccacucauuuccucccaugcaucuccacuuggcagagguucucuguucucccaguaaucuauucaaaguuugaaaucaaaggauuauacuacccacuagguuugaggcaguaugaucaaauuguuuguggaaacacucucacaggcuuaccuuuauagaccuuggagaccucgguguuucccaccagguuagcaaucacggagacucuuaccggcuuuaaagguccucaggccacagugggcagagcuccaggacccaaaaggugaauuucucgucugcgagcugugaggguccacguagagcagaggugagagugugcaaaggagcauguuccccuuugggcucccaauguauaggagcgaucggugacuuugagguuagcccuggcgaccuuggcaagaugagucucaauacuuaaugauggugccuuuauauggaagacagucauguaaucuauacauucagaaaccacuugucauugcauauaaauaaaagaauguacucuaaaaauaccaaauaaugggucugagaagcucagaguccagugauaccaugacuuacaagccauuaaaaguacaugcagagagagugagguauugauagcaucagaacaauauaauacgucauccaaggcaaauagaaaccucucgauguagccauuuaucugggcccauuugucuccuugcccuggaguguacaggcccagccuaugaucccaccaucaugacucagccuuauaacacaggacuacugacuaauaucccugcaaccacaagcuacaguaaaccuuuuauuucucuauuuaaugcaaaagugccuguuuuuagaauuaauauuucuuggaaaccucuguauauagcugauguauaugguuuaggagauuaaacauaguccuaaauauccacuuaaguucaaauuucugguuguuuggaauauucaaguacaaaauauaacuauaaaaucauugauuuuaucaaauucagacuugaaagcaaaguacagacggaucuacuaucuccggaguagacccuauaggcagugcgcuauagagaugagguaacuaugacacaugaccaacaucaucauugaaguaccacagcacuauguagccaagcugggguggagcccacugugguuucagcccugugauggucagagcugucaacuuucaaagaagggccuuuggacauguagggauguucugauugcagcagagaagauccaccugcuaugggaugcggcaccauucccuggucagaggaucuugggcuauguaugagucaaaaaagccaacugagagccuuagugugcaugcauucauuguucuuucuuccugacucugggaauaaugugaccaaaucccaucaucugcugcugcugugacuucacugucacaauggacaauaaccuguaacugugagcuaaaacaacccuuucucccuuacauuacuuuugucaggauauuuuuaucacaggcacgggaaacaaaagacaugccccaagacuaccacaucacaguguuggacagaacccaaagaucccgucucagggacuuugcugaaaaacuucuuuuccugucucaacauucguucccccuuaaguguuggacaacccucucaugauagagacacugcacauuaacaacucaguauugaguuuccuggccuuuuuuuuuuuuaaacuguauuguuuggcuuuuucuuuccucacacucccuggcucggugccuauguuuaccgaaaucaugcacguucuccuaucuuucucuguuucccuaucuuucucuguuucccuaaaaguuugauuuuauuuggagacuggaagagagaagcccuuccuagaaugacugggauaccugcuggaacagguuugcuggcaucauuuugaugaacgguacagguacacuuugugaguuuuguagcgcagagcuaguuacugacauuuacagcuggugagaacgucugagcgauccuuccagaguacccacagauguuaccuaucacguggaauuuuuauauauucaagugacagcucucaaaacaagcccuacucuuccguuuuguuauuuuauaaaaccgugcuuccuuucacuacagagaguuucauauuucugguaguguugaaguaucaucauauaaacauugugacuugcaguuauuuuuaauaacuaguucccaauuugaggaguuuugaaauauuuaaaauuuuaacguuugaaauauuuaaauacaguaauaauauucauuucauauuucagcauauucccccaaaccuaauacuuaacauauauuuaaauauaggaugaguuaagcuuucugagauuugguaaguauuuaaauugcaaccauuaggcaauucccaacauugcaaacagauguuggagaaaugcuguccuuuaucucacaaacuuccugcagacaagaugugcuuguuaacaaacuguuagaaaaaucauuugaguuaagcuauugugaagaagaagaagaagaagaagaagaagaagaaga

SEQ ID NO: 405 - RNA, 5280 nt, Mus musculus
ugacaagaaauugcuauagagacuuaggauacuaagaguauuuuacagccauauuaaacauagaauaagguuaaauucaucugucuucaggguuaauuuaacauaauuugagccucuaauucucccaguauuucuuguuuucccacuuucauagcacaguuagaaaauugauuaucuuuugguaaguuuuguguugaaagauauuucucuugaaccuaaauguuuuauccuuguuaugagcuuuguauuuuaauaaaggcuuaaauuaagguaguuacauuuuauauacacuuucauuuagauuuguaagaaaucuuuuacucgaagaccacacuuggaagaacacaugauucugcauucacaagauaaacccuuuaaauguaccuauugugaagaacauuucaaaucccgguuugcacgguuaaagcaucaagagaaguuccaccuggguaaguuacacuuuggugaaguaguccacuacucacugauuaucugacucuugcuagcucacuacuauuaaacuguacuucuuccucuuaaaaaucuuuauuguuuggagagagaaaagagaaguguaaaaugaguaauuacagucucaaaaauaugucuuuuguucaaaaauaguuuuagguucacagcaaaauugaaaaagugcagauagcucuuauucaggcagccucuacagacauagcaccaucccucaucagcauccucaccacaugguuaucacucuuuguacaagcauagcaucaucacuuaucagcaucuucaccacaugaugcauuuuaaaaaaugacgaacuuccaaguuuuggugauuaguuguaaaauggcuguaauuaucuguuugcaaguuuuguugauaaaaaccuaaaaacuuaaagaaaacuucuauugauuguuagaauguguacaguuugucuuguaauuguuaucuaaaaugguuguaccguuuugaauucucaccagcaaggauuagaacuucauuacuauaguauuuaacauuaaguguuaucagaacucuguauuuaagcuacgauaauaauugcuugcuauaucauugcuuuuauuugcauuuuucugcaaacauuguguggaacaucuuuucauauguuuguaauuuguccuuggugcucuguuaagucuauaugccuuuuguuuaguggauuuauuuuuauuuuuuuauuguuuuuuugggaauauuuuuugaaaaguacuuagauauuuguguguuucacauguuccugaguaugcuuaacuggccauauugagacagcuuauaggacuuggucucucuuuccaccaugcgggucccaaggauggaacugauauuaagggauuuaguggcaaacaccuuuaccuacugagccaucucucuggcuugaucauucuuuuaauuuuuuaaagauuuauuuuuauuauuuuaauuauguuuguguguauguguuuuugcacacauguauguucuugcuguguguguccaaguuggccacagauuggggaguauugcauaucuugaagcuggaguuguagcuaagugguuauaaauuauccagcaugcauaaagaguuaucagacuuuaguucuaggaguauuuggggcauauuugauuuuugugauuauaauauagaaagcacuuaguugcuagaaaguacaguacauguguuguuuuucuuuuuaagcuuaacuucuuccaagugguuuuuuuuuuuuuuuuuuacuaaguucaaucuuagcaauucuaaaaagcuaucauagaaacaacuauuaaauuuaauagaaguucuagcuggagacacaaugauuauguguuacaugugagaaaauuaauuguauacuuuauucuaggaaugacuguguaugugcuuguacauuugugguuguaugugguguaugcacauguguauuugcaggugccacucauuuugugcaugcaaaagccagaggaaggugcuguauggccuguguuguuaguccaccauguucccuguagauaguggcuuucguugagccuggaccuaggcugaucaccaguaagcgcuagccugucuugucuuugcuugcccuguaacauugggguugcagaugugcuguucaugucugucuuuugaccuggguucuggugagucaacuaauggucuucauuccuacucaggaaauguuauucauugagccauuuccccagcccagcaccugcuuguuauuggacaacuaguggguucuuuucuuuuugauuugaaaaacuauaguugauuuuuuuuuucuuuuuuguuaaaaguaaucuggcaaagagauuuuuuugauucuaccuccauuucuguuucuuauuuucuauaccaacuucaauuaaauguaucauuuaguaaucacuauuugaaaaauaucagauauaaaguucuaaguuauaaaguuaggccacuauguacucuuagagcgucaaaguuuuaaaguaaccugcaugauucuuuucuaucagcguaugcugaacuauuagagcuuuugaacaggauguuucuaaaaguaauuguuacugcuguuguuaaaccaugacuuacuuuucuguuauaccuagucuauuuuauguagucucgacaaggaaaauguacagaaacaguagacagugaaguuuaaucgaugugccaaagcuuuaguuauaaagagaacugaaaaauacucuaggaaaagacugaacauucaaaguaguaaacauuuaucaaacagcuauguaacaaauuugccuuagugucuggggagauuauggcuccugauuaaagcacagggcagcacauagucaaguacaucauagucucugcucacacaugcuuagguacugugaggugacauguacuaggaagaacuuagggguaugguaucacauaaagaguaagacuucauggugaagugguuuucacugucuuucucagccaccuacucuauaaucuaaagaguacucaaacuuguacguuucacauaucucaaagaacguuaguaaauguugcuguauggauuaaacaagauuguauuagucagguucugacucuguaucaucuaucuaacuauagcuguuugucuguauauagguguguguguaaaggggaucuauuagaaugacuuacggacuauauucaagccaauucaacaguugcuggcuaugaauggaaaauucaagaauccagauuccaugaagcuggaugucucagcuggucuuguuuguuuguuuuacaagauaggguuucuguguguaacccugccuguccuggaacucucucuguagacuaggcuagcucacacguagagggccgccugccucugccuccuaagugcugggauuaaaggcgugagucaccacugcuuggcuucaucuggucuucuuuaggugcuggaauccugaagaaauaaaauaggcucuaaugccagugaagaaauggacuuugguagcaaggugagagcaagcaggcaaagagcaaaagcuuccuucuuccauuuccuaaugcaggcuucuaguaggucugaugcaggcuucuaggcuuccuacuucaaaugaagcaaacaucucucucaauugugcccuccguuuuuggauuuuaguuaaguccaaauguagucaaguugacaaccaaaacagucaucacaaaggucguuuguauugguguugaguuuguauucucuuucucuggauauguauuauuuccaguacuauaguuauuauguucaagaacucugagaaaucuauuuuugaaauaaaauaauggguuuguauuuuuucauuauauuugagaaaaagauuaaacacaggcuuagguauuucuucuuuucuuuuccuuucuuuuuuucuccccuuaaauagugaugcuaaugaauaguggcuggugaugugguucaguacuagagcagauacauggccugggaaggcaccugauucauccauagcucuauaaagaucaugaauagacaacaaaggaaauguuucaugacaugugguaggccagcuuucacccucaccucuacacguccauugcugugaacuguuguaagcuucagaugagugauuccugagaguccgagcuccugaaaugauggcugaaacaguggcccuugaucacuggcuccggaguacuugcuuuugggggucuugucuacuuguccuaugcagugaugcugcuagugaugaagaguuccaguuguauucaaaacuacauguaugcuuuucuguuaugaugguauguccuguugagggaguguacaguuaaggaagaggguuuuuugguuuuugguuuuuuuuuuuuuaagacuuauuuauuuuaugugagcacacugucccucccuucagacacaccagaggagggcaucagaucucauuacagaugguugugagccaacacaugguugcugggaaucgaacacaggaccucuggaagagaaacugguauccuuaauugcugagccaucucgccagcccacgggagagcucuuaauauguguguuuauaaaugugagauaagucagauaauaacaaaaaguucaaacccuguauacggaguuauuuugaaguuguaccugacgguaagcuucuagcuuacaacaauaaagaguugagacgagcugcuuacaugcaaaacugaggguccaauaugagggcaaaguguuuuugcagaacacuaacaaguaacacauguguaacacaaagguagacgcucuguuucuuccucacccugggggacaacaacugaaaagagccaacgggcucccagcagaggguuaaugcugcgcuucacucgugcuggcccuaggggcuccccuuggcaguacaucucauggcuucauuuucaacuguccaaauacugccuuugcuuucuccaccuuuucauuccucagugcagguauggaggcgggaggucucauaguacuuagaauaagucaauaaauauuuguugacugaguuaaugacuaauaaauucaaauuccaaggucaaagaaauguacauuuuaaauaauauguuuagcauacuuacuaguaauaaagcuuuugcaaucuuacuucauuuugaauguagaaaugucuuguguccaugaaccagauuugcuuuaaguagguucugaauccauguccaaauucucaaucuuguccuuguccuauuaugauuaauucauuguaguuccuucuucaguuuauuuuugcagauucugaacuacuauccuucaaacaguucccuuaagcugugucugccacgcgccuuucgucguguuuuuguuuuagcuucagagucuguagaacuuacug

SEQ ID NO: 406 - RNA, 5280 nt, Mus musculus
caguaaguucuacagacucugaagcuaaaacaaaaacacgacgaaaggcgcguggcagacacagcuuaagggaacuguuugaaggauaguaguucagaaucugcaaaaauaaacugaagaaggaacuacaaugaauuaaucauaauaggacaaggacaagauugagaauuuggacauggauucagaaccuacuuaaagcaaaucugguucauggacacaagacauuucuacauucaaaaugaaguaagauugcaaaagcuuuauuacuaguaaguaugcuaaacauauuauuuaaaauguacauuucuuugaccuuggaauuugaauuuauuagucauuaacucagucaacaaauauuuauugacuuauucuaaguacuaugagaccucccgccuccauaccugcacugaggaaugaaaagguggagaaagcaaaggcaguauuuggacaguugaaaaugaagccaugagauguacugccaaggggagccccuagggccagcacgagugaagcgcagcauuaacccucugcugggagcccguuggcucuuuucaguuguugucccccagggugaggaagaaacagagcgucuaccuuuguguuacacauguguuacuuguuaguguucugcaaaaacacuuugcccucauauuggacccucaguuuugcauguaagcagcucgucucaacucuuuauuguuguaagcuagaagcuuaccgucagguacaacuucaaaauaacuccguauacaggguuugaacuuuuuguuauuaucugacuuaucucacauuuauaaacacacauauuaagagcucucccgugggcuggcgagauggcucagcaauuaaggauaccaguuucucuuccagagguccuguguucgauucccagcaaccauguguuggcucacaaccaucuguaaugagaucugaugcccuccucuggugugucugaagggagggacagugugcucacauaaaauaaauaagucuuaaaaaaaaaaaaaccaaaaaccaaaaaacccucuuccuuaacuguacacucccucaacaggacauaccaucauaacagaaaagcauacauguaguuuugaauacaacuggaacucuucaucacuagcagcaucacugcauaggacaaguagacaagacccccaaaagcaaguacuccggagccagugaucaagggccacuguuucagccaucauuucaggagcucggacucucaggaaucacucaucugaagcuuacaacaguucacagcaauggacguguagaggugagggugaaagcuggccuaccacaugucaugaaacauuuccuuuguugucuauucaugaucuuuauagagcuauggaugaaucaggugccuucccaggccauguaucugcucuaguacugaaccacaucaccagccacuauucauuagcaucacuauuuaaggggagaaaaaaagaaaggaaaagaaaagaagaaauaccuaagccuguguuuaaucuuuuucucaaauauaaugaaaaaauacaaacccauuauuuuauuucaaaaauagauuucucagaguucuugaacauaauaacuauaguacuggaaauaauacauauccagagaaagagaauacaaacucaacaccaauacaaacgaccuuugugaugacuguuuugguugucaacuugacuacauuuggacuuaacuaaaauccaaaaacggagggcacaauugagagagauguuugcuucauuugaaguaggaagccuagaagccugcaucagaccuacuagaagccugcauuaggaaauggaagaaggaagcuuuugcucuuugccugcuugcucucaccuugcuaccaaaguccauuucuucacuggcauuagagccuauuuuauuucuucaggauuccagcaccuaaagaagaccagaugaagccaagcaguggugacucacgccuuuaaucccagcacuuaggaggcagaggcaggcggcccucuacgugugagcuagccuagucuacagagagaguuccaggacaggcaggguuacacacagaaacccuaucuuguaaaacaaacaaacaagaccagcugagacauccagcuucauggaaucuggauucuugaauuuuccauucauagccagcaacuguugaauuggcuugaauauaguccguaagucauucuaauagauccccuuuacacacacaccuauauacagacaaacagcuauaguuagauagaugauacagagucagaaccugacuaauacaaucuuguuuaauccauacagcaacauuuacuaacguucuuugagauaugugaaacguacaaguuugaguacucuuuagauuauagaguagguggcugagaaagacagugaaaaccacuucaccaugaagucuuacucuuuaugugauaccauaccccuaaguucuuccuaguacaugucaccucacaguaccuaagcaugugugagcagagacuaugauguacuugacuaugugcugcccugugcuuuaaucaggagccauaaucuccccagacacuaaggcaaauuuguuacauagcuguuugauaaauguuuacuacuuugaauguucagucuuuuccuagaguauuuuucaguucucuuuauaacuaaagcuuuggcacaucgauuaaacuucacugucuacuguuucuguacauuuuccuugucgagacuacauaaaauagacuagguauaacagaaaaguaagucaugguuuaacaacagcaguaacaauuacuuuuagaaacauccuguucaaaagcucuaauaguucagcauacgcugauagaaaagaaucaugcagguuacuuuaaaacuuugacgcucuaagaguacauaguggccuaacuuuauaacuuagaacuuuauaucugauauuuuucaaauagugauuacuaaaugauacauuuaauugaaguugguauagaaaauaagaaacagaaauggagguagaaucaaaaaaaucucuuugccagauuacuuuuaacaaaaaagaaaaaaaaaaucaacuauaguuuuucaaaucaaaaagaaaagaacccacuaguuguccaauaacaagcaggugcugggcuggggaaauggcucaaugaauaacauuuccugaguaggaaugaagaccauuaguugacucaccagaacccaggucaaaagacagacaugaacagcacaucugcaaccccaauguuacagggcaagcaaagacaagacaggcuagcgcuuacuggugaucagccuagguccaggcucaacgaaagccacuaucuacagggaacaugguggacuaacaacacaggccauacagcaccuuccucuggcuuuugcaugcacaaaaugaguggcaccugcaaauacacaugugcauacaccacauacaaccacaaauguacaagcacauacacagucauuccuagaauaaaguauacaauuaauuuucucacauguaacacauaaucauugugucuccagcuagaacuucuauuaaauuuaauaguuguuucuaugauagcuuuuuagaauugcuaagauugaacuuaguaaaaaaaaaaaaaaaaaaccacuuggaagaaguuaagcuuaaaaagaaaaacaacacauguacuguacuuucuagcaacuaagugcuuucuauauuauaaucacaaaaaucaaauaugccccaaauacuccuagaacuaaagucugauaacucuuuaugcaugcuggauaauuuauaaccacuuagcuacaacuccagcuucaagauaugcaauacuccccaaucuguggccaacuuggacacacacagcaagaacauacaugugugcaaaaacacauacacacaaacauaauuaaaauaauaaaaauaaaucuuuaaaaaauuaaaagaaugaucaagccagagagauggcucaguagguaaagguguuugccacuaaaucccuuaauaucaguuccauccuugggacccgcaugguggaaagagagaccaaguccuauaagcugucucaauauggccaguuaagcauacucaggaacaugugaaacacacaaauaucuaaguacuuuucaaaaaauauucccaaaaaaacaauaaaaaaauaaaaauaaauccacuaaacaaaaggcauauagacuuaacagagcaccaaggacaaauuacaaacauaugaaaagauguuccacacaauguuugcagaaaaaugcaaauaaaagcaaugauauagcaagcaauuauuaucguagcuuaaauacagaguucugauaacacuuaauguuaaauacuauaguaaugaaguucuaauccuugcuggugagaauucaaaacgguacaaccauuuuagauaacaauuacaagacaaacuguacacauucuaacaaucaauagaaguuuucuuuaaguuuuuagguuuuuaucaacaaaacuugcaaacagauaauuacagccauuuuacaacuaaucaccaaaacuuggaaguucgucauuuuuuaaaaugcaucauguggugaagaugcugauaagugaugaugcuaugcuuguacaaagagugauaaccauguggugaggaugcugaugagggauggugcuaugucuguagaggcugccugaauaagagcuaucugcacuuuuucaauuuugcugugaaccuaaaacuauuuuugaacaaaagacauauuuuugagacuguaauuacucauuuuacacuucucuuuucucucuccaaacaauaaagauuuuuaagaggaagaaguacaguuuaauaguagugagcuagcaagagucagauaaucagugaguaguggacuacuucaccaaaguguaacuuacccagguggaacuucucuugaugcuuuaaccgugcaaaccgggauuugaaauguucuucacaauagguacauuuaaaggguuuaucuugugaaugcagaaucauguguucuuccaaguguggucuucgaguaaaagauuucuuacaaaucuaaaugaaaguguauauaaaauguaacuaccuuaauuuaagccuuuauuaaaauacaaagcucauaacaaggauaaaacauuuagguucaagagaaauaucuuucaacacaaaacuuaccaaaagauaaucaauuuucuaacugugcuaugaaagugggaaaacaagaaauacugggagaauuagaggcucaaauuauguuaaauuaacccugaagacagaugaauuuaaccuuauucuauguuuaauauggcuguaaaauacucuuaguauccuaagucucuauagcaauuucuuguca

SEQ ID NO: 407 - RNA, 2245 nt, Mus musculus
ucaugauuauuacugauuagaauauuucaugguauguuuugugccaaaguuggaaccaguagacaaaggaaaguauaccaaaaaggagaaacaagaaggccuuguugguugagauggaggacaguuugaauuuuuaaauguuaccucagaaauuuauagguuaggcuuucgauagagcaaaacaaaacuacuaaaauguuggccaaaguuggcaccaaauuaauaacuuacugauaaggcaaaacuugaaagauacauagaagucacaaccucuaggagacaaagaguguugagugaggcuaagaagaaucuacugguaaaugcgagaagauguauugggcacaacauguaacuauuagaggaaauuuccaauaguugaaaaacuuuuuccagaaaacauugaaggaaaagauaggucuaggcaaaugcuucauuugaacauuucuuguuuaauuugugccaaugacaaaaacuagccacacgcccacuaggagggacaagguagacauuaaacaacuguucucuauugacacaaaugaugcauuaaaaaaugaagcagacaaaauauuauuuuggaauaaaauaguagcagagauaaccauuuuacaacacuaaggauccagggccuuguacacucaaggcaagggguuugccaucgagcuacauccuucacccaaaguugaccauuuuaucuggguagccagaggaaaauaaguugauccuuguucaauaggugaagaaauuauccuugugaauauaugagaagaaagcacuccagacagugaagagucugaagccuuccgcuaggaucauacuuacuauuuuaaggacugacaaggaggccacugggcuuagugaggcagcaggaauggaaaugggagagcagaugcaccagggaacaagguucugggauggcuuaauggguugaggaggagcuguuggcuguggcuuuagugcagaagcuguuagagagguuuuggaaguacagagauguaguguauaagauaguacagucagcaacacucccaacugaaaaaauauuccuccuaaguaaaguggucaugauuaugaaaguaugauauuugggaaugguagcugagaggaucaguuuacuuuugaaauauuugaaaugcccauuaacugugcaagaagagguguaggucuuuggguuuuaggcuaaagagcaauguucagaggaaaaagaaaagugcuuuuuugucaagguuauuuguagaugcguaggcaaugccuauagcuaucugaggaacauuccccuaaaacuuuuaaaauaaugaaaacgaauauccugugguagaguaacugaguauuuguaauauaaaugugacaucucaagucaguaagccccuuucuauggggaaaugguacucugucaguacugagcuguguuuagcaaaacccagaagcaugaaugaggagaguaaauauucugagguuuuguagccccugagaacaaagguguggcuucuuggaugauuaagagcguuuguuucagcaccgaguccaagaaccacugguucuuuagaaaaggcuuccuaauguuuacagaagcacuuuggacuauuuaaaaaaauuuuuauugauauuuuggagauuuuaaaaauaggucuagauguuauuuccaaguuauuaaauugcaaagcuugaaauuuuugcuagguaguaagcuagguuuucagccacaaaagcacaaaccaaaguauuuuaaguaagauuuuucaaaauauucuccuaguagcacuuuuuuuuucccuagaaaaauaaccuuggaauuuuugguuauguuuuuauaacuuuuaaccuuguaauuuagcaaagagcaacuuuaggagaaagcucaguugugucauaguuuugaauuauuauggcugacugucauuuuccccuacagagccuuuugugcuauuuuacuguuuugugagaaguauguaaauuguuggugaaugagggagucagggcaccacugucaggcuuguucuuaauucaccuuguauccagaucaaguaacagcaucuguaucaauauaucuguuaucuauuaauaaagccuaauuuaaauacaaauacucaucuuauuguccuuuccccccagcucuucagugaaucaucuugcaugcucccuaaaguauguugcuuagauuuggagaccuguaacacuguauugguuauuuccuugucaaugugacaaaauaucugacaugaaauaaaaaaggaauuauuugaguuca

SEQ ID NO: 408 - RNA, 10652 nt, Mus musculus
cauuaggagcugcggcagccauggcuguuaaagccaugaugaacugucucugggcuaauucguuuccuaauuucaguuuauuuuaaaaacaccaccuugcuuucuucggaaagaacguuaaacauuggaccgccuguguuuuucacuuucugaguacaauucaaccugccuauggacuccggaucaauaaauuaaucuuaagaugacauuccgguccgguccaucuuucacauccuaaaccugucugaccagagguggugacugaccuaccuaccacccucagguaaacaccgggccaccacccugccucgaguaauuuuucuuguggcucucccuaagccucuuucuuaauccugaaugcgggcgugaggagcucgggagaacucgguagagaucggaagaacucggcaggcaggugagugccucgcucuaccgccgaggaugcgaaccugcaggcucgcgggcacgcgggcgcgugggcgcgcggagacgggggagccaggaagcgcggcgagcccggcggcggcgcggacagcccgauggggcggagcgaggccgccggaggggcgggcuuccaucgucguggucgcgaucgccugcugcucucccggaggcugccggggaccuuuggcuauguccuggcgccgcgcggcuucgguggggaggcggcugguggcgagcgggaggaucuuggcggggcggcguggcgcggcuggagcugcgggcucgggguacgcggcggggcgggccgggccugcggggcuuguggaucccugcgguaguguuaguguggacccagccggcuugggggacaaacaacagacguccuagucugagcuuaacaaauacagcaugugguuuuaacucagcguagaccuggauggcccugaaaagagacuccccugcuugugggaacuuauauugaacuuauauuaucguucuuagauugauuguaagucuuugcuauccugucgcaggaugugaacuugacucaugcuuuuaaaugcccaaggcuuugcagcuaguaacucuggcauccuguagaugugguuucuggcuugaugggagcauugcuuucccuggcuuccuuccuuagcauaacccugggcuggcauaccagugauggccaaucaggccuggccuaggcagcugucaagacgucugucucaacauccuauacuccccugucuuccagggagacuuacuuucugaaagcgcuggucacgugauguuaaccauuugccagaucauuaggacuguuuccuauuggagauaucugguguauauccugcuuugcccaccuaccaccucuuaguagauguuucauaaauggagcgcgacuaguuggugcuuuaucaguguugagguauuucauugggcauuuaugcggugccugccccuuuccuuaauaggaaagcuaaaccagaaaucgaagggacugccuuaagaaagguaggggugcuuuuuuuggagcuuuuucuuuggcagggaauaugccucuuuggucuuuuuuuuuuuuuuuuugguuuuucgagacaggguuucucuguauagcccuggcuguccuggagcucacuuuguagaccaggcuggccucgaacucagaaauccgccugccucugccucccgagugcugggauuaaagacgugcgccaccacacccggcugguccucuuaauuucuuagaaaagcucacccgucguaaaugccacauagguuuaaggaggugguaaaugcuagauuagagauuuuguuuuuagcguugaaaacccaaauagacuggauugaugccauccagcguucuuccaggccaaagccaucuggcacuuuccuacugcuuugaacuucacaaacccugcuagcauuuuuuuuuuuuuuuuuucucaaagcugccucccacaaaguagggagcagucuuccaagcuucuuacccccuccuacccucucucuaccuggaaaaagcacagauaguugcaaugauuccugucucuaacucaucuuuguuguuacggaaggugaugcuuguugcaagcuuauuugaagugguacagagugaccaaguagagcagauauucaucauccagggcuaacaugagcugggaaaggccauuugauacagauucauucagaaacaggacugaaacucuacacugugauuuaggacguguuuucacuggggccuuuaaaauuuaaacuuaaaauagcuuacuuuugcacuuaauauaaguagcugggugugguggcuuuaaucccagcacuugggaggcagaggcagguggauuucugaguucgaggccagccuggucuacagagugaguuucaggacagccagggcuacacagagaaacuuccuguuaaaaaaaaaaaaaaaaaaaaagaauaagaguauacugaacaaucgaaccagagauugguuuuacuagguaaaauuuauugaaaggcugcuuagagaagcacguggguccugcugguguuagcggacaaguacuuugagaacugguguuuuguacugauaaagcuucuuccugcuuuguguauuuggacauauucauauuuaagguugucuucccugcuggggggucaccucauuaacugugcugaucuuuuucauuuguuuuagaaugggaaacagcacaucgucguuuugggggaagucuacaacuacuccugugaaccagauccaagugagugauggggaagaccgaggaagaagaaauagcucacacgguuaauguacuucuuuuguggccagacuugacauaguugggaaaauauuuuacuaaaguaauaucuauuuuaaaaauugcuaucaaaguuauccuugugacaaguccuauaccauuucauugguuaaaguuucugaaauuucuucuucuuucuuuuugugugguuucuguguauaugcuauacacauggcugcaugcuuguguggaggccagaggagggauguccaguguccugcucuaucgguaucugcuuuauuccuuugagauagugcuccagcaguucugucucuacguucccuaucacccccaccucccagagcuggggauauagguguggucuccuugaguugccuggaauaacugugaacugcucucaggcaggcugcucuugaacuugacauguugcuucagcucccuacauagcugagauuauagaccuagccuaccagacuuggcugaaauuuauucuuaaugaaauccaucuaugagguugaauuguuuuuuuuuuuuccaucaagcccacuugaagucuacuauugaccucagagugaggcuuucagagccaagguuauuguguauugggcacgaggagcaccuacuguguaauaauuacuccguaaauuauucucuuugggguaccgugcauggcucuauucucuuguuuucuuuucucuuucacuguccaucuuaauuacuucugccucagaaauuuuguguuaagccggaucuggccucauuuuccugucauccuagcaguuggaaaauggaagcaagagggaaaauucagggcuucuucggacccccccuucugagauccgucuuugcauauaaaaaugaaaucaaaaccauuuugauuucucuuauacguguauuuuucuuuucuuccagcucaugaagcgcaucuuugucucccucaggaccuucugcauauguuuuguuucugcuauggccucagggugcagcucagcggcagaccauaagccugggccuuugcuuuccaguaacgcacagagggagucugaguuuguuuuagcugccucacuguccucccaguacagcagcaauucgagaagcuucuuauacggggcguucgcuauuuuaaaauaugaaacagcgccaugaaacguuuugugagggugggcuugaaagugaagagugucuaugaaaccccggcacuaucaucuggagguccgcucacuuuggacucucuucauuggugcuucuguguugaggaagcauucagagucagcccucaucccuucaagucuaaaugagaggccccggugccucuaaccuaaauagcaugguggaagauuacuggcuucagguguagugcggaguuggaggaaaugagacgaugaacgucgcagccucaguucuguugucuguaaaacugacucaguaauguaguauguuaucauguauggcugaccuugcugugauagaauguaaaauauuuugagaaaguaggagaaagaacauagaauagaucacacacauaugucuaggcuaugacucacuucugaccccucagggugggucuacguucugaagcucucuggguaucccacuuaguguuucugucuucgucuuaaggucacuguuuaugcugugucaugcaagaaccaccuaggcgggugcucagaugcuagcccuuguccauugaaaaccuauguggaugccagaacuuggacauucucaugcuuagaaaugauacaccagguaguggugguccaugccuuuaaucccaguccuggggaggcagcgguaggcagaucucuaugacuuugagaucauccugggacacugaguaaguucuaggacagccagagcuacccagagaaaccuugucucaaaaauccaaaccaaaccaagacaaaaggaacgcaacaaaauuaccagaaagcacuguaggcuggacaaagguacaccaaagccgagagagacugugguuaaagagugcaacccagguagcuaucauagagucauuugggaaacuugcuugugggagcuggugagauggcucagugguuaagagugccaacugcucuucugaagguccugaguucaaaacgaaauccgaugcccucuucuggagugucugaaaacagcuacaguguacuuacauauaauaaauagauaaaucuuuuuaaaaaauggaaacuugcuuauaacuugggcuucaaacaauugaacaaguagcucagucuggaaguggcuuucacaggcucaccugaaaaagcauagcuuaucacgauagcuuuuagggaguaagcuguuguccauacuuggugaaagcugagcauuuuaaggagaaaugucaccuuauuuccuugugacuggaaguuauugguaguagggaauaaaugucuccugagccccucugaaaacauuugagaaguacaauagagauuaagugucuggacuauagggcuggguucaccugaacucacagcuagcacaguuauuaaucaaggauagcagguagguuacugugauacuuuaauauauucuuggcccagggaguggcacuauuagaagguguggcccuguuggaguagguguggacuuguuggaguaagaguguugcuguggguggggcuuuaagauccucauccuagcugccuagaaguuaauauucuccuagcagccuucagaugaagauguagaacucuaaacuucuguuccaugccugcauggaugcugccaugguccugccuugaugguaaugcacugaaccucugaaccuguaaaccagccccaauuaaauguuguccuucauaagaguugccuuggccauggugucuuuucacagcaguaaaacccuaaccaggacaguuacuuaucuuccuauguaccgcaguuucuucaucugugcaguuuaaauaauacaggguggaccuauagugauuccagugaggcugaaacgacuucuugacaucaagaauaugcaggaguguuuguaguauaagaauuggcugucauaauauaugagagaucaaaaccaaagacuugacugucauugguuucauucuugauacuacucucaggaagccaggguuuugauacuuuuguuguaguuguuucuaguggccauggccauuguuugaaaagaacaguauccuuaaucuacagauaccacacagagaugaaugacacgucacuggagcacaggguugugcuccccaccgcagaaucauaauccuuuuacaaauuuugauuuaauugcaaaagguaaugucgagaaugaaaagguuuuguuuguguuuaucuauuuuuuuuuuuuauuuuaggaaacaauuucuaacaauuguguggugaucuucucaaaaacauccugcucuuacuguuccauggccaagaagauuuuccaugacaugaaugucaacuacaaggcuguggaguuggauaugcuggaauauggcaaccaguuucaagaugcgcuucacaagaugacuggggaaagaaccgugaguacagucucagcucugcugcuccuggagauggguuggugccauaccacuccccggacacuagacuuuccugcuagcaaaagcaagccugacauuucagcggauuacacguugauaaguaaauggcagaucuacaaagaaaccagccucauagaauaugaaacagcauagugaauguguguguguaugugugugagagagacagagacaagagacagagacagacuggcaugaggcaggggaugaugucaugaguauuuguggaaccuuaagauccuuuuggagggucucguugauugauauuguuguuccuccuauggguugcaaacccccuucagguccuucaguccuuucucuaacuccuccauuggggaugccaugcugaaaggggauaacauuugaaauguaaauaaagaaaauauccaauaaaaggaaaggggaaaaaaaaccaacuccuuuuggaggucuuugugagguaaauuuauccuuccacucuugaacagcacagaccggaauggacucuccagucucugugcauaucuguguauuccgcuuauuguuuuagcuucuggaaaucugcauuuuuuuuuaugauaugaacaggcagaggacugacuagucaugguugccacuuuccuucuuuguuugaagcuuuguaggagauccuggaaacacguagaccggaaccacagaaacguuauuaauacuucccuaccuugcccuuccuuucuugcugcucaaggacagguuuuuagcgguaaaaggaaaacugccgggucacgcaagcugaaaaaaaucucaguaguugccugagggagagaauggaagaggaaaggaaaggcaaccaguugguuaagccagcaccaaggucagacacaagggagacaagcagcuggcgggcgggcggggcggggaaggaggcuuuagagaaaguagggaagcucaaaggaucagaaaaaauguacuuagguucugaggagcaucccaaagaaagaggcagagagaaggaaaaguugauccuuucugacucaggccucugaagggcaggcagaccccgaggaaccuccuggaggcuggucgggcucaccuuauuuuguuuuuuaaaauucguguggucuguaggagccugcaggggcuuuagaauuagauugcguuagauuugucuccuaccucuuuuccuguugcuauauucggcaaguuacuuuuccucacuucccuccaaaacuggaccaguucugacaccgaugguuaggccuuauuuaucuuuuccuucuucaacagguucccaggauauuugucaauggacgauuuauuggaggcgcagcggacacucacaggcuucacaaagaagggaaauugcugccucugguucaucaguguuauuuaaaaaaaaaacaagaggaaagacauugaaugauguggauagucgccauaccaguaaaugcuaguuagugcagucguaccuuugacuugaggcuguuuucaguguguggauugccuucauaaagaugauucagaauaaugaacaauaaauugcccuggacccuucaucucccgauuggccaguuuuugagcaugagaugguauaaaaaaacuaaaggagguggaguuacaucaaaaguaaagaauguuuauuaagaauuuaagaaucuuacagcaaagagggaguacgcacuuaaacucuugcuccccauggcauucaggaauuaacuucucacguucacuagcugucagggcugaggacugacauguggcuuccuuaaaauuuaaugugguacagaugugcaguggguugggauaccauaucaugacaacccuuuauguucuagaccaccaaacauacuaaauauguagaauucgaugaaguuucuaguuggggcaucaagcugcuaaugacuucauggucagaaagcaaaagguuucaauagagugagagugggcuuuucaaacaguucagaaauguuauuuaguucuguugccaguuggacauucuaccuuucagaauguguaucagcuacuggaauuuuuuuuuuuuuuccuuuuggagacagggucacucuguagcucagaauggccacaaacgcaaaagucaguccuccuaccuguuuccaggcuuggauuauaugcugagcuaccacacccagcuugagaaugcuuaagagaaacaggaauuagaguuuagacuaacgguccuuguuauaguccgaacgugccccaccacagacaucauguguuggaaacacaugacauaaccugauaugguacgcgaggugaggccuuuacaaaguacuuaauccugagggcagauggguccgugcucuauuagagugguucuugauaaaaggaugaguuuguccccuuaccucucccgucuuugcucuuccucuucuuccucugcaguguccugauacagcaaggaaauccucacuagauaaccucaccuucccgaccgaugaccuagagaaaguccaucucuucuucauaaaguacucagucucagguagucugucugagucccacagauggagcgucccuaaaaucacuucuguuaucuuacuauucucuaacuaggaagacacuguucaaauugacuucauuucagauaaacuuagcaaacagaauuaaccuuuaagaaguaauauuuaaaagaacugaaaacauuuccaaugcuuugcuagucuggucaugguuuccgccucuggucaagaauauuuuaagugcuuaagaaaugaugcauuuccuagcagauucucagagucacguuggaaauguuaucaaaugcugagccuuucucagguaggaagaacauggacuucccagagugagugcuucagcuuucuggucaagauagacuagggacucaugcagaguuuggagggagacaguggcuugcugucagagauguuuccuacguggacuucaacugcauuuuggauaacuugacauagaaguuaagacagcucuccugauuuaagcugucauguugguaggaaaggaacaugguguauuuuuauuccuuuauuuuacacuauaucaugagaaauuauauaauuuuacuaugcucuaaaacucacauuauguaugggaaaggugucacuguuucuguugucacuaguaaucuuauuaggauguaaggucaaaggcagguuacuuaaaugcacagcuacaccaaccacguaauaauauggccuuggcuuugaggagcuuuuuuugugguauucagccucagacccagggcuugaauagcaggcaggugugcaggugccacugacuuauaaaacuuuuucuuuuuuuuuuuuuuuacauuagacuuuuuuaauuagauauuuucuuuauuuacauuucaaauguuauccccuuuccuaguuuccccucugaaaauuccguauccccucccauuccccccaacucacccacucccauuccuggcccuggcauuccccuauaccggggcauagaaccuucacaggaccaagggccucuccucccauugaugaccaacuaggccauccucugcuacauacgaagcucgagccaugagucccaccauguguuuuuuuugguuggugguuuagucccugggagcucuggggguacugguuuguucauauuuuuguuccuucuauggggcuugcaaacuccuucagcuccuuggguccuuucucuagcuacuucauuggggacccugugcucuguccaauggauggcuaugagcauccacuucuguauuugucaggcacuggcagagccugucaggagacagcuauaucaggcuccugucagcaugcucuuguuggcaucugcaauagugucggguuuggugauuguuaaugggauggaucuccagguggggcagucucuggauggucauuuguucaguuucugcuccaugcuuuaucucuguaacuccuuccauggguauuuuguuuucccuucuaagaaggaucaaaguauccacacuuugguguuccuucuucuugaguuucauguguuuugugaauuguaucuuggguauucugagcuucugggcuaauauccacugggcuaauauaccacuuagcuauacaacuaauucuuaagaauguuuuaucaguucuuccuaggcuugugggaaacaagaggaugugugguacauaauucuugguuagggucagauguuaaaauaacccagcucuuaaaaaauccuuaucgucagaaggcucaagaauauagaagguaacaggguauguuaauuuucaauuauaaguuuauauaagaaauaaacucuuaaagccgggcaugguggcgcacgccuuuaaucccagcacuugugaggcagaggcgggcggauuucugaguuugaggccagccuggucuacagagugaguuccaggacagccagggcuacacagagaaacccugucucaaaaaaaaaaaaaaaaaaagaaauaaacucuuccaaugauugcuuaau

SEQ ID NO: 409 - RNA, 26405 nt, Mus musculus
cgauggaaggggcggggcucgagacggggcggggcggggcucgcuccgacccgaaccuggagcuguccucgcccuuucgggccgccuccuauuccuggugcgacgcaggcuuucuguaggcgccgcggguccugagcaucaccuuccagguaaaggugggucacugcaggccugcugcgggccggggaaccgcguuuugggcagucccagcgauccugggcacuugagggcuggccggugcgcacucucuuccagccgcaucccagcgucagaggccaggcaaagccuucgccgccucugugcuccggcacccgccggaggagagcauggaccgacuucgcaucugaacauuucgaaccuggccuaguugcuccgggaggauggaaucuuggggaacucaggucaacucucccacuugcaaagcuccuggcgagcgaacgugccaaggccccuuuucacucuuuucucucuuccugcggcuuuggcauagaggcguugucucggauaccgguuugggaaggagcuuugugggaagaccgaaaggaaauuaucuuagaggaauaauaaucaaggaagggagaaagauuucucguccaagggaugagagacucauguaucgggaugaagugccuuacggaaaaaugcgcaccaucccucucccgccaccccuccccccuuaauagugcauuauuuuaaaaacacuugaaaugguuuugaugaauagaacaaaaaauagcuauuuguaauuaauacuuaucauucuucggaggugguuuuauucaucauuucauaaaaguauguuccaaggaaggcuuuuggcuuccacaggaaaaauuuuugcucagagcauccuaccauggugacaucuugccacaguuccucaauacuuuucauugcaucgcccuuaauggaguugauauuuucauuaccuuuguguauggcauauccauuugaaccugggauccuggcuuuguaaaguauuauagcuucauuacuguaaaauuagccuuggcuuuuauuuuuaaagaaacugcguauuugcuugacuucucagggugaaaaaaaaaaaguuagccuuuccaaauuacaugaaauauuggcuuaauguuuguguaaauugaaggaaaacaugguaaucuuuguacuaguaaugguacgacguauauagauuguaguccagaagaucuugaagcagaaguguuauuacaucagugucuugcuaucugguuuacauucugcauuaagagaauggacaacauauggaucaacacaucacugcuuggccuuaugucgaagaacaaguguaaaaugcuccaaauguugccauaguucuaacaguuaaaggcucuaaagcuuuaauuuauagagauguuagaaaacuucaagugguauaaauucgggagacuguuguuguguuuaaagaggucagaacaacucaaagaagaauucacuugauugguuuugacuuaggcuuauagcacuugacuccauaggacuagacuaccagaaaaccagacuuugauuugccucacugcccagcugccuucuaaaccacuggacugcagcuuaggguuuugagaaaggggacacuggcaguugaagaaagaaggaguuaagcuacuguuaguugauggaagcugucuugaaacucagcuugagucacuucauuaguauuacuaagauacuccuagcgcuugguacauuccaaaagauuuugaaacuaucaggaaccauuguaucuccaugucaucuaaugucgccaauuuuaaaguaguuuguauuuuagcccuuaguaauaaaaaggagaaugaauagcuugaaguaaacugccauucgauuuucuauauuuaaauguuuuuauugagacuuauauaugcaaagaaguuuuguaggugaccuagucaccagcagggcaaggugcaauuccaaggugccuacucugcagccagaagagguucucucuagggacuucuacucagguguagcugggacccugacuuaaacugcagaagaccauuuccaaaugagucggucugaaggcaugcuggacacuguaguucauaggcaccacagcuggguaggauuguuaguugcuucccucacuuggaagccuucugggaucaugaaagcuaguccucaggcuuugcaguuugagaccucuuggucauguguccaaaauacauggugucuucagcaauaagcacuuuacuaaccuuccuccucugagaggcaacuacaggcacuaacaauagccuaggauuugggggaaaucucuuauuagacaacccugaccaacaagcccaaaaggaacuaacaucuuauauguaguguuggaguuuuugcaaaguggucucuggaucuuggggaaagcguugucagccagggugaaugcauuucacuuaaacuauauguauacacagacuuacauguaauauguguaauuuuacguaaauagauaauaugacuccuuaugacuuuuucagacccuaaggcugcuauuuuaccuccucccugccucuaauuagaguucccacaucaucacaguuuuuccacuucccgcuucagaccgccuguacccugccauuccucucucuauugcuucucucuucccugcucaccccugccguggucccuuuguacuuugcuguuuucagcuguuucugcagacuguguacucacaucugaagauuuggagccagggaaucuagaugagaaaaaaaaaaaaaguaggacauuuaucuuucuaggucuggguuaccucauucaauauaauuuuugccaguucuguccauuugccuucagaauucaugguuucauuuuucuuuacacuugaauaguauuucagaauguauuagugccacaauuucaaauccauucauaaguuugaggacauuaaguuguuuccuuuuucuagcuugugugaguugcgggacagugaacgaggcagagcagauauauguagggcagaaugacgaguucuuugggcaucugcuguggaaugauaaagcugggcagcugagucauauggaagauuuauuuuuaggcuuuugaggauucuccaggcugaauucaagagggcgugaacccguuugcagucccaccaaccuugaacagacgaucccucuuccccucuuccccacauccucucaagcauuugugucaguuguugaucuucaccagucugcaccuuuguaagaugacaucucaaaaucguuuugauuuccaucuccuaauugcuaaggaccaugacuuuuuuaaaaacacuucuuagccauuuuuauuucuucucuuauuuuuauuuuauuuuuauuucuugagaacucucuguuuagauuccuagcccguuucugaauauaucuuuuugccgggagggucucuuuuguuuguauaucuuaaauacacauaaagauaucaaauguacaucggucaaagauucucuccuauucuaugggcuuccuuaucacucaguugacuguuucuuuagcggggcagaagcuuuuagguuuuauaaguccuacuugucaauugcugaacuuaauuuccgggccaaugcggguucuauucagaacguccuuuucuacauacacuuagaucguguacgguaguguugguguuuucuucuagcagugucuguguuucacacuucacacuuaggucuuugguuuguuuggauuuaguugugucaguugugcaaggugaugcaggucuaauuucauucuucugcaugagagcaucuaguuugcacagcaguguuuguugaagauaccgucuuuucuccaguguauguuucugacagccgaccgagaaacucccacucaagagcauagggcuauuuaaagggccaggcauacgaaauaaauccuaauacaauagcagaagugagucuccuaacaaacaccuguaaucucaauacaugggaggccaaagcaagaggcuuauguguaucaggccagcuuggucagugagacacaggaaaacguaacagagaaauacuucauucuguagauauuuuccccaacuuuuaucacuuuaccuucucuucuugguuguauuuccuacauuuaauacaguuauuguuuuauuggcagaauuuaucauaaagaauuguuuguaguaaauuuuucaucaugaauauugaggcuuuuucaaaugaaugaauuauauuaaaaaagaaucuauugugcggaauucuuaagcaaaucagaaaacaaauuuugaugcuauuucauuuugcuuuaauauguacuagcuaugauguucuagaugccgaagaaagauuuuaacaugauaaaacccaacucuugcugcccuaggagcagugaugucuagauaggcaggcuugggaugaauagauagcacaagggaaggaaugagaaagaucugcuuuaguguguggacucagcgcuuuaaagcccaccacuuucacuuucgggaggaaagccgaauaaugugacauuaaugucauuucugugucacuccaccaacaguuguccaguuuauucacauugaugguugaaaaaccaucacaguauuuuugugaaagcuaagaugggacugguaauggccaggcaguuguguacacucagggggcagagguagguggaucucugaguuugaggccagccugcucuauagagccgguuccaggacuucuagggcuacacaaagaaacuuugucugggcugaggugggguaauaaugguaaauuuauuguaaagaugagaugagaagacuuucugcucggagcuguguguucauagggcuuuucauuucuguaugaacuaacgaggggaugagugguagaggcuuuaagcaccacagauuucacccuaacuccuauaacuguaaacccuucccuaaucugcaaggugcuuacuuucuccugagaugacaugaagccaacccuacccucacccuuacauagcuagcuuacaaguuuuauuuguaagguugacucugguauuucaaacauaaaugugaccccuuggucacaugcagagugucagccucuccaguccucucaugcucuuagcucugcacauuuguuugcugugugcuacuccagguccccuaacugcccggcuucccugccuaccauuuggaacucuucauuuccugccaagugagaguuuccucauuucucaucucugagagcucuuuuuagcauauauuucacccucagagagacagcaaugucucacuuuugcuugguuaucccaguucucuauugccauccguucuccagggcgacccuuugaacaccaaccucaauaucauacccugaaaacaacaggaacguuuucuucuaggucucaccuuugucuuaccuuccuucuuagcuuacagcugcacuucuguaaagggggcagcuccguggagucacuuccacacugcauugucuccgguccucguagcugcacuccagcuugccaguuccaccgauuuccugggccauugcaauaguuauuuuccaucauuuuauucgcaucaugaucuccaagcauuugacauuaccaaccauuauuaaucugaaauccucgucccuguggucccugugggcaaauguuggaacaaugaccagaaaugcacaguucuuuagggagcugaccuuucuugauauauauaguuguucuuuuucugucccugucagaaacucagaucucauacagaccuauugauuaauuggacauaguauacuguaccuuuaaaacuaguuguuauuuguaaucauuauaccacuugcuaguucuuuugaaaaauugggauucucuagcuuauaaaaaauauauggauauauaauaaagguuuuaaauuauaagcaaggucuuugucuaagacacuauaggaugguguguguguguguuuuucuuucuaauuucugccuuaaggacauuuauaaccuuuuacugagaaaaacugaugggcucaaagauguuuuuaaauuaaaaagauucguagcaguucaauaagcaagaguuuuuguuuugguuuuuuauugguucugccuucacuuaauuguaguaacauuuugccuuuuugauagguuccccaagaaacaaggaacauggaaggaucugcaaaccaguugcagccacugagugagacucaaguaguuaacucagagggcggcuguguauggcaggucaccgacaugaaccggcugcgccgcuucuuguguuuuggcucugaagguggcacguacuauaucaaagaacagaagcugggccuugagaaugcugaagccuuaauuagacugauugaagacggcagaggaugugaagugauccaggaaaucaaguccuuuagucaggaaggcaggacugccaaacaagagccacugcuguuugcacuggccguuuguucccagugugcggacauaaacacaaagcaagcagccuuuaaagcugucccugaagugugucgcauuccgacccaccucuucacuuuuauccaguuuaagaaagaccugaaggagagcaugaaguguggcauguggggucgcgcccuccggaaggcaguggcagacugguacaaugaaaaaggcggcauggccguggcgcuggugguuacaaaguauaaacaacgaaacggcuggucucacaaagaucuccuccgacugucccaccuuaagccuuccagugaaggugagccuagaaagacacagacggucgaggcacagaugcacuggauuuucuagaauuagcuuuuauucacaaaacgcaaugcuguagaauuaaucgagaccuauuuaaagccggccugaaacuaaacgccugccucggguaauccagacauugauacucgaucucugaacaugcuggguuuauacuuugagucauuaaugcuuauguuuuaaucucccuucuaagaaaguaauuacuguaucuacauguccuuuucuucgggcacuuucauacacuaaugucucaaauguguaguucagcauagccuucaagauuucaucgcaggcagaacucuagcaagaaggaaauaaguagcaguauagagccccugcuaucaagaagguguaugcuugcuaaaaccugaccuugucuaugcuguauucagaccaucgucacuuggugagcacccuagacaauguggccacaucugagaauauaaacuagucaccuaucagugggucaugagucuugaucauuaaugaccggaucaccuguagcaaguauuugguuuccugcuggcuuuaaauauaucugauuaaugaaucaacguuaaguuuuguaaaugacaguggcugucagguggcugcugacauggugcugguauggguacugggucccagacucagguccucuguaaggguaucaaguguccuuaaccacugagccaucucuccagccacucccucacuuuuuucuagguuaaauaaacaaacaaacaaacaaaaaaaacccaaaaaguuccauccuaaaaucaggaaaaaaauguuuuuuucuuaaacacaccauuuuuuauuuucaaaucugaugcaguauacacuggacauucuuuuacucuguguuuugacaucaauagcauaaguugguacucagauauagaaagaccccgauuacaacugauccugaauagaccagucucuaaacaagagauacugugugggcuuucuugucauggucuauaaagugagggcgagauguuccauaacuuacaucugcaggaaguuuucagucuaagcuauuaagggugaaccacacacuaaaguuuuguugggaacagcaucaucacagaugaucccaagguuccucauguagaaaaaacaaauuuuuaaaccaacucuaaacaacugaguaaauaacguguuaauaugcuaacuaaaaugugcguuuauaaagacauuaagucaaaauauaauugucuuaacucgguaucuauuauguuccugugagacuaagggacuucuauuuuuuuuggaaaaacaauauagaggacuuuaugugaagcauguaauuauuaagacagcuuugucuuaaaucuguaagauagcaagagaugcaauacuguagaaauuccugcgugucaguauuaacuucugauuggauuaucuaaauuuaaguucagaaauagcacagagaguguuucagauuuacuuaaagguauguuuuauuuagccuauaaaaauauuuuaagaaaaaaaaaugaaguuuuuaucaggauauuaaaaaaaucagacuacauauaaaaaaaucuauauucugaccugccuuuagauccacugaccauggugcuaggguuggaccucagacuauauacaugcuccgcacauacucuacaaagcacugagcuauauccccagccauuuuuauuacuuuuuuauucauuuguucauuuuaagcuuuccagauuagaccuaagguacacacauucgaggugaauuuucuauaacugagcuguagcucccacucucaacucuuuauucugaaacaaggucucacucaauuaaccaggcuggccuugaacucaagauccuccuccuacccaaaccucugagcaguuggaauuagaggccugugccccgaaaccugccuuaagguuuaucuugaagccaggcagugguggcacaugccccagcacuugggagacagagauaggugaauuucugaguucgaggacagccuggucuacagagugaguuccaggacagccagggcuacacagagaaacccugucucaaaaaaacaaaaacaaaaacaaacaaacaaacaaaaaaacaaccaaaccaaaaaaaaaaauaucuugaaaguucuuuuuucuuuccuuccuuucuucuuucuuucuguuuuguuuuuggggggguuuguuuguuuugucuuuuuuccagcacuaaaccacacucucugaccaucacaauccuggugacuuuuagaucacccuggccuguuucuguauuuuaccuacugcucucuaaaucaagccaaauguguuaaucucuacacucuuuacagauuuggagauuaagagguagaaagauuaagguugaucaggaaauguacauuaaggaaugaaauggcuacuucuucuugcaguacuuuaaacugagugagcccaaauuugaauucugugcuucucccuugucuuucuucagucuggaguuuguggucuguggccuaccuauugucugucugucuguaguuugugucugaucuauuccugcugucuguccugauaaagggcuuugcucuguauuucuugaacagcaaagaaagaguguuuuguaagaaucuuuuaaaagguuuacaaaggaagaaguuacuuuacugauccauauugaccaaaauagcucucaaaaaccaagcacggguguuaccagccuauagucacauguugcuucccacaucuuuggcauauugguuguuuuaaauugcuuuuaaccuauguaauuacuacaguacacacauaaauacauuagucuggguuaggagcauggaacauguauacuuuaagauuaagauuuagcuuaaauugcaaaagcugaccacaggggaaauccaaggcagagaagguugguuacauuguuuuuuaaggcagguugaauuuaaagcuaaguacacaguaguauagcaggauguguacauaguuuuaaaucaucucaaggcauauuaaauaacaguuucaagaucugacaaauguuuaucucuucaaaggcaagaaguauuuucagcaaaagauauaccauaagcaaaauauaugcuuaagcauagauuuccucaagccaaacuucuuuuaacuauuaaaacaaauguaaaaggaaugcacaaguuauuuuccuuuuuaaaguauugggcuucucauaguuucuguugcugaacaauuuaauagccugucuccacauaaucacuagugucagaaauccguauuuauucaagagcacaggacaaaucagugugacaaucacuggaauagaugaauauugugagugagguuuugcaugugaaguaggcauugucuacaaaguuucuagugucagugucucugcagugccccgguaaugcaauuaguuuaaacuacagguuggauuuucccaccaccauauauuuagacuguaauuacuaauggaguguuagaaaagaaaaaaacacuucauuugcugaaauguguuuguuaugugacagaacauagcaucccauguuaagggagucagcuccugugugucuaguuaagcugauccccaugcagucucaggaccgcuguucuaguuucacuaauccuacuugccuuuuccaugcuuuaucuuguuaaaggacuugcuauugugaccaaguauaucacaaagggcuggaaagaaguccaugaagaguauaaagaaaaggcgcuuucuguggaggcugagaagcugcucaaguaccuggaggcuguggagaaagugaagcgcacgaaagacgaccuggaagucauucaucugauugaagagcaucaguuaguuagggaacaccugcugacaaaucacuugaagucuaaagaggugaguaccucucuuuagaaagagaaaguggaaguaaaaacccuggauucagucccaaacccuaccaaaauaagagaagggccagggagauggcuucuuauuuauagcucucgaugaacaggcaagaggaccaacccguguccagcugaggggcgagaagacagagaugcauccccagagcaggugacuagcgagacuagccacauggcauagcugagacucugccucagaagaaaagugacacgcuaguaaggaagagucccagcuucaaccucaagccuuaaaacacacacacacacacauuugcacacucacacacacggcagagaagagggaccaaacauaucuuuaaagugguacuuauuaaaauauucagcauuaacaugauaccaacauuauuccauucacacacauacauggacacagacacaagcuauauugagaauuuaggaagcucuguauuuucuccacagaaaucuccuuuucuuauuggacaaccuuuaauggacugauuuucauucuggaggcccuuuaaacccuaaggaaaggcuuuacaggaugcauugucacagcggcugacgucacuguguuccacucugagccauuucccuucacucuuuacauuucucacuagcuaucgcccuucuguuguuuguuuuuucucuguagguauggaaggcuuuguuacaggaaaugccccuuacugcgcuccugaggaaccugggaaagaugacugcuaauucagugcuugaaccaggaaacucugaaguaucuuuaauaugugaaaaacugagcaaugaaaagcugcucaaaaagguaugcgugagccgugacucgguuagcucuugggggaccuaagacuucucccauggcaaguuacauucgaauuccuaaagcuaaguuuaauauuuguccuuccuuucuuguguguuuuaccuuuagcaauauaaaccucugaaacucauaauuguuauuuuuacuuaaauuuggcaaucaccuucugucugucuuguuucuaggcucguauacauccauuucauguuuuaauugcauuagagaccuacagagcaggccacgggcucagagggaaacugaaguggauuccagauaaagacaucuugcaagccuuagaugcugcuuuuuauacaacauuuaagguaauaauuguauuuuguuuauuuaaaaaugcuguggggauuaauguauucuguaaaaaacacauuuagugguuuuucauauuauucuauauuaauaucuuagccauuuuaaagcauauacccauugcuuuuccauaacugguaugaaggugauuacaaaauugacaugguaaguuuaugaguaauucuugucacgcugaguaacugcuucuuaucccaagaucauuuugauaauuuuuaaagucuuacugauaaguaacugaauuugaauauuugcauuuugguggauuccuucaaccuaguacucuuuuuuaguuucaguguuaauuugcgucuugauaaucugucuuuugcaauggaaaucuagcuauaaguuaaaauuuuucauuucaaaauuuucuggauauaccacaaaaucuaacaucgauauuguguagcaaauuaaaaggauucuauaugagcaccaagugccauucaucccugaugcgcaaggacauuucaacacuagggcguccaugaguguaaccuugucagcaaagggacaugguaucaauugauguauaaaaagcauuuggcaaaauuuaacauuaacaaccaaaaugaaagccaaaaacucacuuacuaauaaaacuuccucacuaugauaaagcuuuuagauuaaaaaaaaaaaaaaaaaaaaaaguuugugggacaagaaggauggcucagcaguuaagagcacuaucugcuuuuccagaaaucguaaguccaauucccagcaacuacaugguaguuagaaacaucuauccuggaaccugaugcccucuucuggcuacaugcagauguacaugcagauagagcacuuauauacauaaaauaaauaauuuuuaaaaaaaaaaauucauagguaucaucagacuugaauaaaauaacaagagauuuuuccuuaagcuuaaaaauaaggguggcuacuuuccuugcuuuggugccacagaguacuaaaaguugugguaauuauauaagaaaaaaagccucacguggcaugcccauuauucuauccagaaaacccuaaggaacucacacacaaacccuguuagagugaaauauauucaacagaauuucaaguuauaacacaauucauuaaaaaacaacaacaugggagcuggagagaucgcucagcgguuaagaacacugacugcucucccagagguccugaguucaguucccagcaaccacuugguggcucacaaccaucuguaaugugauccaaugcccuugucuggugugucugaagagagccacaguguacucacauacagaaaauaaauaaauaaaucuuuaaaaaaaaaaaacagcaacaauaaaaacacacaaaaucauuggaugggucagggaugguuguacagaucuguaauccugauacuugggaaauggaaguagcagucagaagccagagccuccaauagcacaucaaguucaaagccauccugggcuacuugagacuuugucucaaaaacaagggaugaaaaaauagauaauaaauaaaauaaaucuaguuguaugcuauaguaauaaauuauuugaaaauaaaauuaagaaaauacuaguauuucaaguagcacgaaaagaaaaugaauauacugacaugcaagaguuauacauguaaacuguaaagcaugcccccgugagaagaggguagggccauccaaagccaucuacagauuucaaagucccaauggcauguuuuacagaaaauuaacaauccaugcaaaacuccaagugauuccaaauaaccaaaacaaucuucaagagcaaauuugcaggacucaugucuggauuucagaacucaacaguaaccaaaguaccacgcugcuguuaccaggacagccgugguagccaaaggaaggagacagagucuggaaacaaacugacacugaugugugaggagccuagaaugaguugauccagaaagggcaguuuuuaacaaacugugcugaaacaagcacacagucccaugcaggaggaggaagguggggcauucauugucuuacagcaugcacaaaaccauuucagaagagaucagucacuuacauuuaggaacuaacuaaacauaaaaagaauaauaaagaacaggagcuaacaacuuaaauaaauugaacuucagaauuugaaacauaggguaacugggcagugguggcgcacgccuuugauccuagcacucgagaggcagagguagaggcaggcagaucucagaguuugaggucagccuggucuacagaguaaguuccaguauagucagaguuacacagaggaaacccugucuugaaaaauaaaaacugaaaugugugcaucauacaguguuaggaaaaaguaggaaaaacuuacauagugggagaaacuauuugcagauuauacauauauaaugaaaaguguuuaauauccauaauauaaaaagcccugaagccgggcaugguggcacacgccuuuaaucccagcacucgggaggcagaggcagguggauuucugaguucgaggccagccuggucuacaaagugaguuccaggacagccagggcuacacagagaaacccugucucgaaaaaccaaaaaaaaaaaaaaagcccugagguucaauaauacaauuauaagccaguuucaaaauggacaaaguauuucaauagauaguuuuucagaauuauauaaaugaaagauguucuguuugauuagucagaucaaaagcacaaacaaaaugccacuuuguaccuaacugaaugaauagguguuagcaaaacaggaacaaguauuaggaagguggggagauuggaacccuuguguaucaucaguaauaaagugaaaugucucagccugugaacaugagcaucagaaugcuaaucauggaguacucagaaugcugcaccugccuauaaagccccacagugggcauggugggagagaccaugagucagaguccaccguggccuccauaacacccugucucaaaagcaaacauccaaagcaaacgaacaaaccugaaaacauaaguagaauaccaaccugguaagcuuacugacacacaccuuuaaucccagcacacacaaggcagcgccaaggggccaucucugaggucaaggccagccuggucuacgugucaguuccauacaggccuacauaggccuacauagagaaacccugacuccguaaaaagaaaauaggcaaacaaagaaaaaaaaaaacuaugauaccaucaagaacucagccucagcggccgugguggcgcacaccuuuaaucccagcacuagggaggcagaggcagguggauuucugaguucgaggccagccugcucuacaaagugaguuccaggacagccaggguuauacagagaaacccugucucgaaaaaccaaaaaaaaaaaaaaaaaaaaaaaagaccccagccucuguauaugcccagaggacuggaaggagguccuugaucuugguuuuguauaguaguccaucccggcucuacuaacagcagccaaaagguucccagguuguucuaggacugcaucuugugaaguacacacucuagugccagacaacagccuaggagguaccagacugcucaaggugacuguguaagcuuaaggcucugcauaggucgaugaagugucugcugugacaaugacagagucuccauauaagacaguguuuaugcgccaugaagauaaucagugcugaucaguuauacucuucagaauggcuacagaguaaauguuaucuuucaccacaguuaaaaagaaauucuuaaaaguucccauuuuacuucagugaaaagagauguuuaaaacuaggaccuuaacuuuuuucaguaaaauuaaacagauuacaucuuucucuucauuuugccaguuaauaagagguagaauguuaaagauaguaaucacuuaacuuauauaccaacaaaaacaggccuuucuucuaggagccucuugagugaaagauaaauacgauuuuuuuuuuucagucuaaccuacuuaacgaucucucugacuuuuucaugacuacuuuauuuugucuucuuuuuagacuguugaaccaacugggaagcgcuucuugcucgcuguugacgucagugccucuaugaaccagagagccuuggguaguguacucaaugcuaguacuguugccgcagcaaugugcauggugagauccccuaagacggcuuaguguuccaacucccuaaaacguggucagaggaaaacuggcaaggccagcgucacccaggaucagcuuuucacuuaucguuucacuuaugugacauuuaucauuuucuaccugaagacaacauuauaacacaaaguuuuacucaugcugaaaaggggcguuguguaaggaaggaccagagccaaauguuauagugagauuaaauguuacuaguauaugcaaaaauacaugaugguuaggggguaaaaaaugauuuaaaagcuccagaaaugaguaaugggcauuagagagcuucucgcccaugcuucccucaccacacaguaaggaugcucuucuccgcuugucugccuucauuccucauuuguaagaugaacaguguguguguguguauuugccuaggagagugcuguagauaccagcuucucagaauuguuuuggguuauggcuuuuguuaguucguuuucauguauggauugcauuggcccuggacaagagccccccucagaggacaagacagcauacaggagucauucuguccuuccgccuuguggacuccagggauagaauucagaguggcuggcagcaagggccaucucccacugagccaucuccacagccugugcuccccagugcugugacucucuauucugaaccacaaaaaagacaagcuuaggaauacuaagcaucacaguguuucuuuccgaggugacguuauguaagccuuuaagagacagacugauaacuucagaaugcugaaaauggcucccauugcgcuuuuccaggugguuacacggacagaaaaagagucuucggugguugcuuuugccugugauaugguuccguuuccagugacuacagacaugacauuacagcagguuuuaacggcuaugaauaaaguaagacacuguuuuacuaaaaugaccuguaguuuuguauuggggcauugcauaguaucuggaguaaaaaauuguucuaacuucucauggcaagcacaaucaaacauagaucugugcagacaugguacggucuguauauugguuuacauaaaaugaugcucugaggauaagagccuuuauguuagguauuuauuccagacaucuaauggacacugagaugguuuuauuuuacuauaauuccuucucuuuuuucccugagauagguuccagcaggcaacacggauugcucucucccaaugaucugggcccagaaaacagacacagccgcagaugucuucguuguguuuacugauaaugagaccuuugcagggcaggugcauccugcuguugcccugagagaguaccgaaagguaaacagcaacccuuccgucuguuacugguccucucugaacacacuccauuagugaggcuguuccuucauuuguguaggaaagccagugucgggugggcucagcaguacuugaaacagaaaguagggacuauacguacagcauccaguucaagugguaaauacuaacaacagugcccuuugccagugcuuuugauaaugaccgaauauauauuugaccucagcuauaauuuauaagauauauugcauuucuuaaaaaaauaacuuauuuguaagcuuaacuaaaaacuauaugaaguuacagcaaauuuuugagucuguaaccuaaacuuuaucugucugaucauucucucucuuccucccuuggccuuucucagaugacagaauguuuuguuacuauucuguccaguaugauagacacuggucacuaggcuguugaaugauaacauuuagcucaugugacuacuaaaauguaaaaagaacuugcuaugaagaacaaugguucucccaaacaugauuuuccuaccaacuauagcaucauuugguggucagaucagaaauguacaugccagaccccaucagacauccaucaaacucugugaguaggguucaggauucccaugaaugcuuacuuuugagcgccauaaaggagagacuagaauuuggacuaaaagcagucuagaguuagacuagagucuaguuaguccugagucucuucugcuaaaugugggucugaacaaguuaguuaacugacaaaugucauaguagguaauaaugcauaucucuuaggauugaugcaacaguuauaccugucucaaaaacaaauuggucgcccguuuggcugccuuucuucccaaggcacaaaucgucccagcaugggaaagaccucccucccuccuucccuccuucucuuuugacccauuuucacucuuccaccauacaguaaauaaaauuaauuaaauaaauaaauaagaaagaaaaacaaacuggucauuagaacuggucaugguagcuuagcauguaauccuagcauuugagauacugaggcaggggcuaaagagauggcucaguggcuaagagcacacauugcacuugcaaaggaccugaauucauuuucagcaccuauguuggguguuucacaacugccuauaauuccagguucaggagaucugaugcaucaagccucugcaauaaccagcauuccugugcauucaagcauguacgcacaugcuugcucacacacacacauacauuaaaaauaaaaucuuuaaaccaaagagucugaggcgagagaauccuugcuaagcuacauaaggaauuuaagaguagccugggcuacauauauagugauaccuugucacaauaaaugaauaaauaaaggcugguagaguaguugucuaccauacaugaagcacgaggcucgauccccagcccugcauaagaucauggugguacauaaccuacagucuuagcauuuggaaggcggggcagaaguaucagaaguucagaucuucuucaccuacauaccagguuugcagucauccugagcuacaugaaauccugucucaaagaaaguuuauccaaacaaaaaccuuaauuucuuaauuauuaaaaaaacauuuuaauagauuuauuauaauaacugacaaaacuauacuuuaauugauuguuucuuccgaaauauuuagugauuuuaaauacauaccgagagacugggaauauagcucaguaauucagugguagagaacuaaccuaguaugugcaaggucuuggcuugguccauagugcaaaggauggcuaagaagaauaaagagaaacagaugggagguggaccaggaagucagacagagagaggggacagaauuagaguucugaagagcacaaucuauuuacuguauauauuaaaauuggaaguuggacuugguguaauccagcauuuugguaggaggaaccaugguuguucuagucuuaauuuucaaggauuuuuuuguuugcuuuucuugcauauaauuucauauguaguuacuuucucuuauauuuucucuacagaaaauggauauuccugcuaaauugauuguuugugggaugacaucaaauggcuuuaccauugcagacccagacgauagaggcauguuggauaugugcggcuuugauacugcagcucuggauguaauucggaauuucacauuggaugucauuuaacccugaguaccagaaugaucugagaggggcacugcuguagugguuuucauugaaaauacacagccacuucccugcuagacacaguagugagaaaugucaucaguaugugcaugauagaaaugcacuuuggcaagaacaggagaagacagaaggaaggagacaaaaguugagcccaaaggugcauguacucagcuagcucuugagaagucuucaggauacuguagcuuccucuguagagaacuucguuuuaauagacacuguacaauagugguguuuuacuucacugaaucacaccuuuguucugaaagugugauacagaguauaaguagccucacaucaugucacuuguaugagaaguguuucuuuucuuaaaugucuucauuggaaaacgacaguuuuaauaauguccaaauacucugaggugcacuagaccaugugacugugauggaaaugaaccucaccagguaaauuuuuauacaaagggguuuaaaaaaaaagacauuugguuaaacuaaauuaugaaugaauuuuacaaauucagaguuuucuaagaucauaugaacaacagcuuucuuauucaaugaaaaagauguuuuccuucagauguuucauuuguacuuguuaggauuuguuacuauuugggcaaaacaggguggaaaucccuaagggacuuguugaguuuauauaggcugaggaauuugcuuuguagccuuguguuggcugaacaacaacaguguaucauguacuuccgcuuuccuggguguuucauguauguaacuccccuguccauaauccugacaguguaacaauuaaaacucuacuguaaagacauagauuuucuguaccccuaaaauaccuuuaacuaauuuucauauuuuucuaauauuuagucugaagucuuucauauuuuugcccccuaugcauuuugugucuaguuucuuuuuugauagaguagagaaauaauacagcaagcuagauccuucuaguucaaaggcaauuuuagaguagccauaucaaccaaucaguguauguagaaaaucuaagaacugauuuuguacaaauuaaacuuccuuuucaccauauuaaaauacauucuuuucuugagcaauuacauguuuucacugggaagcuuagcaugagaauggccuauugaaacaccaguaguuuuucucuugauucaguaaugguaucuaagguaguuuauacuaaaacgcuaauuuuuauguauuacucuuuaaauauuaaagguuuacugggggcuuauaaacccuuucaaaacuaguauguguagguuacauaaccuuuuaaguguuuaggggagugaaguucuuuuauuugggagagaaaggggcuuugcuagugugaggauuuauguacauauuuucuuuccuaagaaauuuagucucagagaauaagaaaauguucccuucagaugauuugaguuaaugaaguuucauauguagccauuccuccugacaguaacaaauuuucaguguuauuagcaaagauaguaucagcuccaguucuaaacaccauugcuucugaugcuguucuggcuugaccacugucacaucuuaacuaauucugauacauuaaaguuucauguucaaguugaauuuaaagcuuuaaacccuaguaauuacaugagaucuauugaauucuuuaaacccaggaucuaaguuuuaauaugaucuaacuuauuaugaaauuuacaugccauauuauauaaaagcuuuuuucuuauuuuuaaugcuacuuagauaaugcuuuuaggcaagcagaguauaucuaggagcuaguauuuaacccauaagggaaauaagggucaccucccggcagcccuccuacaguauagguaaaccuaauuaaagagauuaaaauugaauacagaggccaaguguggugaugcaugccuuuauuccugggaaacagaggcagguagaucucuuaaguuagaggccagccugcucuacauagugaauuccagaccagccagggcuacauagugagacccugucuccaaaaagaaaaaaagguuuaagaggcagaggcaggcauuuuucugaguucaaggccagccuggucuacaaagugaguuccaggacagccagagcuauacagagaaacccugccucaaaaaaccauuaaaaaaaaaaaaaaaaaaaaaaaagucccaacagauagaaaucuuaucuucaaauugcaaaacuucagaguagaaagaaaauuuagaaaaaaauguauuugauugauaaccagaaaccagucuggaucuucuggaugugugugugaugguuauuuuguuuuguuuuguuuuguuuugugacagggucucucuccauagacauaguccuggcuauucuagagcucacuguguagaccaggcuggccuugaacagagagccuccugccucugccucccaagugcuagggcuaaaggugugcaacacuaugcccaggguaaggcuggaugguuuuggagaggggucugccucucuacucagcauucuggcuuuuagucucucauccaugggacauguugacuuuguaagagaaacaguagaauuaugaagccuuuuaccuaauuuagacguuaggaauugauuaggaauugaugauaugcaugauuacuuuaggaaccugugaaugugugugauuuguuuguuuguuuugauuuggaguaauucucaaacacaauuaugucucugcagccuauguugcuauggaaucuagccacauagcaaggcauuauuaccucauuaagcauaggauacccucaagugguaaacaaguuuucuuuuccaaauuaccacuagggugacucuuaaguaaauaguacggaaaauacugcuuuaaaaagcaaucuuaagaaaaguaaauguuauuuccuagauacuauguaaauauuucuaggauuuaguuguuacuaauaacacaaaacacuaaucuuuucaucucacuguuuuugauuaguggauaguccacguauuaaaacuguuacuuaguaacuguuuucaggguguguuaggaagggauaugcuaguaaguagaacuacuccauccuuuggagcuucuugguuuuuuuuucaugugcugugucauuaugaacaaccaguucaacauaugugguaaaauucugcucuccuacaaauucauguaucuuagucucagaucauagaagaacaagcuguuuaauauuuaccgaauauugagaauggaaaagaggccuuucauuacaaguccaaacuucauuuuuaauuauaaacacuaagauguccuuaucccugauaaaaaggauauauaaaaaaauauauuuaaaaaaaaagaaagcaaagcucauagucaaacuaggaccaugcuauuacucuuacuauuacuagcuuaucuauuacuuccuuacauauuacuuuauuugaauaacaauaagucuacagcagacaaacugacagguugcuucucacuuuccuagacuucgacaagaaaaauuauaccaauguaaauguaagaaucuaaugaucuuuagaagcacaggaaguguacaucuaagcaggaaaugaaagcuaaaucauuguaaauucuuugaguuauuuuccugugaccuaaacauuuugucccaaggcaagcaagauagucaucguggguaaagacacucaccaccaaguuugaugaaugguucccagucccuggaccccacaagguaggaggagaaaccaguuccugccgguuguccucugugccauggcgugcaugggcgugcaugggcguguaaaagugaaaagaagugcugcuacagauuuggucuguguuguuguguggugugcuuguagucaaaguaacucaagaugcaaaaucgucuuggauuccauugguuuuguuaggguacaaguugucaucuuagagaaaugucacacagccagaaggaaggaucagcaaagaugacagguucuuugugagacaagccgguguuuaacucagaaguuauuguguucucuugauaccugcuccaucaucucuucuuccauggaagauuacuucucgcccauuuuucucuuuugcaaagucuucucccauuuuugccuuuuauuccuguuugauccaguuggguaauaaauugcaggaccagaaaaucauccacagucagguuuggggcgaaucuacugcagguuguuuuuuuguuuuauauaaauuuaagaguauauuuuucagaguuggagagauggcucacugguuaaaagcccugagggcccagguucaauucccagcacccacauggcagcucacaacucucuguaacuccaguucugggaauccuacaccaucacagagacauacaugcaagcaaaacaccaauguacauaaaaaaaaauaauaauaaauaauucauuuuuaaaaauguuuuccaaauuacugaaguaauauccggauugauauguucuuugcccaaaucaagucauguuguagauauuccagaaauguuauagccauucaauaagaccagaaucuguauaaucacugauaaacacugaaaagagaacuguuauacuauauaugcaaucuaauugaccgcaauuucagaaagugacacauauauccucucaguucuauaauuacacuccuaguuuacaaagucuuucaacugagugucuguccaugcaugcacacauacauguacacugaacuuacaaaaagccuuauaaugacuuacguugacauucacuaucuuacugguaacuauuuacucuuuugaaaaaaaucacuaugaaauuuaaaguugauuugaaaauauuuucauauagaaaacuaauaauguaacuaagaaugcuauuugaauaacauaacagaugacacaguuuuccuaaacccuaaaaguaacaagauauauuagaaaaaaagggaaaaucaaugagauucuauuccuagaauugugauuauuuccacucagcauuuguaaauauaaugaagauauacaaaagcuguuucauauccuucagggauauguuugccuuucuacuuuaucccugccuuuaaucaucagaacuuugugaacacaggugaacuuucauuuuaaaauguuugaacuucuguaccuuguauaaguuagcagaaucuggauuaaaaaaaaaaagaaacuaaauuaauuucauuucugcugguuucacuuuacuguauauuuguauuauuaaaaguaggguuaauauuguugacuaugcguaacugcuaaauuauaucagugaaaucauuacauugaaacuguauccaaaugauuucucaggcuuuguuugaaguguaaacuccagccccauuaugaccaaauuagacuuaaagauagugaaugaauacuaaugaagaaagcugcucuuguugcacuguucuaaauaauagaauauauauuugguaugguuggugaaauagcuuuuguuauuauuuaaguuacaauuucuuauugcaaauuuaauaaugaauucuccaaaggaaugggaugaauggaguuauauuugaaagaauuggaagaaaaguauuacaaucugcuucuaaacuauuuguuuuauuacaaugacauuuauuucuauaauuggccaauugauggaucuuucagguauccagaauuaugucugcguaaaauaaauuauaguuauauuaagagccuuaaaguggggaaaaaggacucuuuugacugccuuaacauaugacaagcucucuuuuccagacauacuaauuucuuuagggucuguuaaauaaguaaugccuuaagagugugcuaaugaucugaagaguagagcuuacagggucuucuagagcuuuuaauucuacauaaugaauuuaaguguuagguauuauaccugauugcacauuaauaauuugaaauaagaaaagaauaaucuggcuaugcugauguguaauaaguacauggcugcaacaucaguauauuuuaugguugcuuaagauuuuguauuguuuuguauaaccaguuacccagaagcuggacuuccuggccauaauaugaccuccaaggaccauguugcauauuuaacacuggaugaaaaguucaguuguauagcuccaaaaagaacugcuuuuuaagggaaauuuuugaggcaaaaggcaaauguuuugguucaaaccuaugagcaaagucauuuagagaauugaagauaguauuaaaaccuugagacucuugcaauaaaaauaucagaccagugacuuguuucauugcauucucauuuugcauuugcuuugccguucaaagcagaaaaaucuuacaaaaccgaaagaaugcuuuaaaauugucacgcuggugcuuaaagaucuauuaugcuugauguauaacuaacuuguuuccaagaacggagccuggggaaggcuuauaggccuuuccuaguacuugugauuauugauugucaagucuuccaaguuugcaauguaaauaauguguaacaaugugacauugguguuuucuaaugaggaguggaugaaugcuucaguuauuacuucuacuucaugauaaaaguuuucaccaauacugagaaaucuugauuuuuguaaccuugcaaaauaaccuauuacauacaaguugauugucucuuaccugaaaugcuuggagccucaaguauuuuaagauucuuuuuuccaauuuuggaaucaucugcagauguauaauggaauaccugggauuugcuguaugagccuuguaugugucaugugacagaaaaucauguuuuaauggacuugcuuuggcugugacuuugcaauuggucuauggaacuuuccacgggcauuauguuaacacucucaaguuuccaguucuggagcuuucuaaaauuuuauauuuccaaauuggggaugcuuaacuuguaagucauuccagauguggagugggcacuacacaaacuguuugucaccaguuuauuguagaaaucgauagguguaccaaauaaauuguaugcauaucaaauaacugucuuuuaaucauuuuuuaaucauuuuuuaaaacaugaauuuuaagguuauaauaugccuuauauguaaaccccugaagcagucgguuacaacucaaaagauaaaaaaaaaaucuuucca

SEQ ID NO: 410 - RNA, 643 nt, Mus musculus
aggggaugagaggaacauggauaugaagaggaggauccaccugcagcugaagaaccggaccccggcagcuguucgagaacuuguauuggacaauugcaaagcaauggaugaaaaaauugagggguuaacagaugaauuugugaacuuaauguuccucaguuuaauaaguguaggcuuguuuucaguuucagaccucccgaagcuaccuaaauugaaaaagcuugagcucagugaaaauagaaucuucggaggucuggucaaacuagcagaagaacuuccaagccucacacaucugaaccuaaauggaaauaaccugaacgauaucagcaccuuggagccguugaaaaagguuggauugucugaaaagcuuggaucugcuuggcugugaggucacuaaccggagugauuaccgagaaacugucuucagacuccuuccccagcuguccuaucuccaggauggcuaugacugagaggaccaggaaacaccugucucacacguggagguggauggaguggacaaagaggaagaggaugaaggagaggaugaaaagaaaaagagagaaacagaugacaaaggagaagaugauuaagacccgaaacaaccugcaagaaacagaacuguugaguauugguuggacugcuc

SEQ ID NO: 411 - RNA, 1187 nt, Mus musculus
ucccucugaaucuauagguaggaggaagagaaagccacugggcuugucuggggcuuuugaaaucuaaaagucuaaccccaguaacauuugugccaaugagggcacaccucuuccaacaccaccuccuaaaucuuuucuagugccauuccaugaugacuaagauuuuaaucauauuagucuacaagggccauuuuuauucaaaccaccagucacuacacaaugauuuugaaaguuauucauggcacauaucauuaauucauucuuuuuauuacuuacuagguuauauucuauuauaugguuucaguaacauuugaauaaccaaucaucuuuuaugugcaugagguucaucuccagauaaaccuauauagcuaaauauauuaaacaagacuguauuaucauuccucuuuugugaaugcuuagcagaauagcuucuucuuugggaaguacauagucaacugccaaguaauuguucaauuuuauaaacucccuuuuccucugcaugcaauagaucauugaguguguguguguguguguguguguguguguguguguguguaugugugugugugucuguguaaaugggaaauuaauccuuaaagucaacaacugagaucaaucaacaacaguaaauugcaggcuuuggaaagagucaugaauaccucuuaauuagcuucucacuugaugauauggaugaucaacaauuaagagaaaauugacaaaauguucugagcuaagagacuguaguuguuucucuguagaagcacuuucaaucucugcuuuucaaaaugugaaaaugcccaauugauuacagcacuuuagagacaauauacagauaucuuugcagaaauugcaaagagcaaaucagagguuauguuaaaaauaagaacauagccacaacccugaaaauauaacucacaugagaacauaauuugaugucugcauugacagugaaacauugcagacuguuugacuacaaagauaucuaccaguguucuuucacuacccuuggucaggcauaucccaaggacaaacaaagcuguccagagaucacuuacugacauuuuguuguuguuguccuugaccuggagaaucuuuguuuucugcaagugcuuauaauaauuucuaaauaaauaacuggauauaaauagcauuaauucauuuccuaaagaagaaaacacacacacaca

SEQ ID NO: 412 - RNA, 488 nt, Mus musculus
gaugaaugucgagaugugcaguuucagcgguacaagaucuacccggaacagggcggcgcuccgccaggacugaagggaagguucuccagucacuuagugcaaaaugugaguccacauuuguuuccaaaaggaaucuuugacagauaaacuggacuguccuuuacagaagaaaacacaaggacagugggaagaaauucaaaagaaaagaauccuccgugcagucaaauuccaacgagccaucacuggugcuucucuugcugauauaauggccaagaggaaucagaaaccggaaguuaggaaagcccagggagagggcugccacggaagcaaaaaaagaaaaaaaaaaaaaaaaaaaaaaaaaaaaggcuaagcaggcaucaaagaagacagcaauggcugcugccaaggccccacaaaggcagcaacuagacaaaagauugugaagccugugaaggucucugcucccagaguuggugggaaaugcuaau

SEQ ID NO: 413 - RNA, 2815 nt, Mus musculus
gcuuugagcgcugcuauugggugcugugaggggaccucaaguaagcuccauuuuugaaacauggaugcagugacuuaugaugaugugcgugugaacuucacugaggaagauugggauuugcuggauccuucccagaaaagucucuaugaagaggugaugcaggagaccuaccagaacaucacugcuauaggcuacaagugggaagaccaucauauugaagaauauugucaaaguucuagaagacaugaaaggcaugaaagaauucauauuggagagaaaccguaugaacguaaccaaugugguaaagccuuugcaagugacaaucaucuccaaauacauaaaagaacaaauacuggagagaaaccuuaugaauguaaucaaugugguaaagccuuuucacaauggaguacucuccaauaucauauuagaagacauaauggagagaaacccuauaaauguaaucagugugguaaagccuauggacaucacaguagucugcaauaucauaaaagaacacauacuggagagaaaccuuaucaauguaaucaaugugauaaagcauuuucacaacacaguagucuugaauaucauaaaauaacacauacuggagagaaaccuuaugagugugaucaaugugguaaagccuuugcauggcagucuagucucaauauacauaaaagaacacauucuggagagaaaccucaugaguguaaucaaugugguaaagccuuuguacaucacaauagucuccaaugucauaaaagaacgcauacuggagagaaaccuuaucagugugaucagugugguaaagcauuuacacaucaaaauaaucuacagugucauaaaagaacacauacuggagagaaaccuuaugaaugcaaucaaugugguaaagcauuugcaagacacagucaucuccaaguacaugaaagaacacauuuuagaaaaacaccuuagaaugcaaucacuguuguaaagacuuuggauguaagacuaaucuccaaagacauaaaggaauauauacuggacagaaaccuuaugaauguaaucaaugugguaaagcauuugcaacucacacucaucuacagcgacauaaaagaacacagaggagagaaaccugguuauuguuuacauauggacauaaggagauacaaguauguaucaaauugacaagggauggauugugauugcugcucuugguuuucaauauaagaucuaaaguggaaagcauagguccaggcauggugguacaugcccuugaacccuaggagaugagcaucaagcagaucucugaguucaaguccauccugauacagaacaaguuaaaggugaagaaauucuuaggucuagcccuguggauacagagcuuugcagauuucugaguucaaggucaauauauagagcaaguuccaggacagccaagcugaggaaguaaaggaguuggagaacagaaaacuggugauaauguaauagaagaggccaugucccaggcccagaaagcagcagaacucagcagcuuugaccauguggcucugacuuuagagguaagaauagaagggacuacugggaaaauggaagcuuguaagcugugacugagaaauuagaagugaugaagaagagaccagcaucauugaggugaaaucuucuaggaaguguuuucugagagaacaaagaaacuguguuccagagauagccaggauuguaccuuguguugcagcugaacuuggucucauguaagaaucacccaggugguacugguuuugaaggcaugacggugucaugaggagcagcugaggcuuggaccuaugaagggagcauaagugagacuaucagugaagccuaguugcagcagaagaacccaacauauuaaagaugccaguccaaugggaugagcagaaagaacagcccaguggaguggagucaaccagagcuuagaguaauagagggcagagcugaagaagugaccuuaucucuuuggaggacugcagaagaucauguguggauccaagacauuggaacaagaagcugagguuaccuucgagaccccaugaucuuugagaugucagagcugugggguaccugcucaggaaaaaccagccaaagagaaagaauugugcugcagugaacacagcagaaaaaaaguuggagaucugaagagugcuuuaacaucagacauggagaugcaguuuggagauuuccaagcuggcuuuugguuuuguuuugguccgcuauuuccucaugaugacauuuaggaauguuaaagucuauguuuugaagugguaguauaugaucugcuuuuagauuuucuuuuuuaggggauuacaguuacauugaaugaaucucagaagagacuuugaccuuuggacuuuuaacauuuuugagacugguauagaugauggggacuuuugcaguaggaccuuguguauuuuucauuaugcauguuuaaguaugguccucauacauuccuguacuccaacaugcuuaugggggccagugaguggaauguaggaguuugaauaugcuugucacagggagugacucuauucagagguguuaucuuguuggaggaaguggauaucucugaggguggacucugaagcuccaccaagugcaaaacagaccguccuauucccucccuggaagacaguuucuuccuggcugccuuuggaucaaaaugcagaacucucagcuccuucuccagcaucaugucugccugcaugcugcugugugugcuuccugcuuugaugaaaauggacuaaaccucugaaacuguaagccagccccaauuaaagguuugcuuuuaagagaaaaaaau

SEQ ID NO: 414 - RNA, 1458 nt, Mus musculus
aaugugauguucuuuauuaaacaauuaaaucggagcuggcuguugcuuucugaaauauugaagugcaguaauggcuguuuaaugauauuaaucacaaacucaauaucaucaaauugaacuagccaaucaauuguaauguaaagaaauaaguugaaagaaauauaaaacuacaauucgugcuggauguaaaguaaacaucaccaugaucagaaaacccagaccaguguguuuugcacaauggauaauuuuccacaagauacacuauucauuugucaguuauuuauugcucauguuaaaggauucuuauagaucauccuuucaggaacaagaugucauugcaaguauuauuuuauuaauaauuuaagaagcugaauuggaagguacuggcugcuggggaaguguacccauuuuucuuucauuauaugaccacuaguagguuacuuauaugucggcaaauggccaaacacugauggccauauacaaucagcauguuuucaucucaaagggcuauaaaaauguaaaaagaaagaaggaagaggacuuaaaguuggcaaguauauguguuaagaaaggguuuccaaagaagauggaaugaggaaaguaugggcagaugggaccaaaaauucauuguaucucugaauaaaauucucaaagaauauaacaagauuauuuuucuuuuaaauucagaauaagaagcugaaccuugaucaugugaagaguaccauguacguagcugaagggagaaaauauaauuggauucaaaacugugaguguacccauuugcaucacaucuugaaauuuaaguagggcugggcuugguuaguacuugccugauacaaacauaagugguauauaucaauggcaccccuagauaauguaauaagaugcauuuacaaugugccuauuuagguuuuaagaagauauuaaaauuguauuauaguggggagaucuguaaauauagcuaagguaguggaguggaauuuaagaagucaagagaauguuaaaauuuccugagaguuuuuuaggguagaaggguugaugcccacaguaggauuacaagaacauuaguuagggaucuuugguccaauggcaucagcuaccuaauaaguauuccuguuguguagacuucaugagauaugaaauucuuuauagcugagacugucaaguccauuuauaaaauuauuaauuggcaauuauaauuacagauaauaggauuucuacucacaaaaccaugagggaucaaaaaugaaaauuuuucuaucaccugagacuagauucacccuaccaacugaaagaagugagugaagacagaguacacuuucucucaauuuccaauuaaucauuaauaaaagacuaaagaggaauuucgaccagguagaacaaaaauaaaauaaagacauuaagugcuugcaccuuaccauguaaguaggcuuagccuucguguugugcaagguuuuc

SEQ ID NO: 415 - RNA, 8333 nt, Mus musculus
cagcuucccggcuuccuucgucucucauuugcguggguaaaagccugccgcugcgguucuugcgcaacucacugaagcagagagggggaaaaguugguggggguuggggaaagccuaagcggaaagacagagucaccacuacgucacguggaguccgcuuuacagacuuaaaagcaagguucuccccauuagcagccaguugucaaacugcgagcuaagagcuucaggagucagucaggacucugcucacgaaggaacucagcacugcauccugccagcuccaccgccaccacuacugccaccuccgcugccaccucugcgaugcucuuccgagcugugcugcucugcgcugcccuggggcucagccaggcaggugaguugcgccccgaggcgcccugggacuccucaggcucagacccccuuucuagcagugugggccuggcuguguauuggcaaagagccuggacugcuuaaguccugaggaacugcaacccacuuucagguuucuuauuugcuaaaaaccaauagucuuaauggcuuacagguugucauuaugguaagacaaucugaucaauacuugugaaaagcauagaugugggcaacugaacaagaguggcugcuuugaauaccuguuagaguuuuucuauccacagaaaaauccagaauacauuuuuaaaaauauauuuaaaaugcuaaaacuugacuguuuuaauuuuauuuucuuuacacuaaauuuugacuauugcacuaggucgauccauuuuaauauuuaaagggaugcuuaauaauucuagucuguguguccgaguuauuuuaaaaauguugguaaugugaacuaugaaguuagguccucuguguuucuugcuuaagaauacaaaguugcuugcuauuuccauaaacaguugauaagacagacuuaauuaaaauaaugaccuuuuuaaaucugggucuaccuauguauuugucaaacuuaucauuguaaaguugacccauagugacagaauuaaauccuuaaguuaagaugagaacaaccaagaguaacugacaggauaucuuauuuuuuuaauguagcaaauccuugcuguuccaauccaugucaaaaccguggggaauguaugagcacaggauuugaccaguauaagugugacuguacccggacuggauucuauggugaaaacuguacuacacguaaguuuuuccugggguaucuuccuuuggaauguggccacauguguaaccaucauucuguagauuuguguccuaugggggaggggccugcucauucuuccuccugcuuugucucucuccagcugaauuucugacaagaaucaaauuacugcugaagcccaccccaaacacagugcacuacauccugacccacuucaagggagucuggaacauugugaacaacauccccuuccugcgaaguuuaaucaugaaauaugugcugacauguaaguacaacccucccuuguuuuccagcauccuccaacacaacuaggcacuagaaacccaaccccaagaacuauccugaccuuuucaaagggcuugaaguauaccuuuucuaaucuguuuuuccccugaaaugucuaaaauacagucaugaaaaccuguagucucuauucuaguuuugaccccuguccuucauucguguggaggaagugugguucacuuguucauugaauaaauacccauggcucacagaauuguucggaacacauagaauuguucugaaccuuugaaacaaaugguugacuaggguuugggucagaagagaaaaauagcugucuguaguuauuggugagggccaugcccaaaugucucugucaucagcuauggaacagggaguggguagaaacugaaaagucaagacuacuggagcagaauguccuguguaaaauuuaagcuuuauugaagaugcauuuucagugcucuuuaaaguucagccauuguacagcaggguaucuuugucugaaggaaaucuagucucuguacuugcuacauuguacaaugauaauugauaugcccuuguuguuguuguuguuuuucauaugaggaccaaugauuuuuuuuucuuuaaaauuucagccagaucauauuugauugacaguccaccuacuuacaaugugcacuaugguuacaaaagcugggaagccuucuccaaccucuccuacuacaccagggcccuuccucccguagcagaugacugcccaacucccaugggugugaagggugaguguaaagaaauacagacauagcaacugcagugaggcuuggguguguaccuagaaaagguguccauuauguaaaacuguaaauaguuuugucuuuaguaugguuauccacagagguuuauuaaaaguacagauguaguaugggaaaguaaaucugcauugauguaaugucuuagccuuaguauguuuugcuaaauagaacugauguuaguuacaauucauaaaaaauucaauaacacccccugcuuuauaucuuaacacuugaauuuaaaaccuuagcccagccugggguacaagccugacacugugccucaaaacacaacagucguauugauguugugaucuucuuugagacggugcuucuaagugauggaugcugucauguauuauacagucaucuguuugcuugaacaaauaggugaauggauagauacuuacuuuagaauuuacauguuccaggaaauaaggagcuuccugauucaaaagaagugcuggaaaagguucuucuacggagagaguucaucccugacccccaaggcucaaauaugauguuugcauucuuugcccagcacuucacccaucaguuuuucaagacagaucauaagcgaggaccuggguucacccgaggacugggccauggaguaagugggcuuaacucagauuuauagcaaauccuuagggaaugcugacaucuuaccaugccaaacaaaucacacccauuuuuuuuuaauccaaaugucaugacuacuaaaaccauaauagguguuccauuuucauuuucugauuuaguaaaaaugaacugacacacagagacauauuuuaauguaauuuuccuuacauuuuuaguuuaaaaguuugguccaugaaaagggucuaucuucuguaaauaaauaaauaaauuauuagucaucgguggcauugggaagugaaccuuagaaguuugugcuugccaggcacuggucucugcuauugaggcagaagagguccagccuuuacacacacacacacacacacacacacacacacacacacacacacacacacauacaaaauccccuucuaugcuucuuuaaacaauguaaaauuacuauuaugguuauaaugaagcaaguggcauauuuaauauaggauacuaauacuauucaacauaaagaaauauacagacuuguagcucugguagacaaauuauuuuagaauuuuguggcuaugaaaaagucacuuauugagcuagauuggugauuaagaacaguuguugcuuuugcuuaaguucuuaacaccuacaugacaguucacaaccaccuauaacuccagucaguucuaggagauuccauguuuuguaacauuuuagggcaccagacaagcacaugacauacauacauacauacauacauagaggcaaauucucauacauauaaaaauaaaauaaaucuuaagaaaaucacguggugaauuuuaaagacaacuaaaucaucaauauugaauaagaaauuauaguaaaaaaucaguaaauugaacuuucuccauacuuaauuuucuagguggacuuaaaucacauuuauggugaaacucuggacagacaacauaaacugcgccuuuucaaggauggaaaauugaaauaucagguauuuuccuuaugguuuaaaaaugaccaucugucauuuagacuuacauauuaaaacuauuguggcuuuuuuuuccuucuuuuaacucuguuauuauuguugugauuuaggucauugguggagagguguauccccccacagucaaagacacucagguagagaugaucuacccuccucacaucccugagaaccugcaguuugcuguggggcaggaagucuuuggucuggugccuggucugaugauguaugccaccaucuggcuucgggagcacaacagagugugcgacauacucaagcaggagcauccugaguggggugaugagcaacuauuccaaaccagcagacucauacucauaggugagcaagagagaaauaacaaguaagaucaucuuccccucagaaaagaaaaacucuuccauuugcuauguuuugauuccuucuugugaauagggagaguaaaugugaucugguaacaucccuaccauuuguuguaaggaaacuaaagucucuguguuguguaacaggagagacuaucaagauagugaucgaagacuacgugcaacaccugagcgguuaccacuucaaacucaaguuugacccagagcuccuuuucaaccagcaguuccaguaucagaaccgcauugccucugaauucaacacacucuaucacuggcacccccugcugcccgacaccuucaacauugaagaccaggaguacagcuucaaacaguuucucuacaacaacuccauccuccuggaacauggacucacucaguuuguugagucauucaccagacagauugcuggccggguaagcauuguuccugaaaagcaagaaccagcuggucaguagcuuuaggauuuuugucauagagauagguuuuuuuuuuucuuuuacuuuucuacugguucuuguaacaugacacuuacaagguuuaggaaggguuuuagguucaucuaaaauuauccagcaaauaaugacaccugucuaucuuaaaaccaauauuuuuaaaagauuucagucaucuuauauauuagagaaguuaauauucagacuuguuuaucagcuuauuuuuuuauaaucacaaaaaucauguuccuuauagaauagaagugaugaggucaagacauaggacuucaggaauuugccuaagaaucucauuuuguuauucacuugucuuagguugcugggggaagaaaugugccaauugcuguacaagcaguggcaaaggccuccauugaccagagcagagagaugaaauaccagucucucaaugaguaccgcaaacgcuucucccugaagccguacacaucauuugaagaacuuacaggugaggaaugguuucuaaauuuucuaaaaggaucagggauuaagugggaaaagagaacgugagagggcauuuagugaagggauaaacuaucuuccucuuccuccuccuccuccuccuuuucuucuucuucuucuagaaauagaaaaggaccgaguuuacugagaaagaggagugggaauggggucagcuagugagcgggggaaagccuaugcucaacagccaggacaauugucacccguucccaguuugauguuccuguaucucuaucuuugguaccuuccaggagagaaggaaauggcugcagaauugaaagcccucuacagugacaucgaugucauggaacuguacccugcccugcugguggaaaaaccucguccagaugcuaucuuuggggagaccaugguagagcuuggagcaccauucuccuugaaaggacuuaugggaaaucccaucuguucuccucaauacuggaagccgagcaccuuuggaggcgaaguggguuuuaagaucaucaauacugccucaauucagucucucaucugcaauaaugugaaggggugucccuucacuucuuucaaugugcaagauccacagccuaccaaaacagccaccaucaaugcaagugccucccacuccagacuagaugacauuaacccuacaguacuaaucaaaaggcguucaacugagcuguaaaagucuacugaccauauuuauuuauuuaugugaagaauuuaauuuaauuauuuaauauuuauacugaauuuuuuuucauguaacaucuuccauaacagaaggcaauguucuugaacaauguuacauuugugaagauucccuccgguguuuguccuuuaaauauguguuaccugaaacugaaaggaaaucagcauucauuccucuacauaagccagugagaagggaaaugaauuuugauaucuuuauacuugaauuucagaucaugauuagcuuaacaagaaccaaggaaaaauguaugaauaugugaguguuguuacaagaugaaaaaugcugcagguaucaacacuguugguuacaacugugucuucuuuacuaugauaggagcauguaauguggaauucuucuuaaaucuugcauaucuuuaucucaucaaacaaagggguccaaguucaguuuuaaauaagcauuuaaggcagauacugacaacaaucucauuuuuuaaaauguugucuugagacaaauaauuugaaauuucuaaauugggaguuugaaucacuuuugaaagcucuuacuuucuuaagcugucagguuuguaccgacauggaguaaacagcuaucauaaacguaaaucuccaaaacuaguagaaauuaugucaugauugaugguuaagauaccaugucagggauugucuuuucuuagaaguagugaaagcuacuuacuaugacaaucagaccuuccuuguaugucaaaaugcugguguggaaggugguggagcccgugcugcucugucuuaacuaugagugugagcuuuaaagcucguugaugagugguagccagcaaagccuagagcaacaaaagcuucuacaaaggaacuaaccaagaacaaagaaggguucccaauuaaagaucacauucaggguuaaacuuccaaaggagacauccugauccugguuuugugcuggccugguacucaguagguuuuugcugugagguuaaagacuugccaggcugaacuucgaaacaguuuuucuguugcacaguaugauguaacaguccaucucucaaugcaauagguaucaguggccucgugagcuucuucacaauauugauaugucuuccagcccauugaaccuggacugcagaaggccccaugucaugugugagcucagccuggaugccagcauugcugcuccucuuaguuccguuucucguggucacuuuacuacgagaaacgcugauuggguuuucguagcuguguuccagguuuuuaguaucagaacuauucuuucuuuaaccucuauucauauuuucucuacuugaaguuuuacauucaggaaaaccucagcucaggacuacuauguaccuccccuuuggagggaaaaauuauuuuagguaaaaggcaaaaauuuuuuaaaaauauuuuuauuuauaauuauauggaagggcccuaccaagaugcuagaaauauagggaguuccugacaagaaauuuccauucuuauucugaagaauugcuuucuuacuuaaaaacaaagacaguuugugaguaguucugggcaauagggauaaauauaaaacaauaaugaugaucauuuucuacaucucauuaucagcugagguacuguauauuacugaauuuauugaagauaguuaugucuuuuagacauuguuguuauaaacuauguuuaagccuacuacaaguguuucuuuuugcauuauguuggaauugauguaccuuuuuuaugauuaccucucugaacuauggugugaacaaucaaacaaaaugaugagauuaacguucauggauaaauucuaagaaaacuaguguauuuuuuugaaaaguuugaaguuagaacuuaggcuguuggaauuuacgcauaaagcagacugcauagauccaauauugacugacccaagcauguuauaaagacugacauuuuagacauuuugaaggcccuguaaguguuuauuaauuaguuagaacuuaauugauuaaaaaauauauccaaagcacuauaggcauuagaauucgugcaucaagaaaugaugacaaauaauacuguuauuuauauaaauaacuaaaaagggugucuaaugaagaaauauauuuuauuacaaagaaauuauaaaacauuuugaagauuauaugcuuuaaaaguuuaagaugaaaaaauaaucaaccuuagaaaaaauguauaaaaauauauaaauuguuaaugucauugauuaaaaaaaaaaaaaacuagccaacaugauuuuugugaauaucaaccugcugauugaaccugggaauucagguuaaguaugugacugcuacagugccucagagaaauuuguauuuaaauuaacuuauguaaaaaauaaaucuuagagcaaaugcuuguuuauuuuuauacuuauuuaagaauugaaaacuucugaaaauaaaguuugauuguuucuuuauaucaugg

SEQ ID NO: 416 - RNA, 933 nt, Mus musculus
accugcuaauuuuuuuuuuugcuuuuaaaauugcuuuauuaauuucaaauuaugaaaaagauuuuuuuucuaaaauggguuaaauugccaugcuaacaggaauguuugaauuaaaugcaacaauuaaacaauuuuacauagaaaccguuaaguggaaacaccaaaaguuuacagaaaaaaaaaaccccacuugauaagagcuuguaaaacaguagccauuuuaugagcucagagaaaaucuuagauuucaagguaugaggcaaaagucguaaugauugucagguuccggaaggccucaccugcugcuccguagucuuucucuugacuucuguucccugcacuacaaaucucccaacauccucucccccuucauugcgaucaacaugccuauuagguauggcccagagaaaguuaggcacaagucgccugacuuuccuucggacauuucccccaggcuucuuguuuucaaccucuuccagauggugggguucuucuucacuuuguuuggaggccuucccacccuuuuugucuuuuuugucuuucuccacagugagauccaguaugacuuguuuaaauuuggaugccaucacuccugggccuauccuugccuucuccucuuucuagagaugcucaccaccaggugcgccgagaagcuucugcuucucagaccugcuccgcucuuccuccuccugcugcuuuccgcgccgcccaggcccgcgugcucugcgccaccaggagcugcgccaccaguaacaggugccuccauuagggauggcgggcuggagagagucgcuaauuuuuaauauuaacaauuaauauuaaauucuaauaggauuucauuuuaauaguaaauauucuuaguaggagucuugaaaguaacaauuuuuuuauuuuuuauuagguauuuucuucauuuacauuugcagugcuauu

SEQ ID NO: 417 - RNA, 933 nt, Mus musculus
aauagcacugcaaauguaaaugaagaaaauaccuaauaaaaaauaaaaaaauuguuacuuucaagacuccuacuaagaauauuuacuauuaaaaugaaauccuauuagaauuuaauauuaauuguuaauauuaaaaauuagcgacucucuccagcccgccaucccuaauggaggcaccuguuacugguggcgcagcuccugguggcgcagagcacgcgggccugggcggcgcggaaagcagcaggaggaggaagagcggagcaggucugagaagcagaagcuucucggcgcaccugguggugagcaucucuagaaagaggagaaggcaaggauaggcccaggagugauggcauccaaauuuaaacaagucauacuggaucucacuguggagaaagacaaaaaagacaaaaagggugggaaggccuccaaacaaagugaagaagaaccccaccaucuggaagagguugaaaacaagaagccugggggaaauguccgaaggaaagucaggcgacuugugccuaacuuucucugggccauaccuaauaggcauguugaucgcaaugaagggggagaggauguugggagauuuguagugcagggaacagaagucaagagaaagacuacggagcagcaggugaggccuuccggaaccugacaaucauuacgacuuuugccucauaccuugaaaucuaagauuuucucugagcucauaaaauggcuacuguuuuacaagcucuuaucaagugggguuuuuuuuuucuguaaacuuuugguguuuccacuuaacgguuucuauguaaaauuguuuaauuguugcauuuaauucaaacauuccuguuagcauggcaauuuaacccauuuuagaaaaaaaaucuuuuucauaauuugaaauuaauaaagcaauuuuaaaagcaaaaaaaaaaauuagcaggu

SEQ ID NO: 418 - RNA, 31778 nt, Mus musculus
cgcgcgggggcgcuacauaaguacgcagccacccucguccuuaucccggaggagcaagacgaccuuaccgucaaaaccccgggaugucauggguacuccucuguggccacuucuagaagccgagccaccagaggucaugggucacggcagggugucucgacaggcucugggcuaccgccacgaucuuaacggugccccgagaggggcggggugcaggccucccucgcuuggguagaagagcugcggagaugggugcgggacggcuugcgucaucagucugcacccguuggggccgcgacccgcguuuggaguaggaagugucucugcugucgcuuucugaugagaucauuggcuguggacguggggaccugaguggcaccuggccuuugaagguagcuacuuguacccuaacucgaguucucucgcugacagaaagcuccagggauuuauuugccacaugugcacauucugagaucaaguuagucggccaaggaauaugugugcacccgggcaccaccagcuuccuuuucggggagaaaagaaaggauuuagggaccauauggaacagucagucacuggugcacacucaagcccuguucggaggagauuagcuuagugucaaaccugguaccuacaugcuuuugugggugugagguaccgaaugacuuagugcgaaauuaaaguagucugguuaauauuuuaaacagaaaaaaaaucaaauuuuguuguuuauguaguaagaugacauugcaggcaaaugucugauguugacguuuuuaauuuuaacauuuuuaggacaguuuuauugagacacuugucauuuugccacaguaacagaacuaugucuguuucccgaacacgacucagcaauaucagcguguacuucguuucauggcuggguacuuuucuggaagaauuuguugccuuuugauugaaaauaaggagagcacaugccuguggugucagcuacagggauuaagagguggggggguuaucauuccaggacagccuguguuaggagucaggcucugucuuaaugaaggggaugggagggauuaaauuaguaggagauucauaacugaauucacaagcugaagaagaggacaggagaugagaacaggagauguuccugcaaugauucaauugaagggcugaguaucauugccaccgcaagcaaaacagauugagagaacuuaaaucccaccuuucacacucacuacuuuagucauuuggaggaguuauuuaacauuucuuuuugauuucuuuauguauaaaacggagacgacaauaauaguacuuaccgugcaggaauuuguauuaaauaucaauacaugugaaguccuuagaaaaaugucccguguagaauugaagcaauauagauaauugucauugcagacugguuaccuaaguggcuguuauuaggaguugucucauagcagcaaucacacauuugugccuucccaccuugcacaauuuguagaaaacagucguuuuacagucacuauuggguaaacaaauuugagucucucuccucuuaaugaacuaaucagaaauucagcuuccauauuuuagaaacaagaauaucgaaguucaccaauaaauugucauagagaaugcagcuaaggaguagaucuaaaauaagaaauuagauguguugaaugguauccuuauuuccuuaucccaagagugagaaguaacuuugcuuucucauggcaauugguaauuauauuuguuauuguuguuuuguuuucuuccugugucuuuccaggcaggguuucacucuuuagaucagauugucccagaacucacuauauagcuuuggcuggccuccagcucaaagcgccaagucuguuucauccucaaggguacagcaauuccaggcuugcaccaccauaucuggcugggacucuuguuccuucuuuucuuuucucaaaagauuuuuggauuuauuaucguuugguguguauauuugugugaacaagcuacaugugugcagacuugagaagugggagucagauuuccuggaguugcagcuaaaggcauuugugcaccucuggacuuggaugcuggaaaccgaacccaagcucuguggaaaagcagcaugggcugcuaaccguuaagccaccacucuggccccaagggaguucuuucuuucuuucuuuuuuuuuuugacaggguuucucuguguagcccuggcuguccuggaacucacucuguagaccaggcuggccucgaacucagaaauccaccugccucuaccucccaagugcuaggauuaaaggcgugcgccaccacugccuagcagcgggaguuuuuucuuauagcacuguacuaagaauuccaaagcugggagcuggagagauggcucagcaguuaagaccacugacugcucuuucagagguccuaaguucaauucccaucaaccacaugguuacucacaaccaucuguaaugagaucugaugcucucuucuggugugucugaagacagcgacaguguacucacauaaauaaaauaaauuuaaaaaauuaaaaaaaaaaaagauuuccaaagcugcauuuuaguuguacagaaaagaaugccuuauuuuauaaaugaucacugcaagaaauaggagaguuuugggaaugggccacucuuuuuguucuauugccuguccaccaaugcuaaaacaucagaaaucgcuuuuccccccaaaaugcuaacuuuuauuucuugcaauuuaggcuguugaauuggcugucuauaaugggaagaaccuacauuguagaagagacuguuggccaguaucuuucaagcaucaaccuccagggaaaaccuuuugucucuggucuuuugauaggacagguauguauaugucugcuacucugcagguugauaaaaacaaauuacucauuaguuucaauuauauauacgauuuacuaguaaauucaaaguugugauguggacgggacagaaucuuaaauaguuaaccuaaaguggaucuuugaguuaacauuugaaagaguaggaaaucugguugaaacuugaauaaguaugauuauuuuucccuuugguacuuugaaaguaacuuguaaugucagaaggucacaguuuaagccuuccuugaccacaugauuuacauuuugcuuucuuuguguuuuggaccggauacacagcucagcugguacuugcccagcauauguaaauagcgcucuaaguuucaucccccguguuacuggugguugucagaguggucaaaggcaggaucaguucuuuccaaguucuuggccucuuauccaaauaauuggaaauaaggacucacauuugcaaacguggcaagauaacuuuguaaggaacaaagcaggaauccagaugcacugcaggccacaugagggagguagugcccaaauuauguuugugacuuaguuuuaugggguucaaaagaugggcauucucgccuuuaagaaugcagguugagugguuguccauuuugguuguuagguuagauaaagucugauacucauuuccccaaucuacauguccuuccccauaauccaccugauuaauuuaaugcauagguauaagauuuuuuuuucugacauguucacuugauggacaguuuaucuaacugcacgugcucuuaaaacuaucuuaggcucauuggacauuucuauucuucuuaccagauaucuuaggaauacacuucaauagaaacugacuaaugugguucuuaccaaggacaaggaaaucuauauuguugcuuagagauggaagaaauauguagcuugguacagauaggggucugagagugaggcugcuaggagagagguguuugugcaugguuccugcagguuacgggacuaggcuauaaaguauauuauaaaaggggacagguuugcaaugacccaagugaaauaguaucucagguaagcuaccuccaugcuugccugccucacucaguaucugucaauccaggcguuuugagauguagcccacacuggcuuugaacuuaccauucuuauuauagugugaacuaccuuaaccagcuccacacuaucuuuauuucuucauuuucugcauucuuucucuuucagccugggcuauagugaaacccaguucaaaaacaaaagauugauaccagggucuuguacaugcuaggugaucauuguaccaccugaguuacuuccaccauucuaaagaccacucuaauuuauauuuaggauauccaaguaaauggcugcuguuacauacaucaaagauaagcagcauacauaugagagacaugucccaaggcuguucacuaaaaucaguccccaagaauauaguuuucaucaugaguauuagcaauuuaaauuacuguaaauacuauuuaguuuuugugugccauauguaauucuuucaucagauguaacuguaaugagcuuuugcaauuuguuuuuaaaguguucuucacaaaaggauuaugugauucuugccacuagaacaccacccaaagaggaacaaaaugacaaagucaaacagccgagagcuaaguuggauaauuuggaugaagaaugggccacagaacaugccagccagguaauauaaucucauuauaaacaaaagaaaaaauguuuccugggucacaaaucuagaauuuuaggaauauuuuuccuuaaaugggugccagugguuguacuuaaacaguuuuagagaaggcucugaauauugaaugguucuuaggacuuuguuaauugaauaagucagagaacauauucaauccaucaagggcaauacaaugagaguaagugacacagacaacacuaggaaaagagcaagcaguugggcaggugguaguugaaacacagaguguguaggaaaauguaauuaaguacaaggcuuguuuauggguggcuauggaaugcaguccuaagaacuacacuugguagacaaaagcccaguggucgggguaggcagagucaugguuuuuagggauguagauuuuaaaaaaaguauauggauguggccacacauauguaucugucaggcuccauuguaugaccccacaccugugaguauauggacaguacaaauuagacucacuggauuauuuaaagcaaaacaaaaaaaaaaagcaaagguuuuuuuuaggauuucauugcugugaagacacacuguggccaaggcaauucuuauaaaggaaaaccuuucauuggaacuggcuuacaguuucagagguuuaguccauuaucgucaugguggggagcacgguagguauggugcuggaggaggaacugagaguucuacaucucgauccucaggagucucugugucacgccuggcagagcuugagcaggagaccucaacgccuacccccacagugacacauuuccuccaacaaagcuaugccuacuucagcaagaccacacuuccgaauagugccgcuccccaugccugagccaagcauucaaacacaugaguguauuggggccguaccuauucagaccaccacaacuggcaugaaguaggaagagcauagcguguuggggcuggaucugggaaaaguggggcaugaauaaagauacugcauauaauucucagaguauuaauaaaaguauuauauuaagaaauccaauaauaaacuuuuaugucuacuuauuuuaaaaaggaauaaagcaaucaauuugccaguaacuuauaagauaauguuggcauaguauuaaugaagaguagagucuggagacagaagagaaacuguauaucuaaagcaguaguccaaaccaaugagaguaugagccuaaacuagguucugagcuuugugugggcaggaauucuguuucuuguauuugugucaauaauccaagagccgagcccagcauuuccaugguuuauaauaugacuuguaaaauacuagauuaaaaaugucuaucuauaaaagcuaguguaaguacucauuacugaauguagagaagaacauguaguuuuaaaacuagucacaaucauguaaagggaaaaaguaaauagagggcagauuacuauaugcauauguaagauuguaugauucuacagggcaguccuaugggaggugaaugaacagaaccagggaagacaucuuuagguugacuuugaaguuaccgcauugacuugagaugugggaguguaaaagaagucaauuuaggcugaggaaaaagccugaggaaagcauggaguuagaaagccuagggccauauguggugaacagggacucccuucgaaggaugcuugaguguuucagagaaaguggaucagcagugucucuggacaucacauuggccggauucugggaagacuaaaaucucagucuaagggaaaagauuuauuuugcagacaguuggaagaccauugaaaaaaauuucagaagcuaacuuuacaaaucuuaggaaaauggguuggugcaccuaaacaaauuaucaaauuguuucacuuaaaaagugauuuuaagcuauagaguuaagggugcucagggaaggguuaugcauaugguauacuccaucuuuucagcugccucugccuggauugguccuguaugcauaauuuguccuggauagguauuugcugauguaaagcuuacuguaucaaauagaaaagacuggcauguuuaugauagcuaauauugucuuuauuucuagguguccagaaugcucccuggaggacuugugguucuuggaauauuuauuaucacaacuuuagaacuagcagaugauuuucaaaaugcccugcgcagaguaaguacaguguagcaaaaacucuaaugacaucaaaguuacauauuucacuuaauuauacgcauauguauuggucuuaagcauaugcauguugguguuccauaauucuuuaugcuagaauuaugcuuaaguagcuuauucuauauauuuucuugcagaucuuguguauaauugaucuaaauuaaauauuuucuagucaaagcuauauauuuuuaaauauuuuuuaugguuuauuuauuaugcauguacauauggugggggggaaggccaugcauccaccauggugaccuuguggagaucagaggaugccaacuuuucagguucagugcucucccaucucuucauggaccccagggguugaacucaggcugucuggcuuccauggcaaaugccugcuuagccaucauacuggccacaagacaguuuuucagaaggugauaucguaauguuauauaacgagucagaaugguuuaacuguuuuucuugugcaauagcuuuuuuuuguagaccuuccacucacuaggaagucauugcagucauaugagauucugcuagucacaucuuaaguucugugauuaauauauaaacaacaaccacacacuuauucuuuacuccuggacgggguggauauccugcaucucuuauaauuuuugucuugcuacuauauaagaaaaucagguaguguaauccaggaguaaaagucccaagcuguuuucucuuaaacucaaaccuaaagcagucuucggaagcuuucaucucuuuacgugcucaagauccgcacacgcuuuccuugugagcaagagggaccuuauaccauucagaagcccaaaacuggccgggggccaauuuacacaaugugcagcuagacgcucaggugcucuggacaccuccauguuuguaaccuccgcuucagauauuucacccuugucuuugaaaguuuuugccuugaaagaaaaggauguauuuccucccugucauguuuucagccguuugugcuccuacauuuuaaguugccuguucugauacucaccguauuugacaguuuggagucucugugcuuaugcugcuuaguuuucucucucaaccuaaaaucgccuggggagaggucuuacugaagcggcgucuagaucagauuguccgugggcacggcugugcgaggggucuugcuuguuaauugaugugcagucucggcccguugugaguggcacguucccaaggaggguuuucuguguguguucucucucugcucucuucagacagacgguuuugccugcauaaugagacucuuucaaugaaaaauagaaauagaaaagaaaguguaucuugagagacacugcaauaaauaucuuuauaagauguauuguuuauuuuccacaauuuuggacauuauguaauacuuuguuucaugaagcccuuccuuugaugucaggaaagcugugggucuccugauugguuagaugacgacaguguuguaagaaugcuuagaaucagggcauuccugacccucuggccucacuccaaggcaguguuuauaguucacauuucugauacaaauuaccuaacuauucugauuuuuuuuucuccuaauuuuuacuacuuucaugguuugugaaauuuaaauaaaaaaugccaacuggguaacaucuucauuuuugugguuaaaauaccguuuauuccucuuauaaaaugauguuucuuaaaacucaauuuuuuugaaucauguugugaaggcacaaaugguuaauauaucaugaaauuaucauugucuuuuuccacagcuuucauuuugcagugaauucauguguauuuuucugucuuucagcuaauauuuucuauggaaaaaucuaugaguagaaaaagacuaugggaugucacagaggacgaggucucagaacgagugacacuucacauuuguucuucuacaaaaaaguaucuuuuauuuagguguuuaugguuaguguguguaguucugacuggcaguacuaguguuguggaugagcccacaccacccacaguguacccugcaaugaacagcuuuuccucgccuccccacaaaaucaugugcuauguugaucacauauccacaguucuuuccuuuugauuuauuuuaaccauaagaaggaugauuuauuuuaaucauuccugugaaaaaaaagacuauuaaguuuaucgugaaagagcacauuguugccagucagugguggcccaugucuuuaaucaauacuugggaggcagaggcaggcggaucucugugagguugaggcugggaaugaauuccaggacagccauggccacacagugaaacccuacuuccaaaaaccaaaaacaacaacaacuacaacaacaaaagaacccaaaucccacauuguuaugauuaggguugcugaucaugauaucaauauuaauaauggcuauuaaucauaugcugaguuagguaaaauuugauagagaaaggauuuaggauucugaauucuugguuuguuucuuuuuuguuuguuuguuuuuuguuuuuuugagacaggguuucucaguggagcccuggcuguccuagaacucacucuguagaccaggcuggccuugaacucagaaauccgccugccucugccucccgagugcugggauuaaaggcgugcgccaccacugcccacccggcuagcguagaaauucuuaugccuuuguaugucaaguggcuuccuuagacucuguccucuguagguccccaggauagacagucacuaaagaagagacacagcccaaggacccucuacauuaggacuuggagaagacaguucaaaaagaaaacuuuuacugcagaagauguguguuuaauauauuugacacuugccuggaaaguaucauaacccaguaaaucaguaaauguucuuuaugcguauaagaacgguuguucaugggcuugaccccaucuauauagcacucuguuaugcuacguagagcauguuggagcaaggacccacaggggcuuucuuuuuauuuaguaugguuagcaauauuuauaaacagaaggaaauuuguguuuucuuugauuuuuuuuuuaagcaucauaaguacuauagucagcaauuaauauacauacacaauauauaaacacuuauuuacauaaauguguaguuauauaucaacauaugccuuuuaaguaguguaauuuauagacacuuggauguagguaccauuuuuagguuuuggguuauauuuuauaaucaagguuauucuuuuggagucauuuaugaccuuaauuaguaaagaauaucuugucgaacuuacgauguccaagauccaaagguaagaaaaaacauucuugaaagauguuuuucuguuuuaaaaguaaaaauucaucuuuguauugaguucuacuaauuuccagugccaucgcuucuuuucaauguguaugaccacuugcaguuguuuguuuuguuuuguugaucuccugguuuauauuugagaagcuggugguaaaggcaacugaggagucuguguagcugcaguguguagucagccagaucccagggugauacaaaaaccaggccagcauuugcuuaaaagcagugugaaaauaaaugagcauggagagcacagccaucugagggcgggcagcucagugagcgcuugcugcaggcagcaucuuuacaguggacuguagaggccagcagggaagcugcucccuagagcacugguuaggauucuccacagcuuucugauccuuuuucugccuacccacggagguugccaggcugucgagcuuguaugaaaguaagaaaauuaaugcaugaucacuuuuuuacuucuguuucccugaagucagggaauuuggucaacaguucaggauuuuagcuugucuggguuauugauuuuauacuuuauauuauuuucuuaaugcauguguuuuaucuaagccauaucauguuuuguuuuuccaccucuccugauaaagaguucagcaagacccgcagauuggaaguaucagaguagagugucugccucauggcugucucuagacuguacuguucacguuaacauucacaucccacugucggcuacuucugucaguuacacucuggaaaaaaacacaaagguaucaacauaaaauauguuuucuucagugauggcugagugggcccucugcuguuaauaugguugugacauuuagaauccucagaucuguacucuauuuuaaaugauuguuguuauaugcauaaagaacuuguuacucugguuggauuaggaaaauuuugagcauaaauaaugucauaauacuaguauauuuagcauagcaggaacuuaauaaguauuuauuagcauauguagaguugaauuauguccauagaucuaaugaugaccuucuguugacccugauucguuuugccuuucugauugcauuccuuuuucuucauugcuguuuuguuuguaucuaauuuuucuuuaauacugcuugaugauacacaggcucauauuucuauguguuaagagaucaaacucacuguuggauuuuauuucugugcuuuguaaaauucaaagacuuuugaauuugugguguacauuuugggaaaaaaaucagaaaacuuauuaaauauggauaaagugcuaaaagauuaggacuguguuuuaauuuaugauacuggauuuagacauuguauuauugacccuuggacauuuugaagauuucaguguaguagguggagaguaauacagucuaggaggcuugcuuaggauaacuuuacaucugaaagaucuguguuguuuuuaagaguggacuuacacgcugggccaagcaaauagaaaaugguguuuaucugauuaauggacaaguuaaaggcaacgauugugacuuauuagaaggacaggugaguuaaggaaaaaaaaauugucuuauuuaugacauaauuuuuuaaggaaaaauaaauuuaucuuuaguccuuguuuucauuaaaauuagucucgcuuacucauuucuaggauccuuuguuuuucaauuuauuuacuuuuaugcagggucucuauuuagcucuggccucggacucacaaaggugugcuugccucugccucgugaguccugggauuacagacgagcaccaccauccugagcucuaguaucuuuuaaaguaaagggcaaauguuuuucucagaaagugguaggaagaggcuacuuuugguuuacuuaagauacugaauccugggauuggaaaugucaucagcaccuaacgucuaucuaaucuccaaauuuuaaaagcuuauugaaaacuaaauagcuuguguucuaccaucuguaguucuguguggaaggcucuacaagggucucucaaauaccuuuggccuaaaugaagguaaucguuccuguaaagcagggaucugcaaacuggaaaggacgaaugcuaacugcuucagggcuagaagacagguugcuguugcgcagcuguucaccugugcuguggucccauuaaguacccuuagguaaaagagaauggucucggcugugccaguaaaucuuuauuuacagagaaagguggaaaugugaauucgaccugcaggaaauacuuuacuaaucucaaaucuagaaaaauugaaguagggaauaauuuuuuguuuguuuauuuguuuggguuuuuuuuuuguuuuuggggguuuuuuuugguuuuuuuuuuugaggggggggcgguucgagacaguguuucucuguauagccccuggagcuaacucuguagaccaggcuggccuugaacucagaaauccgccugucucugccucccaagugcugggauuaaagguguaugccaccacuggcuggcagggaauaauuuuaagucaauaauugauugauauagaauauauaaugcaaugugucuguaaaaaagcaacauuaaaauuauuaagacauauuuucuccuugcuauuuagaaaauauagaauaguucuuuauuuuuuguauacaaccuuaacagucuggcuuucacuuauauuuuuuuagaaaaaaagcagaggaaauacgcaagcaacugcucauucuuuugauguccgagugcuaacacaguugguaaauauuucuaaaaccacuuauuuaaaaugaauuauuucaucaaacauaaugaaauaguagggauaugauuauaugaauuaaaaauagagaaagaugugaagcuauauaaaacauuccaucauaagaaaguuacucccaagaaguauugcucugauuaaaccacuuugagccuuuuugucgcagggcuauugaagcaggucgguaacaauuuuaaaagcacacagaaucacaugagugugcauguauguauuuaaauuuuugagccauugauuugauaauuacaguuagaauucuuagaaaccuaaaagaugauauauguugauguacugagaguugucauauacuuaauuuaaaguaugucuuuaucuuauacuauaauuugauggaaaucuccaaagcagggcuggaacaauggcucagucuuucccccauuagauucuuuuuuuaaaggaauuauguauuuauuuuauguauaaguacauugcagcugucuucagacacaccagaagagggcaucagaucccauuacagaugguugugagccaccaugugauugcugggaauugaacucaggaucucuagaagagcagucagugcucuuuaccacuaagucaucucuccagcaccuuacuccccgcucccccuauuagauucuuaaaggcuguuuguaagacaguuuguauucaaauauagguagcaguccuugacauuuguagaacccaguaaaguguuuuuaaccaaaaaggcaccaugucaguccuuauagccuuuaaaauucuuuucuucauguguauguuuuuuauaggauagucuauuuuagaaaacaguaccuaaugcauguguauuauaacuauuaaaauauaucuuaaauuauauguuacauauguaaaauauauuuuucccaaaauagaguguuuucaucuacauuauacauuugugaucuauauaaggaaaucccauuauccucuacuuuauuaguuuaucagugaacucuuuguguaccauaggaaauauuggaucagcauuuccaucuugcugcuucauuuggugacauuuaaaaaaucuugucuuuacuuugugugugagguuugauguacguauguguaccacaugugugccaaauacuugaagaggccauaagagggugcugaauuccuuggaauugaagguacaaaugguuaugaguugcuguguaggugcugggaacugaacuugguuccucuccaagaacagcaagaucuguuaacacuaagugaucucuagcuacaacagauuuuguuuuguuuuguuuucuuaauaagaacuucaauauuauuaaauaugaauuuuaggaaauaccuuugaaggcuggaaagauagcucagcuauuaaaucacuuguugcuuuuacagagaaccaggguucguuucccagaacccauaagguagcuuacaacuaucaaugaucccagugccaaggacucuaacaggcauacauguagucuauacuuaucuguauagguaaaacauucguauacauaaagugaaauaaauaaccuagaaaaaauauuuuaaauuagcuuuaaaauagcguuuggggggggcauagugaugaauugcauacauuauaucuugaauacuccugccuuuuaaggaccauauuaaaaguucuuucuacuucuuuauuuuuuuucuugucuucuugagaacauagguuuauaggcacauagcauuuuucacaaguuuuauuuguuuuuaauuuccaagaauggaccuuauuguuaauuauuuauuccagguauacuugggauaaaaauuacauucuuaugacucauuuuuguuguugcugcuguguuauuguuguuuguuaguuugcuauuuauucuuugggaacuuuauacaauauauuuuaaacauuauuuauucccugcccucaggucguuccagaucugcuuccugggcaaauuccugauuucucucucuuuuaaaaggauaagcuaguuggacauguagugcacaccuuuaguuauagaacacaggaggcagaggcaggcaggucuaugugaguuugaggccaaccuugucugcaaagcaaguucuaagauagccagggcuccacagagaaacccugucucaaacaaaacaaaacaaaacaaaacaaaacaaaacgaaaggaaugaacaaaaagccccuaaaauauaaaauaaaaaaccaaauaaccaagcaagcaaaauccagucugagacuggagagaugucucaucaguuaggagcauugacuucuauuaaacauaucaagcaagguuugauucccagcaccaacauggagggucgcgacuguuuguuaacaccaguuuugggggauccaacacccucuugacuaccaggcucuuauauggggcacaggaagacaagugaacaaaauacccauacacauguaaauuagauuaagugugcuuuguguuggccaacugagcacagggccuuuccuggaguauguuuugauauauccagugugauuccauugaagaaaacugauuuuuuuuccgcucccagcagcuagcaauucugaauaguuuuuuuggcuuggaguaguacuuuauguucacuuccucuucugcugcugggguuuuguuugccuugagcuuguuugggucuuacacaugcuaucacagccucuuugaguucauaaugugcucuuaggcuguguuauacgugcuaccagaggagaaaaauaauccugucucacccugccauaagucccaggagcuacaauacugacuugccugcaagauaugcccucuuguucagccacuuccuuuuuaaauuggauuuaaggccuccuucaagagauagauacuuguuccuucuuagaauggggaacaaaauacacaugggaggaguuacagagacaaaguucggagcugagauggaaggaagguccauccagagacugccccacccagggauccaucccauaaacaaccaccaaacccagacacuauugcauaugccagcaagauuuugcugaaaggauccugauauaguugucucuugugaggcuaugccaauaccuggcaaauacagaaguggaugcucacagucaucuauuggauggaacacagggcccccaaugaaggagcuagagaaagcacccaaggagcugaaggggucugcaacccuauaggaggaacaacaauaugaaguaaccaauacucccagagcucgugucucuagcugcauauguagcagaggauggccuaguuguccaucaaugggaggagaggcccuuggucuugcaaagauuauaugcccaguacaggggaauaccagggccaggaagagggaguggguggguuggggagcagggcgggggggaggguauagggaacuuuugggauaguauuugaaauguaaauaaagaaaauaucuaauaaaaaauugaaaaaaaaaaaagaaaagagaaagaaccauaccugacaccguuaguaaggucaggaaccugagacuaccauuauucugcuaaaccagcauagcaauagccauucuggcaguagaugguaauuagcuacaguuguacaaugcuaagggaacgagagucuguggagcacucugcccuaaaggagagucuucuccucaaggcugcgaucugugcagaggaggauguggaaagacagagcagaggugggagaugacuuccgggaagcagugguuuccaggcagcagggcugaucugaacucagagacugggacuggcacuuggcuuuguuuuaaucuuuuuuccccuuucccucgugaugcuaggccuugagagguacuuucauuguuaccaugcugccuuuguuucugcgcuuaagacaaucagauuuuaagugucugaaauggggcugcggugaaggcacuugguguucuugcuaaggacccagguuuaguuccuggcguucacauggcagcuaacagucauccacuuguaacuaugacacccucuucuggucuccucaguccugcacaugcaucuacauaggcauaugcuccaggcaaagcauuuguuugcauaaaguaauaauuugaauggccgaagcaucuggaaaacagaagguacuggguacuguuuagacugaagacgguaggacuuggaaaugaaaacagccaugccaucccucugaaaccauuaacagcaucuucugcugacagcucuggcuggcguuaaguccuuaccugaggaaagcauagguugcuuuuagcauauaaaaguuauguacugaaaacucagaaagguguauuuauucgucgguuagauuuuugccauauuuaugguguccuaauuuguauaauguuguaguuuuccuguauuccauacccugugucuccuacugccgcaugucuucuuuaugcaucuucuuaucuuuauaaugcuuaccugaggaaucgacaaauaaugucgauuuuuaggagguauacuaaguauuaguauuuuaaauauucauguuaaugagaaaacauugagauauuguuaguuuucuaagacugcccagaaaauaauaugcaacuuauaaaaagacauauaaagaacuuuuaauaauauacagagaauauuuucaaguacuuaggcaaaaaacccuuuccuuuugcauuaaaugguuacaugauggucaaauguuucauauaauuaauaguguuagcacuaaaacagauuuuaccuuucagcuccugaauucggaccacagauccacagccacaguccaaaucugcagugguucuguaaaucuucggggaaaugugaaaugcagagcuuauauccauagcaacagacccaagguuaaagaugcugugcagguaccaaagagugacguagaguugagaaaaucagaaacaaccuaauauuaaaaaaauccuagaaguuuauuuucuuucuauuuuaauuuuaugauuauuaauuuugaccuuaauuaauaaugguucucucuguuuuuagauuuuuauguguagacugucuauguaggcuuaauaaguauuccacccuuguaauguaucgguaccuuuaaaauacuccuuuugagggaagcucagauucuuaacagaaguauucccaagaagaauuguuagguaauguuucagaguggagaaauguaaaagaugaccagcuuuuaccucauaguaccuuuccugauugggaagauuuguuuagaugaaaaauuuaauucuuuaucuugcucuaauuuacuauuuaaauguggguuauauaaauuuaagcuacaaauguauuaaaaauaauaaugggugugcuaaguagauaauaauaaauagaaugaugugucauuugcuuaguggacauucuuacucuggaaaucaaauuauaggcuuucuuccaaugaaauaauugcaguuuaaagcauuuucuuucuuccuguguuuuugcuuuaccucccaccuccacccccaccaggcagugaagagagauauuuugaacacaguugcugaucgcugugaaauacucuuugaggaccugcuucugaaugaaauuccagaaaaaaaaaguaugacuauaaauaaguauuuuuguguuuguuugaacaguuucauacaguaaggggucaagauuuaacaagcaugucauauucuauagcauguucuauaacaauaaguugucuuuuacuuauauugcugaauaaaucuuucaguugcucccuccuccaccacugugccuugaacauuuucuguuagcagacggucaacauuugucaguuccuuucaauguucuguaacccaaauuuucucauuuuaaaauuagguauuugaucauuuuuuuuucaguuuucucuuacauucuuuuaaaaauauuuauuuauucgauguaugagugcucuaucuucauguacaucugcaggccagaagagggcagaauuguuagguaauguuuagaugacauuauagaugguugugagccacugugugguuucugggaauucaacucaggacuuguggaagagcagccagcucuuaacucagcaguuaacugagccaucuccccagccccaugauaauuucuuacaauguauuuugauuauauucacuccuuccaucaccuuuucccauauccuccuuacucaccaaaauuuguuuguuuuaaaacacagcugacauaguuguacugagcacguaauuuuggacaugaugccuuccacuguggcaugcuuaauuguauggcuugaguuugugcggaucauaugcaugcugucacaggugcucuguguucaucugugaaacugcucugcugugucuggaaaacacuguuuguaauaguuauccaucaccuauggcucuauagucuuucugcuccuuuuuugcaauaaucccagaaccuugagaagaugggcugugguguagaugccccauuuagugcugagcauucuguagucucucauucucugcaccaugaccaguuguggaucucugcauuaguuguuacuuacuguaaaagagacuuccuugguugagagagucacuaaucuaagaguauagcagucaguuaaaugugaugcccauuuaccagcauaauagugucugaguuagggccuauggccuaccagccacauguucuugcccuaacaugauacuagauauggcuuucaaauuguggagccagcucuuaguccagugagaaacugauugguuacucucaugacauuagugccuaguuuacuaguagacaugacuugcaggccaguugucacuguggcuagcaggguucgccgcagugggagacugaugccuuuucuuccaucuaguggcaccuucuauuccuggcuaucaaauuaacauaauuuuauacucaaaaguaauauuaagauugcguuuugaaacuacacccugugucuccuuuccuacuauuaugcuagugagugaauuucugauuuuaaguaguuuccccuuucuaauuuaaugagucauuaaauguauuguaaccaauucuuuggcauucaguuuuauaacguuuuuuucuucaggaaaaucuagaauccaaauuugaagugcacuuacaauuuuguacaucaguuauccauguauauuaaaaccauuuuugaaauuuuaauuuaagauuuaauuaguauguuugguuuaauuuaagauuuaauuaguauguuugguucaaaauaauaccauccugguuuugcaugcugugcuacaaauugcaguuauauaauccuaacacuaggaggcagucuggucaaagaguaaaauuauucuuggguucuacacaaaugagaucauacacugaaaguggaaaaaucaucuaguuuaugucacuguguuccccgugaacuuaaggaaugcgccagcaucuucucuuuguaacuguuucaaggagcccgaguuucuugaggaggaaguguagauugcuaacagaauaacuccaauuuucuucuugaucuuuauuuauauugauagcuuuuuaaucauauuugaugcagacaaaaugguuauuuuuuacaaugaagucuacuuuuguguuaguuugucagagcuucaucuugagauuaauagcaguuauauuuaucuaguuaguaaguaucuuaggaauuuggaaacauauagucuaauuugcaaguauccaaagaaaggugaaacaugguggcuggggagauggcucacuggauaaaagugcuugcacccaagcacaaauacccaguauaaagccagaugugguggcauagauuucucuucuuacuguaagggaggcagagacagggaagccccucguuuggacuuggagcaugcauaaaugaaggaaaaguuggcaauaaaauccacaauacaaaauuaaaacaaacaaaaagguggcuauucauuggggaguuauaaaauugacugagcauuccaucacaggacauaguggguccuauaagaacgugugauuaacaauaucuccucauuaaaggcaaggaaggguguauauuucauaggcauauugcuuagagcccuuugaagaagccaggggaaaugacaaaagaaagaacucaauaaaagcaauuuaucaaugucuuacuuucuaguaagacauaauugucauuucaaacuucuuuucaacauuuuuauauuuuugaaaugaauauuaugguauuucuuuucagauuaugaacuuccucagagaguuuuuguuccccuuccuggaucuacuguaauguuaugugacuauaaguuuggugaugaaucagcugaagaaaucagagaccauuuuucagagauguuagaucaugagauucaaauagaagacuuggaaauugcagaggaaguaaacacagguaauuaaaauuugcuuaaaccacaccuaaacuaaccaugccuuccuguuuuuuaaagcuaauucuguuuaauacuuugaaauauuaacugagguauguguaaacacacacacacacacacacacacacacgacagaucucuacacauaaacaaacaaacacaaaaaacaaaacugugauuguuuucuuuggaaacuuuacccaaacuuuaaacacaucaaauguuuuuuuaguccagcaagugaaucuucgugagacaaauucagccuuaaauguguggaaauauguagcuuccaaauauuuauuucaaugggagaaaaguuuuucucaaauuguuuuauaaaauucucucuguguaguuugucauuucauuuauguccucguuguauaaggaggacgggaaagucaggugggcagcuccagaagucagaugaaggugguuuggagagagcacugaccuuuggauguguagcgcaugggugcugcaagcuuuguuugcacgucugaccuuaaccuucggaggguuuaacuugauuggcuuuuuuauuuguaguaaguacaagauauaaaaaugcauauauagaggaaugugcaaacauauuucuuaguguuauaagauuaauuauuugcaaauauuaauaggugcugaguaaaaacagcuuauuuuagaaauuugugguuugguagaaaauuuuuggauuacuuuuuuuuuuaauuuauuuauuuauuauauguaaguauacugucgcuguccucagacacuccagaagagggcgccagaucucguuauggaugguugugagccaccauguaguugcugggauucgaacucaggaccuucggaagagcagacagugcucuuaaccacugagccaucucuccagccuggauuacuuuugaauaugaauguuuauuaaauuugaauguagcaauuuuaaaagguccuuuucugauuucuuacucauuucuguuuaauucccaauucccaucagggaauaauacaguguucauuguuauuacuguuagucguagguaaauauguaauaugcaggauuucauauguacauuccccccaaaagguucauggcccacagguugagaaccacuggguacuaaauggcucuagaaauguuggugugauccuuagaguuccuguaaugcaucuuuuucucuuuuaguauaaaaaucuguaucccacaaugaguauacaguauucuuccuuauucugaguaacagccuuccuguaacguauacucauucaagaguauggaccaauaaaaugcuugcacugcuuccugacugcauuuaugcuuuaaaguugaggcuaccuguucuaaauauuuuagaaccaaauagucccacagacucuauucucuuuguuuuguuuuuuuuuuuuuaacuuuuuuuuaguacuuuuauucucuuuguuaaaguuuccaaauaacaguuuuuuuuuuuccuucccuccauuugccugccuuuggcuugggaauuucucuucucuucucuucucuucucuucucuucucuucucuucucuucucuucucuucucuucucuucuuuuuuaaacuuuauguucuuucugcucuuuuuuuccuuucuuuuuuuuucauuuuuauuagacauuuucuuuauuuacauuucaaauuuuauccccuuuccucauuuccccucugaaaaccccucuauccaccccuucucccccugcucacuaacucacucacucccacuuccuuuucuuggcauuccccuacacuggggcaucgagucuucacaaggccaagggccucuccucucauugaugucccacaaggccauccucugcuacauaugcagcuagagccauggguccccccuuguguacucuuugguuggugguucagucccugggagcucuggggguacuggcugguucauauuguuguuccuccuauggggcugcaaaccccuucagcuccuuggauccuuucucuagcucagaaauuccuuaucugugauaccaaaacuguuagggucugaacuggcuucagaaggccuacaagccucuugaagauauuuguguauuugcuaggaaauguaucuuuuaauggguuagugauuuaaagaaauaaaagaaaaacuacuuucucaaguauacucugauuugccauucuuaaaauaauucaccaaguuaauucuacauucauguacuuuuaacagugaaauguuucaaucaguuucauuguguuaacaucauaaggaaacuguacuuaaugcacacuaauuauaggucagucauaaaacaugauuagaaucuuggugugauaaagagacaggcaaacaugagauguaugcgacugacacugauggaucaugacauacuuuguggagaugaacuaagagccucauucauuuuaugcaaaugcaacugagcugucaucagcucaggacuuacuguuaaacaguaagauuuaaaaaaaguuguagagcuuguacaaccacucuggaaaucagucuggcggcuccucagaaaacuggacauagugcuaccgguagauccagcaauaccucuccugggcauauacccagaagaugucccaaccgguaagaaggacacauguuccacuauguucauagcagcacuauuuauaauagcgagaagcuggaaagaacccagaugucccucaacagaggaguggauacagaaaaugugguacauuuacacaauggaguacuacucaguaauuaaaacaaugaauuuaugaaauucuuaggcaaauggauguaucuggaggauaucauccugagugagguaacccaaucacaaaagaagucacuugauaugcacucacugauaaguggauauuagcccagaaaccuagaauacccaagauauaaguaccaaaacacaagaaaaucaagaaggaagacucauggauacuucauuccucccuagaauagagaauaaaauauccauggaaggaguugcagagacaaaguuuggagcuaagacgaaaggauggaccauccagagacugccccaucuggggguccauccuauaaucagccaccaaacgcagacacuauugcauaugccaacaagauuuugcugaaagaacccugauauagcugucuccugugaggcuuugccagugccuggcaaauacagaaguggaugcucacagucaucuauaggauggaacacagugcccccaauguaggagcuagagaaaguacccaaggagcugaaggggucugcaacccuauagguggaacaauaugaacuaaucaguaccccccagaacuugugucucuagcugcauauguagcagaagauggccuaguuggccaucauugggaagagaggccccuuggucuagcaaacuuuauaugcccaguacaggggaaagacagggccaagaagugggagugaguggguaggggagcagggcagggggagggcauaggggacuuuugggauagcauuugaaauguaaaugaagaaaauaucuaauaagaaaagaagugcaaaaaauaaaauaaauaaaaaacguuguagacaguuucuccauuauauagcccugguuggccauggacuuccuauguagacaagucuggcuucaaggaucacccugccucuccuaggugugucccaucacaucuggccuaaacuguuuuuauaaguaggaguacacucuaaaauaauuaccgauggccuuuccuucaguuucugcuccacucuuugucccuguauuuccuuuugacaggaggaauccuggauuaauauuuucugagggggguggguggccccaugccucaacugggggccauuccuauccacuggauauugucucuacagguuaguucucuccuuuguuggguauuuuggcuaauguccucucuuuuggguccugggaaccucuugguucccuggcaucugggacuuucuagugccccaccuagggauccaucccaucugcugacacuaaacccagacacuauugcugaugucaaggagugcuuacugacaggagccugguauagaggcuaugccagagccggaccaauacagccaaacauuguauugagcacggggacccuaauggagaaguuagggcaaggacuguaggagcugaagggguuugcaaucucauaggaagaacaaaaauaucaaccaccagaccccaaaagcucccagggacuaaaaccaccaaccaaagaguacacagguguuaaccauggcuccagcuggauauguagcagaggauugccuuaucuggcaucacugggaggggagucccuugguccuguggagguuugaugacccaggauaggggaaugauagggcacugaggcaggaguagguggguggguggggagcacccucauagaggcagggggagggagaaggggauagggggcuuguggaggggaaacugggaagggggauaacauuugaaauguaaauaaauaaaauaaccaauaaaaaugaaaaaaaaaaaaccaagaaaauaaucuagucauaaaaacagaaaaauaaauaaaauaauuaccaaaagcauaccaucauauaauguauucauaagacaacaguuauuuauuacuguuaccaaauacuauauacuagaccaucccaagaauuaaucaccagaauggguagaauuauauacucauccucaccaauauaucgaugcuuuaacuucaaguacuuuaugacuuuauuugaagauauucaagagauguuuuuguuaaaugauaccauuagcauaggcucuaaucaaacugugcuaacauccuuauaacaagaggaauuuuacgcguauaaauggacacaggaaagauuacacaccaaggaaaggccagagaagacaaauggaaguaguagauaccuauaagccgaggaggguguacuuggaaggagucaaauccuaauaccuugaucuucagcuucuaauuuccagaacugugaggaauaaaagauuccuguugccuaaaccaaaugaguuaaaaauacaauaauauccuauaaucugauuuuaaagauagacugauaucagagaauauaguaagguacuaguaguacaggaacaaagggacaaaagaaguaguuugucaguuagguguggauaucuagauguuuaauauguuauuauugaaaucacacugguaagaaaccauaacuuuguagguugugcuuauuuuucugcuucugggauugagucaugcacugacaauauuaccuuucacauuaguaaaagacucuauccagcuuuugaaacuugaaugaauuauaaccaaguugauaaaauuuauuauuauauauuaauugucuguaaaauauuaaacauuaggacucuaaagguacauauaguggcacuucucaagaaucuugcaacacaguagaauguacagagaaauagaucgcugugaacaagguaaugagguccguaaucgaaaaguggacagauugucagauaugcaacaggggcaccaucucuguaugggacucagggacacuucuugacuuuaagcugauaaugaaggaagaauugagaaagaaugaccaggcauuuuuaggagcuggaacuggucucagauguagccaagaagaaaaacugucuagaaguacguuaguuuugccucacagagaauuuauagaauuggaugggaugauuuaauaauuauauauaguuuuaauagugacuguguucuuuauuauuaugggguagaauaauaaaaccacauguuugauggauauacuaaggguuuuuagcuaaacuuccuauuuguuugguauuauauucauuuguccauucuuuuauuucauuuacucaaucacauuaggugugcaguuuuauuuuuuuauuuuagaugcauaaugaaagccuugugauuugauuugagucuaggauugccacuaauagcuauauaaccugucuaaaaccuuucuaagccccgguuucuuuagaguauuuucaaaaaagaaauagauaaugaaggcugguacaguacuuuaucacauaauuacuuucuucucaaagaacaucuacacauuaacaaaaauaucaaugguaaaauaugaacauaaaauuuaguaauguacucagauuuacauaaguauaucaggguuucuauauacaauaacccccugaaaaucauugagauucagaaauggaaauguuacacauuuaggacgaguaaacuuucuaaauaugugugguauuauuucuaaggcugugaaaugauuuucuugacuauuacuauuauuuuuguucuauaauguaguuauaaugucaaguaguugcuauguuugaauauacauauuuuaccauguaaagguaaagggcuuuuaaagggcuuaagggauaaaaauacaauuugucugucaaacuggcucacuaauagugaaggauaagcauggcauuaaaacuggguguguuagucaccuccuagacauuaacuuaguaauacagaugcacuuuggcuauaguaucagauaaaaauaaauugaagacacaccuuuaaaacaugcugaaacucauguuuguuaauucuguguugguauuauuuacucauuuauuauuguccacgagguggcugaauccauggcuuugugcaugguaggcaagcuuccuacuccugagcuguauccccaugccuuaguauagcccuggcuguccuggaacucacuuuguagaccaggcuggccucgaacucagaaaucugccugccucugccucccaagugcugggauuaaaggcgugcgccaccucucccgacccaugccuuagucuuuugagacuugucuuguuaugugauccaggaaggccuugaacuccuuuuuacugauuccaugcauacucacaugcauuaguaauuuaaaggaaacauagauaauacuguuugauuauugaggugcuaagaaugaagguuggccucgugcauggcagaaaggcacgcucccacucaguuauaucucaagucacuggcccucccuuuuuaaagcaugauuggcuucuguagcccagguuuucuucaaauaugcuaucuuuaagccucagacuccugaguauguaaauugcaggugugugacaccacuaugcccaguuaaugguguauacuuaugaauaaaugguugacuauaguucuacagggauagggaacuccucuauuuaaagaauucaaguccuaggugguugguaagauggcacuugugucaaugcugaugacuucagucauagauaccuaucucaauaguuuaaugugucauccuuaugugccuauacuaguguaaugggaugcaaacaugguggcauuuuaaauugaaacaguaauuaaauuuaagcaaacacuuucuaauuccuauucuaaugugcucucucucucucucuuacacacacacacacacacacacgugugcacagcuauacuauuuguuguuuuuaauaagagaucaaacugaaauacuuauuuuaaagcauaguucaauagaauucuguaacaguuacugcaauuuugggauaucaagugagucuuugggacucuguuaauuuaaguaaauucacaaaggcagauauauaaaaauuauugucauuauaaugaaguaaaaacuuacauuuuggcuggggggauagcucaguaaaagucuaacgacuggaguuccaucucagguacccuugguuaagggagagaacaaacuccuaaaaauuguccucagaccccacugccuaccuuggaaccuucacauccacacauaucauucgcauacuuguguucauuuaguucugcuuagggcaguaauaaaaguacaucacauguucugaggacuaugucacuuugaaauguauuccauggaauuuaguuccccuguauuaaguaaugaacaaauucauguuauauaaaagaugaucaggaaagaugacuaaguggauaggagcacuuggcuacucuagacgaggacccagguucaguucccagcacuccuguggcuguucacaacugucuuuaaguccagcuaaaggggauuugaugcccucuuuuaaucucuauaggcaccaggcacacagcacagacauccaugaagacaaacacaaagauacauacacacauguacauacacacacaugcauguaaaauaaacaaauuuuaaaauaaaaauaaagggaucguuuaaaauaggugagugaaaggaaaaugcuguuuauuguguauauucuuuguuguuguuguuuuguuuuuuugagacaggguuucucuguguagcccuggcuguccuggaacucacuuuguagaccaggcuggccucgaacucagaaauccaccugccucugccucccgagugcugggauuaaaggcauacaccaccaugcccgacuuuauuguguauauucuuuauuauguuauuuuacaauggcaguuuucaauuuagaguuuguccugauuucuugcagcuugcaugacuuccucugugaauagugaggcuucacugaccaacacaagugaagaacaaccagaacaaccaaaaaaaaccauaggagugaaaauucagcaaaacauagguauuugcuuuuuuuaugacuuugaaauugaacugauuuugaguuuucuuuuuaucuuaaaauuaauuucaaugaaccacaauguuagauuaagacaguauuuacugagaaugauccaagaugaugaucgcuacacaaauaaauuugcauuacaaugagaagcacuacacaguggagcuaucuuucuguguaaucuacguaugagacagcuggcauguuggguuauguguguauguguuuauauauaugucccugucuguguaccuauauguauguauguguccauacauacacacauauauuuacagaagauuuuaaaaauauuucuucuacuuucucuuagugugcauuugaguaagagagacacuuuauccauccuuuguaacuuaauuuucaacucacuaccauauuuuucucuaagccaccacugaauuuuagucuguacauauccauaucuguccauuuuguagugugugcauacauguguacgucucuguguguaguugucuaggccauguuagcucgucucagagccuaagggucaguggcgccuucuuucuuuugcucaucccacuguuauguauugcuugcuucccucuuaggugugaucgcagcacuagcuguugcagugcuugcugcgggcaucuccuuccauuacuucagugauuagagcucccugaucauccagaaaucacggaucaacagcuacagaaaauaacgacaucaauguccaccugcacugaagcuagcaagcagcucugcuacguuaacaucuguuagauguguuucugacuuacaugaaaccaccagcugccuuguuuagcccugcuuugauuaucuggcccagguuuccaaaaguaaacugugcaucuaaauggaguugcauguaacaaaucacuauuauguauuuucagaagggucaaaaugugagcuauuuaagaguuuagugcuuucaaaaaaaaaaaaaaaaaaguuuagugcuauugaaccggaucacacauugauuagaauauugaaaguuuaagcagacaguaguaacuauagcagauguaucacuaggcauuaucuucauccuaaaggacuuuucuaauaugcacccaguugccguaguuuauagacacuguuuaaauuggaggccaugaauauuauuuuaagcauacacauggacugugguuucuuggauggcagauccaguaguagcacugcagaaugcuguuugccucaauccagaaaagagagaaauguaaaucugagaugcuauccuaguuagggaaguuaauauucagcagcucccccuuguaguucuguguagcuagcuccuggcagaaauaaacuagaaacacuccuaacuuaggcccaagacucccauaaguuaugaucaagcaauauuucuuccugauucuauaucaugagguacaagaugcagugagacugggagaaauaaacuauaggaaaaacacauugaagucauuucccaagguucacgucaacaauguagagaguaacagguggguagagccacagugugggugaaagccaaguagugcuccucagaaugaggaggagaggaaacugugggcuguuuagugggaguggacuuggcugaagagaccagagaauggaagguagagcagcaggaaggcugggaggagugaggagggacaaggucuaggaggaccaggaggcgggaaugggagagaggcagcacuuagacaacagguuucugcacacucguuaccaaacaggcuuauaauugaagaaacaaacaaacaaacaaauaauucacaagugaaucaaguaugaaacaagguuccuaaaaagccaaagaggugauaaagaugcccagcuaaggcaacucagucacaugcauaguagaccggaagcaacaguuuacccaagaaggugguaaaaucucuucauaguugugagggcaacugaaaaucagugcaaagugaaacucagaaacaaaccguuauuacagaacugaaaaaggaugguccuugauaagaagaauuccucaagaagcaagcuuugaaagugaaguguuaaugagcagacaaaacgaucaauauuguaaaucuaaaguguuauuuguauacaaaaaucauaaugaaguauuuaaagaaauuguaauagaaauuguaaacaaauguaacaccgaauaaauauuguuaaugcaacauuaau

SEQ ID NO: 419 - RNA, 58248 nt, Mus musculus
cgcagcucuucuacccaagcgagggaggccugcaccccgccccucucggggcaccguuaagaucguggcgguagcccagagccugucgagacacccugccgugacccaugaccucugguggcucggcuucuagaaguggccacagaggaguacccaugacaucccgggguuuugacgguaaggucgucuugcuccuccgggauaaggacgaggguggcugcguacuuauguagcgcccccgcgcgggcacucgucacagccauaggaggcgagccgggggcggggagaaagaaggaaguggggcgagaggugcggccugagcgcgcguaagcgggugagaaauacacuacauuucccaagagucucuggggcuggaaaccggugaaauccccaaaaaacuggggccgaggcugcugugaacucgcuuucccagcgugccuagcucccgguggcugcgugcgcagagagggcgcggcggcgcggcucuggcugcaccuaacgcgggacucucuuucccagggucccgccgcgggagucucaggcgggcaggcgcgcgagagaccgcgagcgaggcggcggacggggcggcuccggcggcugggcuccgcgcuucuccuugcuccuuggcuucuccuucagccgcugcggcuguugccgcgaucccggccgacauggcggcgguguugcagcaagugcuggagcgcccggaacugaacaaacugccgaagucgacgcagaacaaacuugagaaguuccuggccgagcagcaguccgagaucgacugccugaaggggcggcacgagaaauuuaagguggagagugguaaguguggagacgcucuucgcgcuccggucuggagcuggggcccgaccuccuuugcacgccugcccucuucucccuggugagguguucagguagcagcuucucaggcuccaugugcagcggaggccuucucucuucuccccgcugugugguuuagaucggggggcggggggauccuccccgaucuaaauccaccuucguuuaccucgguuuccuuuuacuaagcguagucuucuguggaaacuccucaaugggcccaccgacagaaacuggagaauuuggcccaguuugcaccagauuuuuaggacuaugcaauccuaaucuaauguuguuuugcuguacuuuaaaugacaguuaagcgccccccccccaguuuguuuguuuuuaaacuggauuuauaagccuuuacccauuuccccccuuuagugccuuguuuuaguguguauagcacccugugaucuaauaaugcaguagauggucgcgaugaggaauuuguauacaaaaggacgguacuagaaagagcaaugaaaugcgauaaaugaauauauggugguucucccagagcguugagacuugauaggaaauauauaauaaaaauaucugcuuguacguucuugucguugcuuuuguauaaggaaauuagagacauagcuuaaauauucuugggagaaagaaaacaguuauuuaaaaaacagagccgggcggugguggcggcgcacgccuuuaauccuagcacuugggaggcagaggcagucguauuucugaguucaaggccagccuggucuacagagugaguuccaggacagccagggcuacacagagaaacccugucucgaaaaaaaaaagaaagaaaaaacagaauuuuuugucacauguuuugguuuaucauuaauugagggaauggggucuauaguaugguagauugauuagaaauuuccaccuaauuuaauuuuuuucuucaauaaaguguaguuaucaagcaacguugauaaguaaaaauauccaguuauuuugugacucuuaagaaguuuguauaauauacuguauucuguuaauuaauuuacacacagucaauacugaguaauuuauaugucccaauaaugggaugaaguagacaaaugcagucccuuuuugugggaagucugcauguuuauuuuuacagaaauuuaggcaucauuuaaauuauuuuuacauuaaccccuuuaaaacaaugcacuuuuuaauuaaguauuuuuauuuauuagguaacuuauauuuaaauguuuaauaaucuccugagaucuggagaaaauacaaccuugccugccuagaugaaauuaauuuaugaacccucuuuuagucaauguugucuuuauaugccaguuaagaauaacaggaaaguccuuuucaguuuuuaaucuguuuauuaagauuaaaauuuccaauaguguaucuuaaguuuugcagucaguauuagaagaaauaaacagugguauuaauacugcuuucaagggcacgugugcaugauguuauucauaguguguggacuugucuuuuguagaacaacaauacuuugagauagagaagaggcucucacagagucaggagaggcuugucacugaaacccgggagugucagaacuugaggcuggagcuugagaagcuaaguaaguauuugauuauaucuuuauaacuguucuuggaugcccagcuacaccuuugaaaaucacacuugcagggagcugccccuccuggaaacagacuuuccagguagcaaagcccuaagcagggauacaaacaagguaagaaucaccuagcucuccugccuucaggccuagaggcagacugaucacacuauggacuccaaaauuguguuguuuacuggaaaaaccuguuuuuaguucuaguguggcucagccauggcacgcacuuuuaaugugggaaacuuucugcaugaguauuguaaacaggcagagcaagcaaccagcugacaggaaguaaauuauaaguaaaguaggauuauuaagaaaaaaaagaaacagccaggcaguaguggcacacgccuuuaauuccagcacuugggaggcagaggcaggcaaguuucugaguucaaggccagccugguuuacagacugaguuccaggacagccagggcuacacagagaaacccuaucuugaaaaaaaacaaaaaagaaaaaagaaaaaaaacagaauaaaaggaagucaggucagauagagaggcauacaggaaguagaagggagggacauuagguuugaaggaggauuuuuuugugauaucuugagagaggagcauuuguucuggaacuucagcugggugccuucucugccucugugagcuugcaaacuuucaccccagcaucuggcucccuagucuucauugauaaaaucaaaagauugagauuuuuguuaauagaaaacauaucuguuacaucuuguaaaucauaugauuuccucauacuaaaugccuuuggaaccuugccuuccucaacccaaaccacaaaaaaagaagaaaaaaacauagugguuuuagucuaaacauagugguuuuagucuaauugauggugucgacagaccuugggccuauaccuccugcucacuccuuccucaccggaaccuuaaaagaacacagugcucucucugagagagccuaagcuuuccuucccuacccucugacuaaaggcauucagaccugugccuucucaauguccucucccucacgucauucucugugagcagcuacuuacagugugggaaaugcucagaggccuuguccgagcaguugcaguuuguguucccauuaguaaaggcgugguaaggacauaggcugucacagucugcagaccugguuucuaauucugacuaauaauaaaaguguucuugccacacgugccauauguagauggcuuuuguaaaaaggauaaaaguaguuggaagcacguguguuuacguagcuuuacacaucaaagguacuauugagagugauugaaguagcuuaaauguguacuugaagguuuaaauagugauuuguuuucauauuaaaaauguaaaaccuacugauuucaugauaccuugugacagcuucugugaguccagcguuucuccuaugaagccugguuccuuaggaaggguuuaggugaagccugugacuuucagaggaggacagaagaaaacuuaaggguugaaaggcuuuucaauuaaauguagcuuaaguuuuuuguuuuguuuuuuucuaagacaggguuucucuguauagcccuggcuggcuauccuggaacucacuuuguagaccaggcuggccucgaacucagaaauccaccugccucugccucccaaaugcugggauuaaaggcgggcgccaccacagcccaccuaaaauuuuuguuugauuugauuucaucaaaaaggaacacaagaagcucaugaucauaaauaaacgugagcuuuucucuagcuguuugguguauaauuccugcagcuacuuuggaugcacuaccauuuaaagaaagcucuguagacacaggcgucuguggugcacagccugaacuguacuucuccaacaaagcaugauaaggcuugcccagaaauggugcuaaagaguaucacgaggaugucucugauuacuucuuuugugagguauuugugaaaauaaagaugaauguagacaaaaaggaguuccuuccuaggguggacaauuguacuugaaguauguguauuuguguacacaauuauagaaaaugguaaguaaaacaaaauagaaaauauagaguaauggguugguuuuuuuguuuuguuuuuuuccuuuuauaaugauacaguuuuuauuuuugggggagggcgggguuguuuuuuuggguuuuuuugguuuuuucgagacagaguuucucuguauagcucuggcuguccuggaacucacucuguagaccaggcuggccucaaacucagaaauccgccugccucugccucccaagugcugggauuaaaggugugcgccagcacugcccagcaugauacaguuuuuaaaauccuguuaaauuaccuguucguaggaacuagggagauggcucaaguaauuaagagcacuugguguucuacaugacccaaguucaguucccaguuccuacaucaaguaacugacaagcucaagcccuucuaaaauucuagcuccuaggcaucuaaagccuucugauucccuugggcaccuguacgcaaauggcuucuacuuaacacaggcacacauugcacauaauuuuuaaauugccuauacaugauguaggguuugcuuguuuccucuuugaagaaaggucuuacuagauagaccugaggaacccaaacuccuucuagcuguagcuauccuuguaucuacccugccuuccaagugcugggauuauaagugugaacaucuaugccuggcuuuagaugcuuucaugaaagaaauuuucaaauguguauuuuuuuauauaacuauauauucuaaugacuagacuuauauaugggaagacaaauguaucaugaauauaagacagagcacaaacuuuuuuuucuaugugaaaggcaugauucuuagugauaaaaaacauggaacuacagauauuuauuauaauauauacugaaugcauuuuauguaggucaaauuacauuauauuuauugguccuggccugcuugcuuuauuuuauauaaauuuaccuagaaaauggaauuuaaaaauuggcauugcuaauuuugcuacaaauugggaacaaacuauuuacaugugauuguagcauacuuaaaccuuuuagucuguaauauaguaagaucagaauguauuugcacauuuggaauauggucauaaaucaguauggacuccaguucuucauuuuaaaaaugugugaugguaguaguuggguaaaaguacaaauuuuaaauuaacauaucuguguccauuacaucccuuuugucuagauaaccaaguaaaaguguuaacugaaaaaaccaaagaacuggaaacugcucaagaccguaaucugggcauucagguaaaggcuuuccaguagcucaguacuagucaacagaagguuaaacguucucaugaaacugccaacaaauacauagaaaugugugcauacauacacuuugaguuguuuuuuauuuaucuauugaauuccaacaguaacccagcauucaugguauuuugauauacuugggagcugggucacucuacauugcugccuguuucuuuagagccgugauaagaauaacagauuaaaugugauagaaaggguugcuacuauguuguuuuaauagaagagugauacccagucuuuaaccauauaggacuguacuuuuaaaauuacauuugauuuaagacucagauuuguuuuucaaaacuauguaagaaaaacaugcuuucagauuccuuauaggagcauaauauacccaaaauauuucaguaaauuaauuuguaaggaauauacaguguuuugagcccuuuaaaaauuuuaauuuguucuuguuuggguuuuguuuuguuugccucgguauuaaaagaaaacuguuuucagaaaacuuaaaauacguauuuauauauggaaaaauaacagcauguucuugggugaaguggguuugcaaauuaauauaggcuuuaaugcaagguccugauacacauucuagauuugaugaaacagcaacagagugaagucuaauccagaagaacuguggacacacgaauagauacaauuuaacaaaacaaaauugggggagaacuagguguuuaacggcccuguaggucagcuuucuguuagacacugggauaaaacauacaacauacuuacuuaguuauauaaauauagaggucuauuuucauugacaauuuuacagguuucugcccaagaucaguuugcuguguuguuuugggccaauggcaagccacauaacauguuagggagauugguggaggaaacuucaccacagaauaggaugcaaagaauagguagcagagggucuggugacccacuuuuuucuuuaaaggcacacccucggugaccuaaaaaagcccuuaugauguuaauaauaucauuuagcaauaauaccacagacuagaacccaaacuaugguccuuagauggccauuugugaagcagcugguuucuauugaaaauaaguaaauagucacguuugugaaaacguuuuagguauauuuagaaguuaauauacaaggacacuagagaacaaaauaugaaaauuguuguucuaaugaaugauaauguugcuuagaaacacaaaauacaacagaaugaauauggaguaccauaacaggaaauugguuuggugguaguagguuugguuuugguuauuuauuuauuuauuuauuuauuuuucuuggaacuauaaaacuggaagacaacagagccaaaacugucagccuuugaauuugacaauggucucuuuagaaaucacaccaaauguuuaagccauaagaacaaaauuaauuaugaccauagcaaacggaagacccugugugcuacaaaggaaauaaagcuaaacaguagcuaccaggaauagggggcaggggaauaucuguaagccacuucucugacaaaggcauauauauuacccaaguuuuauaaagaaguaguaauagaaauaaguaauuuucuuugaaaauggacaaaagacuuauuuucaaagaagacaguaaugagcagguauaugaaaaggucucauuuguuaauuguaaaagaaguaagaaaaaugcaugaacacacaguuuggugauaacacaugguuauuaucaaagauauguuguugcgggaauacagagaaaagggaaugguucuuauuucuugcugauuguacauugcugauuuauguguagcuugauacaaccaaugugaaaaacaauauagaggcucauaaacuaaauauagaauaaccuagcaguccuucuucuggguauaauauucagaggaaucuuuacauuguaaaaguaggcauacucaucuauguucauugcugcauggaucaaaguagccaaaaguuugaaaacaaccuguaguuagucauagacagcuggauaaagaaaaucugcuuauguuuacacacaguauaauauuuggucucaaaaaaauguuaugugccacaaaaugggcaaauauagagaacaucugaauaagccauacacagagaaaugauguggcuuaucgaaagucaucaaagaaaucagucagguauuuggaaacagaucaagcugauuggcggggugaaggaaaugcagguugaaggaacaaauauguagaaugaaaaagucucacaaauguauagaggguucuaguuaauaacacuguauuguguuauaacuuggugaaauggauuuuuuuagccacucugauaaaacaaaugagauuuauucacuuaacuauaaugaugauuugguaugguuuuaucuauauauguuauacacuuuauauauaaacaguuuuauuuaaaagcgguuucuaagugugaaagcauuuuaaggacuuagagugggucugugcagauggcucagcacuaaaucacaugcaucaggcuugagaaccguagguugaauccuagaacucacaagugcuugguggguauggcugccauuuuguaauuucagggcagaaguacuaagugauugccuguaguagacuauaaagacaacauggacucgcugucuuggugagcucuagguucaguugaaacauuaccucagugaauagagaccaaucaagaauuagcaacauggccuuuggucccugagccauggcucuggcucuccuuuuguucuaaggguggucuuaaacuuuuugaguuagggucucuuucuaaaaguaaauaaaucuuuuuaaaaacuguuggaaauagaggcaaaagaaauauguguaaaugauugguagguacauuaauguugcucagcuuguaauagaaaauguaaaacuucacauuugaaguuuaacauucuuuacauaaaaauaugcauaugagccauuaagucuguuuauaauagaugacuucuuucaggugauaaggaaacugcuacaagaaaaauacaugcaaaggaaguauauuauaaguaaugaaagcauaaaauguuuguaguaacaggaaaaugcagguuaaagcaauaguaagauaauuguguuucacuuccauguguugacauguuacacccagcuuguucuaaaugcuuaguuguugguuaacugguugguaucguugcuuaugacucuaaaagccucguaaggaaacucucaagaaguaauuugaacccaaacacaaaugugugauaguucccacaauugguuuuugaagacaugcaaauuaucuauuacauagccaaauauaaaggcuauguaaauaauuggggcacuucgguguaaugagugacaugcauucauaagccuagggaaaauuaauuuaaaacucagaaauagagguguuacgauuaaaaguauuuuuuaguuuguugauacccaaguuauaaggaaagaaagcauuuuuuaaguaacugcuaauguuaguugaauugaugauucaaguaccuguauugauuguuuaacuuacauucuugaacuugguguuucuugauaugacagagccaguuuacaagagcaaaggaagaguuagaagcugaaaaaagagauuuaaucagaaccaaugagagguuaucucaggaaguugaauauuuaacagguaugaaaaaaauaacugugccuuuaacugcauucuuuguuauuguuggugcuaggaguugcuucugauguuauauuucuuuguucuguuucuuuaguguggaaguucgguuuaaaaauacuguuguuccuuccguauacauaucgcuagccauuauuaagauguuggccagguaucacgucaccugccuuuuaaucccaguacucaggauucggugacaggcagaucugaguucaaggccagccuauuuuauauagcuuuaggguagccugggcuacauagagaaacccugucuuaaaaauaaauaaaagaauaaaucaaacuagagaaugggaagcuuaccugacugcacacugaaaaaaacacccucccucagcaaccacugucaguacuuccgggauagguaagcauuguggaccccacacccuuccgagaugggauuggcgggcucagugucuugcaaguguggcccagguaacacauguucauguugcagugaguucauaagugggagcaaguguaguuaaauucacuggacagugaaaagaagccacgagaagguuagcagaggucagaguauagacauagacucucuaugaagaaggcuauuugcagaaaaaggaaggagauaugggggaacacuggacaaaaacuacuaaaguucauuacagugguauaaaagggucuuaaacagaaaaaauauugaauuuaggagacaggaauauaaaauguaucaccauacuaugauauauuugucaaaaaugaguuuuaaauaguuagugauacuugucuuugggcuuuuuuaaaaauuuaauuucuguaaauaggaaaauguucacauguuuauguuguauaguaauacacagcuuggaauuugauuuuuuagaagagagugacauuggaauguuugcugauuguguugauuaccuggcuggugguaauuaggauuaaaugaauuaguuucauaaaaacacgguuauuggagaacagaaaaauauuaaaugauuacauuuuuaauggacaauuuuuauauuauaaccuuuuaacuuaaaugguuauaauaaaauacaaagauuuuaaauagaaauuuaguuuguaauuaugacagaagcaagcuaaaacagggaguugaaaagcacuuacuuuguguuaaagguuuguuucuaauaacauauuuuguuacuuaguuucugugaguguuagcuccucauuauuuucaaaugcucacucucauccuccuuucuagaggauguuaaacgucuaaaugaaaaacuuaaagaaagcaauacgacgaagggugaacuucaguuaaagcuggaugaacuucaagcuucugauguugcugugaaggcaaguaauauugguucccaauaaaugcagacugaaaugccuaaggaucuacuuguuacuguauuuuguguuaccuuaacagucuaauuucuacucugaaauaaaagaucauguaucccugagcuacauuuauuuaaaaauaguuaaauauuauuuuaaaauuuucuuuuuaguaucgagaaaaacgcuuagaacaagaaaaggaauugcuacacaaucaaaauucauggcugaacacagaguugaaaaccaaaacugaugagcuguuggcucuaggaagagaaaaaggaaaugaaauucuggaacuuaaguguaaucuugaaaacaaaaaagaagaggugaguaguaaaugugccuugcuuacgguggagguggccuuuguacaucaauaaguaacacaccuccucaguuacaaaacguguguugcaugugacagcagagcuccacuuuaaccuaggggaauguuuggaggaauuuguaaugacuuuuuaauaccacccacucuaauauuaaaccuuucuuuccaaagauauguuuaagaaguagaccuguuuuugugaauuauguucaaacacauuucuccaucgguugauuuugacuuagaguacacuuaauuuugcauuguaugacaaugcaaacuuaaaguacaaggacagcaucaggcuaaugaacuccuguuuauuuaguuuccuuuuuuggucagucuugucaauuuggagaaacaguaaacccagagccuuugcuccucuuucuguuacuauagagagauguaaguucaguugaauggucuguuuucuuguuacucuuacggaagugagacauuuggugcacugagugguugcaugcagacauuaagagacugcaauacaugauuacuaugguaauucauaacaaggccauuuaaaaucaaagaaagaaaugagcaucaaguaaagguugaccuguaagaagucucuccguguuuuaaccuuguaguuucuacaguaccaccuauguuuacccugggguaucaggagcugcuguuaacacacuucauuguguagaucagaguccacgguagucaucuuaccuaaaauaacuuuugacuaagagcuugaaaaauguuuuuggaucaggacuaaucuuuucaguagaguccguuacaauaguuaauguucaacagauuucugauuguaaccuaauuuauaacuauggcaagggaaguauucuacagaggaaccauuuaaagcauguacuccugcuggaaaacuguaacaaugucagguuugugaguggaacaacaguaccaugaaaauuucucaacguuaaccuuauuuuccaaucauugagauacugaguugccuggauacaguugaucauuguuaaaucuuucuuagauaaaaaugcauccuaaggguccaaaccaaauaauucccuguggaaucauucacuacaggaugacaugaugauaauauggaagcauuuuuaguuucaacacagugcucuaauugguaaugacaguagaauuagaauuaaaaguuuaucuguuuaugguuaaaauuaucuuucauuugaguuuucuucaauucuggacauaauuuaacugaacuguugucuguaguuuuugccacuuugaacuuuuaacgaggaguuuuuuuuuuuuuucuuuuuuaugagugaaucuaaaagccuaaaaccuauauaaaaaccuaaagcuugucuaaagguucaggaauguaauuugaacgaauuaguaaucauuuggaauaucuguuugucaugugguaaacuagaguaugucuaagaucacacaaggauuuguauuugacauagcauauccaguguucaccuaagcuggcugaagauggugucaauuauaaaaucuuauuaugcaugaauagagauauggccuauggagaagaggaaaaagaacaaagguucuguggcagagaauucuuguugcaucaucuccaaggcccaagauguuacuuccuucugaggaaguaagugagguuuacugugagcguauagaguggacaagcgcucucagacaucuagaaccgcucucuuaaaagaagcccugcaguuuuuccacaguguaggugguaaggaacuugguaugggccuccaacaagguucaggagucuucugagaugauuuucaagagacuauguccaggucauacacugugaaaggacuagcugccaucaugaagugauggauugugucugcuuucuuucaccaaauaacaguagucugaucuuauauuaucugaaacuuguacuuuuaugagaaucuuuuuggugaauuucucaaaaguaaaccauuuuugaguuauaucuacuaucugaacuagagguggucuuucuccugcugcuggggaccaagcacucuccguggcauugccuguaugaagcuagagcuccauugguaaagggcacagugguguagucaagugccuuuuuuggccccucucugcucuuucagagaucguuguagguagacuucagauuccacuggacuuuuaaacuacauacucaauagacacaguggacaggaggaauauuguggaggcuggaauauaugcuaaaggaauuucaccacauugcaugaugaugaugacagaggaauaaggucuuauuaaucauaaacauauuuucuuagucaugccuauauguuauaaauuuccauuuuuuggaggggauauauuuuacuuuugacaguauaaacuucauaucaaaugaucucagguguuaugagucuuuccucauuuguuuauagguucugagacuggaagaacagaugaauggcuugaaaacaucaaaugaacaucuucagaaacauguagaggauuuguugacaaaauuaaaagagguauauggugaccucuuaaaaauauuuuuguuguuuugauuuuguugugguggugguuugguuuaguuuggucucccugggcuggccuuaaggcuugcaguauagccauggauagucuugaacucuuaaaccuccuauuuccaccuccagaggucugggauuagagguguacuccuaucacacugguuuuuauacacacuagucaagauucuacuaguggagcuaugugccagucccucaaauaaguuucacuuacaaaauuaugaaagcauguauauuuguguuacuuggcaaaauauugucaaauauuuuuguuuuuguuauuuuuagauaauaucuuucuauguuuuccagaauggaugggccccacuucuuuagcccucaagcuggcuucaaauucuuacuccuucucaguucauuaaugauaggauuguaagccuauacuaccauaccugucugagaccauguucucaucuuucuccauaaaacaaccagaguggcuccaaauauuuucuaagcugauagaaucauaaacagcaguuaacauguuuuagacaaaguacuaaguacaaaaccagugugauuucauuuuauuuuguuauuuugcuugauagguacuauaugauuuucaaaguaauuuacuaucagaaaucaguuccauuuguagucuuuacaaaaggaacuuucugucuugauguuucauacauaucuuaaauauucaagcuguacuugcugguauauacauauaaaguugagcuuuuacuuuguuuuuaggccaaagaacagcaggccaguauggaagagaaauuccacaaugaguuaaaugcucacauaaagcucucuaaucucuacaagguacguccuccggcacacacguuaguccgucuccuggcguuggaguacugccuggugcugacuuugugauuaccuuucagagcgcugcugaugacucagaggcaaagaguaaugagcuaacccgggcaguggacgagcugcacaaacugcucaaagaagcaggagaagguaggacuuagagugcgaggaggugguuuuguuguacauuucuucaaauuuauuucaaauuucuucaaaacugauuuaauuuaaaauaaggauuggcuuuaacugggacaaaauuucauggagagaagaaaaagccuaggcuaagaagauuggaauuauauuuuaaagcaaguaguguauuugaaaauagagaugcuaaguuggugguguuuuccuccuucgucuuagauauucugggugcucucuuacacugucagucugugugugagcguguuuagucagucauccauacacuguguuaaauacaaauccgaauguaaucuuagagaugcuggccucagggauuccaagugacuauucguucaaguuacauaccuggaccuucauaagcuuuaggcuucuagguggguuguaggcucauagauucaggaauguuuccuuguugaaauuucgaacuagcagaaacuacagcuuugcuaguuaaacugaagaaaacucaaggaaauaacauuuuaagcauauguagauaaacuuaacaucuaaagaauugguaccaggauccaucaagaauacuuaaagauccucaguucucuuacuuaaagugaucuagccuaaagcuuaugaagguacacaucugccugucucucuuaccucagcuguaggcuagucacaguacuuaaugcaguguaaguagccccugcuuuaugguuugggggauggugugaaaguggcccugcauuuucaguacagauacuacuuuuuuaucugauuacuuucaagccaccgcugaaucuaacaggugggaucagggaaauggaaggucaacagugucuagaaucuuuaucuuuaucuuuucuauucuuuuuuuuucugucuuaaacuaaaggacaaaauugauuccgaagauguacauaguggucauucucuguuauucauacucucuugugguuuucuuggugagaaauauuaaaaaagagccucgacuagacucaucagacuggaacauuuaaaggcugacaaguagagccaggcuuugagugauaauagucauuaagcguagccucuaggauuuaaugucuccagaaggaaagauucuuaguguuuuaauuaauaaacugcaauauuuuaaugauggcuuucaauauucugucuuuuaaaaugcuuagccaacaaaacaauacaagaucaucuucuacaaguggaagaaucuaaagaucagauggaaaaagaaaugcuugagaaaauaggaaaauuggagaaggaauuagagaaugcaaaugaccugcuuucugcuacaaaacguaaaggugugacuaagauacuugcuaccuguucauuccuugagcugcucgaacauaucuaugcugcaauagaaaaacuugauuauuugaaaaauaauauacuauaagucuuuacagcaucaucagauauaaaugccauuugaccacaauauuauuaauuccuagaacaguuauuuguaauuguugugugguugccauauuugugauauauuugcaauauaauaaguaaaaaauacauuuaaugucacuauuccuucacuuuaaauauuuauuaguggcuugcaguuuugcaaaaacgcaaaaaaaaaaauuguguuugcacaggagcuauauugucugaagaagagcuugcagccaugucucccaccgcagcagcuguagcuaaaauuguaaagccuggcaugaaauuaacugagguaagaaugauacuagaucauguuucauuguuacugaaguacucaggggucuuaucuuccccucccccaauuuauguaauuaccugguaauuagcaggcaauuuuuuaaagaggcuuucuuuggccagugaggcacuuccaugaguaaaacacuugagcuggcauucucaucaacauauuccuguccucaaagccuguguuaagagaagcagcucacagacguuaucaucugacucugcauacacacgggagcacgcaccugcacucauagauacauuuuucacacacaucaguaauguuuuaaaaauaaaaggacaggggugcuggguugaagaggugccucagugguuaaaguaccuacugcucuuuagaggucccaagugcaauucccaguacccacguccugcaguucauagcagccuuccccacccucuggccuccucauguaccuuugcucaaaugaacauagucaugugcccccugccaccccacacacacacacauauaaauaagucuaaacaagaaaugaacuuuuuaacuguuaaguaguuauauguggcaaauaacuacuuacaaauaacaaauacuuuuauguaagugguauguucauuaugagccuccauaaacuacauacuccugucauuacacuucaacuuagugaaaugaccaccuuuuccauucccagcuauauaaugcuuauguggaaacucaggaucaguugcuuuuggaaaaacaagaaaauaaaaggauuaauaaguaucuggaugagauaguaaaagaaguggaagccaaagcaccgauuuugaaacgccagcgcgaagaguaugagcgugcacagaaagcuguggccagucuuucugcaaagcuugagcaagcuaugaagguugguucauuucucaacuugaccuuuaggcacagcuacuacugaaucaucuuguacuggcuacuuuucucauaacacucuuugcacuagaaaagcuugaggcuuucacucccacgaugacaaauucugacuuugacucagcuaaauugugagagucucuuacauauguuaaggugauugagagggaaaucuucuuggaccacucuucaaauauucucauagugcauuagaauguuggcuaauuuagcauaaccauuuuuuuucuuagaggguuugauaagccugucuagaauaaucauagcuugauauuaggucacagauuuuuacaucaauucaaaauuuagccugccuuaguaugcauuacuuuauaauagcuccuuugccauguuaaagguugcacguucgugacuacccuuuugcuaucagaggguauguuuuacuuaaugauguaagaguuuauacucuaauuuaccuuuaugguacagcuuuuuacagagaagucuugaagauuuaagagaauuuuauugaggaaauguagauaaauacauuuauaucuccuauuaacugauauguuuuuuucuuggagaauuugaguaaauuguauccuuaauucugaauuaaaucuucuguuauaauauagaagccgcugacauugagaaguagcuaauaaaguguuuuacagcaguguaacuuuacucauugugcccuaagggacuguuggcaaucugacaaauuaaucuuguauuucuauuuucagagaggucucuugggaccaauuagaucuuuuaaguuucucuguuaauaggauauugccuugaucuucuugguaugugaagugcaugucguuaguuaaauggcagauagacaucaauuagaauagcagcuuucaacuuauaaaacaguuuguuccuucacugucaaagaauaauaaaagggcuuaauggucauuucuucauuuuuuuuuaauaacuggcauuuucuauccacaacaugaauaauguguuuucuaguguaaaucuucagcucuuaauuuguaggguucuaaucgcaaucccacugcaucuacuuugcaucuuaauucaccuuguuuguacuuaguagguuuaugagugcugucuuuucugacuauuucuauacuucuauuuucacguuuccucuugcaccuacacauagcuucuuaaagguguaugaacuaacgagauauauuuaaaaguauaugaaaauaacuacgaaccuaaauaugcauaaauuggaaauagaacacagauuucccuuuaauccaucugaucuugugcuaaugggaggguucucaaaacuccaccucaaacuauggauacugcagagcucaccuacuaaguggguacuguuuugguugcugcuucuuugcaaauugccacagacuuuuaaugaagucuucugugucuuacccagcauauuuaguuuugacaucucaaguguuucagucuaacugugauuaccauugauccuucugaucaugauucuggggucauuuggaaaugcacugggaauuugauacuuauuuuugcauaguuguauuugacaacuuguuaaggguagaaaaugcuuuuuauugucauauauauauauauauauauauauauauauauauauauauauauauauauauacacauacacuauauuucuauuauuauuuauauccugggugacacugaguuuucccuuguguuuauauuuuaaaggagauucagcgauugcaggaggacacugauaaagccaacaaacauucaucgguacuugaaagggacaaucagagaauggaaauacaaauaaaagaccuuucgcaacagguuaggacauuuugugugauuuccaguuucuuugugaugcuugagucugcaucuuaugucucacgacgucucuucuaggaaaggcguauguauucucguccuguagcacuuacauaccaucuugucacugucuucccagagauuuuugauugauuuucacauuguuggugacauuuguaauaaguacacaaacaauugaaacaggaagcguuuuuuuguuguuguuccccauguccuaagaguguaaccaguguuagcaaguuggcguguauguguuucaugccauucauguaucaguaaguacauaucugaauauauaaguguguuuuuguuaaaauuagguuacacuaugcauuacucacuacugcuauuucuugagaaggggacuugaacaacccuuccucaucuuucugggugcugggauuuuaggugcacaccaccaugucugcucuuccucuaccugccauauaaaacaagcacuaaauaaguuacuuguaguuucauguuaaaaaaauagccauuauucugaaauuguauuuuucuacuuucuguaaguuuucuuuauauuaaaaguaacuauuucagcugggcagugguggcaugcuccuuuaucccagcacuugggaggcagaggcaaguagauuucugaguucaaggccagccuggucuacaaagugagcuccaggacagccagggcuauacagagaaagaaacccugucuggaaaaaccaaaaauuuuuuuuuuuuaaagcuauuucguuaaaaucuuuucuuagauuuuuuuuuuuuuuagcauuaaagugauagauuuugauguuuuuaaaaauacuauauauuagcuuugguugguuggguuuuauaacauuaaauuuuuguuucuagauaagagugcucuugauggaacuugaagaagccagggguaaccauguaauucgggaugaggaggucagcucugcugacaucaguaguucgucugaagugauuucgcagcaccuaguaucuuacaggaacaucgaagagcuucagcagcagaaucagcgucugcuauucgcucuucgagaacuuggggaaaccagggaacgagaagagcaagagacaacuuccucuaaguaagcagugaccauggcagugaccauggcuaagcacuggguacugggcuuaguguguccuuagagaugcuggguaauggaggugcuuagggaaacugagcaacgauucuauggaauuauuuuuaauaaggcgguaaacuuccguuuaauaugacuagugcuaaaauagguaaacuuggcagacuucauuuaaguuucaagaaagaagucuucauggaaaagagucugucugagcauuacucaagcacaguacagagguuuuauaaagacaguguguuagggaaggaagaguggcauugacugcaagaagauuaugugucaguaggcuugaugcugagaaaguaaguuuuccagaugcuacuaaugaguacaaguacuuaagucuucuauggugggaguuuuaagaaggaacagaauaaagagcaugaaaauagucagcaugaagguagacgguguuugaaugauuuauaauagacacuguacuccccucugaacacagaccuacaaagacuuuuauuuucugcaggauugcugaacuucagcauaaacuugagaacucucucgcugaacuggaacagcuccgugagucacgacaacaucagaugcagcuuguugauuccauagugcgucagcgugacauguaccgaauuuuauugucacaaacaacaggaauggccauucccuuacaagguagauuuuuauguaacuacaggacaauauuuuggaagugaacuggugaauagguuuuuugacaaaagcaguugcuacucuaauuuggaaauugacuucagcuauugugugugacugauuguaacauugauuuuuaggugucauuuugacacuacuaagaaaaaaaauauuguuaaaaaccauacuuuuuagacuuagugaauuacaugguuuguuuuucuuguuuuaguacuuuaauuuguaauacauugcaucuaauuuaaaaaaugaacaauuuuucccuuuuuuuucuugcauuuuauuucugugugugcuuguguaugugcaugcauaaaggcuacugugugugugaggucaggguaacuagugggaguugguuuucuccugacagcguguggcucccagggaucagacucggcuuacugggcaccuuuucccacugagcuaucaagcuuuaauaguuuuuaauauuuccauucucugauaggucuaguaacacuuuacuuucuacuucuuaauuuaguagugaugcuuuugcaaauaauccuuaaaacugauuuaugaaagcacgcaaaaacaucuuauuugucuuuuuuauuuuucugaagcuucaaguuuagaugauauuucucuucucucaacuccaaaacguucaaguacaucacagacuguuuccacuccugcuccggaacccgucauugacuccacagaggcuauagaagcaaaggcugcccuuaaacagguaaagacuauaccuaguuaaagucauggguuaguuauaccuaguuaaagucauggguuaguuucaaguugaguuuuuggggaaaauaguaucgucuaaugaucuucaauguuuaguugcaggaaaucuuugagaacuauaaaaaagaaaaaauagacagugagaaacuucaaaaugagcagcuagagaaacuucaagagcaagucacagaccugcgcucacaaaacaccaaaauuucuacucagcuagauuuugcuucuaaacgguaaauuuucuuuuguuugggaauuaaugccauuaaauguugcacucacaguguucugaccagucaggucccagagcuaauuuacaccgguguugcuuuuuucuauguaguguguucuaagaugagagacuguaaccuucauuccuuaacauuggcugcgaauucuccuguucagggccaggagugaaagauaacgagguucucuguccucggauugagagacguuguuucuggagcucuuucugaagaggugggaagggggaauuguuugagacagggucuuacaguauagcucuggguagcauagaacucagucaguagacuaggcuagacucaaacugguggcagcccugccugagccucccagugcccauaauggguuuguguugcgggaaauauuaaaaaaggaacuggcacauucccacacaugugccugcaacucuuguacccucugugggcccaccggcucugucuaccugccaacucuccggugcucccaaauuccucucgcugcuacgcaacaaccauccaccccacaaucauaucaccacacccauguaccuguuagaaucucuuaaagcuuauagcuggccaaucagauuuauguaucaauaaauuuucagcuuacaagaugccaauacaguaauuucagaaccaguugauaaugauaaaagcuuuaucccaaucuuucuaaccuuaugauaucauaacuaccuguggcugguuaaagccaugcugguucaugucugccuccaucuuggccuuccccuucucucccugagaugcucugucauuccagcuccauccaccuuugcccuguccaaucacaggccuccugcugcccuaauguaauuggacagggaaaaucuugcaacagguuuguaucucucacuguauacccgcggguagccugauaagcaguagacaggucuagccucaaacuuauggcaauucugccucagcaaugcuaguauugugaguguguggugccauggcuaucauuucuggagccuuuccuucaugugcuuguuaguuuagauacuuaaauuacauugucauuauuuucaauaugaauuuuuaauaaguuauucaaugaaauauuuacuuauuuauaauuucaauuuuaacugguaaauaaggguaguauagaaaguugcacauuauuacacaagccacuuucuaauuuuaaucaugugaaauuaaguuucugugaaauucuucaaagaccuaagaacuggucaucuuuauuaccaguuaugaaaugcugcaagauaauguagaaggauaucgucgagaaauaacaucucuacaagagagaaaucagaaacucacugcaacuacucagaagcaggaacagaucaucaacacaaugacgcaagacuugagaggagccaaugaaaagcuagcaguugcagaagugagaccaacacccccuggcugacauuugauauggcuacuuauuucuuaaauuuuauugguuaaaauagcauaguaaaguguuguuuagacuaugauacauguuuuuuaaauagcuuacauauaucuaggaaaaauuucaaauaaaauuuuaguugaccauuuauaaaaagagaaagaaugcucccaacugaauaucaaauuagauuaugauaaaguuaacgcccaucacuuuuggcuuuuaccuaaaagcuagguacuguaugucaucucuuuuauaaaaguuagguacuguaugucaucucuuuuaugagaaauagguucuaaagcuaguaaguagcuugccucuguugacaguuacgagaaacagauuaguuaggacuugaagacacuggguuuuuuguuugcuacauugcauuuuaucuugcuauacuucaugaugggaaauaggagcuuuuuucaaacuguuuuaaguguugauaauuaguaugacucagaacuaaaucugaauacuuugaagauacugcauuuuaacucacucuugcauuucuccugagacauaagagugcagucuuuaacgaagaaaaaaaaaauugacaacauugguuauugcuuuaaaagaaguccuuagaaacuuuuggcuuauaagacuuaacauaauucauaguguauugauuuugacuaugguauaguuacacacuaauauuuguugugguguuuuggauuuuguucuggguuuuucuuuuuuuucauguguguguguguguagcugugucuacacauaagucccagugcuugaggaguucaaagguaccaggaccuuguccuggaguuacaggcacuuaugagcugccuacugugggcguugagacaucuggaagaacaccaaaugcuuuuaaccacugagcucuuucuccagcuuccauuauauuguuuuuaaagaacaguuugcuagagcuaaauuaacauaaguauguguuaaguccaaucauuuuaguucauuaaacaaggaauuauauuuacuugaucaagaguuguagucuacaucauauuaagaaauacauaguaaagaaaacguuauuuuaauuuuguguauuacuuuugacacaguauuucccaacacuuuuucuuucacuuacauucauuuuaagguaagagcagaaaauuuaaagaaggaaaaagaaaugcuuaaauugucugaaguccgucuuucucagcaaagagagucuuuguuagcugaacagagggggcagaacuuguugcugacuaaucuacagacaauccagguaaacagauaagaagugcauggagugauauuugauauuaucuuuuguaucuucuuaauuuuccuaacuaaaaauuuuauguuacuuuuucauccauuauaguuauauuuaaauuggugguguguaaaagaaaauacuuuaaaggaaacucagaaagagaauugauugaaacaaaguaauuaauaugugagagucuuagaauuauaacuacucuaauguuuuugcccccauuccauaccacuaaauauuuaauaugaaauaaauuuuuuaauaugaaaaguggccaaaauacuuugcauauguccaacaacaaucuucucaauucuaaccucaucauggauuauaaucucauaauuuuauauagcuucuaauauucuucgucuugcuuaauuucuuuauuguuaagcauccuucacuucuucuuacauuagggcauacuagagcgaucugagacugaaaccaaacaaaggcugaauagccagauagaaaaacuggagcaugagaucucucacuugaagaagaaauuggaaaacgagguggaacaaagacauacgcuuacgaggaaucuagacgugaguauuagcaucugggucuauguaauuuauaguuacuguucuguacagaaucuuaaauaugccuggucauucuuaauauuuuuauucuuugacagcucuguacauuuacauaauacauguaaucauaucuguucaccaccuccuuccaacuuccacuauugcacccgcuuugccugccucccaacuuucuguucucauuuucuuuuauuaauuaccccugaguccaauuagugaucccauaagccaauuacagcagccuaccugcagccacauccccaaaggagagcaauucucccucuagcagcuagcagcugccaguagcuucuuccucaucuacaccuaauuuaacuggcuugaucuugggcagguauugucuagauagguaaucucagcuccuugaaggugaugugugcaauagccauguugugacuagagucugcauuucacagcuccccucccagccaccugcucuucuguucuuucugccuccauuuccaagaaauccccagagccucggaugguagggaguugauauaggugaccuguucauggcugaacacucugguguucauuaaccacugcacacugcaagaaagaagcuucccuggccaaagucaagagcagcauaaagcaguguauaaagcggauuauuucgagugcaguucgauagcaugaccauugagcuaaacaacaacaggaaguuuccagcugggggucuacaaacuuccuaguccugggcuuuugacuggguuuacaguacuagguaugaaauucuuacuguagagcaggccuuggaaaccagaaagcaguuuguugccccauagccaucaugccauuguugcacuggugggcacuucuugccgaaaucaguauuacaccacagagggucuagcacuggguaagcaaugucuuuucucucccagcagccuacauagcaccaugugguauaguguaagcuauucuucaaggaaagucuucuguucauuucaagguugaccucuccauucugcagccaaagugcuaaccaucaguaggauccuaacuaucuacuuuaguagggcaacaaauagcaggagucccaggaguugcugaccaugaauuuagauacuggauguuuuguauuguuuagaauuuucccuaguuaacgucuggaagguaguaaaguuaaaaauaguuugaguguugcuuuuaaugaaguauuaagcaggcccagaauggugcuugguuuaacucuacuuauuccucagcacugaugcaagaccuuuguaaaguccuggcuguguggugcagggaauauuugguguuuuuggcugcucuuaacuuucaguauuaggcagucuucauguugagccuuuuggugauaugugauaauuucacaaacaugcuuaucacaaaugugccggacauugaagagagguauacacacacacacacacacacacacacacacacaagcaugaacuagagauacuuuggucuucaggaacuuucuaggucuguguucucaauucagggaaucuguuaagaucucuucauuuucuuaugacauacuccagugucuuauuucaguaagcuaggcuguacuucucuuucuuacacuagaaaccaugauuguaacauguccuuugucauguuaagaauuucuagcuuagcaaguguucuaagauccuuaggauaucacuuuaaauaucuaguuacauaagaaccuagugaucuuuauaguguuaaugcauuuguuucuuacagguucaacuauuagauaccaagagacagcuagauacagaaauaaaucuccaucuuaacacaaaagaacuguuaaaaaaugcucagaaggacauugcuacacugaaacagcaccuuaauaauauggaagcccagcucgcuucacaguccacacagagaaccgguaaagguaaagagaguagcuugguguagcauuaaguaaaacagacaagucuuacaguuuauacucugucgugaaacuaaauccccucuuccugcaugcuaugaaggcugggaaaaacauuuuacuuuccaaauaggaaaguucaguugggaaacauaauaaguuuggaagacuugagaauucaaauaauugucugacaucagacuuggcuguucugaguuuucugaucuuugaagcuaucuauggguauggagugguauauuuucugucgaucaaacccagagcaucacauauguaagacaaguucaccacaacaauaaaaccauuuauugauucuugaaauuaguuuauugauugaaaugagaacuugucuuagaguuguugcugugaagacacaccauggccaaggcagcuuuuagaaaggaauuuaauuagaggaauacuuuaucgucauggcagagagcaugguggcauauagacagacaugguguuagaacaguagcugagagcugcuuucucuggcuagaaagaggggcccugggccuaguauuggcuuuugaaaccucaaagccuacgcccaguggcacaccuacuccaacaagaucacacucucuaacccuuccagacagucuaccaacuggaaaccaagcauacaaauguuggacccugugggugaucagucucauuuaaaccaccauggagguuuuuacuaaucuaugauaaaguccagccuagaacuuauauguagaccaugcuaauccugaaucagugcucugucuaccacugacccccaagugcuggaauuaaaggcaugugccacuaugccuggcuuaguuuuuauucugauauucaacucauuuauuuugauuaguauucuuggauuaaauacuucauuugauuagggugucuuauacagaugaagaaauucaacuuuuuaaacauuuaaaacuuuuguuccauauuaucuuucuauauaguuuuacuaauaauagaaacaagguuauguauguauaauauuuauauauuaaauacaggugucugauauauguuuaauagauguuuuacuaaaaucucuuauugauaugauauuuaugauaaaguaucccuuucaacuuucaguuugcucauuuuccauuuacuuuagcuaaaacaaaaauugagauaaauugcagcuuggauuugguucaauauucuuucaaauagucuuaauuuucgugaugagauuuuaaacacuuaaauuuucggaagcagugagacagcagacuuuuaaauuuuccuuccuuucuccucuuccuuucuucuuucuucuuucucuucuuucuuuuuuccuucuuuccuuucucagacacuagcuuccauggcucuggccagccuagaacuuauauguagaccaugccaaaccugagucagcgaucugucuaccacugcuccccaagcacuggaauuaaaggcaugugccaccaugccugacuuaguuuuuauucugauauucaacauggauuauaaauuaaaauacacuuuguagauaauuuuagcuuuaauccugauuucauguacuuuugauagaagucauuuuuauuauuucuuaaaacauuaauugaaaguauauauuuuacuagagcguuuuauuucuuccaggucagccuggugacagagaugacguugaugaucuuaaaagucagcuaaggcaggcugaagaacaggucaaugacuugaaggagagacucaagacaaguaccaguaauguggagcaguaucgagccauggugaccagcuuagaagauucccugaacaaggagaaacagguacauagaagccacacuguccuuaauuaagaacuugcuuguuuauaaagcaguguguuauggguuaggcugacaucguuucuuuuacuuuuggaaaguuuuugggucuaauaagucaaaacaaaagucacacgauuuagaaagcucaggcauuggggagaaugaauaugaguuaucugcugcucgugcaugacuccgcgucacgguugacaaguggguaccuuugaauagagagccaugcaggucaucaaaauaguggaaagcugucaagccucaaucgagagaguauucagauaagcaugucagguuauuuuugugugcuuauauggaaccauugauucuuaaugugucauaguuagaaaauuuucuucaaaggguaguguaguggauuaaggauauauuguagagaguaccaccacuuuuuaaaaaugcuguugugacuggcaucaauccauaucuuuuacugauagacuaaguagauuugggcaaauggauaugaggcuggaagggaaaauaaagagauucagauuucaauauggaaaaacccagguugaaagagaaguuacgcuucuagauuuaugugguauaucugcuuggcuaaucaucuuagggauucuucuccuaguauaagacaaauaguaacuuuaguuugguuccaguucaguuuaaauugggaaaaguauugcauaucauguuauuacucuuguuucuggcugcuuaugaaggugacugaggagguucauaagaacauugaaguucgcuugaaagaaucagcagaguuucagacacaguuggagaagaaauugauggaaguagagaaggaaaagcaagaacuucaggaugauaagaggaaagccaucgagagcauggaacagcaagugaguucacugggauucacaggagcuugcuuucuuagcaaccugaguucacuuuauuaguucauaaguuauacuuugguuugucucaucagaaauugcuugaaugcauaccuaugaauuuuaauuuuauauuuucacucaauucugugcaucuguauaaauuuccuuuugaaaaauuuagaucacuuaacaaaauugauuauuuagugcugcuuuuuagaaagaagcucugccuuggauuuugcagauaguagccagaguuaaaaacuguagauuauaucagauuauauagcuguauucaguuuacuuaaguggauuguuuaaugucuuaaguauuuucccagauuguaauuaacuguggcuuacucuuguuuaguuaagugaauugaagaaaacacugucuacuguucagaaugaaguacaagaagcucuucagagagcaagcacagcuuuaaguaaugaacagcaagccaggcgugacugucaggaacaaguaaguguucuucucauaguuucugagcaguguguuuuaagccucagguuggauuccagcuuccagacaugugaaagcccagugcugugggaggcggaagguuguaggguugcuggcuaccagaagggugcagugagagacccugucugaaaauaauagacagagagcucuagagcaggacacccaaaguccuuuagccuucacacaugugcguauauaacagaaauauugugugugugugugugugugugugugucuaaguauuaauuuguggaucuuaaucuuuaucgaugggggaauuguuaauugcaggcuaaaaucgcuguggaagcccagaauaaguaugagagagaauugaugcuacaugcugcugaugucgaagcucugcaagcugccaaggaacagguuucaaaaaugacaucaauccgucagcauuuggaagaaacaacucagaaagcagaaucccaguuguuggaauguaaagcaucuugggaagagagagagagaguguugaagguaauguuguaggucgcaguagaauguucugaagaaaggaaaggguuucuuauguuuguuuuuccuguacauuugggaaaacauuaugauggacccuuggcuuguaggaugaaguuuccaaaagugugucucgcugugaagaucuagagaaacaaaaccgacuacuucaugaucaaaucgaaaaauuaagugacaagguggucaccucuaugaaggaugcugugcaagcgccauuaaauguaucucucaaugaagaagggaaaucucaagaacaaauucuagaaauucuuagguaagucagcuacauucuuacaguggcccaguaaugaggaaggcacggacguagugcuguacagcucacuccgccucaguuggccaaggaaccuagugcucacuauugauacugagaugaaauccaugcuuguaagguugaaucucauaggaagaacuugagcugcuuuuucugagaaacuaaagauaaagaccagcucugcguggugagaagggcacaucuguaauccuagaaggccaaggugggaacuggccauuacaggacagccugggcuacauaacaagaucccauuucacgaaaggaaagggaaacuagaugucucaaauuauuuuaaagauauuuuuuuccucacuaaccccagcugcuucucccucucgaguguuaggauuauggaugugugucauuggacacagccuaaagauaaucuaucuuuaauuguuuacucacguauuauuacugaguguuugugugcgugcaugucaugcacaaguacuguuauuuccuuagccauuuuguaggcccagaauaauauguuucugaugcuacuaucuaagcccaaaaguaaucugucguugaaauaugaaagugaauacuaaagugaugcauuuuguugucuuaauucuccaaguuuuaaaacacuaaacuuagaguuuucuaaaauuuuaacaugccuucuuguagauuuauucgacgagaaaaagaaauugcugaaacuagguuugagguggcucagguugagaguuugcgguaucgacaaagaguugaacuucuagaacgggaguugcaagaacugcaggauagccugaauguggaaagggaaaaggugcagguauguccauacaccaagcuuaaagaaggaaagcucauguguuucuaccacgauacacuaauuugagcacucauccuaaaguuguaaauuuagcaucuguccaguauugccgaguuguguggugauuagaagcucuguuguagaggucugguuuggaauucugcuuccauaggauuagcucgauaugcugaacauugcuuagcuucccuccucuuagucuccuugucuguagaugagagguaggauugagauugugcaugcgaaucaucuggacuguaguauacaguauauaaaauuccagcuuucuaaucuuuugcagcugcuauauauaaauaccuugugauucauucuaaaauaaaagucuagagucauucuagauagaauagauugaaacuaagaaauuaaacuaaacacaccaugguaacuccaagcacugguggcucucaacucacugcugaguccaugagcucacuuacuguaccuguuacuagaguaacauaacuaaauguucagaauccugagcaggugugggaaggggaaaagccaggagucaaaguaacaguacuuuagagcucauaccaaaguacaagcaaaaauaccuguagugcuggcagcauuuguaguccuuuuuucuuuaagucucuuacauuuauuuaaacucauuugaaauuaacaugucucaggaaaauaaccugcaagcuuucaaaguuucaguuaaaguugaaguuuaaauucucuauacuuuuuuauugggaagauuagaacugguaggaaaaagacgagucugagugcugguuguugaucuauguguuugucacuguuucagguaacugcaaaaacaauggcgcaacaugaagagcugaugaagaaaacugaaacaaugaacguuguuauggagaccaacaagaugcuacgggaggaaaaggaaaggcucgaacagaaccuacaacaaaugcaagccaagguuugugccuuaccagcugagcgcagaagcccuuacuauuuauaaagauacagauugccacacccacuccaggagugacuugagugacaggucuagaagcuuggccgcagucccgaggcaaaaaguucacagaaacuuagucaccuggaaccagggcauccuguauaacgagugcuccaaaucuguccuugcuuuaguagagaacggauccgugugcuuuccuucaguauuguuuuauuauaagugccucuaaggauugauuuuuuuugacauauagcuaaguuagauuagccuccuccaaugucccuauguccuaggcaguccuugagccaauccugggcuuggaauucaguaagaauguugccuauuaagugacguucagaauuaccucuaguauuguaagggagacagugaaagaaauuaggcuuuacaguuacuugaauagagcuagaaaucucagucuacauaguaaauacuuaugaacaauaauugccgagucacucccauacacaggaauuuacaauggccuaggaggaaggaagguugugguuuuaggaggaacugggaguguuguacuauucaugaaaggguuaaucguaagaacuccccuggugcauguuuuucacuaggucuggaggauuagcguaaguagguauguacuaagggaccccuggugguggguuuaacaauagacuagcauugcaucagaccuuucaccuggcuccuguaaauagcugauuuuacacagggcugaucauaccucuauuguaaaccuugccugguuccugccagucauuuuguaugcauuuuuuguuuugugucagauaauuucaauguaccucgucugaccuuaauguaucacuuaacuucuuuguuuucuguaauauauaaaagucucaugcucacuuugacaaauuacauucagauacaacacccuuuugugucuguauuuguuugucauuuuucacugaaucccugacuaccuuuacaggacugauuuucccacggagcaaggggcccaacugaggccaguccgcggcacagauuaauuuaccauuuguuauaaacauacuugggacucuuuucaggugaggaaacuggaguuagacauuuuacccuuacaagaagccaaugcugagcugagugagaaaagcgguaugcuccaggcagaaaagaagcuacuggaagaggauguuaagcguuggaaagcacggaaccaggugaguacaguuagccauuuacugacacagaaaugagcuucagcaguguaagaauuagagauggaaaauaguugugaaacuagugaaaauugcauucaccauuagaagacuaauaguuauaagucuauuggggaugagaccauauagcauagugcauuuagugagaagucuaccuugaaaauacuaguuacguagcgugugaccuccaugcgaguuuucuaacuuugcuagacuaguuuucuucauuugcagggcgugguggcgcacgccuuuagucccagcacucgggaggcagaggcaggaggauuucugaguucgaggccagccuggucuacaaagugaauuccaguauagccagggcuauauagagaaacccugucucaaaaaaaaaaaaaaaucaaacaaacaaacaaaaagaauauggcucuuaaagcagugguuuuuuugggggagggggaacuuuugggauagcauuguaaauguaaaugaagaaaauaccuaauuuaaaaaaaaauguuuuuggugacagaaauuaaacucaguuucucagauaccgagaaauucuguagaaugguaaccauuuaaggauaaagaaauauuucagaauuucagagcacuuuuauucuucauuuugcucuuuguagacacacaaugaggaaaguccagugagauggcuaauugcagucuggccugaagaccuaaacuuaagucuccagagccaacauaaagacagugagaacugacuuuuacaaguugacuuccacauguguuuaauggcaugugcgcgugcacaaacaaauauacacacucacucacauaaacauacacacacauuacaugcacaauaacauacuaaauguuaaaagaaaaaaagaaacuuaagucaaauucguucaaguucauucacagcucugaaaaaugauaaacaguuaauaaaauuugauguuuuuuugcccgucuaucuuggcuagauuuugcucuccuaauuaaaacuucaaacaugcuguuuugauacuuacuacucuguaggcaagacaguuaaagugaauaagcuagauuuuuaaucacuuuacuauagcacuuuguguuuagauaaccugacaguaugcacuucuauuuuucuagcaacuaauaaaucaacagaaagauccagacacagaagaauaucgaaaguugcuuucugaaaaggaaauucacacuaagagaauccaacagcuaaaugaagaaguuggaaggcuuaaggcugaaauugcaagguauuagggaugaacguuuuaaauuauauguagugcacgauuuuccccaugagaugaggucucucuguagcccagaguacccuaggucuaguccauguguaacccaggguggccuugaacucaguguuucccucccaagugcugaaugacaauauguucucugugauccugcuuuguaggaagguaaaagcccuucgcugcggcucuuugccuuuguuucuuuucaguaagacaacaaaacauugaauucuuuguguccauauaucaagguuuuuucuugaguauuuaaaagcuacauguuguaccucuaaagcuaauuucuuuucuaacaauugauagucaauaacguacguacaauuuauguuuuuguuuuucuguucauagccucuuuaugaaaaucuauaaagcuuuuuguuguuguuuuuuuuaauugugcuaauccugucucuuauugaaaacuauagcuuacaaaucucuguuacauguuuuuuucuuuauuccaaacaguauuuuggcaugcucaguaugagagauacuauuucuuuaaaaaaaguaaaaacaaagagaggaagaaagaaaaagaaaaaaagaaaauucaaaaagcuugaguuuauacuuguacaaaguuggaauuagcugcugcucuuuuuagguugucuugcuaugaaaguucaguucaugacauguacaguaggacaaacuauauagaauacuaacaguugugcauaaagaauaauaugugaggaaacuguauauaggcuuuaagccccagcugacaaaguuccucugccgcuuaugggaaaccuggagacucugaccuacagagaacccuuggucgcaggucuagugagacugcgugccgccacuugagggcuucacuuagcacuucaguguuucuucagaacuggauuagaccugugcaauaaggucuaauaaaagaccaaaaucauaaaguacaugucuuucagguggagggaauuuuaauuagaaagcuauuauuaauuaaagcaguacuuaagcugaaaauuugccaaacauuguguauuugguucuuuuaagaaaccucuccucuuuuuuuucaaagaucaaaugcauccuugacuaacaaccagaauuuaauccagagucugcgggaagacuuaaguaaagcacggacugaaaaggaaggcauucagaaagauuuagaugccaaaauaauugauauacaggaaaaggucaaaacaaucacucaagucaagaaaauuggacgcagguacaagacucaguuugaagaacugaaagcgcaacaaaacaagguauuuugaggaaauguaauccccagcccuaauuuugacuguuaaugguuuuuagucuuaacucauagaaguacagugauauguuuauuugguuuugguuuuaaguuacuauuaaccuuuuuccuuuuuuuuuuuuuucuuuuucuuuucuuuuuuuuuuuuucuuuuggcgauagaguagggaaggcuggccugaaacuuagccugcuguugccucucagaugcugggauuaaagguguacacuaucaugccuggccuuuuuauauuucuaauacuguuucuuugcaaagcugauuucagaacuguauaguuacacuuucucgugacccaguaucauuguguuuaggggauacaggcccaucgcugcggagggagaaggaaggcgugacuuugagggucuguggcaggaacaugggaacaugcuccugcauuuucccucuccagaacaggcuguaucccccccucucaguuauuaauucuuucugagaaacccucagagauucacccuaggugggcacaucagugccucacucaaguguuuguuaccuuaauccaguugacaguccagaaauaaccaucacauuggcucauuguuaauuaaaguuaaggauaugcgauuuuacaacuaauagguuuuauaucauuuuagauaaguugugcaugauaacuaucaaugcuuuuaauccuuuuucuuuuuguuagcacuuuaguguguuuuucuuggcauagaacuuucccaagugugucauuugcauaugcuaucaugucacuauuuuccgacugaaucaucauuagggaguuguucuaugucagagugcauuuacaaagugccaccucuaaugucuacuuguauggauaaccauaacucauucccugauucugaacacugaaauuguuuuauagaaauucauuuuugagugcucuuauaaguaauuuugaacauuuaggauugucucuaaguugcagcaguagaauuacuaaauaaaaacauguuauuacuacacaccaucuuaggccauggagacuuccacucagucuucaggagaccaucaggaacagcacaucucuguccaggaaaugcaggagcucaaagauacccucagccaauccgaaacaaagacaaagucacuugagggucaaguagagaaucugcagaagguaggauuuugagggcuauggaagguuccuaguucucucuguaagccucagguaauagguuuaaacauugacacuccauuaccauuuaaagcuuguaaaaguguuccaauaguuuauaaaacacaaacuuugaggaacaacaauaugaacuaaccagugcccccagagcucuugacucuagcugcauauguagcagaagauggccuagucggccaucauugggaagagaggccccuuggucuugcaaacuuuauaugccucaguacaggggaacaccagggccaagaagugggaguggagggguagggaagcagggcagggggagggcauaggggacuuuugggauagcauuugaaauguaaaugaagaaaauaccuaauuaaaaauaaauaaauuuuaaaaaaacccacaaacugaacugauuugaguuaugugauacuuuuuuuuccuuaaaaagacauuaucugaaaaagagacagaagcaagaagucuccaggagcagacggugcagcuucagucugaacugucacgccuucgucaggaccuccaggauaaaaccacagaggagcagcuccgacagcaaaugaaugaaaagacuuggaagacacuugcacuagccaaaucaaaaauuacacaucuaucugguaauuucguguauccuauacacacacacacaacaugugugccugguacccacacagacaaaaagagaguguuaccuauucuggaaguugagucauggauaguugcaagccacuagauagguguugggaaucaaacuugacuccuagaagaacagcuaauacucuuuaaaccauccaucucucuagccuuggaaaauacaauuuucaaaugauguguuugcuguacuuacaaagagcacugguaauuagcuugggguacuguuccccuugugaccauauggaacaguucuacuugugacguucuuuaaguccagauugcugccuaccugcuuuguaaacaacacagaauguuuucuuaccagccuaaggauguuucucuacuuuuaguggaguacucccauggacuuccuggagagugaguggucuaucacaugcguaagguucccaguuaaacagcaggucacucugcuuuuccugucugauuauucuuuaugauaucuaagguuaucuuacagcaacuucaaaaaaauacuguuuugauuuuuuuuuuuuuuuuuuuuuuuuuuggacaggcagggguggugggggggggaugguuugaguccaauuguuucucuguauuaacagccuuggcuauccuagaaauuacuuuguagaccaggcuggucuccagcucacaagagaugugccugccuccugaguacuaggacuaaaggugugcaccacuacaccuggcaucacuggucuacuuuuuuauuauauacuauauaaauugugugaugugaauauuuuauaauuccuaguaacgaauaauauucauauaugaacaagcuccugguaaaguuaauuuacauuaacuuaaauuuuuuaggauaauuuaccuauuuuuaugcuggaguaaguaauaaacauagaucugucuagagauuugcuuacugagauauagauagugaguguaccagaacuaauauauagcauagggcaggauguaaugcuaacuguacaugccauuuaauugcauaauguuucugaugucugguuauauuuauaugcuuauuuuaggugugaaagaucagcugacuaaagaaauugaagaacuuaaacaaaggaacggagcucuagaucagcagaaagaugagcuugauguccgaaugacugcucuuaagucccaguaugaaggucggauuagucgcuuagagagagagcucagagagcaucaagagcgacaccuugagcagagggaugagccucaagaacccacuaauaaggugacugccgcuugcgcuuccaugacaaaccacuugugacuuguguauauuuuauuuggaagugccugguuuuuaggagucuguuagaauuuggacuaaaauuucaaauauacagacaguugauaauaaauagccuaacaucuuuguucaguggacguuuggguguaauaaacacagaaguuaauccuucucuucuuuauaggcuccagaacagcaaagacaaaucacacugaaaaccacuccagcuucuggugaaagaggaaugugaguucuaguucuuuuauagucugccuuuaaaguuccaaaagaaucaggugauguaguuuucaaaucuuguuaucaguaugcuuucauuccuaugucuaaagcuguagugaccagaaacaccuuguggcuuaguuuauaauugguuuauaaauaagauaagcuccuacucacgccuuaucauguucauaacagcucuaaaagucuaggcugggguuggagagaugauggcucaccacuggcugcacuuccagaggacuugggcuucauucccagcaccuauguaucucacaaccauccauaacucccaguuccagaggauccaacacuguccagucucacugggcaccaggcacacacaugaugccuagacauucaugcagacaaacauccauauacauaaaucauaaaauauuuuacaaauuuaaguucuggguugaaaguaacucaacauuuaggugcuuuuucuauauugccagauuauaccacucuggaacaugcccuacaguuuuuaguacugaaauucaaauccuuuauuaauaaguuuuaggauuucaugccuagaaagucaaaggcuauauucauugucuuuaaaacuaccuauuuuaaaccuaccaaguauauccaaaauagaguucagaaaaaauaguaagauuugaacuggguuaagguaauaccugcugaauaagauaucacuuuaaauagggcaugccuuccuuuuuauagggugcauagauuuuacaagggcucaucaauuuaauucucacuggguuauuuuggauuuuucuuucauuaagugccagcacaucagacccaccaacagccaauaucaagccaacuccuguuguuucuacuccaaguaaagugacagcugcagcuauggcugggaauaagucgacacccagggcaaguauccgcccaaugguuacaccugcaacggucacaaauccgaccacuaccccaacagcaaccguaaugccuacuacacagguggagucacaggaaggugagugaaagaacacaucugauuggcugacugcuuguaugcauuucuuuugagaggauaagagcuguaaggguaaguguagcauauaaagucuaagucagaucaugcaugacaaaaguagugaauauuuugaaguauaugauuccuagaacacuugugcuugggguuuuuuucuccccaauagucaucaaacucagguaagugguuuuugacuaaccuacauucucagcccuguuuguuuauuuuuggguccaggcuggucuucaacucaagaucuuucugccucauaggcaugugccauguggcugcccaagauacauauuguaaauacaguaaauuucuuccuucucuucugcuguucuuuucuuaagcuaacaaagagggaaaauauauucccaacauccaucgcuuugcuuucuggaaccacauguucucuucuaaugacuaagauauaugcuaugaaauccauuuuggaaaaccauaguauaaaauugcucuuucaaaucgaauaucauccuuucaccggagcucccugcacuuccugaugcuuucucuuacucucuucccauugaauuguaguaauucgaucauugcacuugauuucacguguacuuuucaaucuacuauauuaggaaucagaguuucauuuucuucguuguucaaucucuuuccuuaacaaguagauguucaauaaaagguuugcaagaucuuaaacugcuuugauguguuagaauugaguaaauguacagguaguuguugguguuaaauaccuuuuaucucaucagaaagagagguaggcagguagguaucuaguucaaggccaaccaaaguucuauagaaagaccauguccccaacaaugugucuuagucaggguuucuacuccugcgggguuuauucagcuuacacuuccacauugcuguucaucaccaaaagaagucaggacuggaacucaagcaggucaggaagcaggagcugaugcagaggccauggagggauguuacuuacuggcuugcuuacccuggcuugcucagcuugcuuucuuaaagaacccagagcuaccagcccagggauuguaccacccacaaugggcugagcccuccacccuucguugagaaaaugccuuacaacuagaucucauggaggcauuuccucaagggaggcuccuuuauuugugauaacuucagccuguaucaaguugacacacaaaaccagccaguacacaauguauaauguaaacacuccaaaaauaaauauauauccuccauucaauaaaagauuaacagauagauuaccaaacuaaacuuuuuuuuuuuaggacagagaaacuuugguugguugguugguugguugguugguugguuuugugcgguuaaggaucaaaccuuacgcauguacaaacacuguaccauucagcucugaacccauuuccuguuuucauggugucauugugauaccaguuaaaaacaaaauuucucaccauguucagcuucuuaauguuaauuacaucugguuauaauuuuauuagaccaauaaauaguacaacacuuucaaacauguacuuacccaccaaauauuacauacuacuguauuagacacauaggcaguacaauauauaacuuuugugcacauuuuuguguauuaaaugguaagacauagaaaaaacaguuaauaagauguaugucaaagaauaagguaaaauaacucaguuuugguagauuagaaggcauacuuacuaaauauugucauuguuuucagcuaugcagucagaagggccuguggaacauguuccaguauuuggaaacgcaaguggaucuguucguucuacuaguccuaauguucagcccuccauuucucagcccauccuaacuguacagcagcaaacacaagcuacagcuuuuguacaacccacucaacagagccacccgcagauugagccuacaaaucaagaauuguccccaaacauaguugagguaguacaaaguuccccaguggagcguccaucuacuuccacagcaguauuuggcacugguaagauuucauuuuaauauuuucuauuguuuuauuuuaugucuauggaugcucugucucuguauauuugggugucauguacgagccuaguguccacagagaucaaagaagggcaucauauccccggaaacuguagugacagguauuggggacugacccuggguccucuugaagagcaucagugcucuuaacugguugcuuaagauggcuaagccaucuucuagacuaauaagauuaauuuuuaaaaugaagcugcaguagacauauaugcuucacauuucuuaggugcaauacaucuugacuauugccuaaaacaauuugcuuucuauccaguguuacuaugaagaaagaaaauauuuuuauuuaguuuuaaucauacuuaacaguagauacaagaacaguucaaaugugcgcuugauguagcuuaaaaauuacauuuauuguaauuuaaauuauuagaaaauaauauucauauuuacuauuaguucaauuucaguuuuuaucauuaaguaaaagcccuccuacccccagauauuuugggcuguuuuuaaaggggaaaaauagccaacauauuauauguaacuuaaugugaauccugaaaauuaaagcuguucauauuauuuagcauauacaguaugauuuuucuuuauuuuuauagaaaguccuauguaaacuuuguaaauagcaauuuaucagaugugucauacaaaguucuaguuuuaagacugguuguaauauuaucuuugucuaaaugaaguuaccaugaucugacuuuugagguugaaauuguaugaucugaaaguuucagcuaccccaaguuccuccuugccaaagcgcacucgggaggaggaagaggacagcaccauggaagcaggagaccaagucucugaggacacaguggaaaugccucucccgaagaagcugaagauggucacacccguuggaaccgaggucugucacacuccuguguauuaccauugcaucagcagcuaagagcuagcugucagucauacucaaugucaaauuaaguuuugggagauuauccuaaaaauuccugaacuguaguuuucacuuauagcuaagguauuuugccauuaucacuugguuuauagucuuugcauaucuuuucaugaauuccuucccauuuaauaaaagcagaagcaaauuaaauucugcuuuuguaaggaagucuagucauuggcauucugcacauugacauuacuugccaugugauuuuaagauuaaggcuagccaaaauuacguuccuuuucaaccauagacugugaugaguuagguuguauaacaguaauaauacuaaauguuauacguguguauucauuaauguucguugaagaaguauuugaguauguuuauauaaacauuuguggcacagcuucauagaauugucgacuuaacguuuuagagaaacacugaugacgauucguguaguucacugacucaguaagaaauaaccuauuaugauuuaggaagaaguuauggcagaagaaaguacugauggagaggcagaaacucaagccuauaaucaggacucucaagauuccauuggagaagugaguaaacauauacaacuauuaaaaaucaauuguuuugaccuauugaaacacuacuugcuuuuuuuuuuuuuuuuuuuuuuuuugguuuuuugagacaggguuucucuguguagcucuggcuguccuggaacucauuuuguagaccaggcuggccucggaacucagaaauccgccugccucugccuccugagugcugggauuaaaggcgugcgccaccacgcccggcucacuacuugcauuuuuaaauuuguuuuguuuugcuuuuugaggcaaguuuuuaccauguagccuaggcuagccuuaaauucagacagcccugcuuuuuuuaaguguuggaauuacaggcauauacuaucaugucugacacugugugcuuuaaaacagguucuuaaauuuguuucucugauuuuauuguuuguuauuguauauuguuuuguauugauuguugucguucauaaauuucuuaacucauagaugcuacuuaauaauuugaaaaaaaauagauuuacugaauacuuaagccaaaugauucauuuuuaaaucagugucagaaauuuuuguuaauaguuuauuuuaauagcaagcaaaauguagaaaguaauuaugcaaaaaauuauuuuaguaucuagcauaugcugaauauugaguaucccuuauccaguaccaacagcauuucaugcagacuuuggcguauuugucuagagccagcaaaaagcacuguuugggcuugcugucacuuguuaaugucgguuuaggcugauguucugaggaguuaaagcuugagcacuuugggugccauggcucaccuauggagcuguccucccagccucccaguucuugauaugcuuguuuuuagaggaugcucugagaaugaaccugaucuuuagagugcagagcuuugguuuaugccagucuuugccacauguagacggaaaggcuuaaccaucuguaaauuacuuuuuauuuuuaauucuuguauauuuuuaauuaaaacauaauuauaucacucuuccuuucuucagccacuccagcuucuuccauguacccccuucccuaucaaagugguaacuuuuucccuguuauuauuauuacauguucuauguauguaugcauaagugcauacauguacauauacauaaauaaaaccuacugggucccauuuucacauuuuauauguacauaacuugaagguuuuguguauauuggacaaucagguaugggcucaucccuggaauagacuaacucuaccucucagcugucaucacuugccuguagguguggcccugugagauauccuuuuauuuacuuaauggauuuauugcuguauauucuugcuccuuaaccuccucccacugcaccuccucuucuuucaaguguuaugcaagugcucagaacguuucagguuccaguuuuuggguuacggauagucaguuuauauguguauugcaguguuucaaacauaauccguguaaugggguaacauuaguuuuuuuguuauguguuuuauuuuaaaacaauagaaauauuuuaguuuauucauuauguauccagauuauugcuaguuuugguaaagaccuuuuuaacucuuaaagggaguuacccagggagauuauacaccaauggaagacagugaagaaacaucacaaucucuacaaaucgaucuuggaccacuucagucagaucaacagacuacuuccucucaagauggucaaggcaaaggagaugauguaauuguaauugacagugaugaugaagaugaugaugaagaaaaugauggcgaacaugaagugaguuuaguaucuaucagccuuccuucugcuucccuuccagagcuagggcucaaagccagugcacugugcacauuggccuugagcucuggaucuucugaccuucuaccugugugcugcuuucaaccauugugcuuuaagucuuugguguuucuaauauaucaaguaguggauucucauucccagucaguuuuauuagauuaucaaguucuuuuauacagauuaguucaggaauguaggauuguguauuagaauuaaaaagcugaugguggauaaucaauuuuuaaacauuuuguuuaccuuguuuuggcugcauuauuuuguuauuuauuagagguaggaucuugguauaucauauagcccaagcuugcugugaagucucaaaaauucugcuucagucuuuugaaugcugagauuauagaaauguauggccugccuagcuuguuuguaaaugauugcuguaucauuuaggauuuguuuucagauuucaucuuuagucuuaauaaaaauggcuauaugaaucugauggucugugcucuuguuucuggaaaucaaagaagaaacaggaguucauaguuguuuuauuuguuuguuucuacuuuaccacccuguaccauuuccaaaucaaucacuuucauucuuugaaauguuacaguuuuuuguuuguuuguuuguuuguuuuuucccuuacuguggaaacgucaaaacucuugaaacacuccuguaugcuauucuaagugugcaaaaggaguggcgugcacuuuauucacacuuggacaucuucuucuaggauuaugaagaagacgaagaugaugaugaugaugaagaagaugacacggggaugggagaugagggugaagauaguaaugaaggaacugguagugcagaugguaaugauggauaugaagcugaugaugcugagguaacugguuagaauugaaacugucuccuuaagaacugugcuuagaaagcuugcuguuuuccugucauauagaaaaucuuguguuaccaggauaauaaaagucuucauaccuuugaaguuuuguuuguuuggcuugcuugguuugguuuuccucugguuuguuugcuuuuaaucauuugguguggcuuuuuuuguaaccuagucauuugaucugcuucagucauuacauuuuguucuuaggguggugaugggacugauccagguacagaaacagaagaaaguauggguggagcugaaagucaucagagagcugcugauucucaaaacagugguaagagcauuagucuuucaguagaguagucugguaauauuuuuuaauauuuuacuagaguuguacuucugauguaguauaacucuaguaaauugguaacuaagugcucugcccuccugauguggccauuagaugccauuauacuaucuguccaccucauugaacuauugugaaggucaaauguccuagacucucuaauguagcauaaagccauuuggaauaauuaaagcagggauggguagcagcucacagcuagaagagguugguccaccaaaacccuguuuuaagauuuguauguagaugugucuuuagauacuaccacugaagguuuuuucgcaaaagauauucuuagccauuuucccccaaauauaacacauauaaauguucuuuccguaagacuucuuuugggaggaguggguacuuuugugucaaucaaaauuaaguucuaguagucuuaagguuagaguugguccauuuucaaauuguuuauaggguuagagagaugguuccguauuuuuuaagagcacuuggcuccucuuggaaaggcaccagauucagauccuagcacucauguggagccccacaguaauuccccuuccaggugaucuggcaaccucucacagccucuauggacaccaggcaugcauauaguaguacacagacauauaugcaggcaaaaaucucaaacacauaaaguaaaaauaauuucuuuuuguuaagguacuacucuugugacuaguuuuauuugucccaaauucucaaacuaaauuuaaguuaauaauuuggauuauagaaaaguaaaguguuuuaaauaccaacugucaggacaggguucugauucuagaucagauuuagaaacuauucucuggcauccuacauuucauaguggagacaacaagaucuagauaccugaguaguaauuggaauuugaaguuugggagaaccaaaauauaaaaauauuaacagugaggcuuuuucuuagucaccuugauugauugacaugcuguuucucuagaaagggguaaguagcuugugcagugauuaagaauaguauuggacuagagagauaacucagugguuaagagcacauauugcucuuuaaucggccugaauuuaguuucuguauuaggugguauauagccauauauaacacaugcugcaggggacccacucucuuccagcuuccauaggcacacagacacucauaagcacauuuaaacauuaagaaauuauaguaccauaagucaaaauguaguaaauacaugcuugaucaaaucuugagcaaagugcuuucaucugucguuugagucuugaagggagggugcuuacuugccuguuugucuguuaaccauccagagugagacagagguaaucccaguauucggcagguaggaggagcugaaguucaaggcuagccuacuacauagcaaguuugaaaugagccaggacucugugagacccuucgagguuuaggccaugugauuucauagucugggcuugguuuccaaacugaagucuuucuuccauaggugaaggaaauacaagugcagcagagucuuccuucucucaggagguugccagggaacagcagcccacgucagcgucugagagacagacuccgcaagcaccgcagucaccaaggcgcccuccacauccucuccccccacgccugaccauucacgccccaccucaggagcugggaccaccaguucagguauuaaaagaacccagcuucugaaaaagccaccuuguaaauucucuuuuccaucacaugguccuuccuuuauuccuuccaaauaguagaauuuuuaauguuuuggcauguuguaagauacuacuuuuaauugaaacuaaucuccaguuucugagugugaaugaguuggcuuuugaaaacacaacuugcuaaaaauuguauaguuauuaaagugauuauagucauagcaaauacaauucugcuugcuguuauuauaggcuuaaaauuucuuaaauuuuauuuaauguaaaaugcauuuagcuggcuuaguaacaguuuugaacauuucuuacuuaagguucauagauuuuuuuuuauuguuauucuaccuaaccauuuuuucacaucaaauauuucuacuuaguucauuagugacccuauguauucagcauggaguaaguuaauucaucuagcuugguucuuauucuggacauggugaguguauugagaaccaaccauuauguauaaaucaaauuaaaauaaaaguaguggaaauuacuugauauuugaaaauacagagucuaaaggaacuauaugacuaggcaucacaaagcauucagucugccaauucaagauuguuuuagcugugaaguaagaagucaguugguauauaaacuacaacggaaaaccucacuuaguauuuucagccaaggagauagaaucuaaauguauguacaugcuugaauuauaaauaugccuuuuaguuuauaaauaucuuuauuaauaaaauuuaaacuuucucacuuauauuuaugauagauauuagcaauucagaaauguccuguuaauucuaaaucuucuaaaauuaguugauauuucauuacaaaaguaauaaacuguaucuuugguguuuguuuuaauugccuaauucuuaaagcaaauauaauucuuuuucaaacagagaauucagaugacccggaggcagucuguagggcguggucuucaguugacuccaggaauagguggcaugguuaguauccacccauccugugcauguaauucacauguaugugguuaggccuauuaaauacugugcucugucuguguuucagcaacaacacuuuuuugaugaugaagacagaacagucccgaguaccccaacucuuguggugccacaucgcacugauggguuugcugaagcuauucaguaaguugauguaaugagaaugaauguuuggugaucccuagcugcuuucucuuuaccuucuaaauuguuuuuuuggauguguuauuuguagaguccuacccuacuuguccaugaaucuauauauguaauaggaucgugaaaaagucguguugaggaagacuaucuagggugaauaaaguauaccuucuucuaacugaagcacaguguuacagugcuuaugaaggugguuucuacgguucgagugcuuccucacaagagcaggcuccuugcucucccuucugaguaaccucauuuuacugauaauacaguuugugcuuacauguuuagauacgaccugacauauauaaguaaaugcuguauugguacuaggggugauguugguuauuaaagugaucaugauaggugguuuauuguaggagcucaggucucaguagccagguguaaugcaacaggcuagaagcacgacagugugccugaugaucuucauugagccaagugaaguaauuguucuaacaacuaauaagugagcacaccugucuuacacuuccuagugauuacuuagaauuucuaugcguuauuuaauccucaaaacucugaacuuagaauagacuagaguaacuuauuuuauauugcuaaacagugaaaacugaaauuuaaaaaaaagaaaaaaacuucuuuuguuguugugcuuccuguugcaguguaucuguuucaaacaaguugaaaaaaaucagcauaauuuggggaagcuaaaaguuaaauuauguuacuuauauuacuaaauuuauuuccaauaucuuugcaagaaacccuugacgaauuauuuucauuguuuccuucccuauuuauugauuuuuuuuuuuuaaagcaaccuuuuccucuuuugguuuaaacagguagcauuaaauuucucaucaaauuaauuuuuguucauuuaguuccccacagguugccgguguuccuagauuccgguuugggccaccugaagacaugccacagacaaguuccagucacucugaucuuggccaacuugcuucucaaggagguaaaauaggcaaaagccagagguuucuucagugugucuacugaguagaaguuaguaugcucugcuuuucuucagcugcuaucaguguaaccccgguucuuauuuauaaaguuacugacauggcacugccuuuucuaauaaauaccucuucaggaagguucuaguuccuuuagccuaaagacuggcuuuuauauauauauauuuuuuuauauauauuucuguauugcuuaauuaccguuuuauugccauauugaaacaccaugacaaaggcaacuuuuuuuuuuaaugcauuuaauuggcuugcuuacaguuuuagacaauuagucuguuauuguggcagggagcaugguagcagacagacaugauacuggaaaaguagcugagagcuuuacauccuauucuucaagggaaucgagggacacugggcuuggcaugugcuuuugaaaccucaaagccuagcccuagucacacacuugcucacaaggucauaccuuguccuaccaggcuauaccuccuaguccuucccagacaguucaacuaacugcgggccacgcacucaaacauaggagucuauuggauccauucucauucaaaucuccacauaauguaugaugaacaaguaaaugcugcuaagaagugccagcuccuuuaaaauuuaggaguacaguguauuuuuugcuuacaauuugagaguuguggcauaccuaguuaaauauaugacuaauuagacuuucccuagcaacaaaacaaaacaaaauugccaggcgugguggcacacaccuuuauuuaaccccagcacuugggaggcagaggcagguggauuucugaguucgaggccaaccuggucuacaaagugaguuccaggacagccagggcuauacaaagaaacccugucuugaaaaacaaucaaucaaucaaucaaucaauaaaauguuaaauauaaaauuaaguaguagugguagaugauacuuguaugugaguuuugguauuuguggaauuaucauuuaguccaugggugaaauuugauagauuucuggaaacuagcauuuugcaagugaauagagaagccacuacuaacuugcuuuguaaccauaggggaaguuuaaguuucaccagcagaaaggauuaauaacuuuggcaguuaagugaggaaaagauuuugacauaauacuuguuuauauuuggauauucuguaaaauuagcaauuuagggaugcuuuuauuaguauuaaagaauuuaaaagauguguugaauauauuuugaggaacuugauuuuugcuugauggaggagccucauuaugagcuucaagaaaauuauacacuuuguacuaauucuuuucuuugguguuuuuauguucuuucaucauucacuaauacuuaaauuuuucucuagguuugggaauguaugaaacaccccuuuuucuggcucaugaagaagagucugguggccgcagcguucccacuacgccucuccaaguagcagccccaggugggugccacgucaaugaggacuuuuuuuuuuuuaauuggugacauagaacacauugaaaccuauucuggcucagaacuaaugaaccacaaagguaaagguaucuguuguucuuuuuaagugacuguguucacugagaguaccaccucugaugcuucagaacaugccucucagucgguucccauggugacaacgucuacgggcacuuuauccacgacaaacgaaacagcagcaggugacgacggagaugaaguauuuguagaggcggagucugaaggguacgauuuuauugugugguuuuuguuugcuguagguucauuauguugucauaguuguuuguguuagcaagcaaauacauuaaaaucuguuuucagugcuauccugccccguggaaaagccaaagcacauauuuaaaaagcuacucagcauucagaauuuaggguuacuaugagagaggcaguuuauaaaaacauuauugaaaauuuuuuguuuuguuuucuaaggaaacagaaauaauuugcuagaagaagcccauaggcagugguuuuguagaguuaagucucaaaccugggaucuuaauucuuauaaacugagaaguuuguacauuuuagugguugagaaauagaacacagauuuuucugcucagagcucaaggacuugauuugacagugcuucauaagcaaggucuccuaggauauaauggguaagaggcaggucuguuuguauucuuuaacaucaguguuuaauugaggggagguuacaagucccagugagaaugcuagcuguuacuaauuauauacauauuuucaggucacuuuauauuuguccuucuaacccacacacuauuccuaaaauauauuacuucccaucauagaaauuaaguucagagcacguuaacaauaaugugcuuggacuauucuacugguaacagcucagugagaauuaaaagucuuaacgucagccccaugcuauuuacauguccccgucuugcaaccuugggggucucagguaaguuguuaccaguagcugcacuaauauuugcagauuuuuaaaaaguaaaguucaggccagguucagguuuuuuacugucuacucuucugugcuucuuaaaaggagcaagaugaaagaacagccacugagcuaggaacucugaugcccauagcuuguuaggucuggguuaguacucagggugacugaccgaucugcuguuacuaguuauguuuccaguuuaucaaaguccacucacuccugugagugucaagacuauaaacaugcuugucaaauggaaaaagaagggcugcugaaacagugguaaaaaguagaauugucgaguauccuaguaagggugugaaaaaaacccaacucaucccaucuccugguccaccuuacgauuaaaaauaaacacacuuaauaaccuauaacugagucuaauucuuaguuaacuagaacucugaaagucauuauaaaauaaaucaaaacgaacuuaggaacauuuaaaauaaauuguagaaucaguuuuccauuuucuaaucaauauuuauuucuuaguauuaguucagaggcaggccuagaaauugauagccagcaggaagaggagccuguccaagcaucugaugaaucagaucuucccucaaccagccaagaucccccuucgagcuccuccguagguaaguacugucccaugcagcuugacaucuccagguucagcucccacaccuauauuuuaacagcuaccuucuuuacauaaccacauuccauacaccuuaaagucaggauuauaaauaauauaaauuauaaauaauauaaauaauauguauaaauuguaacucucagcuuuauguacaaaagaaucagaaauuauagguaugguaauuauuaguccuguugauagucucugagaauugucuguccucuguacuagaauuaauacuaguuaucaaacuaucccuugagugaaaaaugugauugguuguuccuaggaaauagaaugucuuuacauuaauuuccuuaugggugacacuaucucugacuggguacucauucagcaaauuugaaugccuaaccuagcagggaaauccccauguccaagaaagugacauuuaggaaaggauuacaucucugugcuuggaacuaaccucuaauaaucaugaacccauugaaccacucaaauggugccaagucccaccacaacaaagaaaagaggaaugcaaggucccaacccccgaaucagagacuuccgcaacaaauauuguugaugucgguggaggagauugucggaggacucuugggugcaaggagccuccucagcccagaaauggagaccgggaaggaggugaugucgagugaggagcugguggaaacacuuacaaggccagauuucaacuccaaauugacguuuugaguauagaugugaggauauauaaacuugcugcaaauguugaguccaugacauuagcacuaacgaacucaaccaagucucuugcgguauuaacuacccgaguuacaucaguuucagacaccauugagcaccuuaccaggaaaauagagaaccucgagacagcaauugagaaagugggagagaaaguggacuuuguccaugccagaucugccauaggaaugcugagcaccgauguggaugggccagugugcccagcugccccaaccuguuaucccgucagugagccagccaguaucucauccucacggggcuuaaucauugauuuaaaaaaaagaaaaaggaaaaaaaagaugguuuauauaaugucccauaagccaauaggaugugcuugagacauucagagucagcacggaggucaugugacuggagcagaauggggagcaagauucaagaguguaugaaaagaguaaugaagaaaaagcaccuagaucuuuguaguugcucugagucucauggagcuagaaaacaauugaaauucuucacauagaauaauggcaugacacugcaguuguuuuggccaugguauguaagaggcuaaaauucauggucaacuuuuuuuguguguguuuguauaacugcuuagcuuccuuugcucuuaaaguagacuugaauguggaaaacaaauggcacaucuguuuuugugugauuuaaugauuauauaaugcugcuuuccuguuuuuuuuuuaaacuugcuuuccacaugucuugaugcuuucuguagauaccaguaguagucaaccgaagccuuucagacgaguaagacuucagacaaccuugagacaggguguucguggucgucaguuuaaccgacaaagaggugaguuucuggcauacuguuuacuugauaugugggauaauagcauuuguaucaauuucuaagguaaaccuaaggauugauuuauaauuacauguugaucgugugacacuuagccagaaagcuucuuuuaggcaaguugucauaguuauaaaaugaauguguuuuuaaaauugguguauuuuauuucauuagauccaaaaaaagauuuggaaaaucaaguguuagcauguugugcauuaucuguauucuuaugguguuaaguuuuguuuuguuuuguuuucugcaccgaaaguuuuguggcuauuaguagcuaguaaagaaauagaagauuuuaauauuuucacauucuucaaaauaacucauuuagacuguauuaacaucauaaaucuaguaacccagcuauaauaauuaccagucaacauggagaauaucuuuuuauauccauaucuuagauauuucuacugaaaaugaauuuugccguuuccuucuacagguauaagccaugcaaugggaggaagaggaggaauaaauagagggaauauuaauuaagugaucucuaaacugugacacaugugaauaagauugacgaaucuguuuuaauauaaugauugucaaguugagaacuguuuuguauuuaaauagguaugcucauuucaacauucuuuauuaauaaaauguauuucaaugucaaaaaguaucacuguuuucuucauuucauuuugaugacucuucuuugucaaucaguucaaggacaguuguaccagauuuuggagagggucugcccugaacgugugguaauugcucuugcuguucuuguaggcacaucaauguuauaguauugaucuaaauaaaagagaaaacauccuuuuaauuaaaaagaaaguaaaacauuuaaguuuguauugaguguuguauucaaagucaggaucauuucaauaucaaaaguggaugucauuaacuuucugacaaaaaauaauuuagaaugauggaaggaauaacuuuucagcauccuucagguaauauuagguucaacucuaccuuuuuuaaauaaauauuuaaaauagacaauuuaaaagauuuuggcuuuaaccauuuuaaaaauguauuucuuagaaauucauacuauagaaucauaggcagaauaauuuagauaacuggucuuucaaaauuaaguguccugggcaauaaacuuuacuuaauaaaacugggucccaugaauuucuugaauaccuuguagacuguaauaauacaugcugucuuaaaagagucacuugucauagcagcaaguacaguuucuacauaccaguuuucuccugauguccuaacaauacaguagaacuggucugcauuccuuccaguuaaauaaaauuaguguaacagucucacccuucuuauugaguaagcacugaaguuggguuucuuacuuacagucauuguuguacacuugcuguuuccauuuaaauuacacuugcgcuuccucgggugagaucaacuugaaguucacaagacuguuaauuaacuuaccuuuggaaaaggcguaguaaucauagccaucagguuuccuaauguuaggcaguguuaucgcugaaguaacaacauuuggaaacccucuccacauuguacucacuuugacuucauuguggaggaaaccugcgggcagaaguuuuaauaaaagguuugaaaaaguuuacaaccuuagagcuacauaaaccuagguuuugaguuuguucucugccaugacauuacaccucacuuuuagggcugucuugagggauacagauuuguauacagugcuuguuguuugcuauaauuaacaggauuaaauaaacuacuuucuuuaccaaca

SEQ ID NO: 420 - RNA, 428 nt, Mus musculus
cgcggucugaggaaugucaacuauucaauauggaggcggagguccauaagcuggaucugauguuccugaaagcugauucugauuuggauuaccuucaauauaggcuggaauaugaagucaagaugaaucacccacauucagcaggagagaaaaaugcaguuacaguuuuaaaggaauuaucagcaauaaagucucgcuaucaagcuuuaugugcacgcuuuaaggcaguuucugaugagcaaaaagagaccaagagcugcauuugugcuacuuugaacaagacaaugaccaugauacaagaacuacaaaagcaaacaaaccuggagcuaacucuacugacugaagaagagaaagcugcaacagagccauuaaagucucacaugccggacugauaaaaaagaauguuaacgaggaacucugguggagag

SEQ ID NO: 421 - RNA, 11647 nt, Mus musculus
aggacccuaugggaucacaucgcagugguagccagccagcuccaggcauagaagcuuccagaaaacaaugagaacaaaauucauccuugucugggcacagagagaaagcuauccaaggagucguccaugcugagaggacaugucuugcauaggugggccaugggaccuucaugccauuggaccuucaugggaauagggguggagcuuagaguagcagagagaagcgcaaaggaugagaacaggguagcaaaccaggcucugcggcuucgcuguggauucguagacugugauggaguugcugauaugccucugcacacuccacuccgcguugucccugagagcaagaugugaucguucucaggauggggauugccuuccucuggaaauacacagcagcuggcugaaaagauucaugcccaccauccucucuccccuucccaacuucucuuccugccucuaaaagcuauuggaguucaagggcuuuaccugggcucaaucuccuuuggagauuugugggagagagggcugggucauccugaccugucuuuagagaaaugauggcuaaaaauaccucuugggacuuagguuggccuagaccuggagaugagaguguacccuaaaauaaauauucagggaguggugaaggcuucccuguuuagcaugugguucuagccaaguucguaaccuuugcauagccuuccccuggguuaggucacuagcacugaccagggaggcagccaggccucugcuagggcacaagugcauaccugagucucgcccaggaaagaggagcuggggagcuugggggugggggcuuuguuuuguuuuguuuuuuaucauaaaguacaaauaaguugugugcaaaugcagacugugcacaguggcugaggaccuuguggggcaagaugggggggggggggcagcagaaucgggcugugaaaccaagucacagugccuuuuaggguuuccaaagaaccuauucaguucacagcagugggucucucucucucucucucucucucucucucucucucucucucucucucucucucucucucuccuauaaaaaagaagaagaaaaguucuagguagaagaagcagaauucgauccauuagaauacuagcaauaaguaauaagccagcuugaccagaaagcuaggcagagauucacauggggugagguccccagagaggcuggaggcugagggcggcuuuuccagccacagggcugcgccucucugcuugagaauuccaggcagcccuuccuuguugcaccugaugcuugcagcuucaagcugcuugccccccacccccuuccuggguacagccagacacaccuaacauccauuucccagcuagaccucuugcuccucaccgaaggauuucuuguucugugucuugugguucccucugucguagcccaccgccuaacucuggucuguauggaugcugaugcuguaagccaguggaacauguggccccucccuagcccacuugaaaauuagggugcccccucaucaucuccugccccucccccagccuggcucaguucucacucaucucuaucucgcuggcaagacacagucaagcugccuccacgccaggugucaaaggcuccucccacagguauuggcgguuauuuaggaagauugccuugguucaagggaaagcuacuagggaaacaaucaaccucaaccuaguuuugccuuucugagcaccuaaaaaaucagcucggguggaccugggaacauggagagagguaugcugccugcacauggaccuguuuccaucccacgugacuacuaccccaaaaccuuugugaggcgcagccuccuguacaauaauccguuauagcauacauccauucacuucuauaguaauagacauagaagaaaagggcacaauuuuaaaacagcgauacguaaaucaguacaaagguaauuuccucucugcacuaaguguggccauggguaacucuugguguguuggauacccacuugaacagccacuacucuugcgcaaaucagaguaccgcaauggcaucccaaaccacuguuuggcccuccgccugcagaaggaaaaagucacagagcaaucccccgagagcuuugagucugagaagucugagacaaacucacacagccuaaauuuaaguaaccgagagcccuggcaggggaggcgccccuagacaguaguggcuaccggugcuaagaacaagcacaccguacaaagccagccauuguccgucuucccucccugggucucccgaaaaggacguugucauuaucccaacgcucuccugaauggaauucuuugaacccucaaagugauuaggccauaccaaucccauggcaccaguggacuguggcuugaauauuauuuuugauuugacuaucaaaauguucugaugauucuguuccauuuugaaaagggucugagaaaguauacgagucuaauuauauauacauauuuauacauguguauuuuuguuuauuguuacauuuugacauuggacuuucuauuaaauaauuuuuaacaguuguccuggcucuguucuuucuuuuacuacuugggucuggguugaaguggguagagagaugucugugugagacuuuguugauauuccuugccuuccuuuucucuauuauuaacuccacuuucgugagguugucuucuucccuuucuguuuccacaggacacauacucaaucagauacgcaguugggagcccccaaccuucuugccaucucucgacuugcccaucuacuucagaacauucacaaauccagagaucuaguaaaaaugcacaccugggaauauacaaaauaaugccuugagcuuuaucucuuggguacucccccaagaguacacacuuucgagcacacacuacccgugagaccuugggaaaauuacuuaaccuuuuuuuuugcacuuaauaaaaagcaauagucuccuuguaaguuugccugaaggcaguccuuagaaacagccuaacaaaaagccaucuguuucccagacuuauuuauuuguucuagucauuccaccaaccugauauacguuauauguucacugcaugcuaaguucuggacucacccaaguaaagagucuggggcuugaggacuuucagacuuugccacucuaaagucaagcuugccaaaggggcagcaugaauggugggugagccugugcgucacaugcccagcucaucccugcaacugccuggcuggcacugaagucuccauggcacguguucugaucugguggcccagcagccuuugcucauagaaauuguaucuucccgcuuuccugacgguauggugguaagagcuauaguggggaaaagagccuguaaucacugcuacccucccccgccgucagcauuuuccuccaaacaucaaguuggaaguucaaauucugcugaguuuuaugaguuguugaacaggaccaaggcuugagccuagcaugguccugagucccagcuggaucuuacagaaacaaaccuguuucuuccauucuuccagcacagacccacuuagaaucacaaaggcugauucuucccccccccccccaagcagaagucaguguaauucugguucugccugauuucccuaagaguuauguguacaggaugaacaguuuccagucauagacacacacacacacacacacacucacacacacacacacacacacacacugcgaagcagacagcacucaggucagguagcuuuccaaaucucucaucauguuuauaacuuuucccucuaguuucucaauauagaugacagacacacaaacacacacacacacauacacgaaaucccauaacuuaagugaccuggggaaagaacuggacaucgagcaguguuugagaucaaauucugaucaggacuuuugccuuggaggagacauugauccagucuuugggagacggugggcaguugggccuaaaacaucucauccaccuaccucuccaccacagcugaaagccaccuggaaccucacacccagcauccccauauuugcccaugacugcuuuccauaauggcagaagcccucagugaagaacaagcccugaacuuuccaaugcacagccagauaaaauggacuuuacaaugaguccuaccacaagcuaaugagaagaaucaccgggggugccggggguggggguggggggagggggguuaaaacaugcacagguugggcagagccauggauguuagacagauggauauguauauuagccaucccaucuaacuccuccaaaaacaccaaucuacagauuuaggaaugaugagugaugggcccaagugugagaaccagagugugcaggugagaagacacugaggcugagguuuagcaucugggaaacagagagaacagucagucuauggaggcagucuacggauuccaaacgacuuagugaguuacugagugcuuccaaacaccagagaaaaaaugccugccaguaguagcucuccuuccaaacaugugugaccccaggucuucaugguucagacaagugcuacaaguagguaggggaugagaaucugucaccucaaacacauuaaauaaauuuauuaauuaagcaaauaugaugucacuuuggcagagccaugaacagaugggucuccaccaugccuguauguuagguuaacuggggaccucuccuuaauaccaauguccagaccucagguuaagucauccuacguucccuggggggcggguagagcuguacucgggauuugcauauaucuuccuggacagcugugaggugagggaugggaggggagccaugugugcaccucuucagccauuggacuggacacuagcaagcagcucaacagaagggcccguucuuagggagcuuggggagaggaggguguaacaggcugcuaagcgugcuccaggagaaacaacgcuacccagagcaaagaugacuaggucuuggagagaggccacccagugcugauuacagaggcagagagcuuaaccuaaugaugaggagcaauacccacgugacugagcgcuugguauaaggcuagaccuccagguuaucugguuucuaggcaugcuuuuguucaugccauugcaaagggagaggcuuuugugacuauucaaugacauagagccugcuuccucuccuggcaaccuccgugcaggacagcacuggacuagcugacuucgugcaauauagcuccaucccugcaucgacccagcuagcccugcuaugacaagccugacugugggaggcuagaacucaacccagagagcucuuuacauucugcugucagcaaaccacggaaagcaaauauccacucccggaaaagccucuccaugaagaaggacaguggguuucaggggacugauguggggaguguggggagaaaacuuagacucccugcaaggucuccucagcugacugaauagaaaagcagggcuugggcacccccagugccuuugaggaaaggagcugauguuacuaauacuguggcaaaggaagagcaucuugguaagaaugggaauugccugcugauguaugacccaaaacagggcagccaggcucauggcuagaaugucaagcacuugcuccaauuguuagcagagcucaggccauugguaugcucagcacugggccaugagucugaugcugaguucugcagcuuccugucugauugaggacugagagccaugcaugcaacagcauagagaguccccaauaaccugcagcuguaaagacucaucuuccuccccuggcgugaggggcagcuggaagcuggggaugcaggcaagguagaggaugcuggcugaucccucaaaguuaugucaguuugaaagucuccaaaggauaguuacccaucacaaacccaggcuggugcccacagggaucccaguacccuaugaucagacuggaauacaaaugggguuuuagauuuaaaggcucgguuugaguagugugugaggagcgggggacacaugaaagggaaucaauucuuuucccaagcucugucuugcuaggaaugaaacugaagucacuaacaaggccuugucugacuuuaguccccacccucuucucacaggcuuugucccaaggaacaauaggagaaaccugacgucaaguuuucccaaagccuccuuuaucuuugaaaugaugggccuggcauuccugacuguaucucagacccuucagaggauauugcugaaagcagaggucgccucaaauaucucuccccaucccccacccccaguacaccuggaagggaagagcuuugaggagccuccaaaauguagauacgcaaauaaggauuggaaaggaggcugaagcauccuggguaacauggucuccagacuuuccugauuuccaaagcaguugcuugaacacuggcagaguggacuggcaguccacaucacauaggcagcagauccauccucugacccauccucgugagcucauauaauucacuccuggugacugggagggggcagugagugggaugaaagugaauaagaaaaaaaguuauaaaaauaauaaaauaaauaaauaaauaaaaugcuaaagugcugccaaaaauaaaggaaaaagaaaaagagagaaagagagaaaaagaagaaaggaagaaaagagaaauagcuacugacucuuuuauaguuaaagaaacuaagccucaaagagauuaacuuguccgaggucauacagcaauaaaugguagaaacacaguaccaacucaggcuuguucuacucagaggccuugcuuaucaccauucggcucuaguacccuucauguuuacaucuuaggaugacaugccguuggcaucacuccagccucugccagagccacgcagaaccuccucaucugccuuucuucuaggauacucugcccauccuucaacagaaacuggugucugaaguauguccuuccuauccugaaucccaccggaaacccuccgccguagauccgcacugccuugaggcacggguauggaauuacgcgcaguuucuacccgcagcccuucucacaauggcugcugccuacuaauuccuggcucucccuccuccccuuuauuucucccucgcugcuuucccgagcugguggcucucuucucaaccuuuuaggcucaugagugagaaacaguagcgaucugcaagcaucaucuuaguaucucaggcauuguaccggguucuccccaaaccauuccugccaacucucuugccauaacaaagucacgcauccacuggacccugucuggcccaaagucuccguagcucccaacagcacgugaucucuucuaaacaagaaacgcgugugauuugguauccaccagaugacuauugcacuaagggauacugaagaaccgcacccauuccccacaggacugugcuccguucuuacugcgcgauugguugugacaggcagcuucugagagcacaugacagcuaguagccaaucagugcuccccacaccuagcaaacugauguauuucuugaggcggagaguagggggaaggccgacugggaagauagcaucuauggaucaauggugguaggcccccaguauuuaagagcaagaggccucugucuccuguguacucugugguuuccaggcuggugggugguucuuugcccuccaaagccuuuccucuuaccagaggucuguggucuggggaagguuuugacuggaaacauucaggucccuggugguguuuggagaugugagacccuucugugcuaaaagaagaagaaaaugaauggucuauuucgagcccgcuaacaauccaccgucuaagaacaggcagcagcucuguagcugaaaggcuggcuuucugagaagccccagggaagcuggccaugcggcaaucguggccucagcucuggcucauccugcuagaggacccugcugccauaaugguggcaaagcgucuagaauauuacgccuuuguucuggcuuucucuccagcccuccucaaccuccucccagagaacucugguccuggagccugugauguucuugcguuaugaguuagaauccuuguaaaccagaaacuucgugcagggaaggguaccugugagaaagccuccgccuguuuugcugggguaugagugguucagauugacgucccagucacagauguauguaugcucaccugcgggagaacauuagcuugcuccucagaacaaaacgggagccucuggagccuggcauggcaugccugccugccugccuggaguuuccaucacacacacacacacacaaaugguguuugcuuugaauccugagauccaaagagaccgacagccaccgguucuaaauguucugucuauuuaaaaccugaccaguugacugaaauaacaaagccuguuucuaagauuaccauaauuaggaguaagaguccagaaacagacccacccauucaugaucaauugcuuccaaacaaaggugucacaguaauucauuccgggaaagcauugccuuuuguuuucuguuuguuuugagacaaaguaaucauuguuucugagugaucaggaaacucacuaauagcaugcgugggcugcccucaaacuccccauucuccugccuuagccucucuggacugccaagaucacaagugaaugccaccacucccagcacaguuguccuuuaaauagauggugcugaugcaggaugggauugcuccacaccuguaauccuggcacaggagguagagccaagaagucaaccucagcuaccuaaaaaacucauagcugaggagcuggcucaguggguaagaucauuugcugagcaaucaugacaugguccugaguuugaaccccagcacccacgcuauagucuggguguggucacaagugucuguaaccucagaauugagggcauuuaugugacauguuuuccaaaaaaucccacacuccauuacuuauucaagagaaagaaucucacccacccaagacuugugcaguaaucuccauggcaacuauucaugauuuccaaaagauaaauacuacucaaauguccaucagcugaaaaauggcuuaacagguaugguagauccauauaauagaacgaaaaugguaagggggaguuacucagagauacaauacaaaagaacacccacagcauuugacuaagugaagggugccagucuucaauuccccuucuaugacauaagggaaaaucacgacgacagaaucggaucaguguugcagaggauuuggacggaggaaauugcaaagggauccuaagccauucccuagaggcagaguauaucaaacacuauucaaagguguauuuuguauuauuuaauuaucccuuaauaaaucuaacugaaaaaaaaugaaucuucaaaaccagcuuggcucauaaaaacucauaaacuuggauccuuucuuuuauaauuaguggcaguuuauaccuacaagggacagauuuuacauuugcucuauugaaagcuaaguaugauggcucacacuugugaccccagcacuccaguggaacacugaaugaggagggcugcuaugaauucaguguuccaaaccaguauagacugcaaaaugagauuguauucacacacacacacacacacacacacuuacacacacacauacacacacacauacacacacacauacacacacacacauacacacacacauacacacacacacauacacacacacauacacacacacacauacacacacacacacacacacacacacacacagcgauuuucuguagaaaccccuuaugaagaccaaaguguggacacuuuacccuuucuuagaaaugggaacaaaacauccauagaaggaguuacagagacaaacuuuggagcugugacgaaaggauggaccaucuagugacugccauaugcagggauccaucccauaaucagcuuccaaaugcugacaccauugcauacacuagcaagauuucgcugaaaggacccaguuauagcucucucuugugagacuaugccggggccuagcaaacacagaaguggaugaucacagucagcuauuggaugggucacacggccccuaauggaggagcuagagaaauuacccaaggagcuauagggaacugcaacccuauagguggaacaacaauaugaacuaaccaguacccgggagcucuugucuuuagcugcauauguaucaaaagauggccuagucagccaucacugcaaagagaggcccauuggacuugcaaacuuuauaugccccaguacaggggaaugccagggccaaaaaggggaguggguggauaggggauuggggagguggguaugggggaccuuugggauagcauugaaaauguaaaugaggaaaauaccuaauaaaaaaaaaagaaaccccuuacccugugguaucuuguuacaaugcugcuacagaucaauagaguccucccaguaacugggcuguugccacuuuucuaaaucaaauucugaggagucucucgugccuacacaaagcccaucagugcuccccucccucucagucuuccagagucacucaguccaggcauccugcuuccuucccaaggugacccagagaccccagcuuagcucccugaccugguucuuugaguccuucugccugaccacagugaccugcaauucccuaagagguuuugucguccugcccuguaauuccuuggguggcagccauccaagaggccucaccucaauccccugccuguaccccaauccccagggcagaagaauaaugaguucuugagaaguggaagagagugcaggggcgagagaagaagggagggaaggagaaggcaaagaggggggaggagaacaaugaagaacuagucugaacaaggucuauuuaugaugacauagcagccaagguucccauacccuaccuuaaagagcuggguuauuuguuuuuuguuuguuuuuuguuuguuuguuugauccaugaagcugggugcuucuccaaguaagcaccacggucucuuuaucucuuaucccaagggcaucaugggccucucagcauggaaacuucaccugccagagaugcccacccagggccuccagcauuuguccuucucauaacccuauguugguuuccaagcuccccaauuccagguagaagagcuugugacagcaucgcugacucuaaaagucccugcccuggaucccaccacauaguuuuggucugcuucagcuauuuccuggguccagguuuucuuucccaaauagcugaagucuaggcagcugugguuuugggucuuuuuuucuucuuuugaagauuguuagaauccucuucauacccucuaauggagacaucccagugggcuuuagggaaaccuggucccuucucccucaggcaguguucccucccugggcaacuggacagcauccuccuuggagucaccaugugcuugggauaguuucccauguggaggcaggaugaaggauguccucgcuccccucacagacuagugggaaacuugaguaagaggcaguccuauaaggaaaauaauacugucuucuucacuugucaguggauucccuccaccuaaugcugugacuagaacacagaaaaaaaaaaaagucaaauuuuaccugcugaaugaauggguggguggcaagccugggucacauucuccagcuccuuacucaacucuuggcaauuacug

SEQ ID NO: 422 - RNA, 15951 nt, Mus musculus
cccagugugcgcggcgggaagcggaacucccgcgcgcuggaccgucugcuucuggccgagcgggguuugcggugcaccacggcuuucugcgcgggcggcauggaggagcgcagcgauuccaaaccuaccccgggauguagcgggccuggcccggcucccguucgcgauggcggcggcgcccacacaugggcuccggaggacgccuggaugggcacacacccuaaggucaggaggcgcgaggccagcagggcgccgacccggcccucggcaccgcgcucccucuccggcccgcgucucggcggaggacgcacgccagccucgcggcgugggguagggggggacccccgagugcaaggccacuggucgcccgcagugucauuuuuguuuguuuauaugaguuauauaguauagauuaacaccauuccugucaugcugccaaggccacucuuaacccagaggccgcugaugagcccuccauuaauaccuguuuuccuaacuauguaguccuuucugagaugggcugaguccacagcuaaccgaucagaaacaguuuguggacuacggcugagaucuaggaguccgcaaauaauguauuuaggcacagucguauuacacuuagccuuaggcccaaagugugcaucuugauucuguauggggacagaauccuaauuuuucuucuuucuuggaaagcuugaguaaguucuuguacaggccagagaacuauugacauuguauuuucuguguuggccucaaggaaaauaaggauaaccuucugcuugcuucugcuugggaaauugauaacuuuguauccguuaagccacaagcagucugcugauaaugaaugaaggcuguacagagaccuccaggacugguucauuaauaaaauggcaacuccccccuuugagaguuauugagucggauaaguguguuaaaacaaucaaggaaagcgaauauuuguaaauacaaaucuuaaaaaaggaaccuuucagcacuucaugaagcuugguggguuuuuuuauuuuuuguuuuuguuuguuuguuuugguuuugguuuuucgagacaggguuucucuguauagcccuggcuguccuggaacucaccuuguagaccaggguggucuagaacucagaaauccgccugccucugccucccgagugcugggauuaaaggugugagccaucacgcccaucuaugcuugguguuuucuuugauuucccaucaucgacuccauaaacaauagcgugggaaugucacuaguuaccauaacgacaggggaggauguagagagaaacagagaagacaucaacagugacuaggaacauggaggccaguucagacuucccaaguuugaaucuuauuucuguuucaaaguugguaaacuuugacuuguuugacuucaucgcaguucuguuucaauuuuuugacgugucucgguauauuuaccucucuucauuaaaaaauagggauaaugguaguacuuaaccucauaggguaauguuuauaaggugucugacauaaaaaguacuauauaaguauuaguaacccauugaaacuccaucuagguuugauguugccucuagacaguuuucuuacuugcagauucuuuucccauugaacuuaauggcuguauaaaccaccaaaucuuccugauuuuuuuuuuuucuuccaggaacaacaaauuagaccuuguagccuaacacaaagugaugucucaguaccacugucaagcacuuuuugagaucuggggcacguaaaguccuucuuuugaaccugcacauuuaucaugcagccaauuaggucugcccucucaagguucuggaauaucugaucagccauaccugccccacuguguguggaugcccagggccuuaccacaccugccccacuguguggaugcccagggccuuaccacaccugccccacuguguggaugcccagggccagggccuuaccacaccugccccacuguguguggaugcccagggccucccugcagggguagauuccugggauuuuccuauuacagcuagcaagucugaaagaaguaauuugcuucuuuaaagcucaaauaacucccacucaagagcaggagguguucagaauuuagcagauuuuuuucuauaugcaaauuagaugccagagaaauugaggcaucccauaacguagcccaaugaaaaucuaaauuuuuuucugcuccugguggcaaugauucuuuauagacuugacuuucuguagcuuauucuugguugccauaauuucucccacuggaccauugcgcuucuccauacacucaaguccugcaaggcugacugcaucuauucugucaugaaaagaucaccaguucaugcccugagaauacuuccucugaccuagucuguuauuguuuuauaacucaugcuuuuaauaauugucauuuaccuaccagcuuuaaguauagcuaguccuccagaauggaggauuugcuaaauaauuuuuaauugaaaacauuugaaaaaaauauccuuuacauuguacaugugcagacuuuuauuauuauuucuaaacauuauguagcacuuaaaauaaccuauagaugguuuaaagacuacacagauuauauauaaauauucuugcauuuuauauaagggaccugaauauccuuagauuuuggugauugauaagauaguguuuuucuugcaugaagggagacugcauggauguauuuaacaauuguagauuucuuuuuuuagaggcagagauaagaccuuacauucuuuuaacuuccauuauauccagaagaugguuuauguccauauauguauauauauuuuauaugcauauauuuagugaauauuuguuaaaugaaagaaaauauugagccauuauuuucuucucuauuuaacaauuccguuuugauuuucaguauuuagaaaugauggaauuagauauaggagaugccacccaaguuuauauagcauucuugguuuaccuggaucucauggagaguaaguugcuuguuuauauugguuugcuauuggggugugggagguuggggcauuggguuguuauguaggguuguucacauauaauaagcaaacaucuuuucauuuauuauuaauuuugccaguuaauuuuacauuucuuuauugauuuacauugggacuuacuaggucauggaaaagauuagaaaaacaaagagaggagguaauauuacgagugcaguuuguucagcugaguauuagaaguuuagaaugcuuaucuuugcuuuugaaugagugcauauguccauucuugaugcucuuucagguaaaaguuggcaugaaguaaacuguguaggaauaccagaacuacaacucaucugccuccuuggcacugagaucgaaggggaagggcugcagacgguggugccuacacccauuucugcuucccucagccauaauaggugagcgaggacuuuuguccuaguuuaaaagauccuugccuguuagacucuuuguggauuuucuuucuuucuuguuuuuuucuucacuuuuauaaguucuuuuuauauuuuugucaauaaucuuucauugguuguauguuccaguuuuuaaauccaccccgugacauuuuuaagguacgcuuuaacaaguaacaucauaauuugaguauaaccccaugcacccauccuuucuuucaugaucaccauuguugugccuagcuuaagguguauuuccugcuuggcauucuaaguaaagguuuuuaauuucuaaaagguagcaggagauccuguguuugaaaaaugacagaggaggaaaagggcuuccuuucuccugaauaaccucugucccccucauuuucaacagagcuccccgacauuuaaucaguuaccaccccuuggaguucccagccuccacagugcagucaggccggagugugguuguuguuggggaucacggcuucauucccaggcccucuguggaucuauuauguuguuuauaucugcuagguuuguuaaguuagggagaaaauauuucugucaacuuucucuagauuuuccaaucuuuuggaauuuagguuuuuccaacaguuccuuaaugagccucugaauuuuauuaguaucugucauaauaucauccuuucaucuccagauuuaccaguucaggccuucgccaucuuuggcuauguugaguaaguguuuguuuuaucuuuuuaaagaaugagcucuuagagucauuggcucuuggucuauuguauguuauauuuccauuucauugauuucugcuccaucauuauuauuuuuccaucuauuaauuuugaguuuggcuuuucuuguguuucugaaaccucagguacaucauuaaguuauucuuaaugcuuucuuccuacuaauugcuauaucccuaaguucuuuuagaugagaaaggcuuucacuacuggcgcuguccugcaguugcagauguguaacuaaugagcacguucuaggcagcgccugauggaaugacugggacaugauggcguugaucccugccuccugacugcuaaggugucccugggggaggacugcugucaguuuacacugugacugucaguauagaagaagagagauuccauguauaacuggcaaaggcuuauuuagauuaaaugguuacugugacucuacuggccugacacucacugagaaggcuuggcugcagggccagugagcucuagagacuccugccugccuucccaguguugggaucuuaggcacaggcccucaugcucgcuccuauugugguuguuauuuuuuaguggggauuuugagguccucaugcuggugcagcaggcacuguagugccuaagcuucccucuauauuuuuaaugcucugcacuucugacgacaccauaaauaacgucuuuauuaauagggaaaugggaaguauacuaaaccugcuggguacaguuucauauguauuuacaauaguaacuucuuguguacauucagaguucuggagucuguaaaacugggcagcuggcacuuaugaccuguagcuugugucaacuacagugcaguuauaggaugugccuuuaguguagacaaacaguccuacugugucaguucaaccauuagcucucuugcuguuugaguguugaguggcaaacagauagauuuaguuacauggcuuauucuuuaugcuauagaguguauauuuguugauuucuuaaaaguuaauaguucugggcaguucuuauuaucaguucuuucuuuugguuuuucgagacaggguuucucuguauagcccuggcuguccuggaauucacuuuguagaccaggcuggccucaaacucagaaauccgccugccucugccucccgagugcugggauuaaaggcgugcaccaccacgcccggcuuauuaucauuucuuaaugucacuguauaucuggguacauuuuucagaauuucuggacuuuuuuguguccauuuccuacuugcuuucccaggcuuugguccggguggcuuuguuuuuguaguuucugguacuagacaggcagaauucauucuauuacuaauauagacccacagcuauucaaguauaguuaauguagugugucacaguuuucaaucucagaagguugugugugugugugugugugugugugaaugucucacaguuuucagucucagaagauuuuauguguguguguguguugugugaaauauauaaaaaaacaaggcacccaugcuagcaccagcuaauuucuaguaucacaguuuccccgccgcuagggucuccaugguccccaaccugcagaggauccugcucacauucccagccaaccaccccuugagguuagcugucacaaaucccuguaaacagguaaaaucaaaacucuagaggccuguaauuuaucagucagauuaauauuagucaauucucaccccacgaaacacccgcacaaugagcucaaaacucaguugauauaaacacaagcuacacacuuaggguaaacgcauccuacuuauuauuuaaucaccuaagaaauccccaauacuuauggcucccaggacugugugguucuggcuccucuuccucuccuauagguuccaucuugucucuuccucuccaucucccccucuucccucagucucuaauucucagcccaccuucuuuuuccacugcccaaucauaagcuagccuuacccuucaccugcuuucaccuacuuacagcaaucuacgaguguguguguauccuucugaaaauaguaguuuaauuacucuuccuuugggggaauaaaauuugcaaaacgucuguuucuaauuaguggggauauuaggcugauggauaggaguugucuauuugcuauuguuucuuuuuuauuuacaauauuuucuagauaauuuuuaguuugcauuaugaaauaauaaauuagcaugguguguccucagcuuguguucuacuuaaauaagucucagggaucuaaggaguccguauaaccucaguaacgcccauggaugugagcgcuuucuccagacaaagcaguguguggagucacacucauagauuuccagaggacacagagcugauggauuuaaagaugaagacagggggcuggcgagauggcucaguugguaagagcacugacugcucuucugaagguccucaguucaaaucccagcaaccacaugguggcucacaacuaccuauaaugagaauugauguccucuucuggcauaucugaagacagcuacaguguacuuauauauaauacuaaauaaaucuuugggacugagcaagcggaguugaccagagcgaguggggacaaccagagcgggcacagauccuaaaaaaaaaaauucaauucugaacaaccaucuguucagcuacaguguaccuauauacauuaaauaaauauaaauaaauaaauaaauaaauaaauaaauaaaaauaaagaugaaggcuggggauguagcucaguggguaaaagugcuugcuaugcaagccuaagggccugaguucaaauccccagcaccuaugucaaaagccagcugugugccuguaacuccaauguugggggcagagauaggcagaucuugagagcuugcuggccagucagccuagcaaaacaaugagguucugugagggagucuacuuuaaaggaaugagguagagagaacaauuaaagaagacauucagcauccucuucuggccccuucaugugugcaacuaugcacaccccuaccccacccuccccaucacacacacacuuagaacaaugugagaccacaaggaagccugcgucaguuugagucguguccuaucuuuuucaguguggauuuugaaaaugaaguaaaauuuauguuuagguaguuucucuuugggugaaaauuaaaacuaaguguuuuaccaugaucauauauauugacagcuguuagaauacacacuccuucaaagaaaagcuacugugccauugagagccacaccugagucaggauuacagcguuucagguguuuggaguaggguuaaguacagguaguuguaaaggggagauauuuuaaguaccuuacagcaaggcucagaauaaaagacgagggaaaagggguuuucuguuucugauuaccaguguuuuguuucuucuagagagaccuuacauccugucucaaguucagugucaaugcaguguucucagccugugggucacaacccccuggaggacaaacaaccuuuucacaggaguugcauaucagauaucuugcauaucagauguuuccauuacgacucauaacaguagcaaaauuacaguuaugaaauauuaaugacagugauuucaugguuagggucgucacaacaugaggaacucuuaaagggucacagcauuagaaaggcugaggacuaaacacugguuuaguaagauguuaaagaggcugaaacuagaaccauagcuggguaucuaagcccuucuguaugguuaaaaugaacugggaagaauugauucuuuauacgauuauaaaauccacaguuauggagugugguuuucacaucauguucagucuccuuuguuuuaagaugguaaagguuguccuugcugauagcucugcauugcugaucugucacacugacucaacuguaaagcuuccucaguguuagagggcagugcaaaugggacggagccuuccagacacacauuagagcuuucucugagucacucagauguccucuugcuuggcaugacuucugguucgagugucacugcagaucagcaagcagcuucagcacucucaucugucccccagcuuaccucuagaaaauggaaagucuacggccuugccguagggcaucggguucaaggggacuccuuuggcaagauuccuguacagugaaacaauauuggagccaaaguuaggauuuuugguuuuccuaaucuauauuauuuaggcaugccauauccuguuugccauaacccucucagaagaauucaccuccuucuuccuauagugaacuaaguaaauuguaguucuuuuucauuuguuauuuuucucuauauagccuucgaagaccaccaauaguaauuuuucuuuaagugacaugauuacauacacaaguacuuuaucagcuauuaguguuggcccugcaagauaccacagcaguuuccuacacaauauaaauggaugaauuauuuauuuguaugccaguugaacuaauagauuugcagggagaagaugauauuuuaaaacagugagcuguauagagaaaauuaaaauuauguuuacuguucuuacauuaaaaugauaaauguuaagauguaaauaaucauauuuuuuaaccauuaaguacagugcauguaaauuaaugugaauguaauucuagacuauuggaaggcaaaauaggaggauguuuugguuuggggagaggauaagaagguaaauuucagauugcuccugauuuuucuccuuuauaguggagaccuggggucaagggaacaaaguaucacagaccuuuccuacaggaugcccagaguccagggucgagagcaacagauuacacucagugugguuaauguacagagggaugugacuacaguacuucagaagacugcagagggaggagacagaagucuaaugguauaggaggagguggggagucuggaguguucccuggaugacaagcuauuugaaagaaguacagaccuugagauggacaaggagggucccagcagcugccaugguggaaacaaugguugagccugagcaagcugagagccauggcuggcugguugugaacgggugugcacuaauggcagaggcagcagcuucccacaugggugagggcucuguguuuuguguccaaguucauuuaugcaugugaguugggcaagggucaggagaugagaacaaguggaggagugggguggaguggagaggagaaacggaaagaauguuuaaaaagucaccaucggggcagcaggaucuccaggagaagcagccugguaaggaagaggagagugggauaugagcguaagggguucagagguaagagagcagagcagagagcagagcaggaguuuugucacugcgagggcuuuaggaaacagcaguagguccugaaaggugagucagcuauggggguguucauuuguuuuccauuagggaucccagcugaugguguaagaggcuguuagugagggugugcgggcgcuccuucacaucccuuuccucugcugaaccuuuccaaguuccuggccucuagguguugccgugcucugggacgcagucuuccucuucaggcucacugccuagcagccuccucagcccaugguuaagugucaccacuacacugacgccuccacaauuuauaucuccauauuuccacuuuaaccggcacugugaacuucaaacucauauauguaacucuuuacuugauaugucuaccguguucuaaaaggugaccaaugagcaugccaaagaagaacugauguguccuacaucugcuccuucugugaguucugcaggucaggaaguagcaacacacacacgcacacacaccacacgcacacacacacaccccacacacacgggggcggggggagagagagaaugagagagagagagagagagagagagagaaagaaugaauguauauggguggagaaaauacauauuuuucuugcuacuccuuauauuugaugacaaguaaucaaacacuuuccuucucuaaaauacgcccagaaucucagucccuucccaucgcggccacagcuucuuuacuguggcuugagcuaccgucuccccuucuggacuuacugagguguuagguuacuauucuuggcucauuaaaugauaggcaacauaucauggguuugguauuagauccacagagggggaccucacuucauucuuuccuuuaaccccagugccuagacuggugcaugguacacagagcucaguauguguugaguggcuaagcuucugagccagagacuugauagguaguacaguaaagaauauaagggugcauguuaaccauauguccuuucaagaguuuacagagagaggguuagaggggcaugugucuggacacugccauucguuugcagaaucucaccuuucccugucuuucugcuguaacugcuuaccugacaaaggucaccagucugacgaggcaauccgcaaugucuuuugguauccuuaccuuccauggcggucuuucucacccauauguacccugcccuuucacccucuguccccaugcgguguuucacaaaaugaaagguuagaaguuucuuuucgucauuucuaaucauuauuaguauuuuaauuguuuuuucucaagacaggauguuacucuauagcccugccuauguuggcauucacuuuguagcccaggcuggcggguugaugauccuccgccuuccucuccugagugcuggaguuauagacacgagcuuccacaucugacugagccuuaguacagaagugcuacaguuuuuucugaauuacaacuuuguucuuuaaaaauacuccuuucugaaagcauggcuuuuauuguaaguuuacuuaauggccacuuacuugaggccugaagucugguaacugauucaaugaccugcacuguuuggccuccgucauagucaggacacacguccucucgcagccucugccggggucugcugcuugcugauggaaccccagcucuggccacagcucacagugacacuuuucuuaacccuaaggaaaaaaauuguaagcucauaucuuuuauuuauuuauuuuagcaaaaugacuuccaggugaggugacuagccacacaggcacuugauucuucagcaaauccccacugagaguucaggugccuuguuguuguuuuucuuaaaaaaaaaaacaaaaacaaaaacaaaaaccugggacauuugaccugauucccacagagguggccuguucucuucaggccugagcucggggaagaacacagugaauuuugagccauugcagagcucaaaggcagggauuuugucagggaugccuuccauuauagcaugcugaggcuggugaagaagucagggccuuuuauagauagagucacaguguauccuacuuggcuauugaguacagaaggaucugugaaucaaaauuaauaugauucuuaauucauggugcauuuuauuucaaugcauuuaguuaagaguaauacuuuacucaguuucuuauucucacugcaaaucuguaaagauuccacugucuuuguuuuagggucauuagagaaaaauaauauuuaagauuuauggaaaaggcuuaaauaaucuggcucuggacguuauagccaaaugguguugaguuugucuuugguuauacuaaguuauuaaaaaucagugcccuauuuucagcauacagaggucaccugugaagaauuaucaaaaggagaacucugccagcagcaucaaauuuugcuauugauaaucaacagcuaugauuauuaucaacauacccuuuucuuuaguugagacuuucuccgugaaauuucacuaaguagaaaagaaacccuuguucagauguagaguucucucguuucuaaguaagauuucacauuuauugaaaauucaauguuauccuucagugugucuuaccagucauguuauuuuuaaaguagaaccucagaacaucugauguuauccauauuuuuuaauaauuaagcaaugaccugcuggcuuaaguauuuuuaugagcuuauacaguguacuuuaaagggaacaaagaauaaagucugacuacggagaugauggcucuauauuaaacacauguucauaguagacuagacaugauuuugaagaggaaacuuuguaaaacugcccagcuguggucaggcaguagcuaggcaccguucuguccucuaucccugugaagacacacugguaguuuucccacucacugcaccaagugggauaaacaggagcucggagaugggaacuuccauuuaaguuggcaguaauuucccuuagcucugagaacaaaaccucuuuuacaacucuggaguuaaaucucuaaucuaagaauguuuugguguugaggauuccgaaaacaaguaugagccgagacugaaaggacaacagucaaugcaguggacguuuccauccucacuggcagugugagaugugcgugccucgcccaggucaccaccucaccuuaggagaugugcacaugugcacacacagaagcacacacacgaacacacacacaaacacacagaggcaugcauggacauacagaagcacacacacauagacacauacagguguacacaugcacaaauacucaccuaccuuuaauuuaaaaaauaauaauguuuaaaaaagagaaauugaauacaguugucuuaacaagaucuuucuuucuguccuuucucucuucucucucuuuucucucuccucucuuucucucuucucucucucucuucucucucucucuucucucuuucucuucuuucucucucucuucuuucucucuuuucuuucuuccuuccuucuucccuuccuucuuuccuucccuucccccuucccuucccccuucccuucccucuucccuucccacuuccuccuccuucccccuuuccuccucuuccccuuccgccuccuuccucccccuuccuucuccuccccccuucuccuccucccuuucucccccaucccccuuccucccccuuccuccuccucccccuccccccuuccucccccuccccccuuccuccccuuccuccuccuuccucccccuuccuccuccuuccucccucuuccuccuucccuucccucccuuccuuuccuuuucuuuuuugucucuguccugaucucaccauaguuugccaguuaagcauaugucuuagucaggguuucuauuccugcacaaacaucaugaccaagaagcaaguuggggggggaaaggguuuauucagcuuacauuuccacauugcuguucaucacugaaagaagucaggacuggaacucaagcaggucaggaagcaggagcugaugcagaggccauggagggauguuauuuacuggcuuccuuccccuggcuugcucagccugcucucuuauagaaccaagacuacaagcccagagaugaucccacccacaaggaccuuucccccuugaucacuaauugagaaaaugccuuacaguuggaucuuauggaggcauuuucucaacugaagcuccuuugucugugauaacuccagcugugucaaguugacacaaaacuagccaguacagcauacuuagagaaauuuacuuucagcguguccauuacaggguuuaugggcauugacuaggcucuguguauguuguauacugaggaagaagcagugcgagcggcuaagagcaguguugcucuugcagaagccucugguuuuaugcccggcaccuauauggcagcuggcugguaacugcaguuccagaggcuccaacacccucuucugugggcgccgcacacacgugagagauagauauguauaggcaaaacacucacauacagaaauaauuuuuaacgagcaauauuugacaauuuaaacaaauaaggggagaauggaauuaacuuuugagugaggaaaugaugccagagaauagugugaauaaaggaauaucagaagucuugagaauguuaacauaaaagacucuaauguggcuuccucugauugacuugggacagacaaaccaaaaacaggccuuacaacaacaggagcaccgcugggccaguggguaaccaauggggaguuacauagucaaggcagugguuauaaaccccauggaaaagcaagaggcgcguuuguuacagucaguucauuacuuuucagauauuuugaguuagggucucacuguguaagcccuggcugaccaggaacucuguaaacuagucuucucucuaauuuccugugacucuccugccucagucucccaggcugggaguacaggugucuuccaucacaacagcccucuaaucuguuuaaaauaauagacccaagugucacuuuguuucaguaaguaaccaaguuggaaaacaggaaaauuaacaucuaugguccucagccaauuagauacacagaacacuguaguuguaguuguuguuguuuuauagguuucagacucagcuaacccggagagagugaaaaggcaguauguaggccuuucuuagggugucugugugagaggacagcuucagauguucccauuugagccuacagacauggccuuagcauuuuggaugccauguccuaccuuucccucaagaacuuauacuguuuggucuuacuguuaauugaguaaccaugagucucaaacaaacuuugucuucauuuucaggauaagggaaaucuugaaggcgucuagaaaguugcaaggcgauccagaacugccgaugucuuuuacuuuggccauaguggagucagauuccacaauagucuauuauaaacuuaccgauggauuuaugcugccagacccucaggucaguuuugaagugauucacaggaaacaguaaugggagagagaggcguggccugaccccaaguguggaucaggcuucuacuucuuuugccaugugagaaauucaaggcaaaaaaggcuugguuuuuauuccucagauaagaaaaggccgcuuuuuccuagcuguuuuuugaagaaauaauuuaauuuuccuguucugugaagaauaucccauuuuuccagagcauuuugugcagucaugcaucuaaguagcuggagugaaaugcaaaggccaguaacggcuguagucaguugcuuacugagaaaacccugaguuaacguucugucccuaacauuuuaguacaugucugguauuugcuugcucagcauuuguccaccuaagugugauaguuacauuaaauaucuuuauaauuuuagucuugcaugugcugucuauuaguugcacucugaccuucuuccucuguguugcagaauauuucucuuagaagaugacaucugcccuucuuggugcugacuucaguucugaaagauuggaugugaggcuccucagcgagcugcucgucuuuuaucucagagguagucagggcugacuuagcuagucccaacccauaaacuuccuuucagaauaaagccuucuccgauggaagcacuauauugcuugcaaauauaguuagccuagaacuuucuuaucagagacaguacaguugcaugcggguuuacaccaaggauacgugcagaguuguggagccuggcagugccucugccaucccacguagucgauagacagguaucagugagugguacggagaaaacgcuacagcaagaaaacggacacaagagcauuaacguggucaugggugugaaugacacgccaggcuaugaaagugacaaucagauuacugauaguggucucaguaggauggcaggcagcaaguggaugccuuuguccuucuccacauuucauuugucauuuguauuacuuuuauaauaaaacgguuuaaaauaaaaaauaucuugaaauc

SEQ ID NO: 423 - RNA, 9070 nt, Mus musculus
ggggcggagcgggggcugaaggauggcugcaagcagaggaggaggccgagcccgcuagcgcgcaggcccagaagcuugcaagccgcggcugccggcgacgccccagagcggaagagggaagugagucggaccgggcugggcucgcuaaaggagaggcaccgcggaggggcaggccagcgucgcgucgcgauccgggaugucgaagaacacggugucgucggcccgcuuccggaagguggacguggacgaauaugacgagaacaaguucguggacgaggaggacggcggcgauggccaggccgggcccgacgagggcgagguggacucgugccuacggcaauauccuuacgcucgcggcggccggggguuguggggacgcggggccacgcgaccggcugugcccggcucuagguggggacggaggacaggagcucccggggccagcaggccgccuguaccccgcggccgcgccggcgaacuuaccggcggcgccccgauuccucaggugcgcgguccuaagcggccgcgcccuccccggggcaccgcugguguccuagugggcaccugagccagucucugcccgguggggacacgggcgucccgcuuggagucuugcuuuccuguccggugugugugguuggcggagcggggauaguuuaucccuagccaggagagauggagcgguucgcaaaucgaggcccucgguacauucagccccggggcuauuucaucggcagcauuguuuauuaagagagaagggcuuuggcaagguggcauuauaauucaugaacgagccgaagggaguuuucuucuccaaaauucccaguuaaagcuuggaaccuuucaccugcuaagaaaaggccacuaaaaaagggauagcgaaugcaugcagagaaucccugggaauaauauaagaugaaccccagugaauaaagcagagaaugagucgguucuauaaaucaacauuguuuuucugaaauuguuucccuucuaguuaaaacauggcugucaguuccugguuccuugguuugcauaucugaauauucauaaccucgaaauucauuugcaucgaucccuuagaaaaauagaauguuacaaaaauccaaacuggagcuuuagaaaaaucguauucauuaagucuguucauacagcucuccccucaucaauuuucuacuagauuauaaugaagaaagugagcaaaaacagugguaaccacagcaucaaacguacauauaugugcaguauagguuuaacuuucauuaccauaacuuucacaguuguuacuaauuugauuauuuguuaaaauacuuggguuuuuuuuuucuuuaaaagaccaugcaggcuugacaguaguuuauuaccuacuguagauaauuuuuuauuagacccuuugcacagaaauggugagcuuauucuuuguuuguuuggguuuuuuuuuuuuuuuuuuuuuuuuuuuuuuuuuagucuuuaugguggauauaugauauuuuauuaaacuaauguauuuuagguaauuucuggugauuccuacugcuguguucauuaucaauucagucuaccuuuuugucaauccauuuuaaaauauaaagauauugucucugguucuaacuaggagagacuucagauuggucggguacuacagauggaggaaccagugacucuguuucuccuuuuagggaaaugacugucuguucugacagucugauuggccuuccguuuccccugcuugcuaacucaccagugcuuucagagacugaguagguauggaugguccagcccaguuugaauaaccuguaggaaauaaaguaagcugccaccuacaggucgugcggguuacuacaucauccagagcccuguucauauuaagcuauucuuccauucugauugccagaauaaucagccagcauuucaguuaauacacaguguaguuucaguauaaagucuaggguuguuuuccagcaagagucacacagacaagugguauacuuuguugguaaacugcaucauuuggugaccuaauaauucuuaacacauagucuuaagauuucuugaauacccaucuagacaauugcguguaucucacuggaaaguguaaucuauuugacugauagaacugaggucaaaacagucuuugcuuuuuuuuuuuaaaucuauuguuuaauuccaguauuuuuaccauugguugacaugugggaaacacacccaugcaguuucuaauaucgaacauaaugaccauaguaacuuuuguuacugugcagaaagucaagucaaaaaccaauauuccuguaaagcaggggccauccuuuucuguuccacccuuaaccuucguuacaggaaacaugacagcugcucuccaggcugcucugaaaaaccccccuauuaacacaaagagccaggcagugaaggugaguuucagacuacagcauuaaucucuucuguuucacuauuagcaaaguccuuugaugccccacagucaacauuguaccuauuuccuguccuugacacaagaguuuacagugugacuuuugagacugaaccgcagucuauaaccuggucugaaacucaggagaucuccugccuccacugggauuaaagguauaugccaccacguccagcuuuaaagggagcuugugacaaguaaaaaugucaugaaaaaaauagcccugaaauguagaguuaggagagugccguguggagugcaguaaauuuaaaggauagagccaucacuucugcgugugcuucaggaggaauccacucagguuggauuuaaaugggcuugaaaaauaaauuugccaaacacacacagcugcuucuugauuuccuaauuuuguaaauauuaaauauuauagaaaacaaagcaugcgugaccuuaaaaaggugaucucuguccuacuuccuugggucuuauaguuuuuccuaauuuuguaaauauuauagaaaacaaagcaugcaagcuuaaaaaggugaucuccaugcuauuccuugggucucagucacugccuuauaugguaucgcugcacaccuaaggaguuucuacaaggguuugugcucuuuuaaaaaauaaauagaaucuuacacuccagcuguguagucauguacaugaucuucuuuccuuagcaauagauuauuucuguggcauuuaacugcuauacacuaguauguaacaucuuauaugcaacugaucccuguuauugcauguuagauuuucuaguuuuuccugcuaaaauugaucauuuuaaaucuuaauuauuuaugucaauaaaauucccagaagagaaaugcuagcacaaaaaugacauuuuuuaaagacuuuugauacacaaagcauugccaaaucucucagaagagcuuuguagcuuacaucccuacaucagcccuccacugauucuuagggaacugcuuaguuguuuauuguuuaaaaugcaggcuaagcaaagcccuguaaaagccuacaucucaggaaccuaagaaccuuaauugaagaguaauauguaaaaacauaauaauuauugcagccacaaaacuuuauauuggggaauuuuuuuucuuugcuccuuaaaaguuguuaggaacaucauuaaauuuucaauuuuaccccuucugauuuuaugugguuuuguuuguuuguuuguugauuuuguuuuuuggcagcuuguggauaggagguuauagcucuagaugcaaagauauauagggaaaugucagucagucuuuaaacugaagagaacguuggcgguacaaacauuauguaaaaccccgcccauaggaacuccgaagaccccacuguguugaacagaaggagcagugaacagcugagaggguggcuuccguguccccucugcuuagacaaugccuaaggggacaccugugcuucuggaacaggcucucccagaggagaaguucagagauaaguauagguaaaucuaacgucuguaaguaggaaaguuuaaaaaguuuuacaugguuuuaaaagggaucuuuuaagaaaauaaccacucuugaaagaucaaacaagauagaauuacauaaaucaguuuuuuucuuugguuaggaguuuuuaagaccaagaaguaaauuuaaauguuauaauaaauuguuaaauuuucccaucaguccaucagucuaucaguccccaguucugccuucaguucuaucaaaaaaaauguguuccugagcuggacgugggcgcgcacggacgugggcgcacacccuuaaucccacagcucaggaggcagaagcaggcgggggucugugggcuccagaccauccuguucugcagaguaaccuccaggacagccacagcuacaaggaggaacccggucucuaaaacagcaaaccaacaaagagaggggguucccuucuuaccaccucgacucacaugccagccagaaccagccaguguuguuggaaucaccccagugggcuuuugucuuacuccugcccucacugcuguccuccagacagucuuaaaaugggaaacagauugggucacugcucuugaauuucuccaccgugucguuucccaguaaaagccugagccauuacaguggcccgcuggcccucacauggccuguccucuccugucuucucucuuuugcuccugcuucugccaccacacagcucugucacaccagaaucuuuggaacacucugaacgcucugaaacccacgcucacagcacuuguucuuccuucaucuaaucgcuggccauguucccaaggagucuucuuucacauccuccacgucagucuugagaugucacucuagcagggccuuccuaagguuuugugcccagcauacacaugucuaaauauucuguuccacauuugcccucaggaccgugcaggcagcaucgucuugaaggugcuuaucucuuuuaaagcuaaugauauugaaaaggcagugcagucucuggacaagaacgguguggaccuccuaaugaaguauauuuauaaaggcuuugagagcccaucugacaacagcagugcuguguugcuccaguggcaugaaaagguaaguuacaauuuacacaucccuguagcuggcuccuuuaaaauggaagaugccaccucugucaccugagaagugacuugacuguacaccuugacuaaaaugaaaaguuuacauuugcuuaccagccuugaucuuaaaggauuccuuuuugcacugcauauuuauuugcauauacuuaguacauaagugauuauguacuugaaauaugaauucuuuuacauuaaucaaaggauagaaauagcugggcagugguggcauccaccuuuaaucccagcacuuggcagaggcaggcggauuucugaguucgaggccugccuggucuacagagugaguuccaggacagccaggguuauacagagaaacccugucucaaaaaaaccaaaaaaaaaaaaggauagaaauaacccaagauaaagauuaauauaugguaccuagaaacagugggguguuacucauccauggaagggaauggaguuuuuguacauucuacaauauagauaaaucccagcaacuacaugauggcucacaaccauccguaaugagaucugacacccucuucuggugacacugaagacagcuacaguguacuuauauauaauaauaaauaaaucuuuaaaacaaaaaagaaguauuuauauuucuacuugugugaaauagucugaaauaggcaagcucaaagggaucgaaaguuauaauaaguugccaaaggccauggagaaggaguauuugccuagcauucuugguugaucucaugcacuguaguuuuguauuucaaaaauuguuaucggcauguauggcaguguaugucucuagagagagguaucccaggccaagcuggucuacauaaugaauuauaugcuguacugggaggcuggucucagggaggaagagaaaaggaaauuauuuuuaguucuguauaagaauuuaguagauagaugaaccaggugacucaguugguuagaauuucgugccagcaaacuugacaacuugacucauucucugaggcccacauaaugggcagaaagaacugacuaccuacacacacacacauucacguacauuguacccacauacauguacacaaagcaagcuuucauaccuagcucuuguacugauaaaauacuaacaauaacauagccacaucucuccauagaaacgcugggauuccagguguuaaccauucaauuugccuaugauuuuuuuuguguacauugugggaauguaacucugugaguuagcacuuuugaugugcugagccauccuucagacccugaaaaucaguucuuuuuaaaaacccuugucuuaagucggagugaaaacauguguauaagauaaaacuaaaaggaaauuuuguuguugagccuuaguuaaaucacuuuaucuacauacacuaccaaagagcuauuugugaaagccuuccuugcaguauuccgguaucguauccguccuaaguacagugcgcccucucgcugaacggaacuuguggaguaauuuguauggucaucuuauuuggacucuauuugcaggcucucucuauucuugcucacauuucauuuauuucucuuugacagagguggguaguuuuucaagacaggggcucuguguguaucuuggcuguccuggaauucacucuguagaccaggcuuggccuugaacucagagccauugccuuugucucguggggugcugggauuaaagacgugcaccaccaacacccagauucaguacuagaaggagaaacucacuuuggugaggagagcagcacauauguugucugguuuuuccagaucucuccgggguugacuuucugaguacuccucaagugcaucuguaccaguaggucucuaaugcacacuuugcggcaucucagagugacugcuauaguguccuaacugauuugcaccauucuguuuucuacccaacugcuggaaagugaucuaaaauccaaagguaucuugucauucauugacgacccauuuauuucacucuuccuuaggccucagcaguaccagccuuucccugagugcaccccacccucacaccuccacacuggcuuuugguaucuggcugucagcuucccugacaucucuugcuguccggcuaggcauaugcccuuacucugcuuuuguagaacucgaagauagcacacagcacuucauacacaauacugaaauauucuucuuguauaacuguuaaccaaauaaguacaccaaaauuuccaacugcuaauauuuaaucaugacucccagguauucaagucagagauuccaaguuagagaucagcucuuagcucuuaaguaauaccuucuuaccauggggggaaaucugcaaacugaguggaaguugggguaacuggucccagccucagguucuucccaaccucagugagggagggagauggcgaauguccuggguuuauauuugaacguuuuaguuagaaacauugugcuacagacauccuaaacauucuuuagacaagguguacuagaagagugacuagcgucuguuuggaaguaaguucacaggggcuggagccugagaggcuggucuuuguuauguguuaaguccuaguaguaagacugucaucagcuuuaugcugagaccggccugggccauagaggaugcucaggaagaacuuaccaaguuaaugaguucgggguucugccuaaccuuagacugacuucccuuugaccucuucuguguauuugguuuguuuuaggcccuugcugcuggaggagugggguccauuguucgaguuuugacugcaaggaaaaccguguaguccagcuggaacuggacaccguucacagaagugggaguugcugguauaaagaccaaaacaaccaaauggcaccgcugcccuguggguagcaucuguuucucucagcuuugccuucuugcuuccuuuuucauaucuguaaagaagaaaauuacauaucaguuuccuuuaaugaaaauugaaauaauguggagaaaauuuugucucaguggggauguuugacccuuucauaaccaugucaauaauauguaucacauucuguaauuuauauucaaguuugauugugcaauuucuaacucuguugccugguuuaaggguuuuacuuuauuuuuaaccaauacugagagaugugaucaaaguugaggccaguuuccuaacucauugcuggucaggaagugaucuuuauuuuuaaaaaugagagacuggcagcuauuaacauugcaaaacuggaccacacuucccuuauuuaagcaaaauguguuuccagggcaaguagugggugagcccuacuaccaguuuccagccuucuuuccgcuugccuccagaugaugcuauaaguguaagugugcuacuuccuguuagcauccaacuuucauggccucucaaucucuuuguggugacccaggguccggagcaaggagucuugcucuauauaaauguauuuacacaauauaagcgccucuuuggcacaaacaucccauuuccuucugguaauaaggcugccuggggaaacagucccaagucagagacaggccuccagcagccucuggaugaaauacuuucaucagaaauaagguagcugccuuagccauuacacaaguguucacuggaacauuucccaugauuucccgaggacgucuucaguguucuucagguaauggggaucucagaagauuugguucugauccaaagacacagucuguguuucagcucaguguuuuuaagaaagaaaaaugccacauaguaaaagaaaaaaaguguuuacuucguuggacaaaccaaauugauucucaaaaaaugaccggugcuuguaaaaaguuauuacaaaguaguuccgaaaccaaccaccugaaugugcguggccgagagggaaucagccugcuugucuuucccuaagaugccaacuccagagucacugacugaggugagaaccagcgcagaaacucuauaaacugcuguuuuugauaccugcucuuuuuguuuuguucuguuuuguaaaauuaugauaaacuucagaaaauaaaaugucaguguugaauaauuuuuuucuuaauugaau

SEQ ID NO: 424 - RNA, 65659 nt, Mus musculus
aggagucggaggagaggaagauggcggcgaccgccagcacccgcggggccgcggggccgcuccgaggagccugagagacccacggaggcuucgcggcgagacgcggcggcggaggaugagccugcagagcgcgcaguaucuccggugagcgccggagcuuggccgaggcgugguggcgacgggggaaggggaggcucucggggggccgaggaccggcggacucggaagcggugggggagucgcggcguccuucuguccccagggcggggaggccgagcgcggggccgagcgggcggcugcgggagggggcgggcacacacauggcugccuggcccccgggaagccgggcgagccgcgcuccgggggaagccgggcgaggagcggagggagguuggggaagcgggagacgagaacgugugugugagugugugugugugcgugugcgcgcgcgcgcgcgcgccucuggucgcaggcugcggggccgggguaggggagaggagagccggcagcgacccagagucgaggugggugugaaggggucuggagcccacggcccgggaaacguggugugcuggccggggcgaugcaggagagaggaggauggaagucggcacaccuggggguugggagggcgcauucuggagggcaaaugagaggaaggggagcccgcaggaaacgcgagcuuguucuuuagucgcgggcuggaaggaggagaaauaaugccuucuguccagaguuagaggggucggagagcccggaaagggggaaaaaggauggggagacgagggaagagggaggugcuacgaacaaggugauguucucgaaagaaacuguaguuggaagauaccauucugagagucgugugcauucauuaggugcgauguaaggaacuuguaugaaggagauagagugacccauggguacugggggugcgugcguguguauguguaugugugugugugugugugugugugugugugugagugucugggguaagggaggggaagcagggauugaugcacacuuaaagaagacucacaugcauuaacaccgacgucgagaacauuuugaauggaaagacagcagcuggugugcagucagaauaguuugacggauuuugagugagagcuuggaggaaacuagaggggaaaauacagccuucacaaugggaaauaagguugcuagugccugaggcuaauggaggaguugcuaagacugggaacuuacaaacuggccuuuuugucuuucaggaacaguguuuuucuuuuaaauagcaggucuuauuugggaagauacuuuuaaaaagugaguugaaaccuugaggagaagagaauugaauggguagauaacugaguaagauuuucuuuagcuguuuagacauaagugauguggaagucgauguguuaagaguggucccauauauauauuuauauugcaagagaauugauguuguucugugguaaacagaguggcuauucugucuuugaaaguaguuauucauuacacuggagagagaguggugggaucucugaaucuuugaugcaugaauuccagaguuuagcacaauguguaugccugauauuauaagguggcauucucuuuuuuuuccucuguuacccuuauuacugcauuaaguaaacuuuacagugagcugugaauauauaggugcaguagaaaaaaauagaaacuaccaggacaguucuuaaucuuaaggaaauuacaugauaauauccagugugugaguaaauuaauagcacagacuaauguagcuaucaccacaaaaagguaccauguuuuugaguccuagaugaccugagcaguugagggaaauaggaaaggcucucuuuguucaucugcucuuucuacuccuaugauucauugauugguugguuguucaccuguagguaaggcauuguaccaacugcuaagaauagagaguaaggacuccacccucuuacagaacuuacuaguuuguuagguuuuagaagaaaagaacacuuaaacuuuuauaaggauggacucuuccugacagcuguggauuaagaaagggagauucuaaauggaaggacauagauaauaaggaaauggaagggggagugguguuugguuaggcaagaaugcuggagggcuugaauggaguuuaacuuuuuucuuuugcagauuaggaaggugaguccaaagaagcuauugaggaucgaauggcugguguguaaaaacaaauucaaaugcuugucuuguagcuucaugucagcuuucugugcugcauaucuaugcucauucuuugcccaagugugaacugagggcuuucuauaaucuaggagcugagacuucacuggugaaacaagggugagcaugggguagucuaucuugauagaaagucaguaaacaugaacagauaaauacacuauaagguccuuugaaaugauagaaaggaaaauaaggccguguauuuuuauaugaacacaggaaaaccuauucuguaaucugaugcuagaagggucuuaaauuuuaugaucuuuaguuuauagauaaaauaaguagacaucagaaauauuaugaugagggauggauagagauaggaauauagcuucauuuguaacauagcaugcuugcuuacccugcacuaaauaaaacugaguauaauaaaguucgccuguaauccuaucauucugaaauaggaaacaggaagaucagaaguucaaggucauccacuauuuagcaaggucaaagccaccugggcuucauaaggcccugucucaaagaaagaaaucugagaugacuuguuaaaaggcaauuuguaagcccggcugugguggcacacgcuuuuaaucccagcgcuugggaggcagagacaagcagauuucugaguucgaagccagcuuggucuacagagugaguuccaggacagccagggcuacacagagaaacccugucucgaaaaaaacagcaacaacaaaaaggcauuuuguagguuuacagcuuugagaaaauuacugugucauaaacuauguggaccuuuagugcuugaaauaaggucuuggcaguuggaggauugugaugacaaacuggaaagugcugauacuuuuaaugcagagauagcuggcuuuuagaagcuucugugccaguguauaaaucugcuuggagggaagaauuacccuuagguuauggagucagugacagguuggugucaacuugacucugaagaauaaauuaaaauggaaugacggcuacaccuccagcugcaauccaauaggcaaaaagagaggcaugagcuauaggauaccuuccacguuucucagaucuguccuaaguaacaaaagcaaaccuuaagucugaugcuuagagaugcaugcaggaggaagggggcaguaacaagcauugugcuagcuuuaguuuuacucuuaggucaguuaaagacuacugcugggagacuggagacugucuucaaggaaacauuacuuugaauuucuuugaaaauagaacuuuuuaaaaaaauuuaguagauuuauuuuuauauguaugguguuuugccugcauuaaugucugcauucauguacugugaccauggaggccagaagaggguguuggauucuuuggaacuagaguuacagaugguugugauuggccauguggguucuggggaucuagccuccauuacaacagccagaguaugagccaucucuccaggcccccagaacagcuguugugguuuuuguuuuuguuuauuuuaauagaaauuaggggaugugaccugugaccuugacuuaaggaagaguugccuaccuuugucaaugggagaagaccaugacuggacaguuuuuaaacuguauaacuguagauuuucccucauguagaaugaaaauuuauuuucuccuagccaaauuuuaguuuguuagaguaaaguaagcaggggugucugguauugaaauggcgggguaguggaauuguaggggcaagguggcacuuucgaacagugagacauaugauuaugaugguaagaacaagaaaguaagggacucaacauuaaaggaacugaauucaucucaaagaaaaagcauaaaugaaaagaagaaaggcccuguacaggaaagagaugaugcugugaacaagacugcagauuucgaaagauuuaauauuuauaaaguaagaaauguccuuaaacacauguuaaccaaaucgaagcagaagucagauucuuucucuugaugugacaaaacgaaacuuuuuaaaaaaagagauugacacuuccuugaguaaaaggcuggauugaguuuaguuuuucuguuacgugcagaagggugaggguaggccauagaugagauuauaaguaaagcacaauauacuuuaaaauaauuauuuuauuucuuaaagaguuuggaaguuacauaccaaaggcacuuuuuugaguuucuguugcugugagaaaacagcaugggagaagcagguuuauuuucucuuacaguccaucaucacucagggaguucagggcagugacuggcgcacaagugauggagguguucucuuauuggguuguccuccauggcuuacucagccugcuucccuguaccacgaggaucucugcucccaaaaauguugagcccauccacaucaaucgauaaggaaaacacucuaaagacuugccuggagagaaucugauggagacauuuucccacuugaaaguucuaaccugugucacuuugacaaaaaucuagccaggacacacagaaaacugugugugugugugugugugugugugugugugugugugugugugugugugugagagagagagagagagagcacgagagcacgagagcgcgccagcgagcaguuuuaaagcaugagaaagagaagauauaaaaguuguucuagaauaugagaaagaguaaucauagucauagacaauaccagucacacaggucaaauccuauuauaaaaagugucagguauuaccaaauaacacuugcugucauugugagaguuacuauuccuauuuuguauacuuuccaacuuugcuuucuuuguuauucugucuuaaauuuucuucuaugauggguguuuuagugaagucaguuucaaguugauuuccuaguguuagauucuuuuacagaaaugguucauaaaugucugcuuugucaagaguugauacccuccauuggaaggucauucuagugucauauuccaugauagaaacuuuagaguaagaaaugaaacagcagccuuaaacuugucucugaggcaucagaaaaaugguugucuuuugaauuggaaggaaaauacuuccauauuauuguaagauaaaaauucaucaugguacaucuuggcugaggcuggguaaaguagcaagcguaaucauagacuggugaaagaagccaggagaauaggccauuaggaggaguaaauaacugaguggagugggcucuacuuucuagaacaaucugguaaugcugagucugggaggaagccucagaaagacuuguaagguguacacugguaaauccuugcgguccacacaguuguuguguuguuucccccaccuaucuacuccuucccaccacucguagccuuccuaggaugugaaguagccucaauuccagaaaaucaaacauggcugguuuaccaaauaugccaguuaaaaaaauaacuugaggcuuagaaauuuuuguuacaauaauguuaauaacgcuugcuuggauauugacuggcugaauuaucauguuuguuaauuucugcuuccuuugugguuucaguugaauuaaacauguauaccuccugucuuagcuacguuuuaauccuugcuuucacacagcugcugucaucugucuuuaugauggaggaagcagucacugagauuuuuguugauguuuuuaauggguaagucaugguaagagacuaauguagccaguuuccuguaaagcacuuguugggauacuguaagaggacuaguuuguuuuauacuguauuaaguuacugaaucuucagcuauaucucuaacccugacuagacuuuugaauuuuuauugugaaaauuuguaccugaaaguuuagaugggcuaguuuaucugauccucuuguucagagaugagcagacagguguauugaagaaagugguuuguuccuauguaugcauuugcugggaagguauauuuaguugcuguaguuagacuuagcagagagucugguagagugucacuaagaagagcuaaccaucaaccggaaaauaagagacacggcacaugguaaaggagagcuguaaccaacuccuuacucguuaacaugcaacugaacuugcucagggaaguuguuugaugccaaauucuuagucaguacaaacgagguaacuaauuguuuaagaaaauuuuagaaaucucagguacaccaauuaacaacucugguugucugcuuuuuuuuucuugauugcuucauuuugaaagggaauuuuauuuuugcaaagguuggcccugggcugccguagugggcuagagaugcuucaucuggauggucauggucuguuugugcaccuugugccauuagcagccuagccuccuuagccuaugcccaucuaaugccaguaucauucucccccaauguuaccauacuuugggagguguguaaauucucuaccagcugaggauagugauuguaaaaaguauauauguauggaugguauuguuaguuucauaucauuauagcaaauacuuacauagucaacuuacagagacaacagguuuauuucagcuuaguuucuggagguuucaaaucauggucaguuguuucuguugaguuuuguccucuggugagguagcagguguguguguguguguguguguguguguguguguucauuuguucauucauuaauguuacaguggcuaggaagcagaacaagagacucaaacccaagacuccuuugaggguacacauguguucaguaaccuaaaaccuccuaugagacgacccacuccgcccuccccacuaaccucccagaaguuccaauccagggaccaagccuuuuaauacuuguaccuuugggagauguucuaguuacaaauagacauagcaugugucucuuuuccuguaagcuauagauuauuucuuaagcuuucucaucaauuuucccuuagguaguacuaagcuagcuaccauguucauacucguagacacauguacuuauuucagcuugguuuuguaaauuugaguuuugcucuauuagcaguuacugaauauuacauguagagcaccaucccagagcuuuucagcagcaaguuuaaaguuacuggggacacaugaguagccggccaacuuacuacaugcuguaauagagaagcaaagguaauguguggauguagggaugcugcuuaguccaguagguggagaugggugaugagggcaucuugguggagaugagauuucacguaaauauugaaagaugagugggaguuuuaagggggagggaauugagcacauucauauuguacaaacaggcugagcuugcuuauacaucuuuuuuucaaauaccuuuuuaaaaauuguaucugcccugauguaaugcauaauauuaaauguucugaccaggcacauguuucucacagauaggagaagcagaggugugaaaauggcaauuugaacauuugguagcugguaugggucuuaaaaagggaaaagcuguuagguagggcuugucugagagccucaucuuuuccuugugcucuugacuauaccaugaccuauuucauuugugcuguuauuuucuuuacuaguguuuccugugaaacaaucuccuuuuuuuuuuucuuuuuccucuguauagccuuggcuguucuggaacucacuuuguugaccaggcuggccucgaacucagaaaucugccugccucugccucccgagugcugggaucaaaggcgugcacaacaaucuccuuuuuaaaagccuguuuucauucugauuuucccucugaauucuguuguucaugcuuuuuuauggcuaacuugaaguucauccugcugccuguuuauccuuuuuuuuuucuauuguucuuuauuacaucugcagaggcacuaaagaccucaugacccaguuugucaacucuuuuccuuacaucacaccuuuguuuucauaccucugauugugugucucucucuuaaauccaucuacacuaucgcucuaguucgguuugagccaguguauauauuucaggacucuggagauuaaaagagaccaugcuuucagcuguugagguuuucuugucugucugucugucugucugucugucugucagucaguauugauauagggucucacuguguaccgcuagcugaccugaaacucacucuguugaucaggcuagccucuuaacauagauccaccugcuucugccuccugauugcugggauuaaaguuggugaaccccuugcuugggugacuuuacuaagcauacauguacuuaauuauuauauaacucauauuagcuaugauuuaugcacacagccacaugaaaaguucuuaagcucugcugcuuucugcaaccuauucucauuacuugguccuguucuguccuguuucaccaaccaguggcaaauacaaaagcauggccuauucucuucucuccucccuucccucccucccuccccuccaccuccccuucccucccccuauguaguuucuuaaagcuuucucauuuuccucauuguaggugcucauugggauucuuucccucccuucacacuccagguucagccuugcagucauugaguucuccucaucucuuuaccuaacuccugcaugauuguaccacucuggaaguguugccuuucucuuguuuuucuuucuccucacugguucugugcauguuuuacucauacccuuccagccagugccuugccuuuaguucuuccugagaaauaagaagugcugaccggguuuuaaauacugcucauuccuuuguuguuuguaaaauggaacauggauaugaaaaaauaguguaacaaaugcugguucucucucagacuaaauccuuuuuucuucagacuccacaccaucuguccuaccacaaauacauauuuugcauugguuccaaguuaauauugaaaaaauauuuauguauggcuuuuccuuaauuauacuccuuaaucuggcauguugaccuuucauaaaaaaaaucuuaccuaauuuagucauuggugucaggaacaaaaacaaaaugauuugcccauugucuuugaacauggcauuuuuauuucagguuaaaacuauaggaaguucucucuuccauuagccuaguuagacaucacuuuuuaaacgaugacuuccuuguuuaccaauuucuuuuuuugguacuguauuucuuuuuaauuuuucuauuuuccuguguuaaucauuguaccuggauuguaguagagaauguguccugucugucugccuaucugcuuaccugucuagguguuugaggguagagucuccacagcuggucacauguauucuacaguugguacaagucuucuugagaaaguucucccuuaggaguacagugaaagcuuccaaauaugaacacuuguuuguuuguuuguuuguuuuucauuugggagggguccuuauuuuuuggugguuguguucauuuuaaaaaaauuuuuuuauguguauggauauuuggccugcauauaugucuguguaccacauacaugcagugcuuauagaggccagaaaaagacauuggguccccugaacuggaguuacagaugauuuugaccacacaugugagcugggaaucaaacucugguccucuggaagagcagccauuguucuuaaccacugaggcaucucucuagccccugguuguaguugcugcuuaaacugaucuugaacuccugaguucaaguacugucuucugcuucaguguucucagugcuguauuacaggcaugugccauguguccagcuugggcauacauaguuuuaaagcaugugugggaguaagcaaguuaauuauugaagagaaaggaauacaagagaaaggcaguucuuugggauaugcaggauuugaguuuucuccuuuugguaagugggaucauuuuucauuaagcuuuauuauuuauuuggaauacuuguaaauuauuugggaaugaaguuuagcaagugaaauuuugaaaagaaauuuggauuguaggauuuauuuuauagcauucucaacuccugugguaagaucggggacagcaggagcucuguaguuuguucccaacuguacccugcuccccagcccuugcugaagauggaaccccagagguucauacauucuaggcaagugcucugccacugaacaccccuuagcucauuauaguuccugguggccuuugguuuuguuguccaucucaagugauagccaugguucugaaagucuguugugucugucauguuaaugcauccauuuccucaaaaccaggguucacagaccacagaaguugaguucuuuuucuucucaaggcauaguguuucaaggcuauugucaguuauaauaucauauauuagauuccaauaauguuucuuauauaauuacauuuuuauuaggcuguuaccuagcuauauuuucuuugauauacuguacagcaaugagguauuuuuuuaguugugaguugacugaaaaaguuuggccucuuucauuuggaaauuuucuuuuaagugaugaaaaauagaaagcauaguguuaagaauucacauaaauacauuucaauauuaaagaauuucuuggccaucuccaaaacuuuguauguguguauguagagcuuguggaacguaucuuaaaguauauuuacuuuuacuuuuaauauauuuaaucuuaaaagaguacuuuuuuuuuuuucuuuuugagacaggguuucuuuguauagccuuggcuggccuggaacucacuuuguaguccaggcuggccucgaacucagaaaucugccugccucagccucccaagugcugggauuaaaggcgugugccaccacugcccagcuaagauuacauaucuuaaaauuuaaauaacaaaaaugucauuuguuugucugaacauuuguucuuuaaugaaacaagauuagaacauuuugagaagcacaaacucaaaugauaaggcauauugguuauaaauucugccuuaaaggaugagaaaagaaaccaacacagauuuauuuucuaauguaaaaauaauuugguugaccaaauuuauacacaggggucuuuuuuguaggcuucuuaggacagcagugugguguaccaaacugacuuuagaaggccuuugaauuaaaacugccuuauuuuuuuuuuaauugucauaaauucaggucccugaccuuacauacugacaagguaaccuuaaccucuguaguuuucauuuuacugccagugaucgugauagacguguacaugagaagcugugacuuucuuaggcgaaguucaauuuaguuuuauauaggcacugagccucuuuucugcauugacuugauuuucuaaauuuuaauauauuacuauuucauuuuuaaauaugcuaauauagcccuggagguaauugaggggucuguagugugaaaugaacuucuucauuguaugagacuaccaucuuaccuuauuaauauaguuuauacuuugaaaaugccuuucuggaauugucuucgaucucuagaaccugugaguauuuuacuguauauuaguugauggaaagaaauuaaggauucacguagaaccggcagacuuuaaaaugcaauuauuucuugaacucaguguaaucauaagaaugcauaacucgugggaaaaagcaggagaacuagagguagagauggcauucuuuuguauugaauguggaagagggccugaagcuaaagacuccaggcagcuaccagaaacaagagaaggaaaaaugccgauucuuugcccagagucuugagaaagaaguacagacuuccuacaugaugauacuuugauuuuuagaacacuggaaguccuauugagauuuugauaauguauuucauucuagaccacagauuuauaguaagcuguuaagcaaaacuaagauaauaaagcaguguuuucauagagcaucacaaaguuuaaagugcugauuuugaucccagcaguguuuaaagcaccuguuauguccagccuuaccagugcugaagguucuaugcaucucauuuuuaaagcagacccuugaauguuuuuccuuguauuuauaugguaaaccuacccaguaucuaguauauauuagaauauauucugcugguaggcauucucuguuaggcaugaggauugucauacuuccaagacaaauuuaagagcaucagauuaaacuggauuuuuugaggaauauacaggagcuugguggauagcaugagcuggccucauucucauucuguccuuacaguaugguauuuauuccuucugccucggccucuggugcuggaauuauagaugagcaccauugcaccuaagaaugaaacuggauucucucaucauuuuuaaugugauaauguaucgugaacauccaagagggaggugugcuugucucagaguuugccaugauugguguuuucuuagaaaaagaaaaaaauugaugcuauucuuucagguuuuuuuguuucuuaauuuuccuacuaccacauauugcgcucaccauggcaagguacagauauugccauucuuaaaauguuccaccucuaaaaucuuagcuucagccuuucugaccacagcccuuccuccauuaaucugcuucuaauuaagacucccagcuaggugguggccauaccuuuaaccacagcaggggaggcagaggcaggcagaucucuuugaagccagccugaucuagggagcaaguucccaggacagccagggcuacacaaagaaaccuugucugagagaaggguggggggagacuuccuacauucugauuuuucuuucuuucuuaccgcuuuuuucuauucuuccuaucuuguuuuuccagcccuucuuuugauacugguuuccuaucaguauccucuccuucauccuauuuccuuucucauucaucuagaaaaauccaauguugaaugauucugacagucugcuuuggguaaccugucauuaaaaaagucuuccuggcuaguuaacugucacuuacacaaagucuucaguuguauuucaccuuacuggcuugucuaauucuucauaguaauuauuuuacacuuuuauuauuucuugaagcuuuacaguuaguagauggccuuuauaucagacauacucucuuauaaaaguaaaagucuuuugguagcacugaucuuauuccucuucccuuuuuuggcuuuuguuucccuccauauuaacguuauauuguauuguuuuguuuuugagacagggucucacuguauuacaguagccuuggcuagccugaacucucccuagagagauccacuugccucugccucaaguucugggacuaaagguguauaaacuaccaugccuggcugggauguuuuauaauaaugcauuuuuauaauaauucuguccuguugcuaaagagcuuugaugauuaauuugacugucacaugggucuuagauuagcauugauucacuuuuaaucuuaagucauaccuguuacagucuucuugcuaugccauugaggcuaguguagaccagcagugaggaguagcuuuagaggcacuucagucaauagucagauuuagguuuuauuuuaugccagacuauaccaaacacuuucuguuuauuauuuugaauuuuaauagcaauccuaugaguuauguaccauuuuguuugguuuuacagacgggcaaauagacuuagaauaguuaaggcuaaugucauucuaagauugacagaguugaguuuugagccugggaauuaguucagagucaauaauuuuuaacuaugcaucauucugacugucuuuaauauaauuuauuugggauuguuuuuguuuauauauuaugcauugcuauaaaacauaacauucauaauuacacauuuaaucugacaaaauuuaucaaucccaacuuuuagggugcauuauuuuuucuaggggaguagaaguuagacuaauuuuuuugaaaaguuuucugaugggagcagaaagaggagauucuuugaaauucauugcaaccacguaagaauggaagcaagaaugggaucaugguguuuuaaaaacugaaagacuaaagauuuagggugggaagauaagauggcauauuaguuaagucuccagugguaaagagaaaaagaacuuuacucuuuaaguaugaaagggauggaguccuggcaccaauagcugugaguuguggaacagugccuccaauuuaaaauaaccgaaagagacaguagaaccuggauucuaaauggaauuugcaucucugaccucauuuucccuucaccccauuccauugcaguuagaaauuaagucuagggcuggugagauggcucaguggguaagagcacccgacugcucuuccaaagguccgaaguucaaaucccagcaaccacaugguggcucacaaccauccguaaugagaucugaugcccucuucuggugcgucugaagacagcuacaguguacuuacauauaauaaauaaauaaaucuuaaaaaaaaaaaaaaaaaaaaaaaagaaauuaagucuaguugcugccaguaucugugacgaaguagccaguuucuguucuucuucuuuagcaccacuuaaaacguggacuuagaaaaguuacuaaugacuccugaauuauguguguguggcuccaguggagugggaaccugguaaaucuguagcaggaagcaaauuuugccuuauaaauugaggggauugcuuuaaaauaagaaaaauccauaugcuagguuucuaaaaggaaaguuaacuaaagaaaauacaauaaguauuguguccuugaugugccacagauacacauagguaugacaggccucuguaucuuuccuagcuaggaggacagaugugagaaucuauauguucacaugccaggaguuuauuauaaauccgugcuacuaguuuuuucuaacuaaagcuaguguuguagcauucagucuucauuucuuuacuccuuuguaucugucaguuugauaucucccaaccaaccauaaauauuuuugggggggggggguucgagacaggguuucucuguguaucccuggcuguccuggaacucacuuuguagaccuggcuggccuccaacucagaaauccgccugccucugccuccccagggcugggauuaaaggcgugcgccaccacgccgggcccaaccauagauugaaaaacguuaaucauguucaaacuaaacauacagacuuuggcuucccaucacuguuuucuaaauaauauaagaacuauuuauauaauauauaguagcagguauuacaagcacuguaaagaagguggcuuaaaguauauguagaaauguauuccuuccuguauuagagugugaagcccauucuggguguuagcauggggucugagagcgugaucacagagaaccuagcuaguucucuuuagccccuuuauaaaggcacuagucccauucuugaggguuuaaccuucauaugauauucauuuucaagagucagcauuuguuaauauuuuuguacuggagauuaaguuucagcaugcauuuggaaggagauaugcagcauuuaaaugagagcuaguaguuuaaguuacccaauuucuaaacuuucuucuagaaauguuauagcuuaagucugugaucuauuuugaauuaauugugcauauuguugugauguauuauuugagguuguauuaugguuaaaauuuuucauucagguauuaguaucauuucuugagaaaaaaaauucuccuuuaaauuccuugguaguucugucaaaaguuggcuacacacaaaaacauauucacauacauacauacauaagugucuuagugcucuaucacugugaaaagacauuaccauggcaacucuuauaaaaagaaagcauuuaauugggacuugcuuauaguuucagagguuuaguccaauauuaucaaggcgaggaacauggcagcuugcaggcagacaugaugcugaagaugucccggagaguucuacauucagauccacaggcccccgcaugaagaccauuggaccugaguugggcuucugaaaccucaaagcccaccgcagugacacuuucaacaaggccacaccuacccccaaaagaucacaccuccuaauucuucuaagaagugcaacucccugacaacuaaauauucaacuaugugaaccuauggggaggcaggaggaugggggagaaagagucuuauuuaaaccaccacaauaaguauaccaguagauguugauuucugacucuugaaaucaauaagccacucccuugauuaccauagcucucuaguagguuuugagaucagguaacauacaaauuucuaaacuauuuauuuggaaaaucauuccaguaauaaaugcuuuugucuccagauaaacaugaaacgcaccuacuaguuucuaucaaaaaacacauaccagcgcuuuuauuaaaauugcguuauaacuauagaucauuugggaguaacucuaaugagaccaaccaauugcagcuggcuaucauauugauuuguguuuauaugauuuuaguucuuuuuaaauuucuaaagacuuauuuuguggugcagcuuauugucuaucuuguaacuucauguacacuuggggaaaaguguguuuuauuuggcagaauauucuauggauauuaauuaagucagguuguuuucuaguauuggucuaaccuuacuuggcuuucugccuugcuuauuuuauuguauuauuuacugaaagguaaagaaucuaaguaauuguagauuuuucuguuucuccucuuugguuuuuccauguauguguaaaguuaggacaguucacuugccuuccaucuacuccuuuuccccguuucuuugggagugugcauguguguguguagaaaggaucucguguagcccauguuggccucagcuuuuuaagccuucaaaguccuaggauuaaugauaacacugccaugcauggccuuauuacccuauaccccacccuauuugguuuuuugggguuuuuugacuuguccuauuguggaauaucuacauuuguuuuaaucacuaucaucugguuuugggggguuggguuuuuuuuuuguuuguuuguuuguugguuuugguuuugguuuuuugguuuuuuccucaaagacaguaauuuuaagguaaacuucauuuuuuaaaauauuuauuuauucauuuuuauauacaugaauacaccguagcuguacagaugguugugagccuucacgugguuguugggaauuggauuuuuaggaccucugcuugcucaguuccugcuugcuccggcccaaagauuuauuuauuacuauacauaaguauacuguaucugaguacacuguagcuguacagaugauugugagccaccaugugguugcugggaucugaacucaggaccuuuggaagagcagucggugcuuuuacccgcugagccacccugccagcccuuaaagucaauguaaaacaaaaaguaaagugcuauuuuauguuuacucucaagucuauuuguggaacucuucaccuuuaugcuuaguuucacguuuccauuugguauguucuuucauccugaaaagcucuuguuuuaauacucuuugugaguauugaucuguuagcugaaaaguuccuuuguucuuuacuucugcaaauguuuauucucccuuuuugaaagguacuuuugcucgcuauaagauuguauagauugacauuuucuuuuuucuguacuuugaaaauggugccucuagcuuuccuuuucuuugauaguauucagccaugauucuuacuguucuuauuuccuauagaacauuuuuuucuuuacuuguuuaaaaagauuucuucuauuaaaaugaguccauagguuuuucucuauaguuguuuauugaguauuuuaacaucuguggguaaaccguucucaucaguuuguggaaauacuugaucuuuucaggcaaauuggaaaucugaacuuugaugauauuuaaauaacaaagauucaaguuuagguucuguuugaucuuuauuuaugaggaugcuaccaaagaaaguggaauaguguagagacuugacacauaauagcccuuaaaauuguauauuuuugaccuuuuuauaugaacagcauuuggcuguaggccagagaaagccauaacauuuuugugaugucuuuuucuucagggauauucugcagcugccauccauguauguauguauauauguaugcaugcaugcauauaugugauaguucuucuauaccauucaugcaagaaauuacagaaugccuauguucuaugguaauugucuuuuuaauaggaucauuucuaaaauugggguucaguggguaaguuagagaagaggguauagagaaacuucuugucuaagagcuugaucuagaaacuaaaaaccaagacaauuucccagaaucuuuuucagguuuaagaaaaggagacuugugggugaacuauaugcugauuaauuggcaacuuaaauccuaagcacuacuauaauauuuguaauugagguuugacuaucugagccauuggaagguucugcauuaugaaaauguuuaggcucuagaguucuggguuugaaucccagugcuaagucuuuguagccuucucaaguuuccuaugaaguauuucuuuuuauauuuggagaaaucccaaguugcuauggaaaaagccugaaugauuuauguauuuuacauuauguauuguaggcgccaagggauuauuaguugucauucuuucucuauaaauucacuguuaaugucaucuaguucaggaacuuuuucccuuauguuuguuuguuucuuugucuaugguacuaggaauugaacccaaguucuuuaugguaggcaaauacucugccauuaaacuacacaucuuuaugucucccaucuccuuuuuuuuuuuuuuuuuuaaugguuuuucgagacaggguuucucuguguagcccuggcuguccuggaacucacuuuguaacccaggcuggccucgaacucagaaaucugccugccgagugcugggauuaaaggagugcgccaccacgcccggcucccacccccuuuuugagaauuuuauuuuaaaacaaacuggucuugaacuuguaucauagugcaggcuacucucaagcauuugguccuucugcaccagccccuucccagguagcugcugccuuucccaggcauagaauauucagucaaguuccuguggcugucaggaaaugguuuuuacccaucuuuucccucucuaguagaucuuuuauguguuauuucuuauucuauccuaucuuauaaagaaauguuagguaugcaucuuuaaaauccuuuuguaagcuagaaguggcugaaacagaaggauugccaugaguuugggccagccugggcuucagagcaagacucugucuauacucugucacaguugaagacuaucuauauauagucuuauuaugccccacuuuuccaaagaaaauguguuuuaauaagauucucagcaacuuccacauuguuaaauccaauggucaguguguagaccucaucuuacuuuuuaccucacagcauuuauuuacagauacugguuuuuuguuuguuuguuuuuauuuuugguuuuucaagacaggauuucucuguguagcccuggcuguccuggaucucacuuuguagaccaggcuggccucgaacucagaaaucugccugccucugccuccugagugcuggcagauacugcuuucuuggugcucuuuuuuuuuuuuuuuuucaacuuggcuucuaggucaaucauguucaacaauuuuaguguuuucuauccuguauucuguauuuucuaaaugucuggacuccuguacgucuguacuuugugacagugcuguccuaggcuuugaaucuuguuuauauauuggugagucuuggaugagcaccaguacuguguuucuucuaaaccguauauucuuaaagagccauugcauguuuaguaauuucagaucuuaucauuaucaaaaauaauagcagauguuuuuaauuuaccugugaaguauuguugacccccaaugaacucuuuucuucuaacccuauuccaugucuucuccauuagcaaaugcuaaauccucccagauuuuuuuuucuccuacugaaaaccauggaaccaccuuagaccuucuuccauaccccaacauuugguuauuugauauguuauuuacuagagacugaucauaucuaccaucucaucauugcugccuauugauaaaucacucagggcuuaauguagcaguccaguggaacuaaggcaggucaucaugaugucuucaaaaauuccagauauuuugcuucaaagccuuuuccuucuuggacuagcucaaguuggugcugacguucauggucuaauucauucauggucuucaauggcuguaauaguuaagaaaaucagaucucuuuuuguguucucucauccucagcuucauucuguggugauaguguuagaaaggggcaagcauaaaaugcagagaaauugucugucaaagagagugacaggacagagucaugugaucugcagagaguugagaagggugcagaugucaggauguauguuauucauuggggccaaaauaauggaucauagggucuauaugaucuguauugggucuaguuuauuaaauuaucuaaauauguaacccauuucuuaaucagauaugaagaucaauaaaaaggaauugucuagauaaaacuaaaaauguaggauaaguaaugguuucugguaaaaauuucagaggccaccuguaaguagagaacauucuuuguauaccauaauauuauaguucuauuuguaguuagcucacacugucuuccuuacauauuguugcuaauaaauuaacuugcucaucucccacauugcuuuugugcugcauuaggcaguugguaccucuaaucuaaguguauuuggugcuuuacauuauguaaagggcugugauuacuuuguccagugucaaaggauagaaucacacuccuguuuuccuuuuuagacuuaaaaaaauucucagagcauuuuuagguucucacugaagguauuuuugucgccauaguucucuuuacccguguguccuauaguaaaaaucauauauuuagcugucagauuggcuuuguucccuaagcaauaugcaucaagguuucuuucuccuuuuucauaugcuaauaauaaauaguugucuggguguaccacagauuuuccacacauuguagagcaucuuggaugcauccagggguugauaauaaugaauaaaauuguuguaagcaucugugugcauguuuguguagauaaaaauuuucauuuuguuuguguagaugcuggaagcacaguuuucaaauugugugauagcauaaaguaugagaaacguuucuguucuccauuugcuguuacuacuuugugcuaccacuaacagucaggagagcgccugcagagccagacuuaccaacacacugauuuugucaguguucuggacuugaccacuuaauuguauagaggggucuuguuauucuuuuuuuuuuuuuuuuaagauuuauuuguuuacuuauuuauucuauguaaguacaccguagcuguccagaagagggagucagaucuuguuagggaugguugugagccaucaugugguugcugggaauugaacucaggaccuucagaagagcagucgguguucuuaacugcugagccaucucuccagcccuuauuguucuuuaaauuugcauuaacaauaguuucagaucuauuuccuuuuucauuuuuacagugauuuaguauucuguuaauccuacauuuauuauucacauauacaaauaucugauuacuucaccauugucuuuuaagguaaucuuuucugaacauuuaucuaucaugauacuaauuuaguugcuuucuuuuaaauuuuuucucugguauuaagacauuuauucauuuuaauguagauugcauugccugcauacuucaggaagauuuagagguuauuacaaagaaguguuuuuaaagagcuaauuuaaagcuauugcuuugguauaucucaucuaauauaagaauugagaauuucuuauuuaacuaugugaacuacuggacuaucuuauugugcgccucaguuaauuucuguagaguuaauuuacagauugauacacaguacauaggucucacuugaaugaaaagagaaucuggauuuuagaaggauaacuaugugcucguguucucuaauuguauaagauggugaucucuaaacugaaaagauuuuuguuauucuugguucuuggauuuuuuuuuuuuuuuugaaauaccugaaaacaaguaucaaguuuugaguaaccaaaaguuuaggauccugacuuuaaauugagacaccauccacacagugauuuauauucauuugggugaaugucuaauaaucaacaugcucuagauagauagauagauagauagauagauagauagauagauagguagguagguagauagauagauagauagauagacagacagacagacagacagacagacagacagacacacacacacacacacagcuaaauagauccaacuuuguuuaguggaaacauguguaaacccacgauuuguuuguuuagugcugcagugaaacugcaugugcacauguauuggaauaacuggucgagccaucccuuucuuagagaaguuacucgguuuuuaaaauccaagaaagaguuggugcgaaugaaaaaaaaaaaaaaaacaggaguauauugcagguugaguggguaaaaccuuccacaaauaaagaugcggauacugaaagcaagaagcucauagaggcugauugggucagagucacagcuuuaccaugugacuugcuaugucaaggaagcuggaauugcuuuaucucauucuuucccaugaauauaugcuuugaaaguagagcaacaaagcccccucccucaugcaugcuugacauuucuauuuagacauacuuuggugcuaagccugaagaacugugcauucucuucuaaaauguauugauaugaguuccuaauuuguagggaaaaaaagguauuugcauuuuuuggcugauugggaguugugauuauaaauaauaaaaagaaauguaauaauaggucacuuauuuucagugcuuaugguacugaugacuuauguuauuuauucuccuucauccucagagcaucucagugagguggcuuauuuaauuauguccaucuucuaaguaaacuggguacuagagcacuugauucacuuuguuacauggcugacaaauagcagagcucaaguugaacccaggcagucugaauaagacacuuaguaucucuucuuaugcuccuauucugugaggucacauauauagagcacuuaaguauaaugucuagcaauagaacuguaaauguaaacagugaucaauagcuaauaauuaacucuuuuuaccuaaaucauuugaguuaauacuucaggaaacuguuguuuugccuauggcuucuguuccaguacuucauuauaauaauagcacaagaugauucuggaaccaugcuuaaccuaccugcuguuaccugcuucuuugcugaucuguuuauacauucuauauuaacucucuagcaaggacuauuaccugucuguccuuaaucuagugccccgcacauaaaaaugaccagaugcuguucagcaacugagugaagccuaaaaaugugaccucugcuggccuuaaacauuauuuaugccaccuguaccugugcuuuauuuuacgugguuuucuguugguuaagaguucaucuguuugauguuauauauaccugggcaguuacaugguuuucuguugguuaagaguccaucuguggggcuggugagauggcucagcgguuaagagcgccgacugcucuuccagaguccugaguucaaaucccagcaaccacauggaggcucacaaccauccguaaugagaucugaugcccucuucuggagugucugaagacagcuacaguguacuuacaaauaauaaaugaauaaauaaguauuaaauaaaagagaaagauuguuaucucucuuaaaaaaaaaaaaaaaagaguccaucuguuugauguuauauauaccugggcaguuucacccugcagcuugcugcugggcaggaaacuggugucuaauucugaagaaaucacucaguuuaagcacaugagggcaacauacaggaccuaaaaccaaaaucuuuuagaaauauacacaaaacaacauuuaaagguguuuaaagaaacuaauaaaaaagaaaaaacuuugcuauuuuucauuugcuuuuauauuaagucauuucaaauaaauuuuugaaaguuuuuccccagggaccuucuguuuuuuuuguguuaacucauauuuuccuccucuccucugucuagagugucuuagaccauucuaccuugugaaaacuuggauguucuuacagauagucauugugggagaacguuucauuuaagucccagaugaggaccgaaaacuugaaaucagaggagcaucugaaaucaaguaauauuagguaggauaaaaauuacaagggauuucugcacuguuauuaauuuccaggauguacguuaaguuucucauaucuauagacauugaggaaagaaugugcgacuucuugaagggggaaauaugcuaaagauccuauuuuuacuuauguggcuuuaugagaaaugaucuagguuuacuuugacauuagcauguauauguuuuuaugguucaaaaaacuuuuuaagaauguacuaaaauacauuucaggaauuuguaauuaaauguaaaguuucugaguaugaguuuauaagccuuggaauauggguuucaucuuuuucauauauaauguuuccuuuauuuauguauauggguguuuugccugcauguauauguguauaccccaagcaugcaagcauguaguaugcagagucuagaucauguuauuggguccccugggacuggaauuagaaaagguugugagccaccaugucagugcugagaaaggaaccuggguccaguggaagaacagcuagugcucuuaacugcugagcccaacuuuuccagcuuccugagauucauaauuauaaauuagccuauagaguuaaagaaaauuucuguuauauaucuaaugauuuauuuauuaaagacggaugcagguaacauccguucuggguucucuaugucuguagagauggaauuaaaugucucaaaggccccuguagaguuuuguaauaauuuauuauagaauauauuauauacagauaauacagauauuuuauuauaaugcaucuaugugaugcauuguuacucuugcaucuuaauaaugacacagcguguuugauuaauguuagaaauaugguuucagaacugaugguugucccuguaaguugguacuaugauuggugacacuuggagcuaccccucaccuccaaaaaucuuucuuuuuauaaugcuuaugcgcucugguucuagaauuacauugcccuccuacuuuucaauccugugaucaggggacauuucaucacucuguuccucuuuccucaucgacaaaauguauuaauuacuccuuaacugauggaauggaaugauugaaauuuaaaguuauuugcuuguuuccagugcugggggucaaaaauggaguaguagcauucuacuguugcuacuacuguccccauguuuuguuguuuuuagauaagagucuuguuauguagucagggcuagccuugaacuucuuugucacccagggaugaccccauacuuuuugagccuugcuuccuuuuucuugggacugcugguguguuacuggcauguaccucuaugccagguaaacgagagcacaauaaauccaucuaacaaaugugaucaaauaauauuauuaugcuauuaaguuuuaacuggugaguucacacucuauuaucagcauggcauuucagucauuugcuuuauaugcuauugggucucaaguuuuuaaauguuacugugaaguaaucagauauaaucaugacagcuuuagagagaaaugacagaaaccuuuuuuuguuuguuuguuuguuuuguuuuuguuuguuuaguuuuucgagacaggguuucucuguauagcccuggcuguccuggaacucacucuguagaccaggcaggccucgaacucugccucccaaguuguugggauuaaaggcaugagccaccaugcucagcuaugaaacccaacaucuugacccaguuuuguuuuguuuuguuuuuuguaauuucugugucugucaccaacguuauuuucuacucaugcuaaaaauauagugguuuuauuuucuguucuugagaacauaguuuuauggcaucugaauagauuguuuauucuucagaauuguguggagguaaagaacggggauuuuugacugucuugaacccauugugcucuuugaaguaguagaggaaggaacaccugauuuacaguuaggaagcagaucagcaaguaguuugguaguuauagauuguccuuugagaggccuuugucuuaguuauuccacaugacaacagccugacuguauacauugcagcuuucugaacuaucuccuguccaagcuaacuaucggaagugauuuuagugucuuugcuuuguauuguguccccuccuucuccuuccuaguuucuuuggagaguucuugaaaaggaguuuuucuacuuaacuguaucguccuuaucuuguuuccagucuugaccuuuuuaauccaugcuucaugcauuucuaucaucaucccaugguauguaugugcccuauauguacucagugcccauagauacaagguaacauaacagugcuguuauauuguuacuuucaaaucagcaucgauucccuauuacagaacugaauuuaaacucuuaaacacauccugcaagucuucucaugauccgcugccuuucuugguucuccaacuucaucuguagcuuuugacuuugcauuuuaucuuuguuuuacuuaguuuugucuuuugcgcucaucccugaaauucccagaucagaauggcccuucauaaacuuuauacacauacucaaagaauauaggucauggaguaaauguaugguguagaucaguggcuccuaaugcugugauccuuuaauacagcuccucauguuguggugacaccccccccccccauacaauuauuuuuugcuacuuuaugacuguaaauuugcuacuguuaugacuuguaauguaaauaucugauauucagaauaucugauaugugauuucugugaaaggguuguuugacgcccauaggggguccugaauuacaaguugagaacacuuuauauagagcacuggagugugcagagauuuuuuuuuuuuuucguuuuucgagauaggguuucucuacguagcccuggcuguccuggaacucacuuuguagaccaggcuggccucaaacucagaaauccuccugccucugccucccaagugcugggauuaaaggcaugcgccaccacugccuggugcagagauuuuuauauacacugagagaaagcaaauucauguuuuuuaaccugaacugaggaaaauaccuaguaacagccucuucccuuagagucucuucuaaaugacauuuagugggauagcaauagcauuuauucuuuugcagguuauuaggggaaaaaaguauuagaaaacuugcagucuagagagcuauacuuucauguguuugcuguguguucauaauaaguacauauccaccucacagucuuuggucuacuauuuugcauaauuaauuacacuuugguuuuuauguuaugacuguaacaagugaauaugguaauuaucccagauuguuucuuagaacuauauguugaacaaaguaauaaacuaaaagccaaccuuggcucuuguaugguggggaaggaaaaaaaaaaucccaacuacucuaaccacuucucccaaaauaaaagaaagugguuuagcauuuguauguuuuguuuuuauaacugaguuuagaaugacuuuugauuuuuguuaaaacagggaaaguaggucagaaguucaaguagaaaaaaaaaucuuauguguucuaguacuaugggcuguuacuaucauauguuugagucuuguuuucuuacacucagagccuagcuguaguugguuaggaacuauauucugaagccagacugcugaguucaagaacuccuccuaacccuguaaucaugggcuuguuacuuaaucucuauagacuuauguuucuucaagugcacaauggagacaguaauagcacauaguuuauguuaaaacaguuauuuauacaaggccuuuagaacagugucuagcaaaguauuuugauagcuccugaaguagcuaguguuuagaaugcauuaaguauauuuauagauagaucuugauucuguuuugugaauuguaccagauuguaacuuucacuauauuuauuaucauuuauccagacuguuuucagccuauuaacuucggguuuuuuucuuuuucauugauuaaucaauauaguuuauuucucuuaacaaauaacuaagagcuacuggguguggucagauaccuguagucccaccacuugggaagacuaaggcaggaugggcauggaaauuugaggccagcuugaugcauaacaaaauaaacaaagaacccaaagauaauguauauaauaguauuuugaaaauuuuauaucucaccacuauauuuaauugugcuguuuuauuacuaaauauggugauuuaauuuuuggauucuugguauauucauuccuuucacuaauucccucagcuuaaaguaagaacaaacaaauagaaacccaccauugcucacauuuucugcugagagaggacauuaaaacuugucucauccaggcgaauggcaauguagaggcagguguauacugugaauacaaagacaaccuguucuacagcaaauuugaaggagagagugugugagagugacuggucuuugguuuuaggucuuuugguuuuuuuaaggugcauaucucuaugugagcauuggcuauaaacuguaguauuaauuuuuugaagcucuaucaagaauuuuuggaguauaguuuguuuuguuuuucuauagacuggaaaauauucauuuuggggaaagauagaguaaggauguauucucucaaguuguaugaucuuguauuuuuagcgucucgugcuugucaagacuuucuaaauggugaaaguuagaccuaaaguaaccagugaggcuagacuuuauggaggaugaaauuugguauauaacuaagcauaguuauuuaguaucauucauuugauuugauaguucuuuugugcuagauuuucuucaaaagcuuaauauuaaaaaaaaguggguaucuuuauaaagacuacagacuaaaaggauucauuuuauauuuuacugaaguuaaaauuuacagucacugaaucaguaagaacacuggcuucacucuuccuacccacauggcaacccucugcuggucucugcuggcuccaggcacagaaguagugcacagccaucuacugucuuagauaggguuucuguuguugggauaaacaccaugacgaaaagcaacuuggggaggaaagaguguauuucacuuagacuuccaguaauaaauucuaaagggcagccagggcaggaacccggagacagcaacugcuuacuggcuugcuugccugccugcugcacuugcucaggaccacuugcccauggguagccccucucccauugagcugggcccuccccacaucauuaaugggcaaacacccugcagguuuuuccauaggcuaaucuguugagggaauuuugccaauugaggcuucuucucaaauaacucuagcuugugucaaggugacaaaaauuagggcacaggcagaacacauguacauaugaaaaauaauuuuuaaaaauuuacaauggcuguaaaauauuuauguaaauaguacuuucuauaaaagaauuaauauagcuuuuuugggucaguuuaguucuuugaaauggaaucucaaguuguaauaaucuuuauuuauuuuuugucaguugacacauaauuacacauacagaggguacagggugauguugagaacacauaaucaugaguuaugaucuagucucaggguguuuggcauauucuucaccccauguaucacuucuuuguggagauagcauuaaaaagcuacuuuucuggcgguuaagauuagucagcauguauuguuagccauaaucauucuucuaugcaugagaauacagaagcugugggagagcguguuguagagucccugcugagcauuaugcuaguugaaaaggauacugacgguauuuauuuuuaaaggcugugauaccuacuuacuaaagggacuuugagaaccuaugaguuuccuuaccccagcaggguuucccaaggaagcacagugcucugacucacacaaagcacgagugauuauugccguaaaaguggaggugauacuuuuuuuuuuuuuacaauuuuuuauuagauauuuucuucauuuacaauucaaaugcuauuccaaaagucccuuauacccuccccccacccugcucuccaacccagccacucuuccugguccugguauucccgucuugggacauuacaaucuuugcaagaccaagggccucuggaggugauagucuuaauagcccagggacucuucuuuucagaaguucagugacaaagcagcuagaauaaggagagaagagugguaacaguuccgagacuauagaauuugucacgaaaaguuguagugaaaaaucaauaaauguuugaaguucagguggauaguugguaagaucaagcaugcauucaaaaauaccuuuuguaguaguucaagugaggguuguguguaacagguggguggcuaaagauguaaugcaguaaaaagugcaauaaguauuuagaggacagcauuccucugggauugacaaauacugaaacuuaggaagaaggcuggcauagagaccuucugggaggagggggaaauugccuuccacaccugggaagccaugauaaaacggccaagaggagaaaaaacacguaagagaaccgagcauggaguucagaaaggaccaugaggucaaucuaggaccucaccaauaacagacaauucuugaauuucagagggugaauuaaaaaaauuuggaaaacuugaaaauguuugaaggccaaagagaaaaaaacuugaaaacguuugaaggccaguagcaagggaacuuuaaagacuguuaaaaagaggaaagaauaaucaaguccugaggaaauguuagaaggagcuguccauugaaauggccuuugcucucauaaggagaacgcugugucagugcaguacaugcccagucaggagauuguuuucccagagcagggugugcagcuguaguuugccagugggaaaagggacgggaacagcagcuugaaaagagugaaaauuugaaauuguuaaugguaaccaguaaauugaaaacaaacuagucuuuaauuaagguauugcaggauguaacuuguaguauuuuuuauucagauuuggaaaacaagaaaugaacuuuuggggaaguuaccaguuugauuugugaagucauauuuaaguuauaucacuuuguuaagugaacuguugcuacacuggguauuaaaggagggcauaaauuucccuaucacauugccucguuguaaugcauuguucaacuugauuuagucuguuuauuuuaacuuggguucgguuuuuuguuuguuugguuuuguuuuuuuaacucuuguucuuuuuuucuuauuuaggcaggcagaaguccugaaggcugaaaugacagguaucgguugucuucuuucuuaccacuuacuuucuucuauuaaagggagacaauuuccuuucucguuugugcuguuugccuagaacaguaacuuugcuuuaaaugucucuugcucuuguacuuugcauucuucuuaaauacuuuaaaggaauuuaauguaguguaugccucuacucaagaauauauacuacaugagaauuugaguugcuauuagugugugauuauuuaauuuuuaugaaccuuuuacuaauaauuuaagauauaaaauaauucacacucuauauagcuaaagauguuguauuugauuacuauuuucaauuuauagugacucaaaccugaguagcagguaaaccuucagaaaaaauguugauagaaaaauugcacugaaaguaugaaguucagcaagcuaccuuuucuuacacaucuuuucugcucugaguaauaucucaagcccuuugagaagaauuuuuugacucagcugcugagaggaacagauaauucaaagcucaccagugaucaucagcauguccuucauagcagcacgugguguucuaagcucucagauauuugauaggacauugcaucuuaauuuggaaggaauguaguuguauguuuaacucgugaggaauucagccucuguugauugauaaccagaguccugggcaagguuuaucauugaagagggcacacacuggcuccgagggaggcgguguuucuugagcuuugacaguuacagacuaguguuggugaggagcccggucauuauaucauagggagcaaaagaggaaaagguuacagugcguucacuguuguccuuccuacuaacacauuuguggucaucaucuacauuauaugauaccaguguuggaauucuacucuugaauuaccauugaaagugccaucuguagaacaacaucaagcuccauauauguaccauuugcuuuuuccaaaguauugaauaucuauuuaaauuuacucauuugaaugacuucugcaguccccuagagccccauuaguggcacacaccuauaaucuuggcucauggaaaaugaaggcuagagugagcucauagaggcuugcuagcuucuccaauacagugggauccugucuccaaauaaacaaaaaacacuuuaucagacccaaaucugacuagccaacgaaccuauuaacucaaauauccaaggcauucucuuuggugaauaggauuaugauaguguauagguacuaauaacuuaccuaaagaggaguagaaaauguggcaucguauagcagcaagcuacuagaugaaauugaauugcauaacuggaaauuggaaacuuauaauugauacgcccauuaaguaauucuacggaggcagccugcugucagcauuugaacuaaucacccuauaggacuuuggaaaaugaggcaccaguucagaaauacagagccuagcucccuuauucucccuauacacuguuacucuuuuggcacgcauguugagcaguuuaaucccaggguucugcccuuuuacauuaaauggcuguagugugcacugaugacagaaguguaaugccaguguuuuguucauaaaaauaauucucaucguuucaguagggcggcauauaggaaugauccagguauuagcuagauggugaccagauagaaaaaauuugugaggauccuuguaggaaugauucaaaauaaaaaggaaacaggauuuggcugaagauagaauuauucgugguaaaugacuuacuauaaauccauuauuucaaauggauugacucaacuaucagauauaugaccuguugugucaugagcagacagaaauccaaauaaaagcaaaugaugauuauuuuugauggccauuuuaauuucauaauguucuuuuaaagcuggaagaugaggguuagagagacugggucagcacauaggaauucuggcugcgugagcauuggaaguagauuccaggaaacaggugaagucauugugcccaugccuguaauggggcuuccucacugcagccucacuagaaaaccugaagcugcagguucagugagagacccugcuucaaagcaacaggugggaguggugaaaggauagcugaugcccucccucucugcuguacucacccaguccacacacacacacacaccccgacucacucauacaugcacacggcuuaaaaacauagcuaaaagacaaaaauguuuuaaaucaaauuuaguuauuaagcgaaaggcagaaggugaaggucauuugaaauacaguaacauaaacccugugcagcaguggaugggaugugcugagagcggcuuugcuuugguggauggacagagaagucaucgguuuggcuugugguugucacuuaacuauauagugauauuuuuguuuguuuuauuaugcagauucuaagcuggguccggcugaggucuggacauccaggcaagcucugcaggacuuguaccagaaaaugcuaguuacugaucuggaauacgcuuuagacaagaaaguagaacaggaucuguaaguauuaucauuugagacaugacuaugcaaucaggaaucucaagauuuugaaacuuuaugguuaguugauuguuuuucagacuacccuaguguaagcuuuuucaaaggaauucuaauacuugugacuuuuuaaaaacaaaacauuuaaccauuaguauuuuuuucagcuguagucucugaagguaagaggaauaauguuuagauuuaaauuuuaccuaaggcagcucuuuggagcauucuggaauaaacaaaucuaaacauauguaucucagauucuaagaauuuaucuguauugggucuuauauuugaacuuaaagauaaacuuuucuuugauuagugggauuuuguauuuggucuuaguccaaaggccaaaacaaugaucaaugucauccuguuucuucaacaggaaaguguauuugcauuguaggaaaaguuuauguaaaucaaauacauaauauauauccuccuuuacgauccccagaaacuaaagaaagaguuuguguguuuagacuauuccacuuguucuuucuacgaaggaugaaauggccgauguccagacuccccagugaguaaaucaaggccucuuauagaagaucuuaccuugccuuauaaguuaaaacaggggcgcuuagcuugauggacacuuacacaucgauugagaacaggccugucuaguaaaauccaauguucccagugguggugaauuugguuuuuccuuuucucuccccuguguuuuuaugcccuguguauuuagaaaaucuaguaguguaccuuacagacuaaucagaacucaugucuguaauauuugaguccaugaggagaagggaucacuaauauugagggagcauugacaaauguccuaaacuauuuuaaugcccucggacucuagaaccucaacuccgaugcugacauuugguacuaugauuuuucacuaaaauugaauugaagcugauaauauggugacuuauuuuaauauaauguaauucagcauucuguucuuuagguagccagaauugaaaugugguuucuauuuuaugcuguaaagaauuaagccuuacccuauaagauaaaauaaacaaaaucauuaaagaggaauuguaaugaaugauguagcuaauuaacuuggggagauagggacagaccuuacucaguacacacacacagcacccugugugugucacuugacugaggguauaauauuuguuggagcaguguguuaaaguuaguaauaguuuauucggguuuuuauacugggauucuuaaguaggucuuacugugauagcucuaaagguucacaguugcaccacacucugccuacuggagcaucugguaagugucugcugaagucaguugcguucuacugcaugucuagucuuguucaaagaaaagcuugaaguuauuuaaaucaauaacuuuaaugcuggcuuacuguucagugugguauaacaacaaacaguucuuucuuguucucagggggaccagugucugcccagugagucacuacuauaccaaauagaauuacauuuuguuuucagcuggaaucaugccuuuaagaaucagaucacaacacugcaaggccaagccaagaaucgagcaaacccaaaucgaagugaaguccaggcaaaccuuucucuguuccuagaggcagcuagcggcuucuauacucaggugaguucuucuuuguguaugaauucucguagcuuuagugauauucuguucuauguacacaucuuuugugcauauaaacacuuuauauaacugccauaugagacagguggaaguuaaucacauauaaucucuaauaauagagguuucagaaaugauucauaauauauauuuuuuuaaagguacagacuuaaguuugaggucuugggcuuaaacaccaguauugccagagagaggggagaggaagauacaugcguaggauggagguuuaauucugaauaaagcagaugugaugagaggcaagcuguagugaaaggaaacaugugaucagaccgcaugugcucauuaugaaaggaguagcuggauugugucagguaguuguuaaaagcuguaaugucaagugaguuuuauagcauuagccacacaguggaauuuauauggaucaugaaauuauuuuaagcuacuuaagaaacagguauuuuuuuauuugguuugaaaaauaaaaaaaauaaaaauaagcuauuaucuucacauacuuauuuuuccucagucacauccuggugugaucuacaaaugaauccguguucauggaacuuuuuaaaagcaugauuucuuggaacaauuggcuauuucaggcuggagagauggcuuagcauuuaagagcacuagaacucuauauagcaacucucaaaugucuauaauuccacuuccagagaaucugaugcccucuucugacuaacaugggcuuucacacacauggagugguguguguguauguguguguguguguguuugguuuuuuuaauuguuacuccagcuacuuauaauuaaaugaauaaugcaaaauuuaaaaauugauuuuuaugcacucgggaggcaggggcaggugcauuucugaguucgaggccagcccggucuacaaagugaguuccaggacagccagugcuauacagagaaacccugucucaaacaaacaaacaaaaaauugauuuuauguauugggauauaccauguauacuauggcacauggcuggaagucaggacaauugugggcaccaguucacucuaucacauagacucugaggaucaaacucuggucgucaucugugggggcaaucaccuuuccacacugagccaucucaucagcccuuguaaugauaaaauuuuaaggacugcguacugaagaaaucccuggccaguucucgccgaguugcuugccuccaccuauacauuggcuuuauuuuggcuuaaccuuucuuugaagaaaaagaaaagaauguauuggaagguauaaguaagugccauauuaaauaaguuaauaaugguaguaugugccuuuaauuccaucaugcagagacagaagcauauauaucuuuggaugugaagccagcuggguauauaacaaguucaggccaacccagggguucauaagaagguagugucucccucuguaagagaaagaaaaagaggggagaagggaaguauuugucuuucuuacacuauaaaacccaccaaagguuuuugcugaaaaaccuccaguacuauuuuauucucaaaaauuuuuuaaauguaugccaauuuuuaguugaugcuucuggaaaaggggacugauguugaacugaauaaauaauugaaaaguuaaauaaaaaaacucggcuagcaagaugacucaaaggauacaaauauauaauaaccugaaucuuauaguggaauggaacacacacacaaauacaaauaugauuaaaauuuaaagcaggaguaggagagaugacuuagugguuaagagcauuggccugcuauuccagagaacccuggauucauucccagaauccauaugcuagcucaaaacuguaacuucaauuccagggaaucuaaugguauguggaaugacaugaagguaaagcaucuaguaaaagcuuguucauuuugcagauaauggucagaaaaccugguacuuuuuugcuuugcaauuuuguuucuguuuuguuuacuacuaauauuuuuacauuugcugaguaagugcugugccacugaacuauauuuuaacaacuugcaaaguguuuuaagguacuguauuagaugcugagacuaugaagggaaugguaagccaaguauggcgguucaugcuggaauagcaacacucggaaucucuucagguuaaaguucaagaccaaccaacucgucugcagaguuccaggguagccagcuccuguuucaguagccaaaccaccaccaccccuaaauagcuauccaguuacucuguauacuguauacugguuuugugucaacuugacacaggcuggagucaucacagagaaaggagcuucaggugaggaaaugccuccaugagauccaacuguaaggcauuuucucaauuagugaucaagugggaaggccccuugugggugggaccaucucugggcugguagucuuggguucuauaagaaagcaagcugagcaagucacucaguagaauaggcuggcuucaaacugagagauaggcuugccucuuccucccaaaugauggaaccaaaggcaugcggccaccgccuggccagaugaggucuuuaaaaggggaaaaacuagauuugguguucauagaaaucauugaaaauuuuaauguacaccauauuucuuccucuuuaaaauuuuaaaacacauuuuagguggcacacaacugucaucucagaacuugggaggcauagguaaggagaucuguguucaaucaaggccaucccuagugacuuccaggacaguuggccagggcucugaagagacugucugaaaacagaacaaaacaaaaauuaauuguuucuguaauagggauucgcuuaucguagaauuuuuggauuagcauuuuuaaaggacuguuacuuuuggcaagauuuuuuucuuucuuuuuuuuuccgagauuuuuuucuuaauauauaaaaugauggcuccucucuuaagguacaguauuuuggguuuauaaaguguaauuugauuagagugauagaugguuguggguuuuaaaagcuuaauauauaugauuaccacaaucagaguuucucuauaaacaguuuuaucuuuuuuaauucaccuaaaaccgaaggcaccaccaaauucuugggucacagcaaaagcauguaagaugcuuuuauuucccaugaacaauauaguaauuguaucaguuaaguuucuguuucaaugauaaaacaccacgaacaaagcagcuugaagagaauguuuauuucagcuuggaauuugaaguccauuauccagggaaaucagggcagaaacucaaaacaguaacccgaugcaggagcaaagcagaggccauggaggagugcugcuuacuggcuugcucagccugaucucuuaaaaaucuccaggaucgcuggccaggacugacaccaacccaguggcccaggucccgcuacaacaaucaagcuugugguacauuuuaauugagguuuccucuucccaaguauauagcuugcaucaaauugacauaaaacuaaauagcacauagugguucuuacucuaagaaaaugggagaagaaagcauugucacauuucuaugucaugucucaggugacaauuugcuucauagucaacucuuccuccuucacacagagugaggagcugaggaaaaagggggcaguagguacaguuuccccucaugagcaggaccccagagcugucuaguacugcagugcugacugauugacuuacugacugggguuuaccaugcgcccaauagaaggcagauacuuggaugagucuaguuguauuuauguaaagaccaagugagaagaaaauggaaagaaaaagacuuucaagugcuuggcaagaugggggaggggcuuugaauaaagaaaacagaaaagaaugguuggaaaagcacucaggagcugguuagccuugagaucugcaaguuuaaaugcagugugaugauggcaguauagggaucauuguuuggcuagcuaacacacagcaagcagaucgucugauugaugcuuuaguuagccaguggugaauugggguagaagauaguugaauggaaaucagguguaagguaauggguguaaagauuaaguagguauugagaacacaaaugagaaaaaaagguggacuccuuuggaggagucuaguugagaugagaaaggcauuagaagauuguuggaaagacucugaggucaagaaagaaugcuuugguuuuguguucuuuucuuguuugcuuucuuaauaggaaaccuugauauuguucaaacaggaaagaauugagguaggaugugacagacaggagacagaacagaguggaauaacaggccuacgcagucagaggaggugacugugagcagaggagugaguuaccugcuuauuuuucuguucacaccucagaaugaagagugaugaaucagucuagaacuugagaaaauaaaugucaagaccuugucuugcauuucagaaacauuucuagccaauauuuaaugauuuuuuuaaaaagagaaguagauacuuucauggcauuccuuauuguuaugugcuugcugaauguuuuuaaaaaugcuuuauaugaaaaugcuuugauaaauaaggauuaacccaucaaagauaacauuuaaucuccauacaguucuuacuggagucucaggaguaugggauacuuauacacauaaucuuguauacaaacuuacuguuagaacaucugacauuauuaaacuuugcuuauguuuuuuucuucaguuauuacaggaacuguguacgguguuuaauguagauuugccaugccgugugaagucuucccaguugggaauuauuagcaauaaacagacgcacagcagcaccauagugaagccacagucuagcuccugcuccuacauuugccaacacugccucguccaccuuggagacauuggugagccugggaaggauuagugacacguucauccuuuucuuugaguaaucauaggaagaaacuucgaguaugcauguuuguuuugcuuagauugauaauauguagaaauuauaaaagucacuuuuaggaaccuuuucuccauguuuugcgauuggcagaauucuggaaaaagaaauucucaaauuaaaauuuaaauucucuucagauuugauccagguauaggcaaacacuaaaacucuagccaaaaguaaauuuuaaaguaauauuguauuuucucaauuagaaauuuauucucguuuagaauaaauuuuauaaauuauuuuuuuaaaucuaguuugucuauuauuucuuccuauugguacacugaaagcucauuuuauaugcugcuuccuuuuaaagguuaaauuugcauuuccauuauauacauuuuacuugggguuauguauaacguauuuuucuguucauuccuuuaaggugaccuaaaaagguuauaaaacaaauuaacuauaggauuauguuuuguccugaaauaacaaggaaugaggaucaugaguguauuuaaauuaguagauuguacaugucuuaaugccauaaauaaguggcacuuugagaggucacaucagaguuaucagugagcucugcaaggagguacaguaugcuuagguuggcuuugcuuuaaaugucuucuuugcacacacauaauuaauacugcaguagaugcaaggcauuuuucaaaaaucacuuuaagauauugaagaaauacuuaauuuucagaucauauuguauagugguuuuuguuuuguuuuguuuuuaagugccauauaacucaccccuucuuguggccggcuccaggucaccagcauaguccauagugggagcuggugaggcugacacuggaggaccugaagugggggcuagguaagcuuucacaucgguuacugcugaguguccaaggagacggccagccggacacgucacauaauccuauaguuaauuuguuuuaaauuuuucugucuuuaguggucuuuaaaguaauuuuaaugucuuuauuaucucuagaauuuaaaacuagcuguuuuggacaugcccuccucgugguuuuuguguauguuuauguauauuaauaugauuuuaaacuggauuuucuuuuucuucucagcucgauacagaaaucagacuagccaggcagaguccuacuauaggcaugcagcucagcuuguccccuccaauggugagugcaccugggccugggccugccugccaccuuaaagagaccauguuccugugguguuuauaguacucuagcaaauagauuccacuuuccaaguguauuguagcaguagauguugaauuucagcagcauugaguuucauguuuuucuuuuugaacuuuauauuccacauacuuaaaaugaaauuuucuuuuaagaaaguuauucuguaagccaauauaaauagaauuaaucaauguggucuaaaguuuuucuccaaaccuagcauucauaauuggccuacauaguagugaucuuucaggauaacuauuucuuagaaaacuaaccaguuaccuaaaggauagugcuuuugaugacauucccagaauagccauucuugaauuaaagagcuuaacagcagauacuugcuguuacaaaucacuugugcuaagccacauugaaacuucuuuagauucuagauaaugucucaggaucaucuggacacaaggauccauuuuguauugccuguaucagccaucacaccucaguaacagcugagcuuggguggguccuuagcaccuacaacguaaaggagauuaacuagcuaacccuuucugaaaccaugacugcuuauuguauugauucuaauuuuauuauuuuuuguuguuguuguuuugagaccaucuauuuauguggcccaauauggccuugaacucuaauccugucuaagcgucucaagugcuagaauuacaagugugugccuccauagucaauauuuaauugugugacuuuuuaaccugcacaugauaggaugugccaucacuaauguguacaaucucacauucuguccaucuguaauugaucgauugagauuugccuuacauaauacucggauuuaacugagcauuuguauuuugauagcagaauugguucuugguaacuuuagaaucuuaacuuuucuccuuuaggucagccuuacaaucaguuggcuaucuuagcuucuuccaaaggagaccaccugaccacaauuuucuacuacugcagaagcauugcugugaaauucccuuucccagcugccuccacuaaucuacaaaaagcacuuucuaaagcacuggaaagguaggacugacuuuuccaagagaauuuguguaacguggagucuuaaucgcucaaauuuuguuguuuaggaaauuguagcaaugaucucuagucaucuuuaggucuaaaacuacagagaacauaauuauuuugugcacagucacguaauuuuacccaguaugugguuucuuguagcugagugcugacucaucugaguuguagcugugaagcuagaccuggacagaaagaacccuuuucuugucuauuggaugaugaaguaacuugcaagcuaaacccaguuuaaggguuuugcaaauuuugcugauuaagauugauucaaguuuuucuuucauuucagccgggaugaguugaaaaccaagugggguguuucugacuucaucaaggccuuuauuaaauuccacggucauguauaccugaguaagaguuuggaaaagcugagcccucuucgagagaaguuggaagaacaguuuaagguuugaguuaaaaaccaaaaauguuggucaucucuuaaguggggaagcuuaaaauuuggagaacauuaacuuauuauuuugugguguuaggggauggaacccaggaccuugcacaagcuagacaauucccccacuuagcuaugcccagagggccagacuucugucuagucccuauguugcuauuuaauuaugaauucauagcaauaguuaaaucugaaauauaugaaguccuugcaucuagcuuuccucuugcuaucugaacuauaugguaucuagucauuguugaaacagccuucucauugacccccugccaguuggcaaaacggauugaaguauaaauauauuaagaagcaagacaugccgggcggugauggcgcccgccuuuaaucccagcacuugggaggcagaggcagguggauuucugaguucggggccagucuggucuacaaagugaguuccaggacagccaggacuacacagagaaacccugucuuggggggcaaaaaaaaaaaaaaaaaaagaagcagcagcagcaagacaguuuagaaauacaguuauaaaacuguccaaaacagcaacacaaaacuuggacaguaaaagcauaaauuagccaaauauagucaauguaaaauaauuacagauaacugcugaguugaucauuuacaauagaaauaguuugcugcaaaauaauuuuuacugagcuuuuguucuucccaguggccuauuuaaacuuaggccauauacauaggguuggguguaaaaggaaccaccaucauuugagugcccucaauuacuuagccuagaaaagaauauuagaaucugaauagaguuguuggauuuaaaguauaaucaguauaaaucauuagcuuauuuagaaggcuagaugcuuuauaaauauaaaagcagaaaauagaaaucucagaauacagugaaggugauggauauguuugguauggaaagcaguguagucaacugguguggaacugcaagaacuaucucuucuggcuuuuguuugggggggauuguaaugguuuuugaguuguguguguguguguguguauugucuuacuuacucuuuuagcucuugcugaccucaaaauugcccacaucauuauaaucauggcaaaccuggcuacaucugauauauuaucaauuuuuaccaaaagacuaaugacacuugauucugcuauccucuaaacugcuuccuggggagauauggaggagggcuggcuacaacuaaaaguauccauccuaguagcugucaacuuuuuaggaauuuagguuuggaaauuauuccaugugggaguaaucaaaucccaucacagauguuaaagcagaaguaugaucacauagagacaaccagcucugagaauguagaguuccauuaugauggugaugucauacacugcugcccagguuaccaugugcacaguugcugugcaaaugaagcuuaguaaaaaucauauguggaauuuccuaugaagauuucagcaugaucauuaaaggugcuuauuagacauccuaauggcaacuucagcaugucauuugucccuguauucccacguaugugguucugcaugguuuauaaaggguuuaggacaacucuaagucaugcuucauguaucaaggguucaaaauaauacuugaaucuuuuuguuuggaauuuuuucacaacauacaucugcuuucaaucauuuguccuuuuuuaacauuuuauucaguauauaucuucuaaaugucuauauguauagcccaaauacuucuugggccauauuaaaaauuaugcuguuucuggggcuggagagauugcucagcuccucuuccagaaaacccaguuccauuuccaauacccacaugggagcuuguaccuacccauaacuccaguuccagggaaucaagcaccgucuuuuggccucuguaaguaccaagcaagcauaugguacacagacaacauacucaggcaaaauugcuauacuuauaaaaaauaaaaguagauaaaucuuuauuuaauacauggacaguuucuuaaagcaaaaaugcucgagcaauaguuuaaacaaccgaggagugccugaauggauccuuucuaguguaguucuuucguagacauuagagcuguauaaaauacuaaagagugggacaguuuagucaucccguaaugcuauuacaacacucugugauucuggguguagauguuuaguaauucuuguaucuaagauggauccugcucuugauaauauauacaguaucuuugucuuccauuacagagacugcuguuccaaaaggcuuucaacucucaacaguuaguucaugucacugucauuaaccuguuucaacuucaucaucuucgugacuuuagcaaugaaacagagcaacacaguuacagccaagaugaacagcuguguuggacacaguugcuggcccucuuuagugaguauuaaaucauucagcuuugaaaggugcagucagucuacauguguuuuuuauaucuauguagccagaugcaaagauacauaaaaugagcccucuauuucuuaauacugggucagagagacuuauacaucaaagccuguccuugugucugcuuuauaccacucuauauaacauguuaacauaaaaaguguuuuucucuuuguauuuuuuugauagucuuaccauguauucccaggcugaccuugaacuucaugauccucauguuccauccucuuggaauuauagccauggguugccaugcccagcuaaaaauaccuauuuagaaggaaacuaagauacgugaauguuuaauacagcagaaagcccauaguaauauuuuaaacugguuugugguuugaaaugccuuauacauucugaaucuuucucuccaucccauccccaagugucuuuucucggcauccugugcaaauguccucuccagaaugauucucaggaguccaacaaugccuacccccuuccugcagucaaggucuccauggacuggcuaagacuccgaccuagagucuuucaagaagcagugguggaugaaagacaguaguaaguguuacaaaauuuuauggugguugggugguuugucugauacuuagagacacaggaaaacugccuguuaaaagaauagugaagaauugacuguuuucugcauauucugugaaaauugaaaugaaagcaucuaugcauacuuuauuuugaauucuuuguuaggcccaugaucuuggauagaaauuuguggcuccuauauuccccuguucccaguugccauaucaugaagagacagauuucaaaaugaacuuaacauuaaaaaucaaguuugucagccaggcaugguggcacacgccuuuaaucccagcacucaggaggcagaggcagguggauuucugaguuccaggccagcuuggucuacagagugaguuccaggacagccagacagagaaacucugucucgaacccccccccccccccaaaucaagccuuaucugugccacccuauucuguuuuguuuaaaugagaaacuuccauuuucuauacacaaauugauucuaccuuguaacuauauuuuuuauuuuauuuaccuauagaugacugaaaauaauucuuaauuuccuuaagacaguagaacauuucuuaagacccuuugauuuuagugaugaauggcauuuucaauguacuuuugguuguagaaauaaugucuccaaaagacugcaguagcagaguuccuccccugcauaucuuaguaguuguuuuaacucggaaguuucugcugugaccuggguuguacacaccaacaagggacuaucuaauuaauaaguaaugggaccucauuagaauucuccucuuccccaaacacaagucccuucauuuuuaacauuaccaugaaugugauuuaggauauaguguagcauauaggauaguaucugucuucuuuaaauauuaaugugggcagugcuaggacaggguuuuagguacugcuuuuuuuguauaaauuuuugcuuauguguacucuaaaagucagacuuguguuuuauuuaauaauuugucaggacucuaaacuaaggacucuguucucugcgggcucaccgagguuucgugcuuugguugcacguguaguggacaaggagauuguggccaugugcauuuggacccuuaaaaagucacuguaauucacucugaauagagauuugaauuuaguguggcuauucuuugucacuagcugaagaacauuuccacuguucuggacauguauauaucaauaucguugacaaauuauuuuacacccauuaaacgagacuuggggaacaguaugcaguagugcaucucucacacguguuuucgccuauguaguuuugaaagugucuguugauuuacauagccuugaagauggcugaggaguggggugaugaguaaagaguggaguccuuggagaugccguuuuugucauuuauuaguauucuaaguuuucuuguauaagaauaaaaucugauuuuuuuuuuuuuuuuuuaauuuacagcauuuggcccuggcuaauuucucuucuaaauaguuuccauccccgugaagaugaucucucaaauacuaaugguaagaggugccuaaauuguguauugucucucugcuucuucaucaguaaugggagguugaaagccagggagauuggguuuuuggugaggcuuuuuguuuuccuuuuaagagaggcucugacuucugguacugaugaagugacuagauguggguaauucuccugaaguaccccugauacucauuagaguagauauucaugacccuuacauucuauccauuuucuucccugucucuucaucauuucuaucuguuugggauguuuguuugguuuuagguuuauauauuuugcaugugugaguuuugccuguguguacacauccacacugguguccacagugacagaacagaggcuuggauugcuuggaacuagaguuauagacaguugggagggggugccagaaaccaaauucaggcucagcaaguacucuuaucugcugagcuguuuuaaggaaacaguuaccuacauaucucacagaauuuagcacauacggcauagaagauagaaauugccaauggaucucccauaguauuauagauuauauuguccacaugauagugcaugaucuuaggacauccuccuguguuaaaacauaagagucauuuacuacuugaaacaugcuuuuaaauuuaacaguguaauguuaacauuuucauuugcugcuaacuaguuuuuacugacuucauaauauuuuacuuccuauaugugucauugucuauuauccugugacauuuuccuuaucaagggccugagaagauagcucagucaguaaaaugcuucacuucucaaccaugaguaccuaaauucaguaccuagaaaauccaugaaaauaauguccuucaaaccugcaaucccuguacuugcaagccagaaccaagaggagcuuucucuugcccaccaauuagccuaaucggauaguuccaggccaguaagagaccuucuuucaaaggagguggacugcauugcugagaugacacccgaggcuguccuggcacacagacagacgugugcacguuugcacugauggucuaaacugucuucauagcagcauggagcuucucccuuugccauuacuaguaauuuacaaagucacugggucuuuaggauuuagaacauuugagauaauacccaagcuuauuucucacugauauuaguguugucauuggguagcuuaaaggucgcauguaaccuaaauauugggcuugcuagauuugauauuaaagcucuggauucuuuugauugguuuguuuggguuuuuuucuuuagauuuuucaugacaggguaacaggguuucuuuauguagaucuagcuguccugaaacuucuucuguaaaccaggcuggccuugaacucagggauccaccugccccugccuccugugugcugggauuaaagguauugccaugccuaacuaaauuuguaaauucuugagagcagaugaggaacuucuuucugcccagcaacuugaguguuuuguguuuuauguuagggagaucuauugaaugauuuaucuuuauaaggugaugacacuggggagcaaaaaauggacaugacacauucuucccauaccuuuuuuauucacuuuuuucauaucuacaaaauaauaagauuuuaauuaaaauguuuacaauuucuggcaucuuccuuucuucagccacaccacuuccagaggaguuugaauuacaaggauucuuggcuuuaagaccuucuuucagguaaggagcuuugaagaguuuccaguguuaaaauuuguaggaaucuggccuaccuguagaagagccuuugauuugucccaacugugucaucuuucuuuaacaguuguuuguuuguuuguuuguuuauuggucugggggucaugugugggaugugggcauaguuugcaugugaggguucagugagagacccugucucaagggaauaaggcuaagagcaauaaaaauaaccacaguucacuccauguaaguaugugcauguuuucuuuuaucuuacacauaccaguuuuacaagaaauuuaaaaaaaauaaaagaaaauucaguggcaaggagacaaagggacccccuucuucagcccuccugcacgcuacccccacccccauggucucuuccugcccucuugguuuaccuucuaucuuguucuccccucuuacuacucugcuuuacaguguaucucccacuggguuuaauuuguuguuguuguuaucucccacuggguuuaguuuguuguuuguuuguuuguuuguuucgguuuuuuguuuucuguuucuucccaaauagcuaucuugcuuuagccuacuaacauggcaagugugguuuguuuuguuguuguuguuguuauuaguuuuuguuuugucuuuuuuuuuauucuauaaaauaugauucacagucagucuccuuccaucuuucucuguugcuguguauuucuccauaccacaguuuuucuuaagagcaguguggacugcccuuacugauuucagguuuacuuauuucucagccugcuacuacuaaaacuguccuugucaucuuaguuaccaaauuuuaauggcuuuauucuuuaaaaagcuauggauuuuuuuuuguuguuguuguguuguuguuagcuacuuuaagcugcuacacaaauaaucugugaagcaaacgucugaaaacuuaaagacaaaaacaguucagucacuaauacuguuugacaucuuuguacaguuuaucauuccugcuuuauuaauuuuuaagcaguuuuuaaauaauuugccuuuuuuaauucuuguagcauagggucuguugauacacuuacucaccaauccagaaauuagaaaagccuuuuuucccucaucaaggguuauaaucuuauuaccaaaaugucucuaauagucagcacugucaagugacuucugacaguaucucaugacaaaaucaaaaacucaaguucuacaguuauucugggaucuccuuuauguccaaguuugaaaccgguccacuucgugcugcacuagaacaucaccaucagcuccucagccuuuucuuuacugucuuggucaguaguuguucugccugauacgcuccagcucaggugucacucagaaaccuucccauaguuuuggggaaggaauuaaauucuuucacuuugcuuuuuuauucuuuaugugguuuuauuauaagguuuaccagguuuaauuuuaauuacuuuuuuccugaagaugcuuacuguuuuucacuuaucuuuguguuuuucagccuaacuuguuuaauggcauuuuaguuuggagauaggcaugauuucauuaugaaaagccuggaguguccugccuccaacucugaaaugccagaauuacaggcaugcaccaucaccccugacucuuuucaaauuaaugacaggagaucucaggagcccuuuccacauugguuuacacucuguccauaugcuuuaugacaauugcacacuuuucugauuuagcaaacaaaaaguacagugauaguuuuuguaauagguaccccaggagcuagagagauggcuaagagcacuuuucccucuugcaaaggaccuagguuugauucccaggacccauguggcaacgcaaaagcaccugaaacuccaguccaagggaauccaaggcucucgucuggucucaugaguaucagacauacauguagugcaaauacauacauauagcacaacauuuuaaacacauaaaaaauaaauuaagaaaugugcaucagagagagacccuuagcacuauguuguuguucucugagacaaaguuucuuuauauacccuuggcugcccuagaacuacuugggagaccagacuggccucaaauucacagauacccaccugccucugccucccaagugcugguauuaaaggcaugcauuaaagguauacagccuguguauagugauuauuuuuuuaauuaauuuauuuauaaauuuaaauaauuauauauauuuauauaauuauuaauuaauuauuuuuuaauuaaucaaaguauuuagaaaagggguauuuggguuucauagcacuuuuuccuggcauugacaaagacauggauuccaucuuaggaccccaaacaaacagaaucuucaauaauaaaaccuauggauuauuuuacuucguaccuagaaaguaaaaauauuaaaauuaguaugaugaaccuugauuuuauuuccugcuuuguuucuuauauuuggaauauaaauucaagcaaauacaguuauuacauguagucuauagccugugugggaaauaucuuaagguauuuacauuugguuuccuggaaauuuucuucaguauuuaaucuucuauaauaugcugugucauuuuuaggaacuuggauuuuuccaaaggccaucaggguauuacaggagacaaagagggucaacaacgacgaauacgacagcagcguuugaucuccauagggaaauggauugcugauaaccagccacgguaugcccauggccugcuccugcauuccuuucaaucccuuuauugucacgcacguguguacuaaugguauaaaacuaugaugaacuaagacaguauugguagcauaucuuguuaggagccaaguggucauaaguguacuuagucucucuucucucuguuaucuauuauaagaagaauuaaacuugccuuucuuauuuaucaugaacugcuccgguuuguaagcaucuguacuauuugaauuggauugaacauuguuguucuagugggugauuuguuuggcacagaugugccaguuauuuucgcucaggacagcaaggccaugcuuccagcacuaguuaaagacaaagcaacaaggucacuagaacacaagcuuuggagucaguuagggucgugaucaguuucuggcucugaucuuuucugugaaccuggcaucuuccugaugggacauacccuguucagagucagauacuguuauuucuuaauguuuguuuuuaaacuccugccaugcucugugcacuuuugaauacuugcaugcauaaauaaacuuauaccauuucugggcuucacuucaucuauaagauaaguauauauaccucccuuauaggcuaugucaaggacuuagacuagugucuuaaaucaugcucaguaagaguagccacgguuauuagaaggggaaaaacagggacugaaugugaugugcugaugugaaauauagucacaagagucucaguaacugaguaauacuguuuuguuuuguuuugguauaaaaauaguuauugaagcuacacacaacugaguuacuuauuuuuguaguuuaugguuuuuuuuuuauauaugaauuuauucuugcuuuuuuaggcugauucagugugaaaaugagguagggaaauuguuauuuaucacagaaaucccagaauuaauacuagaagaccccagugaagccaaagagaaccucauccuacaagaaacaucugugguagagucacuggcuacggaugggagcccaggacugaaaucagugcugucuacaggccgaaauccaagcaacagcugugacucaggagagaaaccaguggucaccuuuaaagagaacauuaagccacgagaagugaaccaaggaagaagcuuuccucccaaagaggugagaagggacuguagcaaaggcguaacuguaacucaggaggacggacagaaggacagcagcaagaggagagcugagaccaagagaugcaccuuaggaaaguugcaggaaacaggaaagcagaguguggcagugcagguaagcuguauuugaacuauaaagcagggagagaaggcucacaaacaaacggcaagguuucucgugucguucauaaagaccaguacauuagccguuccgcagucuaagugcguucuuuuaccuccuaggaagguauguauagacagagcugugguagauggcgacuuuaucaauugaaggagguccugugucagugaaguucucuuuaagugcucuguacagaguuguauuuuccuuuggaaaguauaacuaccaauuaauauuacagaggaguuuugggguuucagagcaucuaguagaauuaaaaguauaucaaagcuuucuguuguuuuaucuccuacccccuggagaguucugcaggcuggguauuauaauaaaauacaccuuuaaacucagcacucaagaagcagaggcaugugggucuuugaaguaagagaccaagucuggucuacacuguaaguuccaagcuagcaagggcuacauagugacccuaucucaaaaacaaacaagguucacuguacaaaguaaaacuuaacuuuuguuuuuugggguuuuguuuuuuguuuuuuauuuuuguuuuuguuuugagaaaaaugaaacaccuuuucuugacauuguaccuguuugagccagcaguguuauacaguaguaguauccugguucaaagauugguaaaacaacucaaaucuuguuugagaaaaccacuucccagcuuuuguaaccccuuuuuauaccuuuccaaaagggauacuguuaauuucuuauaauacaaaaggauccugacuuuuauuaauaccauuaauguuuugaugacucuguaagaagcuguaugauuuguugguucguuuugacaaaugaagguguuugccuugggggccucuacugcagcaggcugcuuaucagcaagaccaucauuuccuugccugauagaaucgggggcaggauggcaacgaagugugugguucccgucauuuuaauguguuuguucugccagugcccuccugugugcaugaaggugagagcacagccuuaagugucacccuucccuuugacacagggccccucauuggcuuagagugcagcauuaagcuagacucuagucauugacccuucuuccugacuccuccuugucacuuacugggaccguaagugcugcagcugguacuuuuguguggauuuggagaaugaauucucauuuucauguccacaggcauuuuacuaacugagccauccucuaaacuacacacacacauacaggaaauggccugaagagaagaggguaugaagaaaacaaaaaacacaaaaccccaccacauucacuagaccuguguuugaggacuaagcccaagcaucuucugcauguccucugcaguggccucccagugagacccaugcugcuaacacaaggcuccuuuucuccucaguccuucucaaccuacugguagauacuaaaguaaaucuggcauacagggaugcagugcauuccuguaaucccagcacucagaagacaggcaggaggauugcuacacauuugcggcccccugggacuacauagcaguuucuaaacuagccaagacuacguagcagaaccuugccuuggcaauacaacacaacaguuugcagacauaggauuaucaugcucuuuuucugaaacuauuuucuugccuuuggcucaaccuuuaggacugcccauggcaucuccuuauuaacuugauauuuagaacuuugggccuguuuguugcugcuggaaguauuuuuguauuuguuuaaagagccuuaagaugugcuaccuaggggcuggcgagauggcucaguaguuaagagcgccgacugcucuucugaaggucccgaguucaaaucccagcaacuacaugguggcucacaaccauccauaacaaaaucugaugcccucuucuggagugucugaagacagcuacaguguacuuacauauaauaaauaaauaaaucuuuaaaaaaaaaagugcuaccuaguuaaaaguaaaccgggagccaugguaugucaccugugagauaaguuuucauuaaaucacaauucagcaugaagagcccuagcugaagguuguaggcaugccuguggguaugagcuaccucacuuguaaacaaaugauuucuauguuccuuuuccuuauuuuucugugauaagagagcaaaauaauuguauuaguaaaugaaagcccuuguuucuuuuuaauuuucuuauauuaauauagauggacaucguaaaauuuuaauauuuuucuuaaaguaggugcuucuuucuaauacaugggcaccagguuuuuaugguuaguuuugguucuguugauuauagguaaaaucccagacagaacuaagaaagacuccagugucugaagccaggaaaacgccugucacucaaacuccaagucaaacgaguaauucucaguucauccccauccaucacccuggagccuucccuccucuucccagccgaccagguaaauacacauucuucugucugaggccuuggugcagggcuuucuguucacucacuggguacuuuguaaccuuggggcaguguuccuaagcugaacuauaaagccucccuaaugguuaaggggcucugguugcgucauuucucuguaguuaacacacuagugcuacucaguuacuaugaagauuccuccaugcugucauuaaaacaugaaaguaucuuuggggggcgggggggggggguggcgauguugagacaggguuucucuguauaguccuggcuguccuggaacucaaucugcagaccaggcuggccucgaacucagaaaucugccugccucugccucccaaguucugggauuaaaggugugcgccaccacgcccagcuguauuucuuaaugucauguuaaagaccugcaugguucauuguuacuuuuuauaauauguaaaaacacccucuucucaaauuguacaccuuucuuuugucaaguuucuuuagaacuaaagcuguguucuucuguuuuaaaggauucccgcccccaacauauguuauccccccuccuguggcauuuucuaugggcucagguuacaccuucccagcugguguuucugucccaggaaccuuucuucagucuacagcucacucuccagcaggaaaccaggugcaagcugggaaacagucccacauuccuuacagccagcaacggcccucuggaccagggccaaugaaccagggaccucaacagucacagccaccuucccagccaccccuuacaucuuuaccagcucagccaacagcacagucuacaagccaauugcagguucaagcucuagcucagcaacagcaauccccuacaaaagucauaccagcuuuggggaaaagcccgccucaccacucuggauuccagcagguaggcaacaguuacguguacugucagcuuagaauggcaagaaaugcugagguaauuccauguuugaccauucaauaaauacuauuuacguuuguguugcuaggaagguuaaauguuugaccucuugcuuuauuugugaaggguaauaauguuagaaccuuuguuuaugcuuaauugcuagcucuauuaaaagguuuucugcaaaucuuaauauguguacaucuauagguauguagguaaguguaugugcacguguguuuugugcuuuaauguugaagcugaaggacaacuauagugucauccuuaaaaaugccuccaccuccuuucagacagagucucauuggcuguagcucaccaguuagacuagacugcugacccuggagccuccugucuccacuagguuuauaagcaugugucaucaugacuagcacuuuugcauggguucuggggacagaacucaguugcuuuaucauucuuuucaccccugcaccauaagaauucuuaccugaacauagacauuagaauagaaguagauuuguacucuuaagguuuaaggugaaugugauaccagucuuaaaugucauacucuuguuguacuuggaacagaagagggaacacauccuaucuuauguacacauucauuaaacuucuuaaauaauugaauugaaaaaagaugggaguucaaaguccuugucuucucaaaauucucugaauacguauggaagcuacauuuuugccuagaguauuaacugucaaugagauugcaguuuaucuucaucugguugacaggcgccucuuuuuuuaguaucaacaggcagaugccuccaaacagcuguggaaucccccucagguucaaagcccacuagggaaaauuaugccugugaaacaguccuacuaccuucagacccaagacccuauaaaacuguuugagccgucauugcaaccuccuguaauacagcagcagccucuagagaaaaaaaugaagccuuuccccauggagccauauaaccauaaucccucagaagucaaggucccagaguucuacugggauucuuccuacagcauggccgauaacagagcaguaauggcucagcaaccaaauauggaccgcaggagcaaacggucaccuggagucuuccguccagaacaggauccugugcccaggaugccauuugagguauguguccuuucccaucacuagguucuguggaaaucaucaucagucuaugguugcauaccuuaaggauaucucagauacacacagccuuuuaaguugauacauaaaacagggauacauguuuaugagacguaaacauuauaaagacgugaccucuucaaacccauguguuuggagaagaguucauaacugaacuguauuacugagcuguacuggccuggcagaaaaauuaccuaauggcauugugauagagaauucugagaagagcuccuuaguugggugucaucuaaauuuaaaaauaggucucguggguauuuaaauuacgugaaacaaagucaguuaucuucuugcuuguugcucaagagaaacaggugcauaagguuggaagcacuguugucuguguuaauuacucacuagcugcauucacgccuguguccugcucuguugguagucuuacucuucugugucucugucuuccuucacuuuuggccaugccaccuuucauuuguauuucagccuuuuccucugugugcuacaucaguuaugucucuacccuuccuugccuuuagucauguuaucugacuaaccaaucacgcugcuauucuuaugugcuuuugucccuaauugcaucucacagugauccuuucugucacuaggaccccaagagcuccccucugcuuccuccggaccuguuaaagagucuggcugccuuggaggaagaggaagagcugaucuuuucuaacccuccugaucuuuacccagcucugcuggguccucucgccucucuuccuggacgaagccucuuuguauguauuugacauaauucugcuucuugcucuaaccacacagcuucuuuucugagguuuuuauaauacuuguauaggugagcucuucuuucuggggcuuuccucuguauagaaauauaaaguauguuucuguauugcuuaaaauuaaucugauaauguaguagagcacagccaauuaguacuggcucuaguacccucaaauuagagagucauagccuggguacacaucagucagaaugucucagacuggucugcccgcacucuaggugaugcuggcacauuaacccccucuucaggcaguacacaccuagccucaaguaucagguauuguauaguauauuuaauucucaaauguauauaaaauauuaaaggaagcacaucaugaauguuugaauugauuaauugaauugauugguucacuggacccuaaaagagcccuggucuaaauucagaauuggaauuauaaaacaaaauggauaaaaauggagaaacuguucggaaaaggguuuaagauuuuaaaugaauggcuaugaauguaaauaaucaggauaauauagaauaagauggaaugauugacuacugagucuuguagaccacaggcugcagaauguuauucuguaugcucguugguauuuauaucauuuuaacugaggguuuggaauauaaaccuaaugaaaccucucccacuccacacacacacacaucuuaaagcaacuuaaaaagauuuuugaguuuuuauuucuagcuuuuucuuuccuguaaauauagagcaauaauccauuaaccauagagucagaaaaaauagcugccacuccuaguacuugaguuugccugggcgaguuagcaguaaaggcuuccugcccugagggaagaagccuaggagccaugcagcucagcuggggcgguugcugcugcagaugugccuuuguguccacucacucuucugcuccugucuauuugcauggaacuggccaugauagaaaaaaugggaccuuuucacguguuuuguuuguuuguuuguuuuuugcuugcuugcuuuaaaaauuuuuuuaaauauccuuuccuguacuuaacauaguuuauaauguaauguauuugaaaaugcuuuccguguaguggguguucagcaaauuauuaaacuguuaucuauuaacagcaagcauuauauccagcuuucucuccccugcccccacccccaguaacuuuuuuaagacaauuaaauagaaaaucaacuuaguauaucaugaaggcagcugcuuuagaaaacauaaaaacaaaaccagcuaucaaaauggauuugaaaggcuuuuuaaagucaauaauguuuuaacauuuuagagaguaaaaccugcuaggauaauuuguccuuagggaauuccugagggucauauccaaaaaccaauccugguuccugucagcaucucugcaccagaccagauaaacccagaaaagaaggucugauucaccugugacaaguggcacuuaguuggagucauuguauuaucacagugaacacucuacuaaccuuuccuaaguccucuaccaugggacagguagacacauguuuaaguguuaguuuuuaacuugaaaguagaagaaauaaccuuuuuuuuccucccucuaccugggacugcagaaauccuuauuggagaagccuucugagcucaugucacauucaucuucuuuccugucccucacgggguucucugucaaucagguaagcaaacuuuagaauuuuguuuuauguguauuguagacugguuugucucugauggggguagacuaguaaccuguauaucacaagcuugagccuuuuaaauuucucaucgauacucaauuucuuagagcuugguugacuuuuuuuuuuuuaauggccucagauagauaguuuacauagagcaaaauacaaagugaaagaaagacaugaaagugaaagaaguuaaagucuuggaguuugucuuacugagaaccuuauaggucugcugagucauccaugaacaugacuuucuuaaaucucuuucuguguuguuaacuuaaucuuucaggaaagauauccaaacagcaguauguucaaugaaguguauggaaaaaaccugacaaccagcuccaaggcagaacugaaccccucagucgccucccaggaaacaucacuguacucccuuuuugaagggaccccauggucuccaucacuuccugccaguucagguaucaacucuaauacuuagauuauaaaccuugccuuuccuguacauccauauugacuaaacauuagucagauucuauaauuagaaaguuuuuuauauuaucauauauuauuucucuuuuggaauguuuugggcacuguuuauauguuugcucgugugccacaugugugcagugcccgcuggggccagaaagaggguguuggauccccuggaauuggaguuagagaugguuuugaguugccauggggguccugggagucaauccuagguccuguggaagagcacccaauacucguaacugcaaagucaucucuccagacuccuuuuauuucagcuuuauaaagucuuaauuuauaaugauucuuaggauccaagguacagucagucaggcacaacagugaucagacagacugcuucauggucuuuauuuggccuuuucuccaaaaccuucuuauagugcuuucauucaaauuuugacuaccacaucugaagaaaauguuaguucuugguuuggugugggaaaccccuauuuauguucauaauuauucaacagaucauucgacaccagccagccagucuccucauuccucuaacccaagcagccugcccaguucuccuccaacgcauaaccauaauucugcuccauucucuaauuuuggacccauugggacuccagauaacagggauaggcggccugcagauagguggaaaacugauaaaccaggugagauccacauuucuuuaucuacaaggcaaagggggguggcuugcucugauuuuugccugaaguuugauauuugccacuuacaaaacauuuuguauucuuaccuauuguuaucucuuagccaugggugguuuugguguugauuaucucucagcaacgucaucaucugagagcaguuggcaucaggcuagcacuccgaguggcaccuggacaggccacggccccuccauggaggauuccucugcuguccucauggaaagccuaaaggugagugcucacguggcuccugcugcagcagugucucugcuuuuaucccggauugagaggcgucuugaguguguugucagggcauccaaaaugcuagagcauuuaguuucauccuaauguuaaauccuguuaaguuugaguuuagccuuauuugacuuauuaaaugaguauguaagcugggcgugguggcgcaggccuuuaaucucagcacuuggaaggcagaggcaggcggauuucucaguucgaggccagccuggucuacaauguuuuguuugcuggaaaccuuauauuaaacuuacugucaugccauaugaacuugacuuaaaacauaguugauuugacuuaaaacauaguuugggcuggacauguuggugcauguaauuccaaaagaguggucggaguaggaggaauaaccuuggcuugggguuuaaaaaguuguauuccacuguucauagugucaaaauuaucuuaguuaggaacugucuagucuugagaguuccaugacuuuuaauagagcugaguugauuggcauuuagaguggauuuaaaggacaaauuugucuuuauggguggcugagauuuaaaacaaaucccugucagacagccaaagcauuugccuucugcugacaaguuuuggggcuguuuuucagucuaucugguccaguuccaugaugcauccugggcccuccgcucuggagcaguuguuaaugcagcagaagcagaaacagcagcggggacaaggugccaugaacccuccacacugaggccacaggagcaacccagggaaugaaggcuccauaaaccauggcauguuggguuugcaggacugacccacacagucucugcagguggcagcucucuugucuguuucuugcugucgagaggguguaaguguuccaccagcccgcugagugugcacgaaauguucgcagugcaacaaaaagaaaaaaccaucaggaacucucguucccccggggcuuuccggagggagagaggagcugcuguuugucccacucgguuacugauagcacgccucucaccuucuccaccgcgcauguccccaacacgugggaaguggaagcugagaagggaaggcagaugggagaaaccaauaggaacuucucaguccuuuuuuccucuuuggggaauaaaauaggaauccauuaugagugcuuugcugacugagaauguaguugaaauuauucuuaaacaucuuuuauuauuacucucaguagcaaaauaucacacugaauucuuccauacacaggcguauuucuagucaguguggagcaaagacagucccguuugcugcuccugugagaggucaguggugacaggacagggaacugaccucuuaagccagugggaguguuucauagggaggguacaaggccucuuagaagguucugggagaggccuuccuccagccuggaaacuccagcaggaaaugcccuucacucuguaggugcucgagccccaauagaggaugcaguguggguagugcugcuggccuagaccagcagauggcugcuguacgauuucaaauucaugugguggauuccuacacuuuacaguagcguagcaagcagucucagaaggcaggcuaguucauucacggccuggaacccauuuuaauagguggaugcuuucagugugguucuuuuuguugaguugguuuuuguguccccauccugcuucccagccucuugcaucagucuccacccuuuagccauaugcuguaccguagucauuguuuucuuccuaccguguacaacaucucaccacgaaacagcagcauggggccagcacuuggggcccaaaagccugaagucugaagaggaaggaagcggcagugcaagcgucacugcagaggagccgggcuaugcccagucacagcuccuggccuucaccucgaggaugaaguugaaggccacagagacagaugcacacugugcacagaagaaaacacagcagaugccacuuuggagagggcaagagaaaggaauaaacucuauuugauaauuuauauuaggaggaaagaggacugaagauguucuguguaggaacagaagaacggacagcauuucuguuagucauuuccuggaaaaguaauauuuuaaugggaaauuauggaaacaaucuaaauguccaauugcugugcuaggguagggauuauuuucugggaggugugugugugugugcgcgcgugugugucccacacauggcuuucuacucucccagagggcaagggcuaagugugggaaauaguguggagcuuagcugaaggacagcuguagagcaaagcacauccaggagccccaggugucacuggggucugggcagccccgaaaugagaugggguaagguauugcucauugcucuucagaaagagugcuugaagccccaggcuuacucuauugcucuuuuaguuugacaugguauuuggauuuuuuuucuuuuuucuuuuuuuuuuuguuuuuuuguuuuuuuguuuuguuuuuuggguuuugguuuuuguuuuguuuuguuuuugaaaggucugaaagugaaacccuucacuaaauggcaaaagaaacugucugugcugcuccagucccucccuguguccaucuuuguccucucccugucccuucccugcuaccuucacccaguuuguguauguaagcucugcauucagacagcugcagcauuccgagguuggaaaugucacugauucuugcaccuuagaccagccaacagguuuaccaguucccucccugcaguacccacuucccagcuauagccccagucugcaugagaauuugguguuuggaauguuuaugacucucucggcgggguuccucgccuugccauccucacugugggguaaugaagaaggggaggagaaucuucaucaacugguuuuguguaauaaacuuucguguuuuguuuugauuugauuugauuugggguuguuuuuccccccugucugucugucugugcaagaucugcagcugcugaaaucagcuuugccuuuaauuaaaccguguucucuccaagcag

SEQ ID NO: 425 - RNA, 114385 nt, Mus musculus
gggcgcgcucucgagugcgcgcucggaagucgggggucggcgcacagugcaggcugcgcaccgggagguagcggaggcagcgcgaucuuggcucggacgcccacccaucggcucugcguccggcucucggccuccagcccgguccacagcccggccucggcccgcagcggaggaucggccucgggauacgccgcuaggcgagugcagcgcggcaccccagccuuugccgagggcccgcgcgcagcgggaugacgggcggcgggcgggccgcgcuggcccugcagccccgggggcggcuguggccgcuguuggcugugcuggcggcuguggcgggcuguguccgggcggccauggacgagugcgcggaugagggcgggcggccgcagcgcugcaugccggaguuuguuaaugccgccuucaaugugaccgugguggcuaccaacacgugugggacuccgcccgaggaguacugcgugcagacuggggugaccggagucacuaaguccugucaccugugcgacgccggccagcagcaccugcaacacggggcagccuuccugaccgacuacaacaaccaggccgacaccaccugguggcaaagccagacuaugcuggccggggugcaguaccccaacuccaucaaccucacgcugcaccuggguaagcgaugacagccccguccccacuacucgcucacgguccagcuccggggccgcauccauggagccgcugguccggccugaggggccuguccagccgcgugcugacggucuguucuccagcgugggccacacacagaaauuccuuucuccaacuucuaaaauucaucucgcuuugaacauccggugagggccaccaugucccacgcuagcaucucucucuuuuuuucuuacucuuucuaguccaaccggauucucguuccguugauucuuuucuauuucagcaguuaggauuuuggaccaacacccccccacccccuuuugcacccugaggcgcuaaugaaacacucauccuggcaggacaggacuaucacauagcaugcuuacauuagagucuugaagguccacuuucaaacacuugucuuuaaaauguuugucugucuccaggguugagaaugauugcucuuaguuuugauaggggaauuugaggggagcaaaugccuuugccgccgguauuucuauguguaauuaaaguggaaguucacuuuuaaaguuacuguucuucagagcuguucagccuuaauuaggagcuguuucacugcuaauccuaguugggagaaaacagaaagguaaugaagacacucucuguaauugagggcaguuuuguuccgguguaaaaagcuccaaggcucuccuggauagucuucccuuuugcuuugauccgaagcaaguguggagacaagcaugcuuuagaauccaggagagggcugaaguaggagacuucauggcagagccguggaugagcaaggcugugauuaucugaacggaucaaaguuccugcuucaccuggagauguuuucuuuacuuuugagacagacaagagagcagaaaaauuuucauugcuguguucaguugugcaacauuaagugugaaaaacugauuguugcccugggauauuugagagggauauuuuguaggcagauaguccccugaucgugguuucaggguuuucuuuccacugcucuucauuauauuauauuauauuauauuauauuauauuauauuauauuauauuauauuaucagggaauuuucuucagagaaagacuaugacuuagagaaagugccuugaaaguguaaaugacuguguguggaggaaguuuuaggagagcaguguuacugccucuguaguagaugcugccuuuuucuuuguagacgagucaccaggcagauggaacuuuuugaaaacaagcucauaaaugaaaaugugaggcauccgauuuucaguaauuaagagugaguucgguuuugaaaaggacuggaacgacauagaaguguaaaagugaugcuuuggagagaugccuuucuccagacggcacuccgcuucccaagaucucugggaguccuuugaaguagcuucagaguuuuuaaguucuauaacuuauguccaguuauuuuuaacuuuuuuuuuauguuuuacuuuuuuuuuguacucaauucugaauccccuugaagucuugcuuaauccguuuucagauuuaaaaaaaaagaaacaaaauucagaggcaaggccuugacgucucccaagugccugagaugccguugaaaaguucugaacaauaggcugucaaucucugcuuuccuccuucuuuaggcuaaggagcugagguuuauuucaggugauugcagagggagaaacuaaucucuggcgaagucucuguugcagagacaugcgcuaggguaagagggcagccagguugcuacuguugggggccagcuauauuaauuagcuuugggccauguuaaugacgaggccaaagaacucuuccaucucauuaggacggcaacaugauauuuucuauacgcuuggacuugauuuuacugaaaaauucuucaguugguugcuaaaugacauucauaaaacuggggcucacucuggcuguccugggacucacuauguagaccaggcugacuuugaacuccuagagaacccccaccugcuucugagugcaggguacugcgauuccaggugugaguagccacacccagcggguuuacucuuuaaaaguaaaguuuaaaauauuuucaaagccguguaguuauuguaaaaacacaugcuuuacacuuuuuagacaauuuaugaaaacuaggacuggacagacucugcuuguuguggguuggaaaugaaguccuggaggaaaugugugguggcguagcuggggaggggagaguuuuauguguccugggaguugguguuucuggcuucugucccaccuuuauuuauuuauuuacgaccagguauauaugcaugaaugcugugcucaacaauuuagggcaggcaggcaaggauugacuguuuugauauucaguguauucaccccgaugucccccuugacuccaguuacucugugggcuguagcuaacuaauuauuucccauggagucaaguaccaugacuguucuguguauccauuaaaucucccauccaguucacauuucacauacccuuaaacaagugaugcauauugugccuugccccuccagagcaugugaaacugcagugagcagugggggagagugggcccagccucugcgucaccagccugccuuucccugucgaacuuuccucacugcaaaccuugagaagaaaucaaguccaggguuggguguguuggagcauuccgggauggccuaggcggagucuaggaguucaaggccaaccuugacuacauagcaaguuccaaaccagccagagcgacauacuaagacccuguuucaaaauuuagagagagaaaaaaaucaaaucagaucacgcuuaaguaguuaaaaaauuauauacacacauacauauauacacacauacauacauaaauacauacaugagugcaugcacgcacaugugcgugugugugcacacacagacacacacacauguuuuggcaaugguugugagucacuuuuauuacagaaaugaaacauggcuagauauauucaaauaauaaauauaacaaauagucaauuugccuuuaguugcuaagcuccacacccaagagaccacaaugacagguuuuuauguaauccuucagaaauguucauauaccggauugcaugaucauuuuagcuaguaccuuuuggagaaggugucuuaacauuugacagguauaaauuaggucuuuguauacaauacccaucacccggguuaaaaaaaaaauccaggaaaacaagcaugaauucugacaacugccauuuuuaaacugugauguguuguaauauagucggguuccgggcauagcgcaucuguggauaugaagaguuaauguugcuuugggagcgacuauaucuucugccugcuguggagagacuucucagucaggaaccccuucccuaaaaguaagccuucuuuugcuuuuagcuuucagaucucuccugaguaaucgguauugauuacuugguugcuauuuaaaaguguagcauuuacauuuaauaauaacacuguaaguuuuaacaauauccgggaacuuguugaaagugcuguagcugagcauuugacucuuuaaaacagucccuuuaauuaauuuaguaaucauuguggauggaaacuuggcagguaggauuuugaucuugcauaaagguaagcuuuucucauucuuaaaacaguuagguuaagaaacuguuucuauaagcaacucaaucgaaguuuaugcaaucuccaaaguuagcauugcagcccaggucccaagcucuucaucagaucagacauggaugguguaaucuaugugaagugucucgugugugugugugugugugugugugucugugugugugugucugugugugugugugucugugucugugugugugugucuguguguguguguaaaucagaaucaacacagaaggugauuugguacgucuaugaguucaauuuauuauuuaauaugaaacaaacagcaaaguuuccuuuucuccuggaaaaaucuuuguaauaugggcucugacuacaguugagccagugacuucacugugguauuugugcacccugaggggacacuauuuuucguuugucucacagaggccugauuuacauuuuacagguuucaacuugagaagucaaggagcaguucuuuaauggccaguaguuuacugaaugguuuuauaaaagacgcuguuggcuaugccccuguuccacaguucauuguuuucucugcaaauuucuucuccugguuuucuaaggcaccagaagaaagcagacacaccagagggaaagcuggagccgaggcucccugcuccaucacuuuauccuuggucacauuggugucagaggcggaacauuggguuauuucaguccuaaauccuuuuaggaagcuggguaugcuuuuuaucauguuccccccuugcagugugcauacauucucauauuacagccagauauuccguaaacauuuuuaaaauaccugagaaaugcacaccccagagccuaauaggaagguguggaagaccgaaggcccuuuucuaagagcucaugugcuucugaguggaauuuaaaguuguaaugcuuuuugcauauuauagcaagggggggucuuuauaauaauauuuuacauuuuuugaaagccuccagauugucagugguuagauuucuuguaaccucaugaaggugacccugaggguccuguaguugugauccuaugaguccucggacagguaaguccaagucaccuugguacaucauucucugcagcuaauaguuccucuagcaaaucucuuaagagaguguuuaucucuuuaaaauaaaagcucagggguuuaucccuuuaaaauaaaagcucaugggugcggggugggggagggguggggcuggagagcuggcuuagagguuaagagcgcagauugcuuuuccagagguccugaguucaguucccagcaaccacaugguggcucacaaccaucuguaaugggaucugaugcccuuuucuggugagucugaagagcgacaguguaugcaggaacauaaaauaaaauaaauaaaaaggcucacaaacagauugauucagagaucuggauugcuguuguucuuuuccuugauuucccaucagcuguuguuccuuuuuugcuuacauucccaaauucuuauuguugcacacacacugucccugagggaacauguagccuucauuuaccauauucaaauguaaagguguauuuccgguuagcucuuccuucaggucuaguccuggauaugauggcugugggguggcuggguggagccaugcuuaaaauuaauuuacuucuuuuuuuuguuuuuuaaggaauuauuuauguauuuuauuuauaugauuacacuguagcugucuucagacacaccagaagaggguauuggauuccauuacggaugguugugagccgcugugugguugcugggaauuggaacucauaaccucuggaagagcagugcucuuaaccgcugagccaucgcuccagccccugauuuacuuccuacuguucuguccaccgcacaugcaguguggacuccauuggcuuucaucugaugauuuccccaucuugacacacuagugaucuuucagcuucacagaucggcccuuacgcagauagcugucaguuuucagcgggguagugcucuuaacaaagccccugcagccugagagcauaaguugaaagugcuuguagugccccuguagugcuuucugggcuuuggcaacagugguguuguugaugcuuguacuggaggaguaaaugcagagcugcgguucuuuguuccuucccaggguuggucaagaggaccucguuagguguacuucaggaagaggucaagucagaggccagccuggugucucccgaguucucauucuucacuguaaacuccuaaauccaagccaaccuaucagagaaguuggggacucucaguaguugagcugcaguauuuuguauuucagaaugaccaguggaugugaaauguggaucuugucuauaacggccuggguuacaugucuucugucaaccacccugucugaguggaaaguuccuagguggcuccucagguuugcuggcaaagccuuuguccuguuagggaggugcuggaggcucugaauauugucaacaacuagguuuccccuuuuaucgcuuuugugcagagaaggcuguccuuccauguggagcacuucucccaggugucagcaacucagguaggcaggacuccuuccagguuccuuucucccucuuucuguccccaccuccuguccuggguuauaccuucuguucagccacccugucaguaccugucaucauauacuguuaucucuuucuggacuugccuauuuuugccucaaggucauauugaaagucuuagugauuuaguuuuuguuuaagauagggucuggcuaccuugcucaggcuguccugaagugccuggccuuaagcugucuuccugccuuagccucugaaguugagcucacaagcaugugccacuuuccccagacagcuauacucuuugaagguagucugguacuuugccaucguuuaguuaaauaaaauuaacccuugccaauugcucgcugggccugcacacuucugauggagagugaucccgaggaccugcccugccagucugagcucuagauaaaggaaucuguguuuuagauuuggggaguaggaaaaccacacacccuuuacccaaaucuucucagccuguccaucuaguuuuguaugaauagugagcuaugaguagcuuaugccuuuuaaauugguuuacccccaaccccgaaaaaaauucaaaguaauaauaauauuuugugacuugaaaacgacaugaaauucaaauuguaguauauauaaaguuuuauuggaacaacauuaaacucauuuaauaacgcuguuuuguacuacgaaggcagggcugaguaacugggacagacuauguuccugcuuauagaagcugaaguguucacugccuggcccucacugcacaguuuuggugaacucuauuaggguacaguaagucuuuuuuuauuauuauuuaaagauuuacuuuuauuuuauguauaugaguacacuguagcuguacagaugguugugagccuucaugugguuguugggaauugaauuuuuaggaccucugcucgcucuggucaaccuugcuggcucagucucugcucacuccggcccaaagauuuacuuaauauuauacauaaauacacuguagcugucuucagacacaccagaagagggcgucagaucuuauuacagaugguugugagcuaccaugugguugcugggauuugaacucaggaccuuuggaagagcagucaguacucuuaacugcugagccaucucuccagcccacaguaggccuuaauugagaaaugcaaauacagagaguacccccccccccccaguaagcguuugguggaaguuggagcuuuugugucuucagucuuuagcaguguguccggcagaauguucaguggguauuggugggguaagugauggacugaguuacgcaugcgcaagaggauuacccacaacucccuuucuucagagcaguacuggggauggagcuccugugugccaacaguaccaccucuguuuucccaaggcaugugucaguguaguaacuaaucuaagaugugcgacauaggaauucuauuucuagaacuuuagaaacacuaauacagaauuuugaaagaacugugucauuuuauuuuaucuuguguuuugaggcaggaucucacucuguagcccaggcugaccugaacucacuguguagccuagguuagccugaaacuacagaugugaacuaccauacccaccuccauaucugucuuuauuuauuuuaucugucgcugucuucagacacuccagaagagggcaucagaucccauuacagaugguugugagccaccaugugguugcugggaauugaacucaagaccucuggaagagcaguuggugcucuuccaaccacugagccaucucuucagccccauaaacaaguuuuaucuaaaaauacauaugcacugucuauuguuggaaagcucccuguacuaugagaucauuggaaggaaagagucugcuuuucacguaugggguguauguguugguuguaguguauugaguuguuggugggcacagaugagcaugcaggcacagaggaagaugagcaggcugggcuauuggugugguagugaacaacuguagaugcugagcagacuguaguccugcauugagguggucaggcagauggacagucaucuaguagaggcugagcgcuaacaggaaguggaacagaaccuggcuuugcugggucucaucuccagcuggacuugauuggcagcccggcagcuguccucuggauuuuagggagaagugucaaaguuuagagcagagcuguuuguuuauuuucacugcuccaaauuccugagacuuaaagauaagggaugagccugucuuaccuuaaaugguuaauuucaacguaagguuacaagauggcagugcaccaaauuucuguugcccugucuugguggcuugaccugagaucuguaagcaggcccuuaugggacgugcaagcuccuuucuguaagaugauaaaguuagaugcuuguucauuugggcuuaaaauugacagcuugcuuaauagaagccuccagaaagcuuauuaaagucccaucggcaucucuuuccaggccuuccaggggccuuccaggggccagccgaaaauaacuggacccagucagucuggugcccucugcagcuacauauucaugaaauaaaauaaagccacuaucucuuucuuggacaaugcacgcucagaucucuugugggaggagcaccucuggcgaggcugggaggugaacuagggaugcgcuugguuuucuucucaaacuugagggcuucugucucucagcucccuccguuuauuuuuuguuuuccagcuguggagccuuccuguugugcugaaggcaacagugaauuauuguuuuauuucacccauuuuuuuuuuuaagauauuucuccuauuuucaaucucaucuuuuuguucugaaaaauugguggaaaacuugauucacaauaggucuucauguuuuucauuucuucucucucuccucucuuucucccucuuuuucccucccucccuuccuucuucuuuuccuccuucccuccccccuuccaccccucuuuucuuccuuucuucccuuccucuguucuuuuuuccuuuuugagacaggaucuugcuauguaguccaggcuagccucaaacucacuauguagcuauguagcucaccauggccuugacuuugaagcaaucuuccuuccccaaguuuccagcugcugagauuacagaugugcauaauauauagguaacuuauuuauggaauuaguuuuagcaagcacaggauuucggaaagcaaaagagcuauuucuuuguuuuuguuuucuuugucuggaggucacuugcauuaaugguuaccaaccaauaucuguugagaaccagugguccagcccauucuagcugccuaccagccugugugaguucuuggggagcuguucugaaggccagccuuggaagcagagcucuucgaggauugugcagggugagcguccccugcagcgagcugugguucggguugauguaaaauuguaagcuuguggauguugucccagguuuacagacuaaggauguguguguuuggugauaaggucaaggauuuacuuuauuuaguuauuuauuucuaaauaaggugcuuuccgauucccagggugaaaaggaauuguucugcaaguguucucugcugugaugacuuaaucuucgucccuuuaaaccuguacuagggagugacuugugguggagucugcuagguacaauacauucaagcuugaauuggguggcuuucuuggagaagugugugaagcuaacauauuaccaguugugucaggagucucucccccuccccccacuuaugccuugagcuuguugcauugagauucuauuuguugaacaaagacauuauuuaaauggcagccagggagaaaauuuuuccuuuaaggauuuuguaauauguaauggauaucaaagacacuugcuguaccgguacugagggaaucuguaaugugucugagggguuaagacagaaacauccauccauaggaaaaaugacucgguggagauuuucagagugcuagggagugcugcagaucacuugagaggugagcgacaagucagccgggaaaagcugauuggcuuuugaaaacagcuaauggacaugaaugaaggaccuuccaggaaggcuggauuguuugagcgucaauauucuaaacacaaacuagaacaaaaauucuaaaaauaaucagguaauugugaaggaaggcguggcucaccuugcguggaguaacgugaaugguuucagcuuggaaaccgguuagcagaagaaagcgagguuugccucuuagucauucuggcuaagagcaagugaagaaggcagauucgugagcccugugcugggugccuccgaguucugcggccucaagagccgauaccucugugaggaaugaggugaggugacuugugacuucccuguggucacacaggugggugucggugggauccugggcucacaagcuucagucacgccccugccccucugccaccugagagcagacuuggcacaugaacucuacagcgaacuguagagaccuucaccugggcaaaggaccaagugacuccaucagagagcuaagccucgugucucugacuuugcuggaaaaagcuggauuuggaauuuuuaguuuucagauuuuuuuuuaagagagcuuuauacugauuuuuaaaugaaacgcucuuaaagggacaacuuuuagguucagaguccuuuaacuagucguguaauauuuagucuuaugccuuuuggaauguugaaggaauguauugaauuucagaaugaggcccuggguuuugucagugucuccuaauagaaaagggggaagcauaccauguacuauucugaaggguggucaguaaacuccaauuauaugggggaaugcaccuuaucucauuuccuaccucggccacuauuccuuucugcuugcugaauugcugagcucaguucaacuguucccuuuaucugacaucacuaaagauaaggcuucaaggcggccugguugaucuccaguucuagucuguuucuccucugcucccaguaaauucugacccugcuaugguggcuuuguguguguguguguauuccucaaguuugcugaguaggucuaaugugcauuuuuauugacugauuagcgagauagcuucuguacccccaggaacuuuccuuugucacccguuccuucuuucaggcuccagagccccaccauucacuuugauuucuguugaugcaaauuugccaagcuaucaaccuccgacuugcuaaucuuucuggagcuaagguucauuugaaggucacugguggguuuuuucuuucuuucuuucuuucuuucuuuuuuuuggcuuuauuucugagaacgggccauaauugccuuggaagacuuguguuugugguggguuugugccucggccugucauaguucacuucucugaauugaagauucagacaaacaaacaaacucaacccagacccaaacacuucaacccagagcccuccaggcuugagcugccugaggaauuuccguguuucuguccgcccuuucugcuuuccuuacagacagaccgaccuccucagccccuaccuucuuucuguccuuguguggagaaugugguuacaccaccacauaagaagcacuggggacuguuaaaggcuuugaugaguuucuuuucuugugggaugggguggcacuccuugcugcacagaaguagggugagaugggggagggaguguugguuuuagaagccuccaccccugcuucucucuccucccccucccacugguaaaauauguucuuggcguguucuaucaauugauuccaaagagaaugaaaauguccuaccuuuuccaggagaagaaaggguguagggagaacacggaaugcguugucaggcacuaggaaguaauaauuucccgccuucagcucacacuguaauugaaggcaggaaaaaguuugccugcagauuucuaaauucuaugaccaucuuaggaauacgagauugcuccuuggcaauguaaaacuauugauugacauggaauuucaguuuuguguccuuaacuuacaacauuuagaaccuuagcuucugggaggugaacacuuuuagaguagguggcuguugugguuuaaauguguaccaaguucaugccucggccaccgauccagucuucucguguugacagaggggugguuauuuaugaagaccugcucuaagugucuuuggcauggcuguggguuuauugugaaagucaguuuggauccuccugguuuauuuaugcucuugcugugggaugcuuccauuguguuacaauccacaagaagacccuuaccagguagguaccagcaggcuuugggaugucucagccuccagaaccuugagccaagucaauuucuguuuauuuuaaauuacucagucugaauauagcagcaggaaauggaucaagauaguggcuaacuagaguaguaauaaugaaauuauggaguuuguagagaauauagguaaauccuauauauagucauacaugccuauauccaugcaaugccugggaggugggauggaggucagaaguucagaguuaccuuaggcagcugugggagcccaagacucaacaacaguccuuagggaaguuuaagcuguuaaaaauauuuugacaaaaggauucgaguuuaauuuauuuuaaacucauaccaaggaaauugggguuggugagauggcucaguggauaaagggacuuuauucagccuagggaccugagucugauucuuggaacuuguauaaggguaggaagagagacuugaccccauaaagcuguucucugaccuacagacaugcacaaguauauauacacaccauggcauguguacccaccacaugcauguguacacaguaaugcauacaguuaaugguggugugguugccugaggcuuguaguuaaucugcucagcugcguuucucagguguuccugcucaucacaucaaauagucugauaggucuagugacuucaccugugacuggugagccugaugcuuuuaggggcuaggguagaggacaguguuaaauccccugggaccagagucacagacaguaauaagaugcuugauguaggugcuaggaacuggaccugaguccuuugacagagcagcaagugcucauagcugcugaaccuucucuucauccccugagguucuauguuuguuuuuuuaaagacagggucacaccauguaacuggcuggcuuggaauucauugggaagguuaggcuggccuugaacacguggagauuggccugccucugccucccgagugcugggauuaaaggugugcaucaucacgcucagcuaaguuuuugacuuguguuuuaauaugagaucauaauuugauacaagcgagcauccuaagaauuuuccuugcaguuguucauguuggauguggggagaagcugggaugaagguuaugggguggggacugaugacgcuuguuagaugccuuaagaccacuucgugggaaaaguguugcgaucaggagaccgcaugccccagauugacuuuguagaucacuucuaugcagaguuggaauuuauagugaguauuuuagauaaacacaugcaauagaaacuucccaagagauuacagauucuuagaauuuuacagauuaugaaaguuuauggaaacaucuguaaugcagcugugauaaaguuuguuuacuuuuaucaacuuuagaaguucaagcauguuuacugcugucgucaggguuuuuaccccaugccgagauagaaguuagcacugaccugugguggacaugggaaccacuugguuugguagucaucuugagaaggcuuugguuuuugaugacaucccguguaaaacugggcugugcuggcccagacggcagugguggguguggaucaugacuaggggagacucuggaaacagacaaaccuuccagaugucuagagaauguggacuugcggcggccugugcuugccguucuugugucuguaucuguccugcuuugacuuucaugguugcuuuagggaagggcccgaggaccuguuucuuagauugggaaauaaaauggaaguuaacguuuuucuggaagccuuuuaguugguauuggcuuuucugugagagaaagagaccgagaagccgucucagucccuuaaggccgacugugggugggggcggccucgaggauguggcugagagguaacggaaagcagauucauucauggcucuggugagcuucaguuaugaaacgggccuccagugccccagucagcagccugugaaccaugccugacugaaugggucuugguuuugaaauuuacagauugccuggauccccacugucuccuuggccuucuucucagaugcagcuguuuuuguuacuacaucauuuuguguuuuaacuggcugguuacuuucccagucccuuuuauggugaauaaugacacauggagcuugaacacccaaguguguggcuaaucaaacaggaaaucucaaggaagcacagagaaacaaaagacaagacaggaaaggucauucaugagccuaggcaguagacaucugcgggaacaucugacagcuugagacaggcuggaaacucaaccaguggaauguuuuaugugggacuugcuguuuuucuuaugcauuggaaauauuaagccuuaauaaauuagauagaagugaaggugaaagagagagagagagagagagagaaaagaauguggcauucuugccuuucaaacgggaaggcagcucuggccgcagggugccuuggaucuaaaagucugauguguccugucugaagcagcagugaagcugcauguggggugaacgagugacuggaggugacgaccggguuaaaagauggcuuuaagcagugccugaggaauaggagguuaaaaacaauuaggcggcacggcuaucauuguagcgggaggauuuugacuuccaggcagccugggcugcauagcuagucuauaaccaaagaaccaaagagaagaagaaagaaaaauguggucuaguaggagagcaaaccuaucaacagaucccuaaugcuaauccugggacacagaguugugacaagaacagaaaacaccaugggaaccgcggaaacuccaguuaccuacagagaugucagcaguccguaugaauacuacaaagacaguccauauaaaugccuucucagaagcaacugucuggugaccuuuaagauuuauuuauuuauauguauaugaauacacuguugcugucuucagacacaccagaagagggcaucagaugcccauuacagguggcugugagcuaccaugugguugcugggaauugaacucuggaccucuggaaggaagagcagucagugcucuuagcugcugagccaucucuccagccuguauagagauucuugccuccucugaucagagacuugucaggaccagccauuuaaaugcuaucuucuacauaauaaugaaauuaggaagcuacagagcagaacugcccauuaagcaccaggaggugaugcagaugugaagggaaggagcuuugggccucuuagguggaagcugaggcagugcugguugugugccuggcucugcauuucagucacagugggcuucugcacaccacagagaugcucucuucccccuugacugcccccuaaaugcagcugcuaaaggucuaguggaguuucagcucuucccggaagaccacugauuucaaacucuccuucaucguauuuguauuugucuuuauguuaugccagaucuauaguucaucugauucugaacuugaggggaaaggcugcaggccugugaggugaggggugugguacugucgccaggauuuaccccauuagaugaauacuccgaugcuaauauaaacucagugauuucuuagucccucuuaugaaauauuuagaauaucuauuaugcaggagacacuguaaaauucggggacgggggagagaggaucugagcuuuaaaaucugggugaaaugaugcggcaccgaggggcuauuaacugucuuccuccacuggcuuugugucucugguguacacacagccugguauccucugucuggcagucuguacucagaaaagcucguuggaugaaugaauucaauggagacuucugugacacugugaccacuguguacagaugaccucaagaagcagcagcgguuuguuuauguuuucccaagauggaguuucccuuuagauaggguuggaguuggaugucugggguagguuggaguacgugguguagcuucugcaauagcauagcacuagaccccuguaccaaagaaccccaacaagaaagucaucuaccaaacauugauaccugguuuucuuuuauguggugggucuguggugagugguucagggcuaucuggaugugggauuaugguccucaucugccauuccuuagagggccuuccuuguuuacgguugauuuugagggaugagcacuucucgccuccuaaucggugcacacuguugagaacugugugucuuaaguguuaagacuaagaccugauguggcgcacaucauuugcacugcuaugacaaggacaaugagaacagauuuuggcagacagcagugcauagcgacguuucucccugagcugugccugccaacuccuguguggcaguacccacuucccccacaugguggucuuuuuguggagucuuccucagagaucucuucucauuugaggacaguagcuggcauaucgucagugagcccuaaagauccuagaucuuccuagagccuccuuccuaaggaaagccuacauuuuucuccugcuaccucagccugaccuccacucccugccuuggcagaauuuacuuuauuuuuauuuuuuuaauuugaaacuuaucauuaaccaggaggugguggugcacgccuuugguucuagcacuugggaggcagagguaggaguuuaaggaguucaaggccagccuggucuacagagugaguuccaggacagcuagggcuacucagaaaaaaaaaaaaacccuguuucaaaaaacaaacaacaaaacaaaacaaccaugaacaaacagaaaagccaauaacaacaaaaagaaagaaagaaagagagaaagaaagaaagagagaaaagaaagccaacuccccaaauuucuuuacuuuugagaauuucauacaugaguuuuucuuugcucuaaucccucucaaauuuaugguuuauuguuuuaaaaauauuuuuauauauacaccuuuauaaauacaagcugcugagcucuauaguguuacccacauguauguguuuagcacuggccacuuugaauugggugacccgcuagggugcuuguccuugaagaaggcccauccacucucagcagccauuacuugccuucaguucuucaucuggauguggggccuugagauuucccccauccauguuaaccuguuaguugcugcugcuuucuuugcaugucuucuuuagcuaaccccaucguugggaugauguggguccagcuucccugccauggggagaagacacagucccccaggaggcccucugucuccuacagucuguuagccucagaauuuaccuuuuaaugugaugguuucacucuugguucucagccccugccuugacuccgagaucuuacuuauuggguugaugcacaccugaaucgccaggcuauccaugucagauccaucuugggggagcacaucugucuacaggauacagcugcacaggacaagucuugauuuagucaacaguucugauucuguuuaccuucagcaaugauagaagaaucacaaccguuuuaaaauccagauguguuuuagaaauaccacucauuaugucauccacugguuacaugaccacacagucaccuuucuggaaucuuagcauuaggaacauaugaaaucagcagauuuagcaaaaugguuguauauuacaguguacauauauuguauaugccauaacugacauuuuggcugugaaguauguucacaugaaauagggugauuaaagaccaagauagccucacacaggauguauucuacuaaacaaaacaucuaugcuuuaaaacuuuuuaaaacuuagagucauagauagaagaucaugggugcauaccacauuugguugcacuuauaaguuguaccacuucuacgguuagugguguguaaacauuuaacauaaaaccagcaguugaugaauugguuauuauccaagcaaauggauaaagcucuguaauacucacuucugcacggcuggggagauggcucagcaguuaagaguacuuguugcucuugcagaggaccuggguucaguucucagcacccacauggugacuagcaaccaucuaaauaaacucuaguuucagggauuucaaugcccuccugaccucuaaggcaccaggcacacauacagugcacaugcaaacaugcaggcaaaacaucuauacacauaaaauaaaugaaagccaaaguucuguuacauugaaaggaugaauuucuuucuuuuucuuuuuuucuuuuuuaguauuggggauagcuuugaacucuugauccuccggccucaacgucccacgugugggauuacagguuucaugcgcuucuggagaaucaaacuccaggcuuucuguuuggcaggcaggcauccugccaccugcacacagaccuguauucagguuuuuguggaggaccaguuucaccucuaaaguucacucuaguucugcugagagcuugguguguuaaagcugcuucauuugagauaccuucugagucggaaguagguuugcuugccugcagacgcugauacgggugucaucugugcucucugcucuuuuuuuuuuuuuuuuuuuaaagaaagugaguauuucuaggaacucuuaaguuaccguucucaggagugguccuaaaugcucaugccaguagguuucucuuaucuucuuuuugcuuucuaaaggauugugaucucuuugaauugacuucuuuuacuucuguuucuuggagguuucuuggucugauuuucuucauuugcucagaaaccuaacccuuugcucggaugcacuguguggucuucugggcuuuacugucccagcuucuuugggaaugaaaccuccuucucuguaaaccuugcuccacuuuucugccagugugauaaacaguguuuauugugccucucaucggcccuuggagguuacuuagcaucuucuuugggcgucuccucagagagucuugaauauauugguuuuauuuccaauuuuuccaauauugaccauguuggggacaggagcuguguuugacugaacuguugggucagugguuuagagcuuaggucuggacuugugaaaugggaggcaucggcuguucuuccauugucuugaugaauccgaaguuuucauucuaaaugugacagugaggcacaggggugaguucaacaguuaaauauguccagacccugccuuuggaagagugaaagagguacauucauucaguguuggagauaggccauagaauuauuuucucacaguuuuaagaaucucuugugcacaacgggagaccugccuaggcguuuguucuguugaacuuccacucagaacaagaaaagagcugaaaccaacuguagacuuguuuccuuuaagaagccucucccccccaccccccagaacucauaauaccaaguuucuuuucuuaggauagcaaaauuucucaggcgaaggcuuucuguuucuguuuuauuaacuauaaaguccuaggcacuagggauguaacuaacucauugguagaguuuguguuucgcguguaucaucaggccuugggaucgguccccagcacuguagucucccccaugaguucacacagacuaacacacauguacacacauccauauauucuauauauucuaaauugcugcaugugcgugugugugugugugugagacaaagucuuacuauaaggucuagccagggccuugaacuugaucaaacuuggaacuugauauguagaucagacuggccucugccuccucagugcugagauuauugguauggucauuaugcuguguguguguguguguguguguguguguguguguguguguguguguguguguguauguuauugagacaggauuugucuguauaguucuggcuguccuggaacucacucuguagagcaagcaggcuguccuggaacucagagacccaucugcuucugccuccugagugcuaggcucaaaggugugagccaccacagaccgcuucuguuuauuuuugaaauaaggaucacuaaagcuucucucugucuauaguauucauucuuaauccugaccaccaguggcccuggggauucgucuucacaguugaaauccuaguuaaccgaaaugcuucucuagaacuuaucagcagccaacuaacuugucucugaguuuccuugucuuuagauauaacaugugauuuccgguugcuuaguaugaauugucuguuuuuacauagagguaaauacaagguaaaauaaugguuugcuuguucagcaauacaauuucggugcacaggaauguuuaauagauuguggaauaaaaagcuuccuuagaaagauggcaggaucuuccggagugucccuaaucuccacuggacuuuaauguuuccuucuugcuuuugaaagaaguugguuuuguccucucuuccuaaagagcaauguuacugcuuggcuuugagccuuacagaaaugcuacuauguaccuagucauggugaagccuuaacaguuuccacuuucgacagcuuuucuaaaggcagcucauucuuucucccgccagugcagugaagguuacaguguagcuagaucaucuugcuggcugauuuuguuguaugggaguaaugccccuguggauaucuucacgcaugcuuccuggugcucacauaggagagagucucugcaacuugguggugcacucacaacaaugugugucuucaauuuuaugagauaauacugauuuuucccccccuggggugguaucaguuuggauguccaccagcagugcuggcaagcuagcuggucuaccccugacacuggaaauucuuaaauguaccaacucauuaguauaagauugugucaaaguguuuugcaucuaaaguuuucuuuccaugucuuucuggaucuucccuauuucuuuuccuguagaauguugcuucaugguuuuugccuuuauugcuugguagaauucugcagguacguugcuacugauucgucauuagcucugcauuaugucugaaugugauuugucuucuuauuuuuucuacuuuuuuuugauauuuucuuuuuuaaauaucugguuuuuuacuauauguaugaguguguugcuggauucgugucuguguaccacaugcguaccuggugcccucggaggucagaagaggacagcagacuccuuggaauuagaauuaaaaauggaaaugauucaccaugugggugcugggaaucgaauccaggucuuuuacaagagcagcaagugcucuuaaucaccaagccaucuaucuguccagcccuguugggcgguguuucuuaauuucaguaugaccauauuuauuaguacauucuuuggcagucagcccuucugugucuuauguaagaaaucuuuguuucuuuuuaagaucuaagguuuggguuuucauugugugcauuuuccuuacuggcgagugcaaguccuuuucagauguauucuauuuuagaaagaucuuaguuauauuuaggacuuuuucuuccguguaaauucuagaaugagguuucucagaaacuucuuugcaucuugauuuaauccauacugacuugaugcccauuugguuugcguuaacguucagauauuauugaguuugucauaaacuugucauaauuuacauguuuuuaaguaauuccaauaauguuuuauaauuucaaccucaagagucuuguuuuucuguuggauucauuccuggguucuuuuuuauugcugacuuaauuucaaaguaaaccguaauccuuuguagcagugugcagaaaaguguagcuuuuaaaauauggggcuucaagggauuuguuuaauucucuucuuuugaucauuuaucuuuagauucauucaaguuuuuuauguagacagucauccauaaaaauaauaguuuuaugucuucgugcuaaucauauucagaacugcggauucugaaaucuuauuuauaaucuaaguuugguacaaauagugaugaggcuuaucaggugucauggcagacacugaucacagcugcucggagagauacaggcaaaagcaucaagaauucaaggucacccucagauggagggcugccucugcagacaagagcaacagaaaaggaacaagugacagaauuguuggggcuggguacaggcuuucaguccccacagcauauggugucucugagucggauucuaaguuuuggggauagguagguccaugugucauccagcuguagguccugagacguugccaguagaguaugcuacgguccccuuaggaacagcuaggguaugaaacagagaaagcagucccauaaagcaaagaauugcccaaauuccauucagcuucaaguucucacaagauauugugccauuaaaaaccagaguauaacuaccugagucuagaacauaacuuugauacauagacacacacacauauaacuuuucucagauuuuauuauacauaauuucccaugacuucacuacuccgugcacaugugugugugugugugugugugugugugugugucugcccacgcgcaugcacacgugcguguauuaacugaggacugaguuacccaugagaacagcuuccucuuccugcagcaucuggcuguuguugcuucagcugcacucaguaugcgccaauccaucuguuuuucugcgauucccauggagacugaaucuguauaauuugcauguucuuauugucucuuucuccuaacauuuuuuuuuacuggcauuuuuuaagccgaggucugugucuuccaggaugggguggggagcucauuacaugucgccgggugggugaaccagcugacccacugagaggauuggcagcuugcaccuugaucucucagagugagcugcugcaaaccaaaccaaaguguggcuuccaugcacucaccaagcuuaggaggacaggguuguacacucugagugucccuaacucucucccuacgaaagcuucggcuaugcacagcccagcugccagccgcuuuucagucagugccacaggaagcagaaucagccagcuaauccuuucccaaguucccgacuugagauguuguaagaugcagaaaugguaggcugugaacuuuaacuuguacugccauaaggggcagaaacaguaagucucuggcguuacugggcuggagaaucugccuucguuccuuucuggaaggguuccuuucugaacuuguggauucccuggagaaguuggacuucucuuuggcuucagcuagagcgcuccgggagaggagccagagaugucccgaggcuaugcauuuuuuugugugugugugagaacuguaguuuggcagacauuuuaaaaugaguuaccagcccaggaaucuugugucugggugcucaggcuccuuccagcugguauccucaacugucuacugagugguagacaggugcaggcugaguuuuggcagggcugucacuggggacuguaagagagcaagcugucuuccuguuccugguaucuguagguuccuagugaaaaccccugcuuucagaaccagcccuggcuuccugguuguuucccagagauucugcauugagaccccgccaucuuccagcauguucguguccuuuggccucuuccuccccccucuucuucuucuucagagucaugccauuggcuggccucugccccucagcacucuuacucauacuaaaagugcucauuucaguuaccuuaccuucuaauccagagcgagcaugcgcaccaacuggcuccuuuggugggugucucagauuacuccuuuagcugaugauaagcagcuugagagccgagaaggccuaaccauuuguaauucccagugguguucauuaacuaauuuagauucugugaccuuugcuguguuuacauuuucgccuccagacagaacacaguguguuuggaggggugaugcucacagaggcuggaacucaaggaaugauugucuugaucuugggguuugcuaacacaagcacaggugaaggccccaagaggcccacauagugaucacuccauuguuccagagcuuggcuccgguuuucagggguucugcuucuucgccgggagggcgaacaccagccguguccagauuuguguguuuauauuuggaggaugagagugcugaaguccaguuucucauuagggcuucacggcacaguaaauggaaaagccugagaaacuuguaagucuggaugugucuccuccugcugaguuuugugguggcugucccgagugugugcacucuugugucuccucuugucucucuaacucacaagucccagcccucaugaacucacuucugcuuuaauaacacgccacuguguauccuguagccaaaucuagucacugucaauuucuuugguaaauaggacacuuuucuuaccauaacgcccacauuccauuuccuuuuguaacaagugucauuuucgguauauacuucaacccuuacaaaugguugugagccaacgugugguuguugggaauugaacucaggaccucuggaagugcucuuaaucagugagccaucccuccaggccccaauauauuuuauugcuuuuauuuuaugggcauuaguauguuuuugccugcacauaagucuggauuagguugugagaucuuagaauuguagacaacuauuaacagucaguuguaacaaauauugaaacuuacggucauuuaaagguaaacauuuuaaaucaaaagaaaaaaaaccauaaguauucuuucccaggaaucauuguaaacgacagcaaaugccaggaagcagugccauaaggacacuauauaggaacaucuguuguuguuucucauuauggaugguugugagccaccaugugguugcugggauuugcacucaugaucucuggaaggagcagucagugcucuuaaucucugagccaucucaccaggccccaauauauuuuauuguuuuuauuuuaugcacauugguauguuuuugccuucacacaugucuggguuagguugucagaucuuagaguuuuagacaauuguuuuuuucuuuuuucuuuuuauuuuuuuuacaauaucucaagugggauuuauuugguggaccucaauaaguucucagaacauuugcuguaacucagguagaaauaggcgaguauucacauuagucuguaguccaaaaagguauuucaacuaaaauaugucaauucucacaucugcaguggcuuagagauaguugguggucaguauuguguuucuguagcuucuucaagcagagguacagugcucaaugcuuuagaggguuuugcaaauucauuucccuuuuguucaacaaugccucaucuccacuauguaaaaccuggucuccagugccacuaucuauuaucugccuuacauuaggucuuacuucagggcuauuacacaaagugauuacguuauaaaaggccuccagaucacucaguuuaaauguuacagauggcuucaguacugauucaggaguaagggaacuuccuccaaugauucucagguugauaaauuugauuuuccaaauauuuuccacaaaagagcuucggauaaguccaaaaauuugcucaaaugugcccaaacaagaauuuccucgguggacagucccugcaacuccaaccauaacuaauccaugaggagaagacacacauuuugguccuugagaaucaagguugggacugagaaagagaaauuccucuuuagcuaaugacaguaagcgaaggcucacgauuucugcuccuugguagucuaccauguuuuguucugagguguuauaauaaaaccuaagcuuggcgucgugccagaagggcugugggccccagucguuuugaggugggcccagaaaaggauucugagaauuaagaaguucaaagaaccagugacagaauucuucuccuaagcgacgaaaaucaaccuuuucagcugcuuuaucuuccuuugccugcugcuccaagagcuggauguccuccgucucuguaacuggcucugcuguguccuucaguuuucgugacuguuuuccccaguaaucuuuugcauacugaauaagauuguguuuuucagcaguuggagguacaaccaccccuugcuuugccaaauacuuaaguaugacuucucgguggacuuuuuugagccucagaaguucuucuacauuuuggcuauacacuaauauugcaugaauagcaucuuggcgguccacaggcugcaccaggcgguuggugauggugucgcaaagggcaaugaucucgucguuguccagcaggccgaguagguuucggcagcccuccgacucuaaguggcugagccccgacaucucgcccccggggaugggggggcagaggacgacgccaccggugucgcccucacggcccacaggccagccggcgccuagacaauuguuaacacacaguuguaacagacauugaaccaggcggucauugaaagauaaaucuucaauugaaaggacgcaaaaucuucaaaugaaaagacgaacaaaauccauaaguauucuuccccaaugaucauuguaaaccacagaaacaggccaggaagcugcacuauaaggacacuaucuagaaacaucuuguaaaugccagaggcacugacaaaugcuuucuugacuuauccucugggcucugguccagucgaaaugagccuccuuguguggaguuugugguggcuguccggagugugucuccucuugucucucuaacuccaagucccagcccaagugaacucacuucugcuuuuauaacacucugaguaugacuauccuguagccagucacugucaaucuuuuggguaaacacaucucuuuucauaccauaaugaccucauucuauuuccuuuuguaacacacagaugucauuucuaguacauacucaaaagcuuacaacuguacuuucagcccuacuaaaaaaccuaccacauuucauauuuugguauguacucaaaaucuugaaaaugucaaguuuucuagaacuacucaaaaaccuaacacauuucauuuccaugacucagcacuccgauuauucaucagaguuugucugugccuuuccagucuccuagcaacaaucccuagagauaaggaagguucuggagcagggaugaguuugagagcgauagguuuuuuaaaaaacauuuauuuauuuauuuauuuauuuauuuauuuauuuauuuauuuauuuauuuagagauagggucuguuuauauagcucuggcucuuccggaacuugcuauguaguccaagcuggccuugaauucagagauccaccugacucugccucucaagugcugggauugaugagaugucccauuaugccuggccaaaaauaguuuuauucauuuuguauauguguggauacgcucgccuuagcacacaagugucugucagaggaucauuuucaguuuccuuucuaccacaugacccucaaagaucacaagcaggaccuccggcuggguguggccagugccuuuaccaacugggguaucgcaaugguccugccucccgcccccaagacacacugcuuuccuuuccauccauguucuucucuucuuguuuuauaaauaugugccaagcaacccaugcauuuucacauacaauuggauaccuaggcaaccaagucauaaacuaacgucaccuuuagaaagauuuccuuuuuuuguuuguuucuuuuguuuuguuuugguuuggguuuuuuuuuuuuuuuuuuugguuuuucgagauaggauuucucuguauagcccuggcuguccuggaacucacucuguagaccaggcugaccucgaacucagaaauccgccugccucugccuccugagugcugggauuaaaggugugcaccaccacgcccggcucaagauuaguuuuugcuuggaaauaauagcagaccacauugcugucuaaaaauaacucgguuucugucacugauauauuugacccuucuggaaaaaaaaaaaaaaaaaaccucucuccuguucucuuuuaacaugggaagacauuuuuuuuuccugucuaugaaguuguuuuccagacguguagcucuuuagcuuuguuucucaguacagggaguuccuggagguggacuuuuaaagaggcaauuccaagaauucuaucuccaguuugcuugugugugaugucggugggugagaguuuugcucacuuguaccugugcuugugauaugggaguuugagacagggggugacucaguuuuacagugcuuugugauuuuuguacaucuuuacauagcuugcucuuacacugcuucuugugauaaagacuccucuguuuuucuuuuucuuggcagauauacauauaagucuggccuuuuuuaaaaauuuuuuauuuuauguguauggguguuuugccuguaugaauguuuguguaccaugugugccugguagcugaggaagccagaagaaggugccagguccucuagaacugcaguuauagacaguugugaacugccauguacguggugggaaucgaacccagguccuccggaagaacagucacugcuuuuaaccauugagcagucucucuacaccccuuaaguuggcucuugauucuucuugcagcuugguaagagacccauauuguuuucuauccccgagacaguaagugaagugaaggacuuagugacuugagagucuaaaagguccaaggauucagguugaggauucccucguuacugcguauuuuccggcuucuuguagcauuucuuaugucuggguaugcuuuucuuuucuuaaaucuuuauucauuccaaguuaucuuguuaaccaaauugucucugaagacuguuuacauagacuugcagugauucuugugucugcgggugugggugguauaaauaccuuccagaaagcguccaggaauuuuugcccaccuacuugguuccccuggagggugagagaaggugauuaauugaguaaaggaagaaauaagcccuggaaaagccuccagcaaaaggguaucgucauguuuacauuuauuuguuaaagccccuccgcuacaagcuaagcagccaaauaagauaauagcgauuuaucauucucuuaugacauauggaagacauuuucucaagguaacuuaucuugcaacaguguacguuuuuguuguaucucugucaguggaacuguaacauagauaacugcuguggcuauauguguuuucuuagaaucuuggaagagaagugucauauuguucaagucaucaugaucggggcauccauacuugcaggagggugggucagcagaacaagaaauacgguagaggagagggaggcuuuaugaccaauggguucguuaaacuuagucuuguuuuucugguuugagagauguucuggauaaauaguuggaugcacuugcuuaucuaucuaucuaucuaucuaucuaucuaucuaucuaucuaucuaucuaucuaucuaucuaucuuucuaucuaucuaucuaucuaucuaucuaucuaucuaucuaucuaucuaucuaucuuucuuucuaucuaucuaucuaucuaucuaucuaucuaucuaucuaucuaucuaucuaacuaucuaucuaucaucuuucuaucuaucuaacuaucuaucaucuuucuaucaucuaucuaucuaucuaucuauccaucuauccauccauccauccauccauccaucuaucuaucuaagauaggguuuuucuguguagcccugacuguccuggaaauuaauuaaucucucucucucucuuucucucucuuucacuuucucucucuuucucucuuucucucuuccuccuucccucccucccucccucccucccucuucacaugagauaggguuucucuguauagcuguucuggaacuauucaucuaucuaucuaucuaucuaucucucucucucucucucucucucucucucucucucucucuauccauccauccauccauccauccauccauccauccacccacccacccacccacccacccacccacccauccauccaucagaguuucucuguuuagcccuggcuguccuggaacucuacucuauagaccaggccggccuugaaugugugacaccacacccaucucccuaccuuuccuccccccuuuuaaaaauaaaagcguuuauuuauaugcaucuguguguuuacaagugccauggcguguggauacaggucauaggauaacuuguggugcuugcuucucuccugaugugucagugacuuggucauguggguucuggggaccaaacuugggucaucaggcauagcagcagcuuaacuuacagaaccauccccugagcccuggaugggcuuucaguaaguuacaucauggugaauacuagacuggagcagcucauuuguuccauuaugugccagcacuugugauuuguaugaacgacucucaaugagaguaauccgaagaaccgccugaucuuuggcccuuuaucuuuggaaaguagccagaguaagugacuuggguagucuaaaucagccacuacuggaugacagcccuggguauaggaaguccugagcuaugggacauugagaggcagacaaggggagugcaugcaggucaagcuaacacgguguggggcaucccaggugauuacagaaucugcagucaggucugauggcgaccacacucagacagcauacauuggagcaagacuguaaggggcuuuaucugagagguguguaagaaugaaauggguucaugugguggaugauggucauugcauagaggccaagacagcaggccuaacuuuuuggggccuggaagugggaagggaagccagaaggcauccugcaccuuguugauaguagggcucuauugauuuugcaaaauguugccaagcgggccuuuaaagcuaucugcaucacucuucuggggggacuuccuuggcuccugacuguggagugugaguccuugcgaaugugcccuuuuucauaaugcugcuaccugccagucacauccuguagcaguaucuccugaaguccauagaacagggacuccauuuucauuuuaaacaguaaucucccauuggcccuguugggccaccaccguuauucauccuuuccgacugaacucaagucucaugcuuuuucugucaguucuuuggacugggguuucccugucucuaauucccugaugaaucacgauuccuauuguguuuugauagcaccuuauaccuugcaccacaguggugacuaagcuguguccuaacaaauaguuuccacucccugacucacuacauuuccuggagacugaacuaagccuuagucaucaugauggucuuaguguuaggccuaugucaaucacggagaaggggucaccaggggcuugucucaagauugaaugcacaaaacagagcaagauggaggcuauuauaacuugaugagugaggaccuaaaggagacaaaaugggguuuuguuggaaauaaggcuagaaggauuuuuuagggggguugagagcuaaauuuaaguuaggguaucaugaggcaagagagaugguucugcaguucguaguaaguauuguauugcaggggacccaaguuuuguugccaauccccacaucucacaacugucuguaacucuggcuccaggggaucugaugaccucuuuuggcuucuaaaggcaucuacccucaagugcacauagacuuacauacaauuaaagugacagaaaaaaaaaauucuuuuuuuuuuuuuuuuuugguuuuucgagacuggguuucucuguauagcccuggcuguccuggaacucacuuuguaggccaggcuggccuugaacucagaaaucugccugccucugccucccgagugcugggauuaaaggggaaaaacaacagauagucauuuuguggaagauuuugaguacguaccagaaaugaaauguguuagguuuuugaguaguucuagaaacgacauuuucaagauuuugaguacauaccaaaauaugaaaugugguagguuuuugaguagggcugaaaguacaguuguaagcuuuugaguauguacuagaaaugacaucuguguguuacaaaaggaaauggaaugaggucauuaugguaugaaaagagauguguuuacccaaaagauugacagugacuggcuacaggauagucauacucagucgagugcuauaaaagcagaagugaguucacgugggcugggacuuggaguuagagagacaagaggagacacacuccggacagccaccacaaaacuccacacaaggaggcucauuucgacuggaccagagcccagaggauaagucaagaaagcauuugucagugccucuggcauuuacaagauguuucuagauaguguccuuauagugcagcuuccuggccuguuucugugguuuacaaugaucauuggggaagaauacuuauggauuuuguucgucuuuucauuugaagauuuugcguccuuucauuugaagauuuaucuuucaaugaccgccugguucaaugucuguuacaacuguguguuaacaauugucuaaaacucuaagaucugacaaccuaacccagacauaugugaaggcaaaaacauaccuaugugcauaaaauaaaaacaauaaaauauauuggggccuggugagauggcucagagauuaagagcacugacugcucuuccagacaucaugaguucaaaucccagcaaccacaugguggcucacaaccaucuauaaugagaaacaacaacaacaacaacaacaaaagauguuccuauauaguguccuuauggcacaaaaacaacaacaacaaagaugaucuuauauaguguccuuauggcacaggaacaacaacaacaacaauaaccacaauaaaaacaacaaagaugucccuauauaguguccuuagggcacaaguuccuggcauuuuacauuacuggggaagaauacuuauuuauuuuucuucuuuucuuuuuaaaauuuaucuuucaaugacuguaccuuuucaguuuugucugagauauucccgaagggcucauuuccuuggccuuccuacaaaaaaugucaagaugcacucuucagaaauuacucuuuucugugugaguuuccacauugauaaauaaaugauaggaggcuagagauggcuuggugguuaagaguacugauugcucuuccagaggacccugguucaauucccagccgccaaauggcagcucacaacagucuguaacucuaagaugugacaaccucacacagacauacaugcaggcaaaacauacuaaugugcauaaaauaaaauaaauauauuauuuuggugccuggagagauggcucagcaguuaagagcauugauugcucuuccagagguccugaguucaauucccaacaaccacaugguggcucacaaccaucuguaacaggauccgauaacaucuucuagugugucugaagacagcaacagcgacaguauacucacauauauuaaauaaauaaaucuuuaaaaaaucaaaaauaaaugauaguaaaugcagucucuguugucuucuacucuggugguaaauacaggcugcugagaagggaaggggacugaguggguggcuguucucacagagaacggcaugagcugcucucacggauacacugacacuuguucugggcagucagagcacuuggaaauagcaauagcuacucuauugggggaauugagcuuugggaaauucauuucuuacugugccacccuggcagaggcgaggaaggaaagcugggucuuuguucugguggaucaguugaccacccuuuuguacacagugcucauuguauccauuggguacagcaguucucacugugaauaagacccuucagcaaugcagcaggcaugcaggaagacacacuauaugcagacaguguucaugucuguacaugugcacugaaauucagacugggagcucuguuucagucuuuaguugguuucaucuuggcauuuugugcauuauuugcaaaacagaaaguuggaugucacaugacuauaaaaacucugauaugggcugaagagaaggcucggcaguuaagagcacugacugcucuucugaggguccugaguucaaauuccaaauuccaguagccacaguguggcucacaaccauccauaauaagaucugacacucucuuccggugcgucugaagucagcuacagugugcucagauauaauaauaaguaaaucuuuaggccagagcaagcggggcagacuguagaguggggcagacuggagcgagcaggggcccugaauucaaauucccagcaaccacaugauggcucacaaccaucaguacagcuacaguguacucauauauacauauaauaaauaaagaaguaaauacauacauaaaucaauaaaucuuuaaaaaguacuauaauagcuucauuucacaucaacacuugcugucacuauaugcuauagauguagacuacggauccuaaauaggcauuucucaucuuauuaauggaugugggacaugcaugcaugugugugugugugugcacuggcauguguguccgugagugugagugcccugaagacuaaggcugaugucagggcuccucguccauugcugucuaugcuauucuuugagauacggguucuccccugaaccuaagcucaccaggauggaagucuagauagccaacguguccccaggauccccugucuccuccuuccgagagcuggaacuguaggugugccaccuuacccaccuggcauuucccuugggcucuggggaucuaaaugcuggcacucaagauuacacagcagauucuuuaacugcugaucuauuucuccagucccuaggauuuggaauaucugguuacuuuaaggcaauauuuuauucauacuuacucagagaacucgaagaauaaguauuagauuuuguuucuucauuugcuuguaaacauuucaaaggauuuauuuugugugugugugugugugugugugugugugugugugugugugugugugcgcgugccugccugaguauauauguauaccaugcauguagacaucagaaaaggacuuaagauccccuggaaguagaguuaugugugguugugggcugccaugugccaguggagcugagaagcaaacuuggcucuacugcaagagcuauaagugcccuugaccacugagccauccuuccagcuccaggagauuuuguuuuagauuaaaucacuguagggcucuugacaucacauuucuuaccaauuuuggguagcagguaaagaauuggugaaugucuguaucucacuccaauauuuguuguuggcaaagagcaguguuuuagugcaccuaccuuuuuaaauguucuuggucauuaaaaaagcaaacaagcuaccaaguuuucacugaguuucagaagagucgacucagcuuguuucacagguugagcucaaugacuuuucuccaguccuuagcaucauaagacgagcuuguucagcaagaaggcagguucaugcauauguuucauuucagagacagguaauucauagacuuuagccaccaaagcguuuuaaaaacccaagccucuucagaaauacccgaaucagcacauuucaaauaauaacuucuuaagcaugaagaacagcaggaggucuuuugucugaggagagccacccaggaaggugagcacauugaaggaggcuuugugaggcucaccguguaagugggauugugaugcucaccguguaagugggauugugagauucugcucaaaagaugggaaugucuggccuuuacuauugcuccgcagagcacaaguaagucugcaguuguuuucaguccgggcugugccacuccacgacuuuccuugcauugcuguagacaguacauugcaguaucuuguaagucuccuauauauuguuucugcagcagcacauuacaaaaacaagcaagguagaaacaggcaggaguguuucaucaaggcgacuggaucacuauaaagaguuuagucaauuuucgacaucaaaugaauucaucaaagcacacugcucuugcuugggcucuccccugggugguugaugugagauaaugcuauuaauuuuauuuccauaauagguuugcuuaguugccaugcuugaugcaggugcccccucccaugcccccacucuaccacaauauagaaaucuacuuugaaugacgaguacuuaaaacuucauugucagguuucaaguaugaagacauggccugaaaauugaaauuaguguuaagguaucauaaaacuaaguggacaaacuuugcucuuauagacuugagccuuuaaccguggcaggugugguuuuuaggcgagcaggugugucuugguuuucccuggccuuugaguguggcacacugggcaguuaauagucucugugcuuauaaaacuuuacacaucuggacauaucucaaacuuaauccugaugaagacaaagcagaaaauagccuccccaauuaaaugcacaaguucaaauacaccacagaggugaaacggguuuuuucaaggucugcaaaaaacagauuaacuuguccgugcaaguuagugcauugaugcuaaguuuuuauauguaauacauuaaguauagguauuagaguucuccagggcaacaggagcgagggaggaaagaagagagggagggaggagcaguuuuuaaaaauagaauugguggcuugcaagccuguaauuguagggcaggcugggccgauagaaaauuaccugaagaguugauuuuguaguuuccauucuaaagacuagaaagcugaucagaauuucuggguugcaucuggaggcguuaaucaguuuuccaugaucauaacaaguaccugagguaaaggacuuauaaagagagacguuuacuuuugcucagucgccucuacugcuuuaggccugaagcagagcaucaugggaagagugcaugcugaccuuucguuagggaaguaaaagaaaggaaaagaccaggaucccacagucuccuucaaccauggccucuucccucgugacaccaggauggccucuacagaaauacccaucaacuuucuauagcacaaagcugggggcgggggggagggggcggcuaaacauuccacacaggugccucaaggaauauucaaaguccaggcugcaucagguagccagaauuaccagaagguaaaaugccuucuggagcuuugcuuggucugaguuccaagaccuugccugauuaugcgagacccaccuguaccuguuacggagguggaucugccuuauucaguccacggaugucaguaacuguaucagaaaauacaucacauugucauggagacuggacucuucuaaagcguuggacauccuaacccagccaggauguugugggaaagccacucaucccacagauauugauagguuucagucacagguuugaggcuuugaaauauccuaaaauuaacuuugguucaaugucugugggagcccagcgcuccaaggauggucuugaaaggcugaggauuuggagcugggcgauucgccuucaaaugucaucucugcagcuuggcggcaucagguuuugagucuuuguuuccacauucaugagcuguuaucaggcuacucugguaauuaaaugagagaauguuuuuacaacucuggaauacaguggcagucaccauagugauuguaaucucauuuuuauaucauguuucaguuuuuaacuuccuuucuguccuuuauguugugagagcuauugaagacucuugguauuguuuaugggggaaauggaauaaaaaccuaguauuuaauuuaacauuuuguuuagagaauacuuggaaaauuaaagaaugcaugucauaugugacuuuauauguucuauagaacauuaucaccuggagggcccaugaagggugguguagacugucagccacacagcuuaggacaugaagggugguguagacugucagccacacagcuuaggacagaaaggcuggauuacugugcuuuagucauugaugugugcgucucugaagucaggggucaugcuuacauacauuuaagagcguacgcuuuguuucuuguuuugauguuuguguuugcauuuugaauguuuaguggugacuggcucugauauuuugccuagaaaucgaaaaaaaaaaucuuugauuugaaagauuuuaaaauucuguuggguuuauuuuuuauauggaugguguauuuuauuucugauuuuugaugaaauauaucaucuuggcggagguguugguggagagcugugccagcaguuaagagcacugguauuuccuccagaggaaccugguuccauuccugggacccacggcccucucuuuguccuugacagacacugcagacaggaggcacacgcaggcaaaacacucauacacuccaaaaaacaauugucuuuugagauagggucuccucagauugccuguagcugcggcugguuucgaaugcugauccucuggccuccaucuucuagguagaccauaggcuugugccaccgugucugguuacuggaacacauugaagcauugauuguaaugaagaauuugccuccugaaguuggccccacugcuguaggaagcaugccaugcacucgcugcugugguuuucugagaagcugcugcuugcauguuaguaucaggcuuaagucucggugcaucauuauaaggagggccuuggaaagucacaugggcauugcugugauugacugcuuuauggcuguugccauagugagagauaaaagucccugcaaguggggucauugcaucucugucuucccuacauggcgggagaugggaugagaguuuauuuaggaacuugcugauacagaauacuugauaauaaguaccacguggaaaauggaaucuccuuuuagaaagagcuuugcccaaggugaugcuacauugacguguguguguguguguguguguguguguguguguguguguguguguguuuucuguaaggacaaaagugacucuuaauaucauugucccagucucagcuuuuuaagagcaagcuaauuauuuucaggucaguggaagcagugccugggauauuacagucagaggggaacggugcucauauaugauguacaggcaaaguaaaguagauacauacauugagguggacauggagaaaauggaccagaaagguggagaaggcagaacucagcagcuuguuugcgaggguugauggcuuaagauacucacuccuaagaagaucuaacugucccuuguccucacagccacucugaaguagaaacuauuaaguuaggcaugucuacaggucagcagcccacauucuugacagugaauguguuucagagucaugauuucagaguuuucuccucccuccuccugcacagugcugggacaaggcgcaccauaaucgagcgcaugacuaauucugccgugaggugcagaaaaucccauacuuuugugggaugacuauaaauagccucgugucaacucaggucaggguuugcugcagaugaguucucuccugcccaaggccuucgcugcuaacuuaaaaccauuagacaaaaaaaaaaacaaaaaaaaacaaaaacaaacuuaccugacauacagggcuuuuaauuucagacuuggggauaaggguuacagacuagcauuucuauuuuuacaguuaagguagaugcauagaaugguaauuucuccaguuuucugagucuuaaaaacucuuuuuaguuuuguuuuuacugaugcgcuugugauaggucuaagcccuggaaugcuggugccugggguccacuggugucacuguggaccuggaaguacaggcagccgugaguccccuaaccuugguuguggaaacucagcuccuaggcaauggcaggaugugcucuuaaccacuaagcuaguccucaguccuucgcuuccccaguuuuacuugagccuguagaaguaaacugugugucaccucuugcucuucugugaggugggaucuggcguuucuagaauaagaagggauaccuacaaauggcaauagaaauuucccuuaccuucugugguuagcucaaggucugauuuauuaaccccuccccccccccaggugcuuugaauuaaauguaugaccuuguguauccccagcuuucaccuuccaguuucccaccuaaacccauucauuauuaguguagugugaacugucagcaguaugaacgaaauccgaucugugcuuacuguuuuuacaacacuuccuguuauuaucgcgauaccacacacuuccaaauguucucugacacuuacauacaguuucagcccacaagagcauuuuauuaguauuauuuuuaauacuaauauacuaauuuauacuuuuagugcuuuuaauacuaauuagucuaauuaguacuaauuauaaauauuaguguuauuuuuccccugcuagugauuucuuaauuuugucuuuguuacaaaaagcaaaaguaguuugagaucaagccagaaccagauuuacugguuuauaauaaauaaacaacacuguacauuuuaucccuguucuucaggguuccgagcauagccguuaccguuuuccuugggcauuaacuggaauauauuuaacuaugacuacaguuuguuugaggaagcggauugagaaaacgcaggaaaggcucauggugccuggcuagagaugcugagagucuuacagcccagcugccuggguucaagucacauuucucuguucucuauguaccggagggugaugcacugugcuuacaaaugucgacaucccucaccaauuggcaguuuaacuuugaacauguaaaugaucauuguaagcccacuuuugaaagacugaguauaggggagaguauagguuuaagcagguggugcaagccuaccuuuaaucccaguacucagagcucugugaagagccuggucuacagagcaaguuccaagauagccaagagaaacucugcccccaaaaaacaaaaacaaaaccaaaucaacccaaaauucagcugguuguagggacucaugucuuuaaucagaguagaggcaggcagcgcuguuugaguucaaggcuaaccuaaggugaauucgggguagccaggguuauauagagagaaccuacaucaaccccuuccuccuaaauuuaaaucaaagcugaacauugucugguccauacacuuuauuuuauuggucuacauauuuuaaaauuuaauaacauuuucauauuacaaacuauacuguuucaagguuucauguugugucaguuucugaagaacucuggucaugauugguuuuuuuguuuguuuguuuuguuuuuguguuuuggguuuuguuuguuuguuuguuuguuuguuuguuuugagacagcauuucucuguguaagcagaccuggcuguccuggaacucacuguagaccaggcuggucuugaacucacagagagauccacuugcccccacccccaagugcuaggauuacaggcaugugccaccaccaucagcuaggacgcuguuuguuuuuuguaaacuguccauauaagcauuuuaacuuguauuuuuugcacagaaaagccuaguggaaaacacuaaguucuggguacuggggauggaacucgauugguagagugcuuguuuccugggcaccaagcccucggauucaaucccuagaaucacauaaacuggugucccaagucacuuuucuauaugugauaaaacgcuaugaccaaggcaacuuacaaaagaaagcuggauaauugugcuuaugguuucagaaggcggggaaagugcguggauguggaguaaaggaauggcagccagaacaggcgagagcucaggucuccacuguaagcaggaggcagagagcacacugggaaagucuucugaaacccuggcuuggccccuagugacauacucccuccuguaaagcuaugccucccaguccuucccaaacaguucuaccaacugagaaccaaguauucaaacaaaugagccuguggggccuguucccauucaaaccaccacaacuggcuauggugguguaugcucguaaacuuuguauuugaugauggaggcagaagggucagaaguucaaggcugucuuucuuucggaguuugaggucagccuaggauagauaggauucuuauaacaacaacaacaacaaccccaaguccaagaauuuuauuauuugucgugcuaaugcauguuggaagcaagaacaagguaaggaaauauaaauuuaccuuaauguccuacuauuuugugugaugagagauucagcaaaagugaauuuuauuuacuuaguauuuuauuuuacuuaguguuaccauuuggaggcuaacuuucuuuguuguuucaaggagauuugggauggggguggaaggggaaagagagagagagagagaauaugagaauaugagaaugugcauguguaguuaaugggugcccacugcugaagaugaagagugcuuccuuuuaaaggugaguguuuguaguccaacuggauugcugugaaagccagggaaaugcagauagucacccaguucagaacccaggcagcuaauccacuaagucucgguugccgaucaguagcagacauugugaguuugagaggagagcccuugccaguaccgugguccagagaaggucucuuugccaaucuuggucuaauuccugcagauccugacuuuguuuuccgaagacauuucuaggugccaucauaguggucauagaaguugaaguaaaaugagguaggaaaguuguugaguuagaccucguggaccaagguccugaucccaggagagaauggcccauuugaguaagccggagcaguuugggauacccaugccccgcacauggaagaagcuucguuaaguucauaagucaucaagagugauucagugagugggcaggugaaugaauauucuggauuauagcguuaaggacgacacuuggccaguguuuauacccuuguuacagagugugucuacccuucccugaguccuuuggagaacugaaguauucugaguaaggggaggaaaugaucgggcuuuuguuucuaguugaagguagaguaguaaucagggagcacuuacucaccggaagcggugaggggaaaggagccuuguuuuuaaagauuuauuuuauguauauggcuacacuguagcugucuucagacacaucagaagaggucaucagaucccguuacaaacgguugugagccaccaugugguugcugggaauugaacucaggaccucuggaagagcgugcucuugaguccguccacugagccaucucuccagcccagagcuauuuuuucaaccaguaauuugacguuguucauaauguaacguuuuauaaacuauaaagguugaaggauuuuuuuuuccugcuugaauucugugggguuuuucucaaagucuucagugggaguuuucaguaccucugucauggcaucuguggcagauccauuaguauguaaagaauuguaggacagguggaagaguuacugagcagugggcggggugagcugaaagagaagaauccuacagaagcgggccugcuggaagguaaagugugggauccguggauguauugccugagauggugugugagugugugggaggugcuuguucucacuuccuguuucagcacagccugccaccugcuguggcgcuauacaaaguaacaacaccauuaaagacugucuaguuaagguaucagguuuuguacugucaggaagcagggugccuuugguuuugguuuuugguuuuguuuucuuuggauuugucacaaaaggcugcucccaagccuuuuugaaaauuggugugugugugugugugugugugugugugugugugugugugugugugugugagaaugugggcguauguguggaggucagagggcauccucuggguguuggucaccaccuuccacuuugagacauagucugguuugaagcagcauauaccaggagagcuggcccacgugcuccugggcauucuccugucucucccucccaucuucuugcaggagugcugagauuacagaccggagcucucaugccuacuuaugucgguucuggggagcuagauuccagcccucucuuuaccccuuaggucccaugcucagaauguugaacaaugacauuccuacucuuacacaagucugaugaguguugcaccaacauugacuuguggacugcuucuuucaaaaggugacacucauaagagggucaccuuucccgugugaacauucauugcacauuuguacuuuucacuguugaacuuggugccuaagauauccccuccccaguauauuuugaaaucguuaacuaggcucccaaggacaggagggaagugcucccccagaagggaaugcgauugguaaguaagcuuugucaaaugugacucuuaguguggacaaugaauucauguauucaguacaucaucccuaacuggaaacacacaugaaacguggguacacauugaucaguugcugucaguguugugaccaaaggaacgauugguucugaauucuucaacucguuguugggcuguaggaaauaaauaaaugagugggaaacguauuagucugagcugagauaguugguugucagugauuguggggaaugucuuuucuuuaauuuugugaggcugggucucacuggagccgaggcuggccuugcauuccuggcaauucugugacuucagcuuccaagauucauauagacauuggcucuuaagucaaacuuuaagaaaaacaaaaaaacaaauaggauuccuuuuuacuucuguguagucugucagagcagaugcucgcagaggccagaggaguccgcugacccuccuggagcuggaguuaugggagguucuuagcugcucaguguagaugcugggacugaacugguguucucuguaagagcaguauggucccuuaaccacugagccaucucuccagcccccagcuuaugcucuuuaaaaauacagaaaaauauuuugaaaauagacaagguuaucuuguaauaagaacaaaucauuauguagaaguagucuaacuuucugaacuccuuguguaugaguguggcauguacacacauauguacaaguaugcaugccuguacauacguguauauguggggguuagagagggaugucagauaccguacucuguuacacuuuuccuuuauaccuuugagacaggcucucucacugaaccuggagcuaugguagccagaaagccugugucuguguccucccacccccacccuggacaguacauauguuacaggcaccaguguggccacgccuggacuuuaaauguguguucagcucuaagcucagguccucauuuguggagcaagagcucuuacccggugagccaucugaacucguguagcucuacuguugauugguaaugucugcgacagugugaccacgugagcuuccgagucuagaugaaaucuuguugcggcuuguucauagacugacaugagguaugagguauuuaaucccagagguccuugcagagacuggaaagagugcuuugagaguccacuuucuuagaagcccggaguuaccggugaggugucccuccuugcagggacugucaauguggcauuccuuuugcaaagacacuagagggaugggugucuccagagggaagccuugcuuggagcugggcgauguggacuguuuccauaggacuuguaagcugacugccaugaaagagcaccuuuggguaaaugaaugaccucugaguggugcagacuggaaggcauccauuguaacaccaucgccuagggcuuccuuguaauagaaucaaaauagaaguuuuccuuuuuaaauucacuuuaauccuugaucuuccuuuauaucucauuuauacaaggacacauuuccauucaagucuguaagaaucaaauauauuugagaucuuaagacuggcuacguaguuucauccagaagaugccauuguaugaagacacagaggccaugcaguugcuucauuugcgucagcucucaggguuuuccacgcacuguccaacugugacuggacuuuguggaccuuucuucugcaaacauuacuaaauguaaaucauuuuccaaaaucauuuuaaucugugccauauacaaacuauaguacugaggguagacucaauacugcauguacugagaaauauuugucucaucuuuaucuucaguuacuuacugccacagaguuuuaaauccuagggaauuuucugguaggagcacauuuauuuccuaagugagaggacucgcuaugggauccuucauagcuuuaguggggccugggcaucggagagacucaaccauguaacugaggugggcuuugacuagcuugaucuuugagaagaacagcaggggguggggaccauucagucaaguguacuuaaugaaacccugauaaaaaccagcugucaaggccagaugacaguuccuguugcuaggagacguugauaucaugggaggaagauaccucugguucccuggaaagauggcacagagucccacaacuucaacucuguuacgcuucguccuucguuucuucauuuggcuguugugaucugugcguguccuuugugacaacaccauauucaaaaaucggagccaucuacuuauucuauugaguuuuugaaccuuuggggaaugugagaacccccaaauuuauagccagucagaaguguagguggccuggggucuccugaagaaaagucagcaagacuaggacaaagucuguggagucuugugcucaccucaggaugcccagcuggggugaauacggggugcuauguuuaucagaacacagugaagacucacgguuagcucaagagauacccuguaaucaaucauagguauaaauugguaucuuauuguuuuauaaauguaucccacagguuaaaaagccugagcaucuuuuguuugaugacuguaaauauuucuaguucuuuuuagacucuuuggaggguuugaggcagucccgucuguagcugaggcugaccuugaaccuucaacauugcucauaccucagccucccaagggcugggauuaugggcaccagccaccacccucagcucaacuccuguuuucucaguuuguuuuucugcacuggcuagaucuucaggguaacaacaaaacguuaugucaguguggcaucauagcacacaccuuaaaucccagugcucaggaggcugagguaggcagcucucugugaaaggccagucuaggaacuacagagugcauucuaggauagccugugcuacauagacccuaucucaaaaaacaaaacaaacaaacaaaaaauuagguguccuuaacauuuuuucacuuuaaagggaccuuuuguuagauuuagggaguuuucuuugaaaucuuugcuuuaauaaaguagggcuuuuauuauuaaguaauauugauaaaaaguccuuuucugaaucuacugaacugauuauauacuuuaauuuauaaagacaaaugccauguuuucaaagaguguaaaccaaccauccauuucuagaguuaggccagcuucagcauguguuaucuuuuuacauguucccagagagaacucggcucuguuucugauuauauucaacuagauuccugagaacaaucauucugagggggacgugaucucaaagagcuaacaaaauggaugggaauuucuggauaucaaacucccaaaaggcgggagccacaaaaauaagcccuggcacauuuuccaauuugaaaaacauuuucuuaacuacaaaaaguuuugacaaccccauagagcaaaggguuugaaauccagaguucaaggcuuuucccagguaggcaucgugguaaagaggacagaaacacaccaucuuugcuucauguguacagccuaggacagucaagucgucaccuuggauuaagguugagccagucugguuuuacucccaguucaugguauaaagaauugaacauuaaaaaaaaaagaagaauugaacauuucuuuggaagaguauauuaggucucagauaauauaugcguguguggggguuguguuuuaacucagugucaaacacauaaggaaaguggguuuguaagagaaaauggaaaaugacauaaaaccagcagaacaauaggcaaaaagaggaagacucacauuucaaguauaaaaauuauuagacauuuucuguaaacauagcuuuguuuacuauguauaaagaaagaaucaaugcacauaaaauaaaagugaaugaauuauuuuuuaaaaaaaagaaagaaaaauuaugaaaguugcuuguggaauggaaagcaaccaaagaauuacauacauuagaauaaacaagcauacauuccccaaacugaaaauuaacuacuaccgcguuuaauuugcaagguuuuaauuuuuuuucuauucacaagcuacguuggccuguaauuuucuuauacuucuauccuuaucugauuugggucaaaguuguguuggcguuacuuagaguguuggaaaggacucuuuguuuuccuauuuuaaugagaaauuuaauuaaaauuaguuguguaguuauuaaaaccagacacacguaguaugagucauauguacugcugaauauuccugaguguacacacagcucuguugcucauauggcauuguugcuguagcucugaaggcaggaaguccaacacuucguauuuauuuauuuauuuuugguuuuucgagacaggauuucucuguguagcccuggcuguccuggaacuaacucaguaaaccaggcuggccucgaacucagaaauccaccugccucugccucccaaguguugggauuaaaggcgugcgccaccaugcccggcuaguacaacacuucuuaggcucugaaguuccaucauccuguaguuuaggaaaggcuggaguauucccagucuguaaugacauuugugugugggaagcaggcaguuuuguuuucuacagagcacacccuuaacgucaucgugcagccugucguccauguggggcucaccgauagaugacaggaugaggagagagagccacaaggugugguuugcucaaacucccucagucuuaaguggggaugucaggcaagaagacugugguccacagggaccuggagaggaggagggaugcuuucuguaugaaugcagucgaacagaaauccugagccugagucauggcuuuccucaaggagaguaccagcuguuauacaacccccuuuguuuggaccauuguccaucuuuaagaggagacaguauguccaguccuuguuuuaucaaacccugcaucaaaacagucagucauuuauuugccuuccauguuccucaaccaucucccacaguuuaucauguggguguguuucccagugauaugggcucagucauuaguauggaggcuuuguuaaaauuguacagaaaauaacauuugcaaaauuacuuguguaaaaaaaaaaaaguuccuuucucacaccuguuagcuuauguguccuuacaguggaauuccugauagaagaaaguucaggggugaaggacauuuucuggcuugugguucauagggucuuugugcagcgucauggaagacacgcugaggguauguggggggugggggugggguaggguuagaguugguggcagcagcagcagaauugggaccagaacccagcagcuggguguaaucuucaaagguucaccuagugaucuaccucuguaagcugcaccccaccucuuuaaggccccacagccuccuaaaauauuaccacccacuggggaacaaguauucagaacaugagcccauggggacaucacagguucacccaugacaguaucccagcauguccauguuaccguuacuaccucaccuuaacuauuuaaacagaaaacuaguucucacuauugaaacagaaaacuaguucucgucuaugucccacaagguaaggaaggguauggugguuuuaguuguuaccagguaacuagcuaucuuuucaucaugaccuuuaaagucaaggcagugcuuugagggaaagaaccauuguaauuaaaaaugucuguaccugguguuauuaagacacacuaggggagcaggguggcuugcuguugucuagagcagaagaaaggacuuuaacaaugaaaacaagcucaaaccuaauuagcccugcacgucucucauuacugaagucucgggagcauggaugcuuuugaaguauucggcagaauaauuaugcaguauuuuccuucuacacuggguuccgggguaguuggaguccucuggacagaggaggcuuagguagguguuagugcugacuucauaagaagccacuuuuguguuccccaccucagugcccuguccuucagugacgcuguacugugucugaaacugacuaguucagggcagucaaguucccaaguguauuuaauuguaguauuguauuuuuuuaaaaaaaaauauuuaaacauuguguuaugcuuuuuuguuuccuugugugaguuugcauccuuuuugauggaaugguaaauuauagguaugauuacaaauuaugaguuguucagcaagauuauccauagcaagaagugugucguaucuuuuguucuugacuucuuauagaaccugugaauuucagucuggcggugacauguuaaguaaagaaagacugguucuuuuuaaagcuuaagguuugauuuauuuauauuuuaugcguaugaguguuuugucugcaagucugucugugucacuugugugucuugugccugcagaggccauaagaggguguuggaccucuuggaacuggaguuccguaacuccauuuugguacuaggaaucaaaccccaguccuuugaaagagcagcaaauacucuuacccacuuggccauuucucuaguucugaaacaucguuucuuaaaauacacagaagccuaaaagcuaaauuaaugagacagaguccucagagucccaaaucuggagccaagguaagaaacuuaaaccuuuaauggaugaagugauugcaacuucuuuuuggaggggagggcaugguuuaaaugcaacaugagauggagggguugcuauaauacaugcaugcaagaauaaucacacacuuugauagcauagacggacuggugaccaaggagcaguggagagcaguaugcuaaucucaggcccacucugggagagaggaugcucuaauuuuagccuaggauucugauuauuuuuagagggccguugcuggggagggcaguuugccacugucuggaagugcugucgccugaguagaucuaccuuccucugccugcuucucucugcagaggaagcagcuuucugguccccgagcugguuuucugugaggacuugggcugugcagauaccugcugccgucuucuugacaaaaauuaacuucaccuaaaauuaccugucucacauccucugcaaauacacuauggcuuccaguuuagugcuuuuaugggauccucgggugugugaacaagugggucuccgauucgugggccuuuuccugcuguugguuuuagccagguucuauguguuaguuuuuguuuuaucuuuuuauuuuauuauuauuauuccuucgaagccuguuuguuuucuaauaggagacagaaagggaguggacacugaugggagggaggaggggaaggacgggagggaggggaaacugucaucagguauauccugugagaaaaaaaauauuuucaauuaaaaaacaaaagaauuauauggggaaaaaggucaccugccccuguuucguggccucugagucgguuugguugacuuugguuuauacgcggagaucucuaggcucuaugcccugauaacaaguccgucuuuaaauuugaaaagccgugcaacaggugauuuauuuuaaacgacugaccagcaccacuggucuucacaggagacuaggcaaaauucgcaaguagagaacuguuauuuuguuacuaagauguucguggcaggcuuucucaccuggcuagcucagugagaaauacaggcuucugaaaaugugggcauuuaaagguuguuuguuuuuuguucucccuauuauucccugccacggaagauaauaagguccaucuuguugacuauacccagcaucaguuggucugccucuggggaugcaccacacacacacacacacacacacacacacacacacacacacacacacacacacacacacacacagaggaaauggaggcacagauguuuauuacagauguuuauuugacuugcaacgggugaggcaagauggccccggguggaguggguuaggguaagguaguucaccuggguuuauagaagcaguuugaugucugccuucgcuccacugccagacccuggcucucacuauggaaacuaaacuuucuuugucugaggcuuuggggaguuuggggcguaggacccacugaacucaucgguaguagguuuagucaagucugagauuagaaauguugcucuguacuagacgcaauagccaguuacacuaggcugguuauaguuuguggcaauggcuuggcuuuuuguuuggguuuuugaagguggagagugaagccagugcuugugugcgcgcuaaaccucugccccuguccuacacccucagcccgggcgcuggugcucuuuguacuauuuuaaaugaaggaacuucccuugguagguagacucaaugguaaggguuggguuuuuugguuugauuguuuguuuguuuguuuuucuucugguuacguuucaauacaguuguuugucuuacuauuuauuucuccuuaggagguuuuaaauaaagauuuuugguuaacuuggauaaauaaaaguuuaggccuauagauggacuaucacgucugcuuaaaauauucgucuuguauguuuuaaaucacauaaaaaaauuggaauuuucuacauucuuagguuuuauaaauuucuguguauuucaguucuuuauaaaucucaaugcccauaauuuguaaucaguauaguuagcccagaucauaucacauauauuuccaugaauacacucugacuuggugccucuuaaauauuugcauuaaauuuguauuacuaaaaugcugucuccugaugcagagcugauugauauaauagaacaggaaggguguuuugugguuuugagacagucucacaguagcuuuggcuagccuggaacuugcucuauagaccaggcuaagaucaaagguguggcuaccacaucuggucccagagcgaugcuucacucuuucccugugucuucauucagucuguucuuccacagagccugguuuuccuucuguccugcauaauccugguuuucucuuuaacaucucacugaauauuuaagaacuugggagugugugacucuuaacacauucuuagaaaggucgaguacagcacuaaguuuaagugggccaagaaagcagagcaugccuguauguaaguuuaaaacucuauuucuacgaauggcagggagggagggaggaagggagggaggugagagagggagggaggugagggagggugggagggagggagggaggcggcccuagagaagcugccgugacuuaucaggguggaaucauugugcaguaaugcgcugcauggcaguccugccauucuaauccuccuacaagcucaagucaauaggggcuuuguuccucguggggaagaauauacgagccaaguaguagugggaguccaguucaacgccacugugcuguagaugggugaauuucaaaaugauccagacauuuacuuuuucaaguaagagacuugagagcagaaaaugcauucuucugucuuucugcuugugugagugaguguguguguguguguguguguguguguguguguguguguguguguguggccagccagaguguuaaugauggauauuguucauaaugcagaggccggaggugauguagggaugucuuccucagucacuucaucucuuuaguuuuugagaccaggacucucagcaaaccugucgcucacuguuucugcuaaucuagauagccaccaagcccuuggaucuaccugccuuuuccucccagugccggggucauaggugcugcauaaucacaccugacucauuuuuauauggacucuagggaucugagcucagguccuccugcuugccagccagcacuuuacccacugagccaucucuccaccuuguguuuugagacaggcucucccacugggauccaaaccuugcugacuacucuagacugggcuggccugcaggccccaggaauccgccugucuccaccuccccagugcugggacuacaggcguacauuaucaugccuauuuguguaggugcuggaggucuagcuuagcucuucaugcagagcuauuccccagcccguaugaagaacuuauucuagaagguccuguuugaagaccuuguguucaguuuugggcagauuuaauuucuguugucuuuugcaaaucacucaauacaagauuuccugcagcuggguucacagaccuuggcgaacagaaaauauagaugagaauguuguagagauuuaguuagucuacagaacggagauucguuuaagaauuuuacuuguuauuuuauguugcagauaucauucacuuucauuuauucucccccucuuccgccccuucugcaggccccacugagccugggaacucucuaauuuuucuggccagccaguaagccccaaggauccuccuguccccaccuccccaucauugcaauagcaggcaugcaccacuaugccuggcuuuuuacacgagcacuggagagugaacucaggccuucagcgcuugugugcgaagcguuuuccugugugacugagcuaccuccccagccccaagcuuuuuggaauugauauauuuuuguuaaaauuaaucuucuucuuuccuuuccuuuccuuuuucuucuuuuguccuguaauggguaucaaacacgaguccuuucacaugcuaggcaacuccaugacuggauggcauccccagccauuacaaacuguuucagagcucagaaaguauggcagagauacuuccugcugcacugaggcgcccuagaugagaaaguaaguggacuuaaaguugcaccuaaccuucuucuucuuuuuuguuuuuguuuuuugguuuuuugagacaggguuucucuguacagcccuggcuguccuggaacucacuuugaagaccaggcuggccucaaacucagaaauccgccugccucugccuccugagugcugggauuaaaggggugugccaccacgccuggcgcgccuaaccuucuauggugauuuuuuuuucccuucauuuuguguuuuacuuaaccuguguuuucucucaccagguagaauuucuuuagugcggagacacauguuuuuacuucauuuugaugucuuuaucuuuaguaucacaaccaauuaccugguauaaguuaaguuucaaaauauguuuguaaaaugaaucugucauugguauaaccagccaccgaauuuacuguuuucuuccuauaaaagcaacagacaugugacucaaaaggguaacaggcaggagcaagacaaaauuccugaucccaaaacccacacacuguaucugucagugugugugggucauggcuuuaaaaaugcaaccuguaaauacaucucaggucuuuaaaaaauuccaggaaaagaguuccauauguguagaguggacuguugaggggaacuucguccagucuuuacugucgcagaaaucuaaccccaaguacugagugucaguccuccaugacaguagagaccucccaugccacuacccugaaggcuugucacguguuuauugcugaggggaucuggaaccagagccacaagaauguaaaagauugauuuaugcaaggcuagaauacagggugcccugcucaugaauggacuccaugcgguuuagucaggaaagagacuguuuucucugauacuguucaaagacuguuccacacagaggacuguuugcuuguuuuuguuuguuuguguuuuaauguggucuugcuuuuuaagucuuuuuaaaaggaguuuugggaagaugcugccagguuuuguuuauauacagacacuagcucacucgagcucuacccugaccaaugcgagaggugaguuaacucagcaagagcaccuggcuugugccaaggacagugcccuggggauugccaaauaacguuuuuaaaucauggguuucaggucaugaaugucacccaauuuagugaucuguaggccagcauuuucugacaaaugcaauaggaauagaguaauaauagauugcaucauaagacagcauuuuuuaaagcuaagcuugaguucucccucccgcuccgccccccccccccacacacaugaguguguccgcauuaaggcuacaauaugaagugucuuuuuuuccuaugcauuuuugccagaaaagcuuuuuaaaaaaguuaugauaaaaaguaccaaaaagcuucaaguucuugcuuucuaauuaacuuuucuggagcaagaaaacgugcauagagggguaaguacucaaguagagauuuacacgauuugggcaguaagggacaauacagauggagaugggcuuuuagacuuuacuggaccugaaccuggcaggacaggugguauuugaagagagugguuuauggguaauaacaaaggggagacugcagaaggagucagugcaccuuggagaguugcaggaucugguuuggggacagacagugaagcacaauuaaucagacuuugggauguuugcaguaacuugcauggagaguuagcguuaaauuggguaaccugcauggaucgauauggugggcuccggaauacuuccauccccacccccaacuccauacagcagggagcuccuaggagaaaauuucuagguggcguuuggauaccaagucucuggcaucagaucagagagccgggaaaggguguuggcaguucuccaggauguaaauagaaaagguagaaaagguuccauugugagugcgugugaaccacccugugcgggagacccgaggugcugucugcuugaaauaugucagaggguggguuggaggcauuucuuaucaugcugaauguuugcucucacuauagagggaaaaguagauaaaagggcucggccaccuaaaauaugcuguguggcuuaucugucaaguggccucuuuccccuccacaucacuggaucugguauacauguaauuuauaaaucuggggauauauuagggaacauuucuuaucucugaaaagggacauuuauuauuuaacugcucaagucuuuucuacuuuuuaguaggagagaauuuuaaaauacuuuaugaaauguuaauauucauuaaggaaaagaugauugcuguaauuagaaaaaaacuucaucuuucaaugacuguagcaguagacacacuggucauuuugaugaacuuccacuuagaagucuuuuuuaaaaucaaucuacuuuuuuaacaauucauuuauuuuuuauuucauaugcacugaugucuugcuugcauguaugucuacaugaaggugucagguucucugaaacuggaguuacagacaguugugagcugucaugugcuugcugggaauugaaccgggauccucugggagagcagccagugcucuuaacugcugagccagcucuccacugccuacuuagaagucuugauuuuuuguuguagcagauucuuaaaggcuguaaauugagacuauccuacaucauuggaaaaaucaaacaugcuugugucuagguguccgagguuacuuacaucuggucuagggagacugaacacagcuuagcuaugugacaggagcucacgguuuaaccacaaaugggcuagcaaguggaagcauaggcugggagggguagaaggaugagaaaccaugaaggacuucuaaaggcuuccacggagagucacgccccugcagggagggcccaugaaugagaaguggggacuguuaaugcuuaucuucugaaggcaucugcucacaaucacuccuuguagagggaaugcgggcuggcuggguacguucaugauguaaauuguccauccgcucagaagaacagaaggacaaggaagccuugucaaaggcugaauuccuaccccaaagucaagggcgggagguucucauggagaucuaaaugagaucuguucggguuuuccauuucauuugcaguuuucaguaagccaucuuuccugcucucccaccccccugauucccauuugaugcaacgaaucucuguuucucugcuuuuacugcucugcuuggggcgggaagggacugcaucggaaaaauggagccucuuuuuccagcaggcuugugcuucuugucuuucugcuugccugcuucauuuucaugagcuguaugaguaaaagaauaucauucaguuuugauuuuuaaaaugauaaguucuguuuacugcuuuuguacaugcucauuugcaagaaauaaagugauuuucccucugugaaauaguaugcaccuccagguaucaaacacagucaaauugucauuaaucuuaaaaaauucuagauaaacugucuuuuguuauuuuggugguacuacaaggaaaguucagauguagugaaucagauuuuaaaaccaugugcccuauagaaagaaugguagaaggcuuaguagaaacuuuuuuuuuucaaaauuucauguauuaaaaaguuauuucauuuuaaacauuuucacauaauauauuuugauuguauuuuuuuuccuuucuccaacuucucccggcucccccuaaccaccuaacuucauuuucuuuuucuuaaaagcaaagucaaaauauuaagaaugcauguacacagaagcgcacacacacacacacacacacacacacgucuaagcaugaggccugcccuagagcaugguuaauacaccuaguguuacuccauugagaaaaacuggucuuucccucuccgcacagcuaucaaccucugauagcuuccgggcugggcauggagaaggguggauucugcuuccguuccaccucucagugcugagccuguacaguuuuagucuccccugucacaggcucucugaguucauacauggaucagcccugugucuggaagaugcuucuuggggucauccaccaccucuggcucuucuuaacagaccuucugccucucuguagagcccuggacauugagaggggcaggagaucccguucaggacuugagugcuacacagucccucacucuccgcuccuucuuguggggcucuguguuaaguaccaucuacugcaauaagaggcuucuccaguggggauuaagccaugcauugaucuauagguauagauagaucauuagaagucgcuuuauugccauguucauuuagcagaacgauagugguagguguuccccuggggcccauacaaucuuuguuuuuauauucuuggauuucuuaggccaucugacagucguagauuuguuguugcuguuguugguguugcuguugcuguuguuguuguuguuguuggccaugcaaugauuugcauacaacucuucucugguaaccaauuagcagccagggaugguuuacaugcgagcaggcaaggcuucauuccaaugaaacguuauggaaacagacaagcuccagagaguccccaggcuauauaugaacccugacuuagaggauguguccccaugcagagcgggacaggaggugagguuagugaugcucccccccccccaccccaucucccccuuccccaaaaaaaacccucacuaugcaucuggugugaggcuggggaauaccuagaaacuggaguaucuggcuuggaauccugcaugcuguaauucuucaaucuccuuuccccucccccuuucucuuucccucuagucuuucuuucccucccuguucccuuucucuucccccuccucucccucuuucucagcucucuuaugugagcaucacacacuucccagguauacaucuucuucuucuucuucuucuuaaaaauaaacaucugaaaugucuucucugaaaagucaguauuuccacacugaucuaacccagcagaguguaacagacacccugccugagaacgccagcaccacccagcagugaccuggcuucgacaagccuaggcguuugacaaaggaacaaacugcuuucuuaccuguuggaguguaugaacccgagguuaacucuuugcuucuguaucuguuccucccgaugagaacugcugguggccuuaauaucguagcaguuuguaggagaaggagccggaagggauaaggaacuucacccauguuugcauguaaaggauaacauggcauuuuagacauguaguuuucuagacaucaaauguauauuuauuggccuaagaaguacagcugugaggaaacugacuugggaaagagaugugauggagguuggacucagcgggucuagucacuccaagccugccggcacugaguaaccagccccugucguguuugcggccuguguuugucugugguggguacuugcuacauguuuugccuugaaaugugucaccugugaaagugaacggaggggcuuggguuugccccauucauucuacaguguuacacccgcauucagggauuuuucucuccgacucauuuaaagucugagaacugagaugaaaacgcuucuagcccacguuucuguugcaaagguaaaaugcaccgcaagcaacuugggcgcgagaagguuuauuuaaguucacagucccaggcuauagugcaucguugccuggaagucaagcggcagggccugaagcagcgagcuccaucugcagccaagagcagagaggcugguugguaagggagcgcgcgcaugcucagcucgcuuucuccguuguaggaccgagcucaugagauggcggugccuauauucaggaugggucuuccaauuuaaguuaaccaacuuaggaaaaucccucaugggcacacucuuagccuguguaauauagacaguuccucaugaggacuuccuucaaagaugauuccaaauugugucugauugacgauuaaaacuagccgucacagcagggacguaguucucaaccauaauugcauauaaaagucacugguuggauguaaaauuaaauuuuauuagaacuaagacuuaagauuuauuugccguuuucaaaaguuuucuaggugaugcugacugccaauguggugccuaacuuggggucaggauauggagagugcuauauguggaacgccuagcacaggcuauguagaacgggggagggcucugggacucuguuggguuugaacuguuuggcucauuauugauaaguaccuucugcucuugcagagaacccagauuuuucccagcacccgaauauuggcucacaacugucuucugacacucgagggcugcugcauauaccuggugaacauauguauagauaaaauuaaauauuuuuugagucacucagugaauugucuguuauuccuucuuucucucuugggacuccuugguaaugcugucccccugggcuuuacucuaggcuaaggugagcauucuggacucacucggguccaucugucccaucaggaaaacuuaguguucacuuaaacuccagguauauugagccauuccaucagcacaagacaguuaucuucucgccuuguuaaagacaguuucaggacuagggagaugacucagauggugaaggugcuugcuguuaggcauacagaguggaaagccugaaagacagacagacagacagacagacacacacacacacacacacacacacacacacguuaaucuuuuuaaaggaaguucguccuuuguuuauuuguuuguuuuuccuauccagcuacuauucuuuauaacaaaauugcuuagaaauugucuuuauuagcuggcuccaacccgaaccccacccugccccgcuccacccaacccaacccaacauucuuuguuucuaacuaacauuccaccaaaccucuugucgauauaguagagacuuccagguugugaaaucuaguggccagagugcaaucuccaucuuucuugaucuuucagaaauaauugacucagcuggguucucuucuugaaaaacagaacaguugguuauccagauggucagccccgagaccauuuacauacaaguaacauuauagagacugggcaggguguacuuaugaauuuguauguauuuaggaacaaauacacaccccugauguaauuacaauuaauggaaaaagaggucauacauuugaaagagagcagggaggucuuagagggaggaaaugauguaauaccaucucaaaaaauaaaagucucuuugucuuuaguaucuauuucucaugagucccaguguccgucuguccucacgucugaaucuaguugaaggacauuuuugucugacuccaugucuuugaacacugguucuugaggacuuccagauuuuguucucuccugccuauaccucuuccucgacuucaguguuggucugucuguuccugugguaguggaguuugaacccaggggaguguuccaccauggagcuacaccgcagcuccagacucugugugguaucguguagggaaccaaaaaaaggggggggggacccuggggaaaaguggggaggaaaaggggccuaacaucuggccagaguuucugugcucugggcaggcagacgcaggcagaugcuucuccauuuggcuccaguugagcaugccugacccacgaggcaugggguggaaaaggggcagccccgaccagggacucuggagcuaccuugcuuauuacugcuaccuuggaccaaucuauugucaucucuugccuagguuguugcagccccuccuccagcagcuuuuuuuuuuuuuccagcccagcuagagagugcuuugccaguucaguagcccaagugagucuuauaaaaguagcagucaagggguguuggugagguggcucaguggccagacacauuugugcacaagccuagcaacuuaaaugugggcccagaucucacaagguugucucugaccuccacagguacauaguaugcguaaagcugcaugugcgcaugcacacacacacacacacacacacacacacacacacacacacacacacacacuauaaauauauagaauugaacaguagccgagcauguacauuugcuuacagaguucuccaguggauuuucaccuaguaagaaccaggucuucucaaugaccuacaaaguccuguguccucggccccaucuccucgugcuuuccaccuuacucauacugaccuccugaccacucccuaacuaaagcuugcugacaggcucaggguauuugcauuuucccugagaaggcuucucacccacauguugcaguguuccacuuacggucugugcucagauaucgccauagccauguuagugccgucaccucugagaaugcaauguuagauagcauuucucccucucccgcucucuaucaucuaacauagauaaugugugugcaugugcgcaagugugugugugcuuaugaugagugcucaugguugugcaaguguguacauguggaggcuggaauucaccaucagauaccauucccgaggagccccagagucuguuuuuugagacaaggccccucacugggaucagggacucacugauugugcuuggcuggcuagccaacaaguccaagggaucagccugucucugccuugacagcauugggauuuuguaggcacauuccuguuuggccuuuacguuggggcuagagaucaaacucaaguccuugaaguuucccauggcaagcagugacagagccuuucccccaguugacaacauuagugcguauuuauuccagcccuagccccgcucugacacccacuagacggugaacuccaccugcuuggcaccauauggaucucccuuucugcuguggccucaugcuuagaauauugacuagcugguacauauuaacauucaguaaauauuugcugagugaauggaagaauuuggaucuauacgacucuugggaccagugaggaguguuaacucugaccuaguggguagcugugguaagaaaugaacgcacaaccaugaaaacugagaaagccaucuuauacugagccauacgugguuuuauaggaauuucucauauagaugagagaugcaagcgaagcggaacaugguuguggggaguugaaagggaacguguucauugggaccuacagaaacaaccaguuaaagguauucuuacaaaauggaagguuagacuauucucagaaguuugucaccgugagcuuuggggucauucacugacuaaauaguuaaugaagaaacaaagcugcacucuuuagccuucugcagcuccguguauuguggggaucaggugggguugguuaucggaguuggucuugguuuguacuacacugcuauccuuagaugcuggaaagguuuuaccaucaggcugucuguucacgaauccuuuacugaugcucauccucugugcagacaagacagcauagagccauacagaccugcagauucuggugucuucuuucuuucucuuucccauguuucaagucccucuacugcagccagcguaugcaucacugacauuuugcuuacuuuauucgcucaguaaauuuaaucaucugccuucuuugucugccucccuccugucagucgguucccacagcuagaacuuggcuuagcagagugaguagguuuuuuuuuucccugagugugcagaugagugggaggaaggaccagccucauuccuuuagcucggcuaaaggauuucaggcauguugugacccacuagccugaaucagggcuuguauuaagucuuguaagcaugaggcuuggguuaaucagccaugcucccagccaguucuuggcuuggcuuuucacuugguaaucuaaucucuuuugcugaagcuauaacgugaaguggcagaggagguacccagauuaagauaaauauaucugauguuuaguaauggaaaaugguagucucuaaugguaauuugcaccuauuuuaaaugaccuuccaagcaugcuugacauuuuaguauuaguuaagaagucucucggucugugcaguggcugucugaugagacagccauguuuaauaaccaggcugagucacaauaguguggcuuuucaguuuacuaaagaauaugcagccuuuggagaccuguuccuuggcaguagggacggauaguaccaggugguuuuagggggaauagcagggagagggcagaauuguggccuucaccaaaacuucaaguuugauacuuuauggaaaaaucuaauuuucuuagaaauugggauguuuuuaucuccaaaaccauaucauucacuucaaaacauguucuucuccuuagcuccaugcugacauauaccaugguucuuauaaguagccuuugauguauagaccaacucuuacaaaagaacucuaaauacuuuggccccccauguucugccuuugcauuuagcaggucuggguuauagcguagcacaaaugugaagggauguguucaucacacacacuuggaacauaagacuguugaaggcccgggccaugcuuuugagaggagacuuucucagacugaaagcuccauuguauuuguuauaauaaguuuaguugaaaauuaccguuugcuagaaaacugucaagguuaucccauuuguaaaauuguaguaauuuaaauguacuuucugugggccugugcccuuuuucugauaguauuuggcuacuugacaaagggcaagacuaugaacaguugcugaaaucuaaggggaagaaauugguugccccucucuuuccucuuccucuccuuccucucuuucaacauuuuauuugaaagaugaugcuuacggcaguaggaagaacccagcucuucgcccaggcccucaaggacggagcuuucagucauagggaugacucuucuggacuugcuggggucaccucagcacacccuggaugugcuuaacugucccagugcuuucucauggguuggccugaagaucccaaacccggcccugacuuggcucuggacuguguggacugguggcguuguauuugugugcagucaucucugaggugcagcaguggcagcuggugcacagcuggacaugcuguccugggaacucucugcucacaacccugagaacguuuucaaacaguggccuucugcgucuacuguuuguguuaacuguuuggagaggccuaguuaguagccuaaacauacaccgucucuaauugacuguucuacagcuuucuuaguguuaacguucuugaucuugacuugacagagagagagagagagaguucaguuucugauuucuagagaguuagccuguaaguucaauagugagccccguggcaccuaauuugguucuuuagaaggaacuucuuuuguucugauucagcccuuggaaggcauuuuggaauccuggaaaguucuguauggccauuaucauucaucaguaaacuauacaggcaguuguuucacaagguccucauggaauuucucugaacugcacauaacagagagacguuuauguuccccggcagucaguguuugcauccaacucugagacaggaagagcuucuccguacucggggagauuagaaauauuuuaccacguaggaggcugcagcagaauuccuuggcuuggcccugcugggagcauggcugcauccccauuguucgggcagcccccuccccuucuccaucucuucagccagcauggacuguaggauucagagcagaacauaggaauuaauuuugagcguuccauucuaaacaucugcacuugaggguuuuguuuuaaggggaacauguggcaggggagggagaagggcagcagaacucucagaugcuaaguauuuucugaaggcuggguguacggauggcuugucuucuuaugccugaacaagaggugaugcauccagaauuuaggauuuccucaaucauuugaucuggcuccugcuccucaaagccauagugucuuguuuugauugaucgaucccaugaugaaaugauagcguggcagacucacuggauuggaaaucagaaccuggacuuacuuucuauccaccuauuauugaauuaguuuucacuuugccagaguugaauuauaagacggaccaauaagaguaggaaaucugguaagauagagggagggcaggcagggggaaggagacgcagaggcagacaugggagcccucaagucucaaucauuuacaggcaucauagucucaguagcacagaugauugcaugcccuggccccuccauuccauuccuuguguagcucucuggguguucugcugcuauggacacaugaggggucuuuuaugcaaacuuauuucagaaggugucugccauaggucagggugcuaaaacgcacagagaugucagaaagguaggaaaagaagaaacgcaagguaauguggaagcccaguagaaucccaagccaccuacucccgugcagaaucaacuguuugccuuguuggaaugucuuagauaguaaguuucuggaauaccaugcauacuauacaacaaucucauccucauggcuugccauauuuugauuuagcagagacaaugguucuuucaacagagcuguagaaacuguugugugugaccugcuuggaaaagugcuauguggguaccuuagggaggccuguauuuguggaguguucuucugugaguguaauuacgaaguagccccugggccaguuagguccuugucugaauagguucaaacccuugguucaagaguugucuucauaaacucuguuacaguauugcuuuacgcuuccuagaacuuuauaaugggucaaggguaugcaagagcagaugggcaggauuguccuuaucuuuauaaaagagaaauugcuacagagaaaucagacaauaaaggagcuagaccugagcacaggccucauagagcauaguccuauguucuucuugcaugcguguguguguguguguguguguguguguguguguguguguguguguguaugugucaggggcaguuauuaaaucucuucucugaucuggaccaguugagaaaaucagccuuacuguagauaaagcuguguaggaggcucuggccuugcuggauggcagaggacuccuugagcaucucagagggcaggagcuccugcucuacacaggaggucaggguagguuuuuucuaagaggugcuuuacguagggggaguacaugccaccuccuugagagcagagaguuggucuguucacauccugugucuaguguaucgcacaggacugaguguggaguugcgcugaacaaauacuuguugacccagccauggucucuggcugucucugguauagcagagaccuagcaaagcaaauguguucuaaggccucacaagagcuugggugaggauuaaauagcuguguguugucugaggucuugccacccaaaccuuuggccaugcccuagcugugcaggaacucccaaauccgcugccgccgccgccgccaccaccuccuccuccuccuccuccuccuccuccuccuccuccucgucguccuccuccuccuccuccugcacuugguugcucagagcuggcuucucacauggucucuugugagcaucuucagauagaaccuuucucuuuuugucucuuugcugagccuuugaaugaggguuuuucuccuuuccuguucaugucccaaacagccuccuucuccccaggguagauaaccguucugaggacagugcaccaagagaagcacucuaguuaauaaagggaaaggcuuugaauguacuggacguccccagaggacccauuccaaaagcuuucagauuucuaagaaaagauauuuuaauuaagcguucaaugaagcccgaggaguaagaauaggugagcucauuauuugguuuuauuuuaaaauguauuaguaccgcacuuauacaaguuuucauggccuauguuaagaaccacuuguggggaaaugggcaauuuccaggcuuagacgagccuacggggccauuagugugucugguguccugagguuuuccuggucuaaugcugggcucuuccucaaaucucacagcuaguuagcaauggggggccuuucuuaucuucauccacacgacuuacguacucugauguguuuguuccgcaggaaaggcuuuugacaucacuuacgugcgccucaaguuccacaccagccguccagagagcuucgccaucuauaagcgcacucgggaagacgggcccuggauuccuuaucaguacuacaguggguccugugagaacacguacucaaaggcuaaccguggcuucaucaggaccggaggggacgagcagcaggccuuguguacugaugaauucagugacauuuccccccucaccgguggcaacguggccuuuucaacccuggaaggacggccgagugccuacaacuuugacaacagcccugugcuccagguaggcacccacaggguggugugggagccagcugcucuacccaagugagccauccguggguggcuagguuuuaaugccauucuccuguguguuaucuauaagugaaaaaaaaaaagccauuuucuucccucugccuugggaacauguguucuuauguucuuuuacucuuaaaaaauauaucccaggguguaaccuuucuaaaacacauguuaguuuaaggagguauuuugagacaaagucugcccauguauguaguugaggauagccuugaacuccugacccucuagccuccaccuccccaguguugagauuauggguguacacccccacacucugcuucuuugaaaaucuuauuaaaacugaacaguuuucauuuucgucugugcucgugaggagggaacauaucgcuucugacuuuuccaagaaaauauuugguguggggcuagggauguauaucccgcuugguagacugcucaguuaccagugccucuagguagcugguucaaggccaaccugaaauacaugagauccugucucaaaaagauucuaauucuuuuacauuuugaaguuuauuuugugucuauguguguguaagcacaauagcauguguguagguuaggcggccagugcaugggaguuggcucucaccugguggguccuagaggaucugagggcauagacuugacgggaggugccucugccugccgaaccuucucacugucugcccauucuccgaguaaauaaaauaaggcauuugaaauaaccucuuauuuuucuugcauccuuucauaacuguuccuugauuugauuuuauuugaaaauaagccgggcgugguggcacacgccuuuaaucccagcacucgggaggcagagguaggaggauuucugaguucaaggccagccuggucuacaaagugaguuccaggacagccagggcuacacagagaaaaccugucuccaaaaaaaaaaaaaaaaaaaaaaaaaaaaaaaagaaaagguagaaaagguauauuuuuaaaauuagcaaugcgaaacaacugaugcaagauauuuaagauucucuucuuccuuccuuucgacacgaggacacuugucugugcugcugauagucacugugggaacucuuucuuccugaccugagaaguugaguucuagagucaggauaacaguuagggugccuuggcgugcuuaugcaucaccugaaaaccuuuucccaccuaauaauaaaacaaaucaaggauuccuuuccucuguucugugcgcaucccuguacauccucguauggagucucuguguacugcucagauuucucuaaacuucucacaugcucuggcuaugugcucauggaagagugaggagcccguguccuucuuaguauguugauacagucacugaugucauaucuauuugcauggugauguaaguaucuagaugggggccgucuauauuggcugacagaggagagaaggaaggacuagcugugacuuugcaaaugcuacucccauuucaugaaaaggaguucuucugggcuuucuacuucuggauuuucagccucugucucuggaauuuauuauaauuacuauuauuuuccguuuauuuauuuuguauguauaugugagagcacagguguacacgguaacaugcacauguaggccagaggacaacaugcaagaccuucuaccauguugguccugggguucgaacucgggucaucagccuuggccacagacauccuuacccacugaguccucucaccagcccuguaauuuguuauuacauucaaggacaccuuuugauuugguuguauaguuguagguagagccaaaagaugagaauauauuuuucugauguucgguuucucacccauuguacucuuuugggcuguccagagaggguacauaugaaaguaaauccauuagccagugccuuugugagauggguucuugugaugcagaugagauacaggacagagagaacagcuaacuuagauggaauaacugaagauggaaagaaagccucaggagaggcgagacagcagacgucugccacacuuguuucuuugguugauucuguuuccuggccuguagggucugcaguggggccaggaagagugguguuugagguuguaacugguuuucuggcuccuuugcugccagcaugcccaccagccuguccugagcagcuccccuggagggacucugcaguuuacuguucuucacgcccuagaaaccagugagacuauguguuaagaaugccuugaguguucguuucauugugugguagcuuuaauuauguguguguggauagaagagcccuggcucucauagccuagggccaaaucgggugagcagaugugacaucuaguugaucagauuaagcugccuucucuccgaccgaggagauggagaaguucucuggucucacuggcugaguaucaucaggguguguugguuugugguucuuagucucuguuauagcacuugugugguagcucuuaacugugcuguagugcaguggguucucagccauagaugccugagcaguguuguggugucuagguguauauuaagucuuuuaacccuuguaacucuguaaguugguuguuuuuuuucuuaucuucauuuuuacagaugaggaaucagagcucagaaaggauguaaauugccccagcuuucaguuguaagcgacagagcugacacugggccucuguucgguugagccucagauucucuguucuuaagauagucauauugaugaauaagauauucauauugcaggcaguugacucaguggugcccugugagcuuuacuucuuuaagaaggggagcugugguaaagauggagccuuggaagguauuauuagcauuaagcagagguguguuuagcuauuuacguuauggacaacuaacagauuccugccauuauggccccgagugggaguuguuauugaguuccaagacuggauacagugaaaucaucuucuccauucuaauuauacucgaagcuucccgaagauuaguuuuuaugaguucuccgccuugccagguguuuggcauagccugaggcugguucuuuaucaggagugcgcucgauggucccguagagcucucugcaagcauagaugccugcgucagucccuauuuguacaucugugaggaugagucugacacacagugcccaaaggucuccuggacuugaguugaagugccaucuuuggguuugggcucacacaccagccgggucaacugaaggcugagucuuucucuuccgcuguggucuuccauguucaggagaccagaacaggcuuuuuuccacagugaggacaagucccuuggcaucgcgaauacucccuauugagccucugcuugugucaaauugacugauauccccucugccaaaaccagcuguacguccaagcccagagucagcauggagagggacugcccaggguguggcccuggcagacggagucauugggaucauuuuuauagcaguaugagcaucugauaaaguuagcucaaugaaaacaugguuacuauaagggcuuagauauaaaaaucaggguaauagcgcagcuuuuauucuugucugcugcuguuacaguacaccuuucaacuugaucugacauagauucauugccuuguaccaagcgugagggaccccgcacugagcaaaauggacacagauuccuacccucugauccauuugaugggguggcauaggcaguguggacaugagugacagcaacaaagcaaugacguggugauaacuuuaagguagaguggccuuggaagaccuagcagaggugacauuguguaaaagaucacaacaaacacagacugcacucagugggcucggguccauaugcucacacacgaccuugugcuuaggucucugucugccuaagagagccuugcucagcccuuucagucaccucaggaagaaacagcagugcccucgccuuuggaaacuccaaguugugaagugaugguguuagcugccgaggagacaaggaggaaacuaucagggaauuuaagguuuguaguucagcaguucacugauggagcagaagacgaucuugauugacauaggaacuguuuagaagaguuugucaagugcaucucucaucuucagcuccucggcuucucuucaugugucugcuugccuuuuugcuuccuggcaggaauggguaacugccacugacaucagagugacgcucaaucgccugaacaccuuuggagaugaaguguuuaacgaccccaaaguucucaagucuuacuauuacgcaaucucagacuuugcugugggcggcaggugaguggacuguuaaagcugccuugaugguggugggacuuugauguagaacuuguuuaugacuuuauuagaacuuaaggagggaccacguggaucuggaaagacaagccauaaccuagaagacuuuucuuaucagaucuucucauucuggaagcuaagcaacuggguuuucugaaaccuuguuaaaucuacauuuauugaccacuuaagugcagaauccaguaauagguucugcagagcaguugcccaagggagaaaccuugaccuucuuggaucuuaggagggaguuaaggauaauucuuaaauagguaaaaaucaaaacauaggcugagugucccuaaucuacuaucucaagguguucuaguuugcuuucuguuguugugaaaaacacccugacccaaagcaaguuagggaaggaaaagguuuauucgucuuaaaagucccagauuauaguccaucacugagggaagucagggcagaaacuccagcagggcaggagcauggagguaggaaccgagccauaggccauggagggugcugcuuacugguuguucuccauggcuugcucagccugcuuucuugcauaauccaggauccuugccuagucauagcacuacugccugcaauaguuggcucucccuacaucaaucauucaugaagaaaaugcccaccuacaggucauucagauagaggcaucgauuucauagaggguccucccagauuccccacacuuaggccaagcugauagagaaauuaaccagcacacaauacuugaaauguuacaaaguaaaauauuuucugguguucaugugaugucacaaguggacagucaaaaugcuggucccugagcguuguguaaaauuaccuucaggccaugaaauucaugcugugacuuggucccacucccaaguuugguuuugaaagaguucaagaauccagaaacuuccaugucucgagcacuuggggaggguguugggcacucagcuugugcuagugcacccguguauauucagaacaaaaccaaaaaugucaugaaucaagauacagaacugcaagacuagaggagcagauggggucuggaugggucuuagagggcaggugggauuugaguggaagaugucuggauugagugcaggaggaugacuguguauuagcagaaguucagcguguaacucugcuccaugggaagaaaacaucuuugcacagcuauaaaccagaaagaucgcuuuaugcccagagacgacaggcuaagaaucauagacuuucuucucugguguuagcccgugaaaucucaagagcagaaaaauuauuuuuguuuaugguuuucccaacaugcucagugagguugauuugaaauguagccacugagaaauuuuuuggcaguguuuggaguaaggcuguaauaugaaaacuggguuaggaagaugaguguucguugagaguagaggauagugguacauagauagcucugaagaugccacgaagcccauuacuuuauauccuaaccugcagaaucaguucaaagacaugucucgggugaguguggaaagagguaaaggggcaguguggugcaguccucuuugauguuguauaaucuggauaugagacagcaaacaccugauggcaugcagaucgagagggacauauaggugcauuuuacugugaaaggagaaugaccaggucuuuaaucaaagaugaucuuaaggucuaaugaucaagaagagaacagugcuaccaccagcaaacuaagaaaaugggcuaacuuggaggugcuggugcauucaguccuagauuuguauaguuuuaggcccugggagacacuaaguuuguauaaucaccaaggacaggagccuuaaagaaggaucgaaacagaauuaucaaggcaggauucaucucugcaugaugaagaugacuccagugugcacagacauuuuuagguguagaugaagcuguagaauugcugucuuuaaggaagcaagugagagacucaucuguuccagccacauucacgucuccaaguucccucgggcccucaguuuauugcuauacuugcaucuaggggguccuucagugauccgugcccacagagagccccaggggaccaccuaacuacugggcaucuauggggagugaggcaucaaagucaguggcccuccuccuucagucagaagcacacucaugaguguagauuacugauauguguauuaaccuguauucugugcaguccagugugcagaaauagagcaauucccagugacucugagaggagcuuugacucuguuuuacaggugagguucagguacucuguaagugacagggaagcccagguggccugguaucagacuuuaugcuauucuuuuuuuuuuuuuuuuccgacuuuaugcuauucuuaaucauugucuucugcuucccgacagucuugacuucaggaaacauccugcuagugccuuagaaacuguuagggacuuucuacugucuaguuaaugucccaucuugggauuuuugguguguguguguguguguguguguguguguguguguguguguguguguguguuucagcuuauccuugccaaguuccugaguuuauacuuuugaaugguaaaauucaaaaaauucuuagguuacuuuugguuugcuguauacccauuucuucugcaucauuuuuaggaucugacagcaguuccauucuuagcuguuccugucucuuuucucuccagguguaaauguaacggacaugccagcgaguguguaaagaacgaguuugacaaacucaugugcaacugcaaacauaacacauacggaguugacugugaaaagugccugccuuucuucaaugaccggccguggaggagggcgacugcugagagcgccagcgagugccuucgugagugcugcugguguagucugcccaaugucuuagggacuauagcaggagggagggaauggugacuuccucaucgauuggaaacugaaaugcacuacuucuauagaguaggguacugagccacaugcacaucagaggaaaaugauagauaaggaaguugguugugaauaagucccacugguuuuguuuccuucauggacaucaacguggaagccgaaucuccaagguucaggaauuugauuagacucaaauacugggccaauguagcaccucuaaacugcgaccucugaagucacuguguggcccuuuaaaaucaaccauuccucaguaucuauaugagauggauuccagaacuuuccucacguaccaaaguccaugcacguucaagcucucuauguaaauggcguaguauuggcaugugaccgugcacucucuuccacgucuguugucuguugguuacaguguagacgccauguaaauagucccacauuauuuggggaauaaggacaauagagaaaagucuguauauauguauucagacauaaguacagacauuauuucccccuacauaguugaugauugaugggaucugugggcgugcaucacccuagguacacuuguuuagacuccugcacuccagcagccagcuugguuagcaugugucaguacacugacucgauucaucuuuucuuuaucugaccaaugagaauagagggaagagcuugcccagccacugcccugcaaaucuggguggcuucaggagaagggguagguccugugcccuaguaaaaggucaagaugaagaaguuaacacauacuuacccuucagaacgucuuggcucacugugcacagccugagagggggacuccggagaggagacagagucaugacuugugaaaggcuuaauaggaacaaacguuaaagccaccacaguguucuugaguccuucaucagucugggaaauagaaagacugagaaaaaaggacucuuggaacuuagagcaguuaccacagcaccuugugaaggacuuuugacuguuuucauugagcugucuugagcaaauuguauuauucgucuuuaauuucucucaacaaagcccggaguugcugauaaacuuucccgccuccucuagcauuucuaggaauuccagggagcuucuuuaaucccauuaccuaaucccauuaccacacuaauguaacuggauguuguaaggcgaggacuggugaaagagaugcacgaauuacuucuaaaacaucuaaacacaugugcauuugaaaaguauguguguaccgaugucguguuucuaguuuuucuaggaaauaggaacaaacaaaauacuguuagcucacugaucacaggcuuugauaaggagcucgcuggauuugccuuccuccauagucucuucaggaccaaccccucagaguauaguuucuggaugaugugacuaugacaggacaaucaggauacuggggcuagacaagagaagaacacagcugucuucucucauccuagccauuaacgagcgagguacagcauggccuauagcuuugggauggagcagaguggacaagggaauuguucugccucaugaucccaacaccggaccacuacuccagaaggcuagauugacugcagggugucauagaacagcuugggggucagagaaauagcaagugaaaggggaaggcacuguacaacaacuacugaaaagggugggggcaccaacuuaacaaacuuggugccagcaacucaaguuucuaaaaauguuuucaguuguaauucuauaauaggauauauuguacagagaaagaaaauacauauucagauaucuuuuaaaauaguuugaaaaguauuuauuguaaauuaagcaaaauuuuuguuuuuaugugauggacaagaacuuauaugugcuuuggacagauuaagucuuagaaaaucaucucacuagaagcagcacuaaaaacugaaauauuucuuuauuuuggauaccggaucuuaguauguaaccuuggaacucacuguggagaccaaucuagccucagauacauagaaacuugccuccugagugugcacugccaagaccagccaguuacuuaguuuuaaaguacgguuguguuuaacagaugaccuaguuagaucugugguuccccaguagauggaucugaagugucuagauuucccugucauucugcuugcgucaucagacaugcuaauuuaaaccuacaggucucaaguucccuggucuggagagaguagucuggcuccuuggaagcuggugucuuaauguguuugaauuauugaggcaaauguccaaagaaaagaugcaugauaaauuaguaccuuguuuuugcuguuagugcuagaaguagaagauaaggaguuaggaaaaugggugugauuauauacauuguuacccguggggugcacugggaggcagaagccagcagguguauggcucaaggccaggucuacauagugaguuccagaccagccaacacugcauagugaaaucuugucucagaaaaacagaaaaaugaucauuugacuuggcucuuauguaugaacagccacugggagacagauucucuucugaguauaggaguucuuauguauacuuuuucuaugaggauggauauuucuuaguaaaguaauggaugaucaggcuuucugaauuuguugacauacugguuuuuuuuuuuaaauaaacaauguagcuagcagucauuuuuauucuaugccaucugucauagagauguaaauugagguuugguuuucuugggagucuuuuaaaaugcuuucuuaaagguauauaggucuuggaggcuccagagauggcucagagguuaagaacacauacucaucuuccagaguuuauuucccaauaaagcacccauguugggugacucaccacugccccuaacuccagguccaggggaucugaugcccucugcaggcauccacacacauacauaacauucacucacacagauauacacacaguuugucuuuuuaaagauauacuuauguggcauaacuuguauauuuagcuugugacugcaauggccgaucccaagagugcuacuuugauccugaacuauaccguuccacuggacaugguggccacuguaccaacugccgggauaacacagauggugccaagugcgagaggugccgggagaauuucuuccgccuggggaacacugaagccugcucuccgugccacugcagcccuguuggugagugacauccaucccagugaguggaguaagcuaaaagagaagucuccugaacccugaggaaggaaagcuuugcuuucugagcaugugcagaguuaaguguggcgugauguaugcuguucuaacuuauaaacgucucauucugccuccuucaugcuaaguugaacuuucagauaacuuucuaguguguauagaagaaggagcaguucuguaaauaauuggcagcugggccauagaccauuugaacuuugacugugaaaggcuuuuccuuguuaaugauuuuguuuagucugauauccguggggagcugagcugcgcacagcauguuagugugugucuagagaugcguagcauuuagucucuuguaaucuuuuuaauuuuuaucuuuugagaguugggcuaauauuuuguuguuuggaccuuuguauacuaaaauucuagacaggagccuuaaggaacauuugauuuccagagaggugacuggucuguguggacuguaucacuggguacaguuuuguuccagagugguggguagauuuaccucgggugugccugggacacuaaacuguuagggcuuauaaagccaugauuuacagaguugucauuuggcguucaguccucauuuucucugucauccagagaugacauacuggucaucaggcauugcuuuuggcuccugcuuguguuugcuuugacauugguuuuacuuacccaucuguccaggcuuggaguugaacaugaacucuuuacauuguagguucucucagcacacagugugacaguuacggcagaugcagcuguaagccaggagugaugggugacaagugugaccguugucagccuggguuccauucccucacugaggcaggaugcagguaaauguuuucaggagcagagacggguccugggucugcgcagggacacgguaacuguagugggagcauuuucccagcgguaauggccaagacacuucuagacucgcaguggugauggccugggacuggggggacagaaagugcuuuucaguaguuuuaagcuagcauguacaguauuagguuucaucacgggggaugaguauucuugacugaaaccaaauccaaauauaaagcuaacaugaguucacccuguccuuuagagauucucuguggguagaaucugccgucguguaaaacggguugacuuucagaguggggcuucuuuccugccuguucuuuuuauuucauuccauuccccucaaacaggccaugcuccugcgauccuucgggcagcacagacgaguguaauguugaaacaggaagaugcguuugcaaagacaauguugaaggcuucaacugugagagguagccccagcuccucuagcucugugucuggccuuggcagcagauuucccgagaaagcagugccugaucgugccuuaaucucuuccagaugcaaaccuggauuuuuuaaucuggagucaucuaauccuaagggcugcacacccugcuucugcuuuggccauucuucugugugcacaaaugcuguuggcuacaguguuuaugacaucuccuccaccuuucagauugguaauguagcccuuaugcaccaccucacaggccucuagaacucccaagaccauuccuauauggguaguuugguuuuuuguuuuuuguuuuuuuuuaucaguaacuugggaguguuuuugauacuagggauauuugauguuacuaauaugcauaguuuuucucuuguguggcccuuuaaugaggacauacauaugauuuuagagaauguauuguaguaagcagugucuguaaauauuuuauuaaaaaauacagcaaaauguaucuuucaaggaacaguauauauagguucuguuacagggucuuuuuuguuggugguagugguaauuuccuuauagaaagugcaguucauacacuuuguggggccuggguauaggaugcuugucaucugaacgugcucuggucuucauuccuaccugcagaugaggauggguggcgcguggagcagagagauggcucggaggcgucucuggagugguccucagacaggcaagauauugccguaaucucagacaguuacuuuccuagauacuucaucgccccugguaagugaggcugcagagccacacagcuuucuagauccuucucuuggucacauccucacacccugacccagccuaacuucuaccuuccagugaaguuccugggcaaccagguccugaguuaugggcagaaucuuuccuucuccuuccgaguggacagacgagacacucgccucuccgcagaggaccuugugcucgaaggagcuggcuugagaguauccgugcccuugaucgcucagggcaacuccuaccccagcgagaccacugugaaguacaucuucaggugagacuguucucucugccaacucaagccugaccggcggagaaagagaaaguggcuuucugcuguuuuguuuuaucuugaguugaucuggccucaagguguguguuaaagagaaacuucugggcuagaugugguggcucaugcuuauuguccuagaccaguggagguugagguaggaggauugccaggagcucaaggccagcuuggauuacacagcagaaauucucugggggaaaaaaagcccuaauggauuauggagcugagcccuuuguuaucuaucucucaguuguacugagaagcuggcaaugcucucuuucauuugguuagcuugucagcauggcccgugguggcaagaaacagccuccuugcagccuacccuuacagggguucugugcccuuucuuugucuccaggcuccaugaagcaacggauuacccuuggaggcccgcucucuccccguuugaauuucagaagcuccugaacaacuugaccucuaucaagauccgugguacauacagcgagaggaguaaguugugaugucauuuaggaguugauuaaggaggugacuggguauaaaaggacuggguauaaaaggauucaugauaaagaaaagguccuguucugauguguucacacugauccaaaggaucaccaacuguauauuaaaauguacuuugaaacacucuuuaaggauuuggagaacauucacuaaaauuagugauagucuuauuuuauaauuaauaagccaauugaaaugccauuuuauauauagauuuucucagucuuauuauuaacuacuaguucaacuugcuugaccuucaaccuccauuucuuuuuguuuacugccauguaauuaucaagugaucugaacuauuggcuaaauuaucagaaucuauguauuacccugugaacauuggcuuuaauuuuguguaaauaaagguuuaaaaauaugccuucaagaacuuacuaaugagggcuuuuucccccccuuggcugaaacuuggauguguugggguguuuguuugcuuauuuuuugaaaucccugccugaguguccagauggaaauguuuuauaaguaauuacuaauauggaucugggcccuuggaagagguuuggauuacgaauguagguuagaaguugucuacauuuugguccuuuauuuguaaacuugggaaaauaggaaggggauggaauccuagaaacagaguugaggucugugcccugaagcccaaggaggggaacguggagaagaaagaauaguuacagguuugggacaagagcagcauuggguguuagaugggcaugggaggggacuggggaggagcuuagcuuuggcuuagcuuggaaacugagcaagaccccaggacucucugaacagucauuuugaaugugaaaaaguaaaauaaagaauauucucuucaagaacuuugaaggagacgaaagagaugaauuaucauuggggaguaggagcaagauugaagggagaauauuuuuagaccaggaagacagaagaauguuuagggauuagaagugcaccauaacucauggucugacuggaaaaaagccguacaccuauuaaaguuagguucaagccagcaauagaaguuuccuucagccuagguggucaguuuccauaugaauuauauaaacagcgagucauguugcauaacgugggggaaugcacuuuacccaugaugguaucuccaaaggcccacuugacugugguuucugcuggauuggauggaccauuggucuaacucagcauagcuuucuuuuuccucauggaaaugucagagcaugacuuguggcuuaauggcuuugggcgggcugcacacucgucagagcuauacaauccucuuuguguguuuguguguguguguguguguguguguguguguuugcgcgugugccauacuucaacuccaugaguauccuguaccacaugguugucuuggaugucuuuuucugguugccauucccaugaauaaccuaagcugauaguuuugccugcacucuuggggcuggcuucucacgagcuacccaguggugaugagccucuggaagcugggaggccccucaguggcucucuuuuccacaccacaaacaggcgcuggguacuuggaugaugucaccuugcaaagugcucgcccugggcccggagucccugcaacguggguggaguccugcaccuguccagugggauacgggggacaguucugugagacgugccucccaggguacagaagagaaacuccaagccuuggaccuuauagcccgugugugcucuguaccuguaaugggcacagugagaccugugacccggagacagguaagaaggccuguggccagugcuggaccugccaguccuuuugccauuagcaguggcauccauugucuucuuguuacuguacugauaguguaucuccacucucgcaauaggugucugugacugcagagacaauacagccggcccccacugugagaaauguagcgauggguacuauggggacucaacccugggcaccuccucugacugccagccuugucccugccccgguggcucaaguugugccauugucccaaagacaaaggaaguggugugcacgcacuguccgacuggcacugccggugagucugccuugcuccucaucccucagaguucucuaugguugugagcauugacacagccuuuuucccucgggugaccucacaaccccaagauggaacugcggcuguuguuuugcugugacuaagagagcagaaacugagugcucuguucaaggcuguguggcaaggcacaggugagcugggacugcaacacagcuuugugauuccagauagaacugucaccacauauaauguaauuucucauaaaguaagaacccaaacugggcuuucugcuggcuugucuggaauugcucaugugaaauggcaaucuuaaaauucugucucugaaucacccuuccagcaucucagagucagucacuuuacauugggaacaucuaucuaucuaucuaucuaucuaucuaucuaucuaucuaucuaucuaucuaucuauuuuuaaagauuuuguuuauuuauuuuauauauaugacaaguauacuguaguuaucuuuagacauaccagaagagggcaucagaucucauuacagaugguugugagccaccauguaguugcugggacuugaauucagguccucuggaagaagcaguugguguucuuaaccacugaaccaucucuccagcccuauuuacuuauuuuuuuaagagcuuuggguagaccucuguccccauuguagccaccccauucauuuuccaaagagcauaaaauuaugucucuuuuagguguuccuagcuauucugaccacagaggggucacuagcaaacuaccccuccuuggcuuacuuugccuucacugugaagggcaggaagacaaaaccagggcuaaacagcgugcugcuuguucaguaugucuuacaugcacuggugggauuugaaccuugacccuagacuuugaaagcaaguugcauuuuggaaugaguuugauacaggcuaccugauaucucuguuuuagucugauucaaaucacgucucaagcuuuugaaguauagauuacauguggacuagcuacacuaucagaggaggcaucgaagcuggaauguugccuuuguacccuguggcgauggcugugcgggagcugguggcugcccacagcagggccaggagggcccccauuucccucuguuccccuguguucucgucucuucccucagccccaccuccagccauacuuucugcucagcucauugaccuggguauuugcuugucacgucaguaucauggccgugcuggacaguggcugacugccucugaucugaacucugacuucccacucuccuugguuuucuucucuuuccucuuggguaccccuugaucaccucuuuauuucagcuggagguuuucauaugacuuugaugauccagucucuucaggcgaccaagucuguaucgcagcccugggcacgcucuccuaagcagagcccuuuguuccuuuccugggcacccucuccuaggcagagcccuuuguuccuuuccuuccccaccuggugcagggcuggacgcuuucuguucacccucugcaucuccucucccuuuuucugucugaugagacgugugcaccgcaucagauccggccuccuuggaguuacgguagccaggagcacaugccggagaugaaagaggacagaguauuuaucccaaggccuggguugaugggauccucaggcuugguggcccagaguuacaguuccaagcuucuggaagguaaccuuccccagacagcccugacaacccuguggucuggucacggcccccuccgugcuggcccuagagcauagguuacagaguccaugcuggucuccaccuuccuccuugauucccuaucucugcucccugggccgugcuaauucaguaugccgauuacucuaugcauucuagauccacacagcuauaauuccaaacuuaaguaacccucuucuucacuucgucccuuuuucuccaauucuaacccuuuccuucccagcggucuauagacuaccacaaccugccuguugaagccagaauccuuggguucacacuugauccaucuuuccuucguuucuuagaaacagccccuccucuaccacuuccugccgacguccagccuccagccuccggccucucagcugaagucccccucaccccccucucgcugguuccccugcuucauuuguuuuccugacaucuguucuucacacaggaaccagaaugauucuuuuaaaaugccuucggauuacaucgcuauauuaguauuuguuuucuucugagcuauuuugugaucuuccuggcuuagccucugaagcgcugagauugugugugugcaggggcugaggugguaaaaucucaguaaguaaaacccuugcugucaagccucaaggccugaguuuagucccuggaucacagguaguugaaagagagaaccgacucccauaagcuggccucugaccucaguagucauacuauggcaugcaugcaaacaaacagcaagaguggaaaagaaaggcucucuaguaucuugucacugcacuugaauuuaagucuuucugucaccaugguccgaccaggguuaguugguuucugcauguagccuuguucagaaguguucccauguauuuuucugacagacuucucugaauucuaauccuaaugucucuucucccaguauaaaauggccuucacccucacucugauuuuagccacuggguuugguugaaugcucucgggcuugucugcaucugacaucucgugugcauaucugugcugauaauuacaguagcagcuucaugggagcagagaccacauccacccacucgcauccuggaagagugcugguguggauaggagaugcuugcaggcaguuguuuagugacuuagcaaacaaaccugauuggugagaaacacugggcucucuuaggcccuguuggcugcucagauuaaagagcucaucucgaggggacaggaauggcagggauguauagaaggauggaccgaucagugaggaugcagaaccugaaggugaguuucuaacuccaaagcagacaugggugguaccugguucgcuuagaguucagcauuagcugacagugcuugaguagggagugagugucuuuuauaaguuaggagacccugcucgcuagagacuguguggaugcagagacugguaaaccucugcauuaccaagaauuugagcacaucaucuugguuaguugucagagaauuugaaaugagguaagcaaaccagggauuaucccaccuaggaaguaugucaaggccacuccacuguuuuggcccagugguagggccucggccuggaucuccugcucacaccacaccacaccacaccacaccacaccacaccacaccacaccacaccacaccacaccacaagaccguguauaugcuggucagacuagacaguauguacccauugguaaucuacggcaggaaugccucaggccuuucuucuuuaaccucagauccucucauucccaggcaagagaugugaacucugugaugacggcuacuuuggagacccucugggcagcaaugggccugugagacugugccgcccgugccaguguaacgacaacauagaccccaacgcgguuggcaacugcaaccgccugacgggcgagugccugaagugcaucuauaacacggcugguuucuacugcgaccggugcaaggaaggguuuuucggaaauccccuggcucccaauccagccgacaaaugcaaagguuagucacuggccagacucagucacgcccacaccucgauguacagauccacaguggggucucucucaguacuuacagaaguuuucgagaaugcagugugaaccacuucuugcagaacuuaaaauugcuacacuccaucaaaaacguaaaacaggagaauuaauuuaguaugcuuaacaauguagccaguguuuuauugcuuacuauuaugcagguaaucaucuguuaaaaaccauuaauaagaugguucuuuucucacccuauguuuacaagggcaauguguuuuaauugcuagcacaucucuguucagacugccaagacaagacucucugccguaucggcuucugugugagacaacacaggccuagagaaccugguccagugccuuagguuuuacugcucucccuggagauuugcaucuguugcuuucucugucuccccacccuagccugcgccugcaaucccuacgggacagugcagcaacagagcagcuguaacccggugaccggacagugccagugucugccucaugugucuggccgcgacugcgguacuugugacccuggcuacuacaaccugcagagcgggcaaggcugcgagaggugagacuugagucuguguaaagugauccuuguugucuuugucuuaagaaguacaucuuuccaagcuacucuaagcagcuggcuugagguugcuuaggaauuguuuccagugucuuaugcaggaaaggcgcuguguaaauaggggacagaagggauagauagcauaguggcaguucugaugugucagacacuaauucuuuuuuuuuuuuuaagauuuauuuauuuuauuuaugugaauacaauguagcugucuucagacacaccagaagagggcaucccauccuauuacagaugguugugagccaccaugggguugcugggaauugaacucaggaccucuggaggagcagucagugcucuuaacugcugagccaucucuccagcccucagacauuucaaaaugcagauugcaagguuucuucugagacagacucaucagggcugcagccugggagucuguccaguucucugucaguaggguuuaguguggaccuaagggaacaaccccuaacauucugaugagucguccuuagcgugcugucuuccagaugagaauguugcccacucucugccccuccuacccuagaaacaucuugugcuucuccucaggugugacugccaugcuuuggguuccaccaaugggcagugugacauccgcaccgggcagugugagugccagccuggcaucaccggccagcacugugagcgcugugagaccaaccacuuuggguuuggaccugaaggcugcaaacguaagacauggugacuugcagugcagugucucccaugccaguuagugcguuacaggccugauagccucuguggccacgaaagaaaccuccugugacuaucagaaaacucuggagaucgagggccuuugguuccucugguaccacccuguugaugucuccuuuucuaguuuuuuuauacuuauuucuccuuguaauuuuguuuucuaaagaaaaaaaaauccccccugaagcacugagcguguccacucugcuuauuaaggcuuccugacuaccucggcucugcagauaaagaagcagccguggcucugcucggccgcuauuggcuugcuucggcuccacccuuggagcccauuugguuugguugcauauaaacaucugcuucuccuuggcauaaacacuugccuggaaaucagaacaguuuggauuuuuuugcuuucugaauuccuucauuucuuguguggaauguagaaauuccaaagagaaaacaaacuguaaagaagcgcaggaaguguuagguuagcauuuggguuuucuuauuucuuagagaaauuuaaagaugaaaguagagaggagucccagaagcauaugagaaagagcgcuacaucauuuaauauacuguguguguucucuguguagcucaggcugaccucacuuccccuuccucuaccucccagagacauauucucuaccaugccugacauucguguaauuuuuauaccacauugaggucaugugccccaagggauugcugaggugacucaguugauaaagugcuugccauucgagcaggagagccugaguucagauccccagcacccauauaaaaaggcagguguguaucuguaacgaggccgaggcagguagaucccuggagcucacuggccagcagcucggguugagaugcaagucucaaaauauaagggagaucuaggcacaguggcacacaccuuuaaugcugacacagcagcucuuuagagaccuggaccuaauuccagguaaagguaggcagagcucuugugaguuugaagccaucccggucuccauagugaguuccaggccaaccagggcugcauaaugagacucugucucaaaaauacacacacacaaaaauaaacaacagaaauuagguaaacggugguagagaugaacagauacccaguguugaccucugaccuuuguaagcauauacaugcacauguaugcacacaugccacaugcugcccauauuacuucacaaccuaguuuuccuuuuaaaaugucuaucuugccugcuacauggacuuagcuauuuaaaagucucauaagugaauuuuucauaaguacacaugaugaugguacagucaguccgaguuaaaaugggaauugucuccucauuccuuagcuugugacugucaccaugaaggaucccuuucacuccaguguaaagaggacggccguugugaaugcagggaaggcuuugugggcaaucgcugugaccagugugaagagaacuauuucuacaaucgguccuggccuggcugccaggaguguccggcuuguuaccgacuggugaaggauaagguaagcugucaguagggcauucacucauucauucauucauuuguucguucauucacucauuccuucagcagacaugaaguagaaacucaagucuacucuaagcuccagagaagaaaugguagacaccuugaacuugcucucucuucucagagguguauguucuagugaggggggaguggccagaaccgcauacauaggagaacuacugagaaaagugccugaagggaaggaauagguacuaacaaaccaugggaaacugcagagccucuguaaggaaacucucgugauucgagauccgaaggauaaagaggcgggagccgugugagggggagugaggcaggcaagcgccuggaaccuggaagcugcccagacccugcccugggaggaacuuugucuguggcaggucauauaggacuauguugacuuuaaguggggaguuucggggacuauuuccaaauucaguagagauguacagaaguccuuuacgaggaguguugugacugcugugugaagagggauuguuagggaugggaugagggggaagacccuugcauggacaacauaaauauguguguugagagaccaggacacggaaaaaagaagaagaaucaggaacuguccuuaagguuguuguuuaauguugcuggcgaugguuuuaaguccccagggaaaucagauucucgaguucgguuugagaugccuagcagagaucuaaacaaugcucaggggagaggucaguacuggagaacugucaguaggcuguguguacaggaagaaugguaccaagagcuugccguggaagccagagaaacugccugugcugucugugugagcaugcagaccucccucugcacagagcuccaguuuccugcagugugcacagccaaucucuccccccuccuuagguugcugagcaucgagugaaacuccaggaguuagagagccucaucgccaaccuuggcacuggggaugacauggugacagaucaagccuuugaggacagacuuaaggaagcagaaagggaggugacagaccuucuccgugaggcucaggaagucaaagguaucgugaucaaaaccugugugaccuggugaucucaguucuaauuuguauaguuucauaaauucucagggcuuuggcuuguuuguuuguuguuuucuagacaggguuucucuguauauauagcccuggcuguccuggaacucacucugacugaccacaacucagagauccuccugccucugccucccaagugcuguccuuauucuaaacuaggcuuuucccccuaaacuuaggcgaacucuuuucugcaauuauuaagugccuguaguaagccucguccugagcucagugccaguggugagaagcuggguaaacccuccuccuguuugcaggaugcucuccauuaugggacaagugugcucccagaugcacauaauaaauguucauuaaaaauuagcaagcaugggacaguaguaaccaacuucucuuugaguauguauguauguauguauguauguauguauguauguauguauccauuuggaguuaccuagaaaagucagccuguccaagaauauagaucagaaacuaaguauguugccuuuucucuucauauagauaucacuaauguauagaauuuugauuuuuuuuuaugauuauugaaguaggaaaggaagugacuggacauauucguuauggcuaguuguuuuuuuuuuuuuuuuuaaugagaguccacaugggacauuuuuagauauugaaaagcauaaaauaacagugacuuauuuuaauguuagaugcuucuauguauuuauuugggguugcuuguguauaucauuguaaguggugaacacugcaagggacacccugcccauuuacgacguucauuucgucagccacuuuagcacgugguuuuccacuaacaugcuuuauuaaaacagcaaauccacacacuguuugcuguauacacaguaucaugagguuggcuauagucugacauguggggcuaaccaggaugugauagaaagcucugggccaauaccaccagcauacaggagcaggcccagggccaaagaagggcagcaagucugggcaccgucauucuacgcaacuuggcauagcugcaccacuacuggcagcguccucuggccacagaaaccacauauuuccugugcccacacaggugggucggcuggcuguggcuccaccacacuucuuugcauuaccugcaagcuggaaggacaguggguucuugcuucuccgagaccuggaagccucucauaggcugaagugccuuucugaggcuccucauuugugcaaguuccccgcugaccuuuccugcuuagguuccaacuaaccgagaaugaaaaugccuucauaaugaaugcuuuggcuuuuagacuggaaauacucaguuguaguugagauguacuuauacuguaggcuugggagaagguuauauggaauggugcagugcuagcagguagacauuggaguugaaggacaauugaccugaaccucccagcgagcaucucuguuguccucucugugccauucuagagaacuggaccuugaggaguggcaguugggaucuaaagcgggcacgcugcuuuaacaacaguggcugauauuuuucuguucuaaacuugguuuuauuuucauaguuucugaaaauucucuauauuuucaaagaacugugcacgguguccucuaagcaggacccagugugcaguuaggcaugguuucuucaggaugucacugugcacgaguguuucagaaccuuacugucaaguugcuguuuuccaaacacguuuuaauugauccuaucuuggaacuuucauauuuuuacacuccuuauaaaauuuagauuuuacacagcaucauacugaaauaaaaaaaugcucaauuuuuaaaaauuaaguucauuuuaagugcucuauuggacauaaaaguacacauauauucacagaaugauaauauuuugauaugugugcauauaugcauagcccaaauuuuaagucaggauaaacauuuagcuccucaaauauuuguuacuucuuuauggugaaaacugucaaaacccuuucuucagacuuuuuaaaaugaauaguguugauuaucaguugccccaguuacuguucaguagcacaccagaacuucauagacuugccuaacuuacuguccaucucccaccaucccucaccaucugucaccauccucugccaucuuccaccaucccccccaccauccccuaccaucccucaccaucccccaccuccauucccccaccaucccuaccauguccccgaccccccaccauccccuaccaucccucaccauccccuaccauucccaccuucccccccuccacucccccaccaucgcucaccauccccugccuucugcugcuguaaucacacuguauguuugauagcuuuaccacuguauuguugauaucagcuuccacaucugggugaggucaugaggcacuuuucacucugugugacuuauuucaccugccccaucuguguaguugcaaaugacaggauuugauucccuucugagguugaacaguaucucuguguuuccgugcuguuucguuaaccacugaugguagaugcuuucacugcuugccuauugacgagacugcaguggucuuugacuuuucccuggaaugugucuguagcguuggaacuccuggaucaugcuuuaguuuggggaacccccuccuguucuccaucauagccgcacuaucgcacacuucuaccagccgugugcaggguuugcuggucuccgcccucagcagagcuucaucuguuccaucucuuugacaguagccaugcugacugagcucucacugagcuuuuuuuucuuuuuuuuugggggggggggauugguuuuuucaagacaggguuucucugugaagcccuggcuguccugaaacucauucuguagaccaggcuggccuugaacucagaaauccaccugccucugccucccaagugcugggauuaaaggcgugcaccaccacugcccggcucucacugagcuuuugacuugaauuuccuggugguugaugccauuaagacaucucucacaucccuguuuuucgucugugugucuucuuuugagaaaugucuguuuuuguguguuguccauuaacuccccccgccacaacucacacacacucacacucacucucacacacagacacacucaaacacauaccacacacaccacacacacacucacacacacacgugcauacacacacacacacucacucacucacauagacacacacacacacacacacacacacaccguuuugauaaugagcuuuaaaguuguuaagugcuuccagucucacgguacuuacuuucucccagucugugguugucccugcuacucuugauguucccuuugcuguguagcccuccaguuugauguaauugaauuuguccaguuucgcuuuuauuuccuguguuuuuggggucuuguccaaaaaaggauccuugccaauuccaguguccugaagcauuuuuuuccuuugagugauuucuuuauuucagaccuucuguucuaguauucaguucauuugaggugguuuuuuuucugacugguggagcuaaagguccaguuccaccuucguguggucauuuuccauuccuguuuccuggcuguccuuucacuggugcguguuuuuagcaacucuuuugaaagcugccuggcugcagauguguggauuuauuucuaggcucuuuuucuguucccagaacuagucaauuugaauagaacuugaauuuuuuucuauauuaauaaaaccucaugacaugugagaauuuaaaacuggcaagcuuuauauuugcacagguuuauauuuaucgguugauuuauuaggaccccagugugagguuuaaaaagaauggaauaguaaaauucaacuauguagaagcagagauccaauugaaaauugcauacauuauugggacagaggugaggugggagaggagcaaaaaguauaguuuaaagaacagagaaguugaguuugccacacuucccaaguuuguuggugggcaguuuuguuuguuugcuucucgguuuuguuucauucucaggauuuugucuugauucaugucagguuuuacuuuguaucccaggcugagugggagcuccccuguagaccagacuggccuggaacacgcagagagagagccaccugccucagccuucugagugcugggauuaaaggccugcaccauuccuggugucugcuucaaauguccuuuuuaauaguuaguguuaggcuuuuaguacuuagcaguguuuuaacaguauguaguugugguuaaauauggcaggugucauaguauaaugaucaguuuuacuuuucuucaucaagcaucugcaugcuugauugugcuuugcugacuauuguauaagauuguggagccaguaauggguagaaaagggacucagagucacccgagacauucagugcaguggggcaggcagcaaugaaagcuugaugugguacaauagaaguuaggggaaaugugucuaaaagaugcugcugaggauauuaaagauacagugccacagcuucacauagacggcauaaccccucagaucauuuauagacugucucugcaaugcucuuccagauguagaucaaaaucugauggaucgccuucagagaguaaauagcagccugcauagccaaauuagccgacugcagaauauccggaauacuaucgaagagaccgggaucuuggcugagcgagcacggucccgaguggagaguacagagcagcugauugagaucgccuccagggagcucgagaaagcaaaaauggcugccgccaauguggugagggagucugaaguucugguggguuggugggaccuuggguaaugguggauuggaguguugugcgcauugccauccuccuaccuggcacuccagagcacgagagccaugcugcucaugguuauuggggcagucgcuuuucuccuugcuguggcaaagugaacggaaacaggguaagacaggagaggucuguuugguuccucggcgugggcaaaggacugaggcagcuguugguagggacagaaguacguggugacuucucauacagcaggcaggucuagaagccaagaaugggacagaagcagaacagucuauaccccuaaaggccugucccagugacccaccuucugagguuccugccccggugacccaccuucugagguuccugucccggugacccaccuucugagguuccuguccuggugacccaccuucugagguuccugucccggugacccaccuucugagguuccugucccagugacccaccuucugagguuccugucccggugacccaccuucugagguuccugucccggugacccaccuucugagguucccuagcuucuccuaaauggggaccagguguucaacuacaggagccugaggaggucacuucagguucagacuucagcgauugucccaaaacagaacuggauaaaaacugagagaugucuaggcucuuucucuuacuugccucuuccgcagcauucaaaauaaaaauaauucccagccaaaggugucaaucagagguaaagaucucugaaaauaagaaaaagcauuuuuugcacaagaguuggaacaaaaauuuaguguuaauacuugccuuauggaacuuaaauaauucagucuuuugaaaauaaguguuuuguuuccucuucagucaaucacucagccagagucuacaggggagccaaacaacaugacccucuuggcagaagaagcccgaaagcuugcagagcgguaagcugcagugugcuucaugguucaggcacagcacuucagcugagacuuccauauugcccuguccccucccacggcuacuuuccauugagguuuacccacucugaaauguuaccagauaugcaugcucuuuuucuuccacuucaaaauuagaguguuuaccuuaaguauuagaauauaauaguuuaaaacaaaacuauacuuauauaguucacagaucauaauuuuuauauuuuuuaacuuuaaagugguaaauuuuauagauuucuaagacacucaauagaacuuauuaauuuaaaauuuuccauuaguuuuccaacagauauucaacuuugagaccucaauagaaaacacuaacucauuacacauuugaaugucagccaaaggacacugacccuuucauucccgauuuguuuggguuuuauacuuuuaaauugguuauaagauaacuucuuuggaaggcuuuaaauugcaggaggaaucaaauuuuuaaaaauauuuucuaaaauggcaaggauguugagagcaagcaucuguguaugaagccccaguagagaagacucaguagacuucaguaguauggagcacagaaggaagccugauacagaugugagacguguagauccugcccagagcagccuggucucacagguucuagguuauguugaucuuagcaggguuuuuucucuucugguaaggguaaacauaugagccauugacuuugcagaacguucaugguucauagcuggacuuucuuacuaaaggaagauagcugaaaacguggagccucccaagcaaacucggucuugaggguugacugaucuggugggcuuuuaaugcaaagacuuaggaugaaaguuucuuaggccaaggggaauggccacguacggggugccacaguucaacacgaaaugguagaggcagaacauccauuagcauugcuacccagcuaagauguauugcuuggcuggagugccugucgauauguuccuugcuauuugguauugcuuuuucugccgguaacgagggagcauaagaaaaguccaaacagagaggcucugcagagacuaugcaggaacuguguagaaacugugcaguaauuguguagaucuguagaccagaagacuuuaugauaaauaucaggcccaagguuuauguugcugacuacacacaugguuuuguaaauuacuuguguuccaaaguuaguugccugcuuccuucuauccccucccugugcucugagauaucuuuacuuccuaccucaucuggccuggaacuccaauccuccugccucggugcuaggguuaugggcagaagcuaccacagcacacccaaucaaaaaucaguuuuucuaagaaaauacacauuugucccuguagaguuuugugccacugauuuucuuagaaaauacucuuuucucaguuacagaugcuuuuuguaaauggagcugcccaaaaugauugugaagcuccaaaugggacuuugcaguguuccuagaucucuguccauauuaggauguguaaauauaacaaaguguuaccuaaacguugcuucuuucccuacugaacagucuguuucaugucuauuguuuaucuuuccuccuacauguacagucauaaacaggaagccgaugacauuguacgaguggcaaagacagccaacgagacuucagcugaggcauauaaucugcuuuugaggacccuggcaggagaaaaucaaacugcgcuggagauugaagaacuuaaccggaagugaguguaauuggaaaguggcucgcgguccuguucugcgaagaaucaagugcuguggauuugggggauauccucuugcauaugagguuucucagcgcuguggauuugggguuacgcucaugugcaugagguccaucgugcuuucagagugguagugugauuggggaggggauguccagccacaccaagcuccguagcugcucaggaugguaaccagccuagccaugcacuuaagagucuucauuuauggaaacuggagagaggaaauuccagugcaguggagaaagugugcugagcugccaaccuuuaccugggccuaaagggagaaugugcagacugaauaacccuaucuagaagcuuagggaccagaaguguuugggacuugagagacauaguuuuugaacauuugaauacauaaugagauuauggauuagauccagucucaacacaaaguucacguguguucccuaacacauagccuaaaauguagcaucguauuuguagugcaucugcaguuugauagcggccgucaaaugggagcaggugugaaauucuccuccuguggucuugcaguagugcuaaaaacauaacaggguugggauuccggguuagggauggccaguucuauauacaguaagcuaauuagaauuagaaaaaugaauuguaacuuuuagcuaaguguugcuaucagaauaagagcuuugguacaacauuuccuuugagguguuuggagauguugucccagugaacguaacuagauuguuucugguuaauaucaagauguuuuuuguuuuuuuuuuuuuuuuaaaaaaagcccagccagcuuuuuuuuuuuuuuuuaaaugaauuccaucauuuguuucuuagguaugaacaagcaaagaacaucucucaggaccuggagaagcaggcugcccgaguccaugaggaagccaagcgugcaggugacaaagccguagagaucuaugccaguguggcccagcugaccccuguggacucugaggcccuggagguaugugugcagaggcucuggucacuggaaccccaucacaccccugucccucuagucugaggaagagccauuuugacagugcccugccucucccuugcagaccuacaccugacucgcugguaaaggugaguucuacuuugaauuaugcagguagaacuuaaugagauggagcaguauagaugugaaggggugaagauuacuuggugauaggaacacuugucaaacucuaguugaguuacuugaagcacaguauggcuagagccuaccuccuaggcauuauguaacagauauugagagagcaagaagaaccauacuagccugcaagaacuauaccagccagcauccacagaggcagguagaguauucaggaguugguaguguuuuaauucauucuguaggcauaaauuuuugcuaccgacuucuaauaaggguucaaccucuccucuagcccaccacccagcagagacaguggaagagaacgguuauuaggauaugggggacguggaccuguucagcaauaguuccuuaggggcgagcucgaucuucuuucucagcauugcagucccauagcaaauacgacucccauagcaaauacgacucccauagcaaauacgacucagcagcugcaguccaguccuuucagcaggcagacacuagacagcuguaguucaagccugaagaacccgccaggcucgccaaguggccugaggugaggccauagaagcagcaagcugcuguaggaaccuuaccagcaguucuugggcaaguuucucucaauggugguguugucaccaguugagcucaacaaugcuauguaaggugaaccaauacauguguuguguuagcaaagaauagugaggcagagcaaaccagaccaaagcucagugcucaucucccacugucuguggggucauauuuuacuccuucgugaaguguccuuucaccugugucugcuucaggaaaacauucuuucaugugucugcuuuggcaagacacccuuucaccugugugccucaguaaaacauccuuugacauaacuaacuuuccagagaaacuagaaguucccacuucaucauucaaaccauguaacaaagccuuuauagcaauauuuuuaauacuaaacuugagauguacugucuuauuuccuauaccugaggugucaacugggaucccaagguugaggucucuucagacaccuaaugccaccugaguccauuuguaugaaauauggaaagagauaagacugccgaggugguggcagucggggguagaguaggggaagcugcagggaggggggguuggggaagguaggggacccagggagccagcuucucauggauagagcauucugcaucuugacuagggucugggcugccuaaagcuguguagucaucaaaguacagaaaacacuggaaaaucacuaacauauaccugguuaaaaauuguuuuuuucuuuccacagauuuuugcccccugucuuucacugucacauuuucauuuaaauguaaugaccuuccaugcuuguuacagaaugaagcaaauaaaaucaagaaagaagcugcagaccuggaccgucugauugaccagaagcuaaaggauuacgaggaccucagggaagacaugagaggaaaggaacaugaagugaagaaccuucuagagaaggggaaagcugaacagcaggucaguuugacuugccgcuggcugcauuucuugaggcgacaauuuaaacugcucaggugggagccuagcgugucuagcgcguggccucuccguacgcuucagucucugggcugugacugugagggggcuugucuguuaguggcaaagucugaccccggaagguuuguccucugaccugccuugcauuugcagaccgccgaccaacuccuagcucgagccgaugcugccaaggcccuugcugaagaagcugcuaagaagggacgcaguaccuuacaagaagccaaugacauucucaacaaccugaaagguacggguccagugacagcagcaucuucugcaugcccuccaagaggcagucacucuuuugcuuuuccguuuuguuuugagcaccauucucucagaacgaaagaguaugguaauucccauagacuauuuagaugcagugguuaaccaugcucuuuuaccgucuuuacuucauccucuacacucuguguguguguuugcauguaugcauauguauguaugguuguauguguggauaugugcacaugugugugcagaccugaaaucagacuucagguauuuucuuugcaggcucuccacuuuuauuuauugaggcaggaucucucaacaaaccugaagcugaaguauuugaaagaaaaaucagggugccucugucuucucauuccuuugcucuucacugaagaccaaaagccacaugugggagaguggccuccgauuagaugaaaaugucaccauagucugccugcuuagcugacuuuaaaugauacaugauaauuaucuggcacuuucucugacucugauacuuaauucuuuguuuuaaagaaacaugcccaguccacugaggggcugauucgugugugauaaaaagaaucacaggcaauauaaacaaggaggguuggcaggcacacuagcugggcgugggagcuuuggugucagcuggccuguuuacaucccugcuccacgaguuagccucuucauuuguaagaagagugucaugcugccugacacacaguugacacuaaggcacuggcuacaguguaacaugcugggacucugcuuggaguggcuucucaaauaggacccucucagaaacagaugugcauuccuaugacuugagaccuggaaaaccugcacggggcugucuguuuucuuccuuuucugagauuucacccccguuguuauuuuaaaaacaaaaccaagaaagacacugauuuuuaucuauuauuaaacaaaauccaauugcuguuuuguggaagguuuuucuucucugccguuuaguucaaaucugucucuugcacuccuuuuagauuuugauagacgcgugaacgauaacaagacagccgcggaagaagcucuaaggagaauucccgccaucaaccggaccauagcugaagccaaugagaagacaagggaggcccagcuagcgcugggcaaugcugccgcugacgccacggaggccaagaacaaggcccaugaggcagagaggauugccagcgccgugcagaaggugagcacuuccaucuucuccagcuccugcuugcacaucgcacacagaacucucuggaaccaucccugucuguuucuuuucuuuucaaugcuaaugagaauaaguacaaugaccgaagaaagagaaccaggaagaggacuuucuacugucuggguguuggauugaguugugaagggggugguuuuuacaucauaguccccgcccaccaagguuccugcucucucccugcauaaacguucucuagacccuccauagagcugcuguggccagcacuacagaggcugucuucacucacgcuaaagaggcauuucuucaccgggugugguggcgcacgccuuugaucccagcacuugggaggcagagguagccuggucuacaaagugaguucuaggacagccagagcuauaaaagaggcauuucuucaggccggcuuuuuuauguuaccgaaagauuagagcuuguuuuaaaauuaaguguuuugagaaucacagaccauuuuaauuucuuugaaagggucaguuuuaaauagauucugucucaugagaugcucauauuucaggauguagucuuugguagaugaugcuaagcucacaagaacagucaagugugguaacugcauugcaguggaaaggguucacaguuacaguuuuauuuguugucugugugugaccucagcuaaacaugguuauacuaggacagggaauucucaacaguaaagaagagggcacaaugaaaaaacuguauaaaaugcuguuguguuugacagugauuuuuuuuuucuuuuaaugagaaccuaaugaauaacgaguugagcagugauaguaacugucauugugacauucuuucuggacugcacccugagccauucuacagauuacaaaagggaguacgcaugugcacuagaacagggaggguugcucuaggagcuuuggcuugccucugccgaccguugcuucuccuguacccagaaugccaccaguaccaaggcggacgcagaaagaaccuucggggaaguuacagaucuggauaaugaggugaaugguaugcugaggcagcuggaggaggcagagaaugagcugaagaagaagcaagaugaugccgaccaggacaugaugauggcagggaugguaagaggcagaggucaggggugcucacugggaaggaccccacccccacccgaugcccaauuccugugaguuuccguuuguauugcauuuucuuccucaagaauugggucaguagcuugcguagaagacaaagaauuugacuccuuugccagguauugauguugcacaauugcccccauaccaaagcacagcugcagucccagaacacuuaaaacaaaacagaacagaacagaaugcaauuguggguaugugauguuuuuuaacguaguuugaauggauaauuccuacacgggauaaaauaacuuagaaaaggagauugcaaugaaaagcucauuucauucccaguuuucccagcugcucgcucacuagaggcagaagccaguuuguuauauaagacauuggugaggcacucuguagcacugcacggaagccugugguaacgugcacgucucacgccacguggaagaguuaaucugugacucuacggggcaguggggaaugagggucagcucuguucauucggugcuguauuuugcauucagaagaacuuccuggggugguagugugacugucccuguccuguucuguguugcagucacagggacaguguauaucagccuguuugcucacacccuugcaguggcaggaagaagcccaguuuucccaagcccccaacacagggccucgagcuggguuuacuuugggacaaagugcaaggccugugggaaugaugccaguucuguacacagcuguacaggcagcugcauuuggaggcuuauuuauuuguuuguuuuuguuuguuuguuuguuuguuuguuuguuugagacggggugguuuuacuauguagcuuugacugaccuggagcucucugugugcacuaugauggcuuugaacucauagaaauccuccugucucagcuucccaaaugcugggauuaaaggugugcaccaccacaccuaguuaaagagcugagauuuuaaacuuuguguuggauuguucugugauuuuuuuuuaugcaaagcgaggcucaaaugaaaaggaccaugaagcaaucguuagucuuucucuuuuuucucuguacuucauuuuuaaaauuacuuauuuauuucauguguuuuugaugcaugcgugccauaaggcacauguggaggucucgggacaacuagugggaguugguucuuuccauccaccauguggauguuagcaugcgaucucaggucgucaagccuaguggugaguccucuuucccagucagccaucuugccagcccugugggugcacucugacgggagcauuguauuuaaagcacugaaaacagcgaaggauacagauuugccaguuccaaaaagggaucuggguuuacuucaaagagggaaaacuaaguuuuucuuucguuauuuuugguccauaucuuuuugagagcagcaagccauccuucucuguacucuuuuguaacucuaucaguuuugaaaggccaccauucagcuaguuuuaccugaguguaacauuuucuucaaccagacagguugugauucuuucuggaagauaccaaaggccacagguuaaacacagcccagcucugugucccagucccagaaacucgcaggaagccuguaugggcuccagccgugugucccagucccagaaacucgcaggaagccuguaugggcuccgagaacagcugcaauuggaacugaauuuaaaauuuuuuuuucuguuuuuaaaauucccacaauguuuugauccccaaauguuugcuuuguccugaccccaaaacuaggaaaaauaauuagugacugggagugcagagccacuccuuucuguccugcuuuggguuugucgggagagcaucugcuuucugauacagggauguuuccuuuuccuccacugcauccugugacucacgcucuguguguuuguucagguuucauggaacguucccaaguauguuuaccuuugguuggcuuugaaaauauccauuguuguguguguaugugugugggugugugugugcguguguggguguggguguuuuuauaaguugacagagaauuuucagaaaagccucgcuuuuauucucuccaagaauagaacaucucuaauaaugagggcccugagaauauccacauucuagaauaauaauuccuacauucaacucgaacuuaaaacaaaauaaccuguuucuacuuaauccauuuuaucauguguuugccccaaaguguucucaagugaggggaagggagaaaaugggauaguauugguuuucugacugcauacaucauuagggguacccaggcacaguaguacagucccagcacuccgaagguugagacaggaggaccuugcauuugaaaccagcuuagguuacauaguaacucugucuuaaagaacaaaacaaaaccaaaaaaccaaaacaacaacaaaaagcauauacuguacuaugcaguagaaauaacauccuccaccugaagauaccacccccaaaaacccugcagugagagcgacucugauucaagggaaacacaucugaaaauagaccugcuggugcacuggaggaaaauauuuagagaagaagaaaacacaaaguccgaaguauucaugcuguuuauccucuuccacuacaggcuucgcaggcugcucaggaggcugagcucaaugccagaaaggccaaaaacucugucagcagccuccucagccagcugaacaaccucuuggaucagcuagguaaguaacagaaggguugcugcagccaccgcuugcagggcugaguccacugaugcagagucacauucucuaaaagcaucauuaaggcauucauauuaauguuuuguuuagcucuugcuuauuuaaagacaccuuguacacagugucuugcuuggcagaaccuuguaagggcagcuugcaucggcgcgacacugauaggcugucgauucuagagugaaggcgaaugggacucuauuaaguucaaguacuuaggugccuucccuggggcugagaugagcugccagcuagggaugccacuauggccaagguccagccuacaguuaaacagccauuuccucuuaguucugccugcugguggagcgucuuuaagggauuugaagagaaaggcucagugggagaauaaaauaauacuugaaccugacugcacuucagagcucagaauucucuccacuugccaaccaaagaacaauuugaugaagugaaaacuuucacaccaaacaagagaaaagcuuuguuuugucuuaucuuguuucagggacauauaagcgcugagcucucaauuuaacccagugugguagagaacugagcuuucuuaggaccuccauuacgagagagucauauagccaccaaagacuggggauggauucuuuuauguuuuuuuuuuucuuaaagggaagagagauaauauuuuaucugucucagagaccaauaauaauaaauuaugugccuagaaugaaagcaagcuaaagcaggggcuuuacaccuucuuuauccguuagguuguauaaaugcaugcaaauaauucuugaccgucuguacuugcugguuuugugucaacuugacacaggcuggaguuaucacagagaaaggagcuucaguugaggaaaugccuccaugagauccagcuguaagacauuuucucaauuagugaucaagggaggagggcccuugugggugguaucaucccugggcugguagucuuggcuguauaagagagcaggcugagcaagccagggaaagcaagccaguaaagaacaucccuccauggccucugcaucaguuucugcuuccugaccugcuucaguuccagucuugacuuccuuuggugaugaacagcaacaugaaaguguaagcugaauaaacccuuuccuccccagcuugcuucuuggucaugauguuugugcaagaauagaaacccugacuaagacaccaucugagaguuggugagguagacugggcucaggaaacugcuugucuuucuguaugauuuuauuuucuauagagcaucuucuuccaaaagaaacuauuauuuuuuucuugauauauuuagagcaaagcuuugcuuacagaucucggcauuuuaaccuuggucguuuuucaucaaaagguugcuagugguguguaacgccuacaagcagaaagugacccccaaacggccccauuugaaucccaggaguugaggauguaugcuucuaucuuagagacuuuggcauucuuugacgauacugaaauggaccacagauuacaccuagauuacacauagaaaccugcagaggauugagucuuaccaagucaccuucuucagcauaagcgaggucuaagacauggugcuuauacauuuagaaacacauccuccgagggcuagagagauggcucaguggauaaaagcacuagcugccaaguuggacaacccgaguucaaucccuggaaaccucauaguggaaagagaaccaaguccugcaaguuguccucugacauccacacacaugcuauggcauucaugcagacacgcauguacacacaugugcauagugauaaguaauaaauaucaaauuaaaauauugugugaacaaagcuuugucaaaaaagaaaucuguccuaguauuaaugauacacgcuacuucuccucuguccacuuccugucuacaggacagcuggacacaguggaccugaacaagcucaaugagaucgaaggcucccugaacaaagccaaagacgaaaugaaggccagcgaccuggacaggaaggugucugaccuggagagcgaggcucggaagcaggaggcagccaucauggacuauaaccgggacauagcagagaucauuaaggauauucacaaccuggaggacaucaagaagacccuaccaaccggcugcuucaacaccccguccaucgagaagcccuaguggcgagagggcuguaaggcagugucccugacaggggacccugugaggccucggugccuugacacaaagauuacacuuuucagacccccacuucucugcugcucuccaucacuguccuuuugacccaagaaaagucagaguuuaaagagaagcaaguuaaacaucuuuaaccaggaacaaaggguuuugccuaauaaagucucuccuccacuucugucagcacccuaccggaacuuucccuuguuugccugaagucacggcaucuuccaggggccuacccacaucaugugaaccuuuuaaugccagggcagacccagcccccuccccucucucaacaccagcaggaccuaucucaguacucauguuucuaugaaggaaaucuuuggcuccucaucguagcauugagauggccaguauguccgcucugcaucuucugccuccucuuugaaaggaaauaaacauccugugccaaagguauuggucauuuagaauggugauggccauccaucagacaugcuggcuggcugagcauaggacacagagccaucgugggugacagcguaguuacauguggguccccaggagaacauggcucaaagaugcuuaggguuuccuccuguuuucauugacuaggaagaugaauguuucccaaauccucaggcagcugauaaaaagucuggaugggcagcucgcacgcaccacuacgugagguagcuuuugauauuuuuauaagcaggacuuaaugcagaagaaacagaugugauaacccacucaaguuuuuuuccccaaguaguacuaauucuugaagcuuuguuaguguuagucuuggaacuguugguaagauaucugucaaaacaguuguccucuaaggucuugaccaaugaaagaagagcaaaucuccuuuuccccauauuuucugggaaguggcuguaauugggauguaaccgcucucauuaggauuccaugagugcauuucuuuuucucuuuuucuuggagagagaugugacauuuggcccuuagcuccauucucuucugauguuuccguucuuucuagaacucuucagagcacaucguuguuugccagguccugguggcaaacacccgcucucaguguuucucaaggcugccaaccccaucuaguuccugcacuuuguggcucugcccacuccaagccuuuccucuguguggagagggaagauccaugcguggcauuuccuagugggcuucucaaccucugauccucagcucgguggucuccuuaagaccacacugugacaguucccugccacacauccccuuccuccuaccuaccugccucugagauucauauuuagccuuuaacacuaugcaauuuuguacuuugcguagcgggggaaagaaacuauuaucugacacacuggugcuauuaauuauuugaaauuuauauuuuuugugugaauggauuuuguuuaucaugauuauagaguaaggaauuuauguaaauauccccgguccuccuagaacggcacugucugcucacgucucugcucaguugucccucucacuggcacaggaaccuguaccaugccuggucacgucgugccuaguccccaguguuuugcuccaccucugccuuguguuugcagcaccuucacugucugacgggaagccugcucaccuccacaaccugaccgaagagggcccucuuccccguggcucugaccaucugagcugcagcuccucaagguucucaugccugccccggagcaguagccaagcugacaggguaaagggauuaggaacguuuguuuguggaaccuucccacacgggucaguuuucuaagggagcaugugaugacugaacacuugagggcaucagcaccgugcuacugaugacagaggggaggcucuguucagccugucuccaucucggagauugccacaaaaucucagcuuggcauccuccgaggccuuuugugccacggcagaggcguggccucaccaaguucagugcugauuggcuaguuccucuauuccgagcucaccaccuuaacauuuuggucacaguugcaagaaaauggcugaaacagaccaccaccagcauucuuugggucaacuccacuccagcaggcccgaggcgcuggugggugggguguuuugguuuguuuucuccagcuuuugugguauauuuuuaaacagaauuuuauuuuuuaaaaugaaaguuauuuacaagaugauaccuuauuacacuccuucgacacagccauugcuuuauuguauaguuccaauaaccuguauuuuauguaaugaaauggacagaauggcugcuguagaaugcggggugccgcacagaacagauuguuuuaucccucccccgcccccgcccauggaauuuuccuuugauuccaacuguggcccuuuucaaugugccuucacuuuagcuguuugccuuaaucucuacagccuuccccccucagggagggcaauaaagcgcaacacuuggcauuuuuuuauguuuaaaaagaaaacaguauuuuauuuauaauaaaaucugaauauuuguaacccuuuauaucuuguguggccuaaaugcggugcuagaacaugaaauguuuaaaagguuuaaugaauggaugucuacguauagugccucggacuggcuugagaaccacucagugcuauuuguuauuuguacuggggcuugaauuuagguccuucagcaugcuagguagauacucuaccaacugagcuacaucccuggcucuuuauuaucauuauuauuauuaucauuaucaucaucgucgucgucaucaucauuaucauuuguuguuuuaccuucuucaaauuguggucuucauugucauccagaaguuagcaaacuucucuuuacagaacuagauugugaguauuaacuccgcucuuagcacaaaaguggcucaggagcaaagagaggccaaugaggauccucaguguaucacgcugcuuauaagaaucuagguauggugggucaugucugcacuccuagcacuugaagccagcgugggcuacagagagaccguggcucacugagcagagcacuugcaguauagac

SEQ ID NO: 426 - RNA, 1374 nt, Mus musculus
auugucuaggcgccggcuggccugugggccgugagggcgacaccgguggcgucguccucugcccccccauccccgggggcgagaugucggggcucagccacuuagagucggagggcugccgaaaccuacucggccugcuggacaacgacgagaucauugcccuuugcgacaccaucaccaaccgccuggugcagccuguggaccgccaagaugcuauucaugcaauauuaguguauagccaaaauguagaagaacuucugaggcucaaaaaaguccaccgagaagucauacuuaaguauuuggcaaagcaaggggugguuguaccuccaacugcugaaaaacacaaucuuauucaguaugcaaaagauuacuggggaaaacagucacgaaaacugaaggacacagcagagccaguuacagagacggaggacauccagcucuuggagcagcaggcaaaggaagauaaagcagcugaaaagguugauuuucgucgcuuaggagaagaauucugucacugguucuuugaacuucuuaauucucagaauccuuuucugggcccaccucaaaacgacuggggcccacagcccuucuggcacgacgccaagcuuagguuuuauuauaacaccucagaacaaaacaugguagacuaccaaggagcagaaaucgugagccuucgcuuacugucauuagcuaaagaggaauuucucuuucucagucccaaccuugauucucaaggaccaaaaugugugucuucuccucauggauuaguuaugguuggaguugcagggacuguccaccgaggaaauucuuguuugggcacauuugagcaaauuuuuggacuuauccgaagcucuuuuguggaaaauauuuggaaaaucaaauuuaucaaccugagaaucauuggaggaaguucccuuacuccugaaucaguacugaagccaucuguaacauuuaaacugagugaucuggaggccuuuuauaacguaaucacuuuguguaauagcccugaaguaagaccuaauguaaggcagauaauagauaguggcacuggagaccagguuuuacauaguggagaugaggcauuguugaacaaaagggaaaugaauuugcaaaacccucuaaagcauugagcacuguaccucugcuugaagaagcuacagaaacacaauacugaccaccaacuaucucuaagccacugcagaugugagaauugacauauuuuaguugaaauaccuuuuuggacuacagacuaaugugaauacucgccuauuucuaccugaguuacagcaaauguucugagaacuuauugagguccaccaaauaaaucccacuugagauauuguaaaaaaaauaaaaagaaaaaagaaaaaaaca

SEQ ID NO: 427 - RNA, 822 nt, Mus musculus
ccguaaguuguuuuccauauuugugggggauauuuauuuuauaagauugcugucagccuauauuugcuguuuuuagcaaguaaugaccacaacacauauauacacacaugcauuagucucagaugggggcauggaagaguacauaauuuaagauuacagcuuugcauuaguguagguuauaaaaguugaaauccaagacaaguaaguuugguuguuacaguauucuuuuuaaagacagguuaaagauaagcugaggacacagugggauucuggucuuaagugaccagucucuaaggaaggaagagauaguuucauaauaauaguuucaacauaaugccauauguuacagauacguaacauaucugcacaccacugcaguuggcauuguuuaacaugguggcuggggaacugcacucggguuuucacaugugcaagcauuuuacuggccgagccauuucccagcccaaagcucuuaagggaagucacuaauccauguugaguucauuuuguauguaaugugggguccuaacgucauuuguuaaagagaccuuucugcccugaauugucuugacauuccauugacuguuaacaacaggaacacuuccucuagccuguuguuuguaucccacuaaugaugucuucuuuaucccaauaccacacuguuuggucagugugacuucguaguaaguuuugagauuagaaauguauuuucaguagguuuguuugcuuccuugcuugguucauugguuggugaagauaacuucuugcuuuucugcagaguccuguagaagggcugaagauacggcuuagucaauaaaauac

SEQ ID NO: 428 - RNA, 1262 nt, Mus musculus
uuuaggcucuccgcuuaugaguuuauuauuuuuaccauucaaaagaaaguucuggauuuacggccuccccuucuagccauuuagcucucggaugcugagagagugggcugagggcauagaucaauucacaucuagggguuuuggucauuggggucacacuugaucauaacuuucagccccacucccuuuuuggcuguuucaaaggcuucaacugccuucuccagggggaaucuguggguaacuaagggcuuuacauucaacgucuuugaugcaagcauggaaauugccaucggccacguguugcaguaucgaaacacgccuuugauauccacuucccgaauggcugcgugcaccagggguaaauugaccaucucggcgcccauucccacaaucaccaaggucccaccagagugaguggcauagaugcccgucuggauggaggacucggcuccugugcacucaaugguaaccuccggcuugcuucccagcaggcuuuccaccuuacuggcaauuuccugaggggucucuuugccaaccuggaugguaaagucugcuccaacuuccuuggcuuuggucaaccgagaagcggauaggucagucaccacaacuugagcagcucccauugcuuuggccacaagcaaagugaccaucccaacuggcccagcgccacacacaaggaccuuguuccccagggaaacugaaccucgacggcaggcauagauuccccacagagagagguucaaucagggccccuucuucaaaagugacacugucaggaagcuuguagcagaagucagcauugugcuuguagaagcggcagagguuuccaucauccgggggcguggcacagaagaagauaguuggcgucagguuguaccggccaaucuugcagugcucaucuacuucucggggaacgccaggcucgauggcaacccgaucuccugguuucagauguuucaccaacucuccuacuuuugugacuguuccagcagccucaugcccaagcaccauuggcuuuuucacaacaaaguccccaauucguccaugcucccaguagugaacaucugagccgcaaauccccaccgagugcaucuuuaguaacacaucauuugggccgagcucagguauuggguaguucuccaggcggaugucuccagguccgugcaccaccagggacagguucuugcccuuagcuggagcugccauguugcucucuugcuucgagguguccgcuggacccggcggggagcuggugguucucg

SEQ ID NO: 429 - RNA, 1262 nt, Mus musculus
cgagaaccaccagcuccccgccggguccagcggacaccucgaagcaagagagcaacauggcagcuccagcuaagggcaagaaccugucccugguggugcacggaccuggagacauccgccuggagaacuacccaauaccugagcucggcccaaaugauguguuacuaaagaugcacucgguggggauuugcggcucagauguucacuacugggagcauggacgaauuggggacuuuguugugaaaaagccaauggugcuugggcaugaggcugcuggaacagucacaaaaguaggagaguuggugaaacaucugaaaccaggagaucggguugccaucgagccuggcguuccccgagaaguagaugagcacugcaagauuggccgguacaaccugacgccaacuaucuucuucugugccacgcccccggaugauggaaaccucugccgcuucuacaagcacaaugcugacuucugcuacaagcuuccugacagugucacuuuugaagaaggggcccugauugaaccucucucuguggggaaucuaugccugccgucgagguucaguuucccuggggaacaagguccuuguguguggcgcugggccaguugggauggucacuuugcuuguggccaaagcaaugggagcugcucaaguuguggugacugaccuauccgcuucucgguugaccaaagccaaggaaguuggagcagacuuuaccauccagguuggcaaagagaccccucaggaaauugccaguaagguggaaagccugcugggaagcaagccggagguuaccauugagugcacaggagccgaguccuccauccagacgggcaucuaugccacucacucuggugggaccuuggugauugugggaaugggcgccgagauggucaauuuaccccuggugcacgcagccauucgggaaguggauaucaaaggcguguuucgauacugcaacacguggccgauggcaauuuccaugcuugcaucaaagacguugaauguaaagcccuuaguuacccacagauucccccuggagaaggcaguugaagccuuugaaacagccaaaaagggaguggggcugaaaguuaugaucaagugugaccccaaugaccaaaaccccuagaugugaauugaucuaugcccucagcccacucucucagcauccgagagcuaaauggcuagaaggggaggccguaaauccagaacuuucuuuugaaugguaaaaauaauaaacucauaagcggagagccuaaa

SEQ ID NO: 430 - RNA, 2268 nt, Mus musculus
cuucaaagguuuucuaaaagagacagagaacacuauccaugcagcaggguguaguacagacuggauuucuguuggauauuucucugauagugguaaaggcuuggcccugagacauucccauccaguuugucuuacgacugccugagucuucucucugguguggacucagcuuaggguauagaaguauagugccuauuaccuugguuuacccgcagacucggggguuuagccaacucggcauuaguggaaaggcaguaaacucugaggguuuaaucagaacugaccacuauugucacuaugggauauaaacauuucucccugcaugcuggcccauggacaagaaacauggcuugcuccuagaguaguugugugucauuagguguggaggagcaacaggcuugacuagucaggaugcugacaaauugguauugugucuccuucaucugcaaucuuugaucuuaagcuucuuccugucugucuuuucucccguuucuuucugcauccacagaugggguggcagccuuccgugccuucuugaagacggaguucagcgaggagaaccuggaguucuggcuggccugcgaggaguucaagaagaccaggucaacugcaaagcuagucaccaaggcccacaggaucuuugaggaguuuguggaugugcaggcuccacgggaggugaguuugucaggacagcuaucuccugaggucuuggggguggggcugaaccaugcccugggauuucuuccugauccaaugggccuccuaacucuguugaguuggauccugaugagaaaggcguagcuuuuaaggagugaaagccaagaguuugcgcaaaaggcccuauauuaggagugguuuugcugucugccugacacguguaauccaggauguuguuuuugccccagugauuuugcaagaguagguaccguggagugcaugucuauuuuccuguugaaggcagcauuggggccucugagaugacucacuggguaaaggcaccugcugccaagccugcugaccugaguuugaucucugagacccacauggugcagagagagaacugacuccugaaacuugucuccugacacacacacacacacacacacacacacacacacacacacacacacacacacacacgcacacacacacacacacaccccacuaaacaagugaacaaaccugugauaaauagcuuuuaaggacagcagagguuaacagaauaaguacccucuuuuaaaggauuuuguuugcaguucugccaugaugugggacuguccucaauuuguucaaucacucugagccuuauuuuccccgauauaagagaggauaaugucacucgcuuuuccaggcuacucuaaguguuagagaugaagcaccuccugagcauuugccguugcucauuaaugaauauuuauagucacuuucauugcuggauuagaaugagguauagcuguucugaauuuuaauacagcaugucccuugggaggguuuaauugaacaguuugcucucucuauuuaggcagcuuugacuuggauguaaggccuuuaccaguuggguagaaugcuauuagccccuaauagugacauauagagagauguacauuuaccagggucugucuguauugggcaucuauugaccuugguaguuaaggaagaaugagagagaauauuuagggggaccuucauuaacaacuggcuugagacucacauuagucugguaucaacacucuugauuaggguucguugauuugagaauuuuugccaugguucucuuacccaucccuccuuuuuaagacaagcuuuguaguuucucucucucucucucucccucucucucucucucucucucucuuucucucucucucucucucucuccuucucugucuuuccucucucccucuuuucuuuccccccuccccuccucuccuccuccuccuccuccucuuccucccccuccucuucuccuuuuccaacauggucucuuuugcauaauucugccuuccuggaauucacuauguagaccagacuggccuuggauuuacagagacccagcugccucugcaucuugagugccgggauuaaagugugugccaccaaacccagcuagucucuuguuucuucacuuaccuuacuuacaucacgaaacuaagccuaucuggacuucagccuccacaacauuucaucuagaauccugaggaauaaagcccaggaaagcaguuugagaagcaguaguaaaccuaaagagugagaugcugccguugauug

SEQ ID NO: 431 - RNA, 2268 nt, Mus musculus
caaucaacggcagcaucucacucuuuagguuuacuacugcuucucaaacugcuuuccugggcuuuauuccucaggauucuagaugaaauguuguggaggcugaaguccagauaggcuuaguuucgugauguaaguaagguaagugaagaaacaagagacuagcuggguuugguggcacacacuuuaaucccggcacucaagaugcagaggcagcugggucucuguaaauccaaggccagucuggucuacauagugaauuccaggaaggcagaauuaugcaaaagagaccauguuggaaaaggagaagaggagggggaggaagaggaggaggaggaggaggagaggaggggaggggggaaagaaaagagggagagaggaaagacagagaaggagagagagagagagagagagaaagagagagagagagagagagagagggagagagagagagagagaaacuacaaagcuugucuuaaaaaggagggauggguaagagaaccauggcaaaaauucucaaaucaacgaacccuaaucaagaguguugauaccagacuaaugugagucucaagccaguuguuaaugaaggucccccuaaauauucucucucauucuuccuuaacuaccaaggucaauagaugcccaauacagacagacccugguaaauguacaucucucuauaugucacuauuaggggcuaauagcauucuacccaacugguaaaggccuuacauccaagucaaagcugccuaaauagagagagcaaacuguucaauuaaacccucccaagggacaugcuguauuaaaauucagaacagcuauaccucauucuaauccagcaaugaaagugacuauaaauauucauuaaugagcaacggcaaaugcucaggaggugcuucaucucuaacacuuagaguagccuggaaaagcgagugacauuauccucucuuauaucggggaaaauaaggcucagagugauugaacaaauugaggacagucccacaucauggcagaacugcaaacaaaauccuuuaaaagaggguacuuauucuguuaaccucugcuguccuuaaaagcuauuuaucacagguuuguucacuuguuuaguggggugugugugugugugugugcgugugugugugugugugugugugugugugugugugugugugugugugugugugugucaggagacaaguuucaggagucaguucucucucugcaccaugugggucucagagaucaaacucaggucagcaggcuuggcagcaggugccuuuacccagugagucaucucagaggccccaaugcugccuucaacaggaaaauagacaugcacuccacgguaccuacucuugcaaaaucacuggggcaaaaacaacauccuggauuacacgugucaggcagacagcaaaaccacuccuaauauagggccuuuugcgcaaacucuuggcuuucacuccuuaaaagcuacgccuuucucaucaggauccaacucaacagaguuaggaggcccauuggaucaggaagaaaucccagggcaugguucagccccacccccaagaccucaggagauagcuguccugacaaacucaccucccguggagccugcacauccacaaacuccucaaagauccugugggccuuggugacuagcuuugcaguugaccuggucuucuugaacuccucgcaggccagccagaacuccagguucuccucgcugaacuccgucuucaagaaggcacggaaggcugccaccccaucuguggaugcagaaagaaacgggagaaaagacagacaggaagaagcuuaagaucaaagauugcagaugaaggagacacaauaccaauuugucagcauccugacuagucaagccuguugcuccuccacaccuaaugacacacaacuacucuaggagcaagccauguuucuuguccaugggccagcaugcagggagaaauguuuauaucccauagugacaauaguggucaguucugauuaaacccucagaguuuacugccuuuccacuaaugccgaguuggcuaaacccccgagucugcggguaaaccaagguaauaggcacuauacuucuauacccuaagcugaguccacaccagagagaagacucaggcagucguaagacaaacuggaugggaaugucucagggccaagccuuuaccacuaucagagaaauauccaacagaaauccagucuguacuacacccugcugcauggauaguguucucugucucuuuuagaaaaccuuugaag

SEQ ID NO: 432 - RNA, 5118 nt, Mus musculus
cgcgugccgcucuccagaccucuucugcgcagccugguacuugcuacucgcuuuucccucuucgcccuccgguccgccaccauccucuccacgacgugcuguccugcguccgcaaccaugugccgcacccuagccaccuuccccaacaccugccuggagagguaagaggauuuuuuuuuuuuuuuuagcaguccggacgaccaagucccgaauccacuaacccucagccuugggaacgcggggaaacggggacagccgggcagaacuuguugugcuauaaagaccccaaaguguuaagaccuaucagggcauagcccaagugcugccuuuguggccuagaacuugaagacuccaaugagagaagcgcuuagggccuugggaauggucaagugucccagguuucuugggacugaacucuggguggugguguuaguugggaggcccuccuuccccaacuucucggugcuggcaaacaaacagaauccuuacaccuugaugguuuuucuuucagagccaaagaguucaagacgcggcugggaaucuuucuucauaaaucagagcugagcuccgauacuggggguauuagcaaauucgagugggccaguaagcauaacaaagagagguaaguccuauugucuguccagcccuggggcuuuagaggggagaaggccugaaagggaaaauaggagcagacuagcuaggugcccgaaaccucucucuggagauuugagugagacuuuacugcuguccuguggcugcggagccccauuguggaggugguagaguccagguuugccacccccagcagaugcccgcgugcaggacaugcaucccuguuucucugaggauguuguaacacucgaauacagggcuagggcagggucugcaucugucuagagcacucugccuagaagccaccuuuuauggaacgccaggcgugaugcuaggcuuugggguuguaaguaaauagagagacucucucagccuccugcuucauuggagaggugugcaaaccaaaguugagaaucuugggacuagaauccauuuaguuacagaagaaggcgguguuagggauacugacugaggacuaaaggguuccuggcaacgguugcuggaugcccaggugccccuuacauaaccuguuucaugggagcuugagagguuaguuuugacaaccaauaacuucagccuaggaugcuuuuguuuguugauuaaaaaauauucauuuaaaaaucucugcuccccccaucucccccccccccccacagaagcuucucagaagauguacugggauggagagagucuuucgauuugcugcugaacaguaaaaguaaguaggacccuguugucugucugugaaaggcacgugugugcucaugugcuuggagauugucccagcaaggcugaaaaaacacggggccaaauaauaguaguaguaauaauaaccccaguccuccagugugccagccucuguucggaacacaaagacagagccuuguucaggaaaauuacauucuaaaaauagagccauuaacgccaauugcugucuuuucgucuuuucuucgcagcuguccccuagucugaccugucuccuuucuccccuuaccacagaugggguggcugccuuccaugccuuccuaaagacggaauucagugaggagaaccuggaguucugguuggccugcgaggaguucaagaagauccgaucagccaccaaacuggcguccagggcucaccacaucuuugacgaguacauccgcagcgaagccccuaaagaggucagugucccagugccccagcacucggcuccggccuugacuccuccagacccugucuguuccuuuccaacugaaaaccgaggucaaugagggaagaguuagcuuugcagugcaguagucugcacgguuggagaaggguagggagucaguggcuggacacuaaacuuugcaacacaaaguguuauauauagcacagggacggcaagaauuuuuuugggggggagggguucuucucuccauaccaacauuuguaaauucguuauuaaaaaaacaaaacaaaacaaaaacucagcacaagaaaguagaggaacaaaaggcuuuggauaaccugacucugaucuguguccacccuuugggaacuuuuuuuguuguuuuuuuguuuguuuguuagguuuuuguuuuuuuguuuuuuguuuuuuguuucuuuuugcaaugccucugaaaggcuauucacaguagcaguggcgccaccugguggacacaccugagcaaugcuguguguuuguaucuuguuuucuggcugcuucuguuuauuuuacauuuacucuguaacgauuuaauaaguaucacuuaacaugcaaggaaguuuuauuaucuuagaggauguagcagugaaaaguguagaguucuaguggaacucuauuguaacgggagaagaugucaggaaccaauucaguauaagccagggaugugaacagagcacacagugagaauuagggagccggugaaagaacacacaaggccaagaguuguaaggaucgagagagggaaggacauccugccacagggaacggggacaggugaggucauacacauggcugguggccagaugcagccauucuagcuuuuccuuugaaugacauggacaggaagcuaggguauuuccagacggauugggcucgauuuagcagcugugaggacagacagacagugggagugaggggaggcaggagccgaauuacuacacagguccagcgcagagguggugacuggaaccagcagaggaguagcauucauaaaaggccucauguuagucuugagagaucagaggaccaaccccugggucugaagugggaacuguccuagacccgaaaagcuggugaguggggcugaagagauggcucagugguuaagagcacuugcuguagaggacauaggucaccccacacuauacauccagaacuccuauauuuuaucaccagcauggcagcucacaaccuccuuuaacuccauuucuggggauccuucaggccucuagaggcuccuauguacaugcggugcacacacuuaugcaggcacauauacauacagaucacauauacucauauacacauauauacaugcauauguauauauguauaugaaaggagucacuuuauuuacugucugguacucuuucagugacaucacuugcucaccaaacucccccccccuccgcccugcccugcccggccaccccacuccacaccacucaccuuugugguuugcccugcuucccccacaggugaacauagaucacgagacccgagaacugaccaagacaaaccuacaagcugccacuaccaguugcuucgauguggcucaggggaagacccgcacauugauggagaaggacuccuauccgcgcuuccucaagucaccagcuuaucgcgaccuggcugcccaagccucggccacuuccaccucugcacccagcggcagcccagcugagccuucacacacuugagccuccgcagcaaccuagaagccaucgggaagagagguggagucgcccgucccuaaagcagcugcccugugugggaggcagauccugugcagcaagugcaagaggauaguggaaggacagacggacauccauccccgcagcuugagugcgaagaacccccucuccuccagauacuguggugggccaguguaggagagacuccucauuuccaggaccugugacugagggcugacgacaaggcugcgccgggugcucuggggggaaggguggcccagaacuuauacuuuuuaccagggcacacacaaagggaugcugggugguugggaaccaugagaacaggagccagagagcaguuauuuaagggccagacagucggcuuugguccccgucuugauuuccucacuccuggacugggccuagaaaaggcuguguguguggaaccuucauuuccugccccuugccuucccagggacacccagggcccccgagcugaggcuucuuaauauuccugugcucauucuugccgucucacagaggucaaugagucugucugauucuuggcccagaugagauuucuauaccucaaaaaaccggccugugagccccuuuccgggucaaugaugaauccugcaaaagaagccauucugcucaugggacccuaagcugggugcucuccauggccgucuuguagguggcccccugccuucaccuuugcagcagggucugcuugugaacagggcuaacugagaagucuuacugggcccugcgcuccuuggaagauggggucuaaggagggaggugggaggaaggagacuuccggcacaggggccagcacucauguccagcaggugagcuaagggagagaagucauugaaaaauccaucuaggagcccaaaagacuagcugaagucaaaccaguucucuuuguggguaugaaaauggggaaaagugucuccuaccccucacccugguggaaggggagccuugugcuucuuuccuguugacaugagaugcccacuguaguuaggggagaagcccgucaaggaccaagaaagcucuggaacagaaguuagcucagccaagggaguauugcagaugugcggggagggcugccuggaaggauggggccgggggaaaccaacuugccugccuaucacuucugagucuuaccgaacaaacuuuccaaguugggacuuccagcaccagccaccgagacggagaccuagguuguuucccucugcacuugagguuucuccgggagagaacucuuuuaaguauaauauuguguucuguuguguugugccgauugucucgcugcuauuguuauuuauugugguuuguuugccuguacugaagagccucagcuggagcugcugccugaucacgccuccucccuaccagacucuaccucugcaagccuugggaaucacugagggcugggggggggggggaacgggacacgggacuccccacuguguuaauauuuauuuauuguuaacaaagggagcuggguuccuuuaucagcaguguaugugaucacuguuuuucuguuugagcauguuauauucuuguaaaaaaaccugaaaauaaaacucaaaaauaauaucccaauau

SEQ ID NO: 433 - RNA, 5118 nt, Mus musculus
auauugggauauuauuuuugaguuuuauuuucagguuuuuuuacaagaauauaacaugcucaaacagaaaaacagugaucacauacacugcugauaaaggaacccagcucccuuuguuaacaauaaauaaauauuaacacaguggggagucccgugucccguucccccccccccccagcccucagugauucccaaggcuugcagagguagagucugguagggaggaggcgugaucaggcagcagcuccagcugaggcucuucaguacaggcaaacaaaccacaauaaauaacaauagcagcgagacaaucggcacaacacaacagaacacaauauuauacuuaaaagaguucucucccggagaaaccucaagugcagagggaaacaaccuaggucuccgucucgguggcuggugcuggaagucccaacuuggaaaguuuguucgguaagacucagaagugauaggcaggcaaguugguuucccccggccccauccuuccaggcagcccuccccgcacaucugcaauacucccuuggcugagcuaacuucuguuccagagcuuucuugguccuugacgggcuucuccccuaacuacagugggcaucucaugucaacaggaaagaagcacaaggcuccccuuccaccagggugagggguaggagacacuuuuccccauuuucauacccacaaagagaacugguuugacuucagcuagucuuuugggcuccuagauggauuuuucaaugacuucucucccuuagcucaccugcuggacaugagugcuggccccugugccggaagucuccuuccucccaccucccuccuuagaccccaucuuccaaggagcgcagggcccaguaagacuucucaguuagcccuguucacaagcagacccugcugcaaaggugaaggcagggggccaccuacaagacggccauggagagcacccagcuuagggucccaugagcagaauggcuucuuuugcaggauucaucauugacccggaaaggggcucacaggccgguuuuuugagguauagaaaucucaucugggccaagaaucagacagacucauugaccucugugagacggcaagaaugagcacaggaauauuaagaagccucagcucgggggcccugggugucccugggaaggcaaggggcaggaaaugaagguuccacacacacagccuuuucuaggcccaguccaggagugaggaaaucaagacggggaccaaagccgacugucuggcccuuaaauaacugcucucuggcuccuguucucaugguucccaaccacccagcaucccuuugugugugcccugguaaaaaguauaaguucugggccacccuuccccccagagcacccggcgcagccuugucgucagcccucagucacagguccuggaaaugaggagucucuccuacacuggcccaccacaguaucuggaggagaggggguucuucgcacucaagcugcggggauggauguccgucuguccuuccacuauccucuugcacuugcugcacaggaucugccucccacacagggcagcugcuuuagggacgggcgacuccaccucucuucccgauggcuucuagguugcugcggaggcucaagugugugaaggcucagcugggcugccgcugggugcagagguggaaguggccgaggcuugggcagccaggucgcgauaagcuggugacuugaggaagcgcggauaggaguccuucuccaucaaugugcgggucuuccccugagccacaucgaagcaacugguaguggcagcuuguagguuugucuuggucaguucucgggucucgugaucuauguucaccugugggggaagcagggcaaaccacaaaggugagugguguggagugggguggccgggcagggcagggcggagggggggggaguuuggugagcaagugaugucacugaaagaguaccagacaguaaauaaagugacuccuuucauauacauauauacauaugcauguauauauguguauaugaguauaugugaucuguauguauaugugccugcauaagugugugcaccgcauguacauaggagccucuagaggccugaaggauccccagaaauggaguuaaaggagguugugagcugccaugcuggugauaaaauauaggaguucuggauguauaguguggggugaccuauguccucuacagcaagugcucuuaaccacugagccaucucuucagccccacucaccagcuuuucgggucuaggacaguucccacuucagacccagggguugguccucugaucucucaagacuaacaugaggccuuuuaugaaugcuacuccucugcugguuccagucaccaccucugcgcuggaccuguguaguaauucggcuccugccuccccucacucccacugucugucuguccucacagcugcuaaaucgagcccaauccgucuggaaauacccuagcuuccuguccaugucauucaaaggaaaagcuagaauggcugcaucuggccaccagccauguguaugaccucaccuguccccguucccuguggcaggauguccuucccucucucgauccuuacaacucuuggccuuguguguucuuucaccggcucccuaauucucacugugugcucuguucacaucccuggcuuauacugaauugguuccugacaucuucucccguuacaauagaguuccacuagaacucuacacuuuucacugcuacauccucuaagauaauaaaacuuccuugcauguuaagugauacuuauuaaaucguuacagaguaaauguaaaauaaacagaagcagccagaaaacaagauacaaacacacagcauugcucagguguguccaccagguggcgccacugcuacugugaauagccuuucagaggcauugcaaaaagaaacaaaaaacaaaaaacaaaaaaacaaaaaccuaacaaacaaacaaaaaaacaacaaaaaaaguucccaaaggguggacacagaucagagucagguuauccaaagccuuuuguuccucuacuuucuugugcugaguuuuuguuuuguuuuguuuuuuuaauaacgaauuuacaaauguugguauggagagaagaaccccucccccccaaaaaaauucuugccgucccugugcuauauauaacacuuuguguugcaaaguuuaguguccagccacugacucccuacccuucuccaaccgugcagacuacugcacugcaaagcuaacucuucccucauugaccucgguuuucaguuggaaaggaacagacagggucuggaggagucaaggccggagccgagugcuggggcacugggacacugaccucuuuaggggcuucgcugcggauguacucgucaaagauguggugagcccuggacgccaguuugguggcugaucggaucuucuugaacuccucgcaggccaaccagaacuccagguucuccucacugaauuccgucuuuaggaaggcauggaaggcagccaccccaucugugguaaggggagaaaggagacaggucagacuaggggacagcugcgaagaaaagacgaaaagacagcaauuggcguuaauggcucuauuuuuagaauguaauuuuccugaacaaggcucugucuuuguguuccgaacagaggcuggcacacuggaggacugggguuauuauuacuacuacuauuauuuggccccguguuuuuucagccuugcugggacaaucuccaagcacaugagcacacacgugccuuucacagacagacaacaggguccuacuuacuuuuacuguucagcagcaaaucgaaagacucucuccaucccaguacaucuucugagaagcuucugugggggggggggggagauggggggagcagagauuuuuaaaugaauauuuuuuaaucaacaaacaaaagcauccuaggcugaaguuauugguugucaaaacuaaccucucaagcucccaugaaacagguuauguaaggggcaccugggcauccagcaaccguugccaggaacccuuuaguccucagucaguaucccuaacaccgccuucuucuguaacuaaauggauucuagucccaagauucucaacuuugguuugcacaccucuccaaugaagcaggaggcugagagagucucucuauuuacuuacaaccccaaagccuagcaucacgccuggcguuccauaaaagguggcuucuaggcagagugcucuagacagaugcagacccugcccuagcccuguauucgaguguuacaacauccucagagaaacagggaugcauguccugcacgcgggcaucugcuggggguggcaaaccuggacucuaccaccuccacaauggggcuccgcagccacaggacagcaguaaagucucacucaaaucuccagagagagguuucgggcaccuagcuagucugcuccuauuuucccuuucaggccuucuccccucuaaagccccagggcuggacagacaauaggacuuaccucucuuuguuaugcuuacuggcccacucgaauuugcuaauacccccaguaucggagcucagcucugauuuaugaagaaagauucccagccgcgucuugaacucuuuggcucugaaagaaaaaccaucaagguguaaggauucuguuuguuugccagcaccgagaaguuggggaaggagggccucccaacuaacaccaccacccagaguucagucccaagaaaccugggacacuugaccauucccaaggcccuaagcgcuucucucauuggagucuucaaguucuaggccacaaaggcagcacuugggcuaugcccugauaggucuuaacacuuuggggucuuuauagcacaacaaguucugcccggcuguccccguuuccccgcguucccaaggcugaggguuaguggauucgggacuuggucguccggacugcuaaaaaaaaaaaaaaaauccucuuaccucuccaggcagguguuggggaagguggcuagggugcggcacaugguugcggacgcaggacagcacgucguggagaggaugguggcggaccggagggcgaagagggaaaagcgaguagcaaguaccaggcugcgcagaagaggucuggagagcggcacgcg

SEQ ID NO: 434 - RNA, 5967 nt, Mus musculus
ccauuucuggggauccuucaggccucuagaggcuccuauguacaugcggugcacacacuuaugcaggcacauauacauacagaucacauauacucauauacacauauauacaugcauauguauauauguauaugaaaggagucacuuuauuuacugucugguacucuuucagugacaucacuugcucaccaaacucccccccccuccgcccugcccugcccggccaccccacuccacaccacucaccuuugugguuugcccugcuucccccacaggugaacauagaucacgagacccgagaacugaccaagacaaaccuacaagcugccacuaccaguugcuucgauguggcucaggggaagacccgcacauugauggagaaggacuccuauccgcgcuuccucaagucaccagcuuaucgcgaccuggcugcccaagccucggccacuuccaccucugcacccagcggcagcccagcugagccuucacacacuugagccuccgcagcaaccuagaagccaucgggaagagagguggagucgcccgucccuaaagcagcugcccugugugggaggcagauccugugcagcaagugcaagaggauaguggaaggacagacggacauccauccccgcagcuugagugcgaagaacccccucuccuccagauacuguggugggccaguguaggagagacuccucauuuccaggaccugugacugagggcugacgacaaggcugcgccgggugcucuggggggaaggguggcccagaacuuauacuuuuuaccagggcacacacaaagggaugcugggugguugggaaccaugagaacaggagccagagagcaguuauuuaagggccagacagucggcuuugguccccgucuugauuuccucacuccuggacugggccuagaaaaggcuguguguguggaaccuucauuuccugccccuugccuucccagggacacccagggcccccgagcugaggcuucuuaauauuccugugcucauucuugccgucucacagaggucaaugagucugucugauucuuggcccagaugagauuucuauaccucaaaaaaccggccugugagccccuuuccgggucaaugaugaauccugcaaaagaagccauucugcucaugggacccuaagcugggugcucuccauggccgucuuguagguggcccccugccuucaccuuugcagcagggucugcuugugaacagggcuaacugagaagucuuacugggcccugcgcuccuuggaagauggggucuaaggagggaggugggaggaaggagacuuccggcacaggggccagcacucauguccagcaggugagcuaagggagagaagucauugaaaaauccaucuaggagcccaaaagacuagcugaagucaaaccaguucucuuuguggguaugaaaauggggaaaagugucuccuaccccucacccugguggaaggggagccuugugcuucuuuccuguugacaugagaugcccacuguaguuaggggagaagcccgucaaggaccaagaaagcucuggaacagaaguuagcucagccaagggaguauugcagaugugcggggagggcugccuggaaggauggggccgggggaaaccaacuugccugccuaucacuucugagucuuaccgaacaaacuuuccaaguugggacuuccagcaccagccaccgagacggagaccuagguuguuucccucugcacuugagguuucuccgggagagaacucuuuuaaguauaauauuguguucuguuguguugugccgauugucucgcugcuauuguuauuuauugugguuuguuugccuguacugaagagccucagcuggagcugcugccugaucacgccuccucccuaccagacucuaccucugcaagccuugggaaucacugagggcugggggggggggggaacgggacacgggacuccccacuguguuaauauuuauuuauuguuaacaaagggagcuggguuccuuuaucagcaguguaugugaucacuguuuuucuguuugagcauguuauauucuuguaaaaaaaccugaaaauaaaacucaaaaauaauaucccaauauuucccaggacaguauggaugauaugaggguccaggggaguauggagggccugugguaucacagcucuggugauucugugggauggggauacaggacgggguggguggcugaaggcacgaaaggguugagcuggguuugaaaggcuuuugcaggguaguccacaaggagccgggcuucuccucugccuggugccuucugggucacaucaguccugaaauccugcucuuugagauuucacugccugaaaagagccuggcccaggcacauaguagugaaugccugcaagcccuagcuuuuaggaguuugagaauggccuuagauuacauacugagaucuugauucaaaagaaaaaaaaauuuagccaggcggugguggcacacaccuuuaaucccagcacucgggaggcagaggcagguggauuucugaguuugaggccagccuggucuacagagugaguuccaggacagccagggauacacagagaaacccugucucaaaaaaccaaccaaccaaccaaacaaacaaaaacaacaacaaaaaaagaaauuaugugguguuauagauaucugcuuauacacagaucugacaugcuguuggguuucaguucucccccaaguccucugugugaucagaguucaaguacuugguuguagagaccccuuagaauugcacccuacaccuagauccaggguucucaggugauagcaggagggguucagacacugagggcuuaagcaaaaauaugggaacaaacaggcaggcucuaaccucauaccauccagacaacagcucgaccggauccuaaacgggggagagcauguguggugcagcuggugcagcuggugcagcuggugccggaggccaucugagcuguuacacuguggggcguuugucuaugugagauggguagagaggcccaugaccggggacgggagggagacaggagugcccagguacaaugaaacacuguggugugugugucugcuccacacgcacacaucccacgcuaagcaugugaaaggcggaagacaauuuucuggaguuguucucggcuucuaccuuuuggguuuuggggguugauuucagguggucagccuuggcagcaagcaccuuuaccugcugagccaucuugcuagccacaaggccccgaaucccuauuuuccacggcuggagauguuugcacacauaaaaacauggcgauuccuuaaugcgacaaaaggucaucaccuccuuuugccagacuaaagacuccugcguuaugcauguucuuguccccaguuuucuguauauuuuuaucugcuguuuggagcauuccagaacccuggaugauaacauguaagaugugggcaucaguuaagccaguaugucacggagaacgcaacagccaaagaaaccuaggccggggcagugcuuucgagggccgaggaaggccagacgaucccuugcgcucugcugcccuccuguggcuauaacuauguauugucuuagguuugucugacuucuauagacuauuuaucuauguuuaauuaugugugcagguguguggcuuugugcccaugaacgcaggcgccugaagcugggaugaaagguggacaugagucgcucaauguggguucugggaaccgaacucggguccucuagaauagauguauucuuaacagcggaaccgcccucuccagccugaauuucuuucaguuucaaaagcuuugcuuuuccccguggaauucuaugucauggcuagaauuuguuguuuauuaauucauuuuuggugaacauucaaaauuaugaaauuggaauuauuaacacaauuccuaacacagucagugucuauaggaguuauggcaagauuuccuuaguucuuuuagggcuaaaauuuaucuuccaaucuggaaggucuuaguuaaagagacuguucagggauccagggucuaugagguguaaauucaaggcagauagaaugcuugaaauugguccaggagaagaaagagaaggccgaaguuagguauccgauccuaaguuaaguaguugaugcuaagggugagagaugcaaggggcuuaggugcuauauuacaggguagaguuaccuucaggggacaaaggcaggcaggcaaagcuugcagccuuuccccucacaucuuggcaguaccuggaagaugcugcacacucaaggggaggggcuucacccuucaguuacgccugcaggaaauacucucagagacccacccagagccuuucucuuugcuaauauccuaugcaaucaggugaccgcugagacuaacuggcacagucacagauucaggcacugacuuagacuuugaguaaagcaagaaucuguggaucuuuaaaaaaauuuuuuuuucuuuuuacaucaagcacccauuuaagggagaauuuucauuuuagccauucacaggacagcucacagaaagcauggagcaauauuuagagccacacgacugacuuuaaucuggugucugcagguugcuaaucaguauguuucucaauuucucaggcucucacuuuguauuauaaaaugugacuauaaauaguauuggcuucagagagguuuugugaugacagaaaaugugugaaaaguguguguuagacggcuuggugacaugcucaaaaacagcaaacacuugucugcggcagauacugcucuaaauacucggcauauguuaauuccuguaauuccuguaagaauccuauaacauuaaagacauagaagccagagcguuuaugugaaucacuccaauaaauguaaagagauaccagucagcuggagcugcauagcagccagcccagaccacucacacauugcagauaggagaaggucaaccuucuacugguacaacguuacagcacuggcuucuacccaaguucccagaaggguuugguaagcuaagugcgagucuggaugugagccggaagucugauguucuuuuuggucaaaggaaggaucgaggauaccacagugggaagugguucaggaggaagagggaaaaugcccuuacauuugcguuggccguuuguuuccucuccguguauccaguccagguuucccacucacuccugugccugcugucuacccuugguaaauuauuccuucaaaguuuaaaucccacccagaagagaucuuugguucaagaugguccaagggaagucaugguuccugucuuagacucuccugucauacagaucuguccuccuccaugcagaucugucccagcauuugucccuccccaaagcagacagcugguaccaggugccccuccccccaugcucacgugaugugacagcuaaagaauuacuguguuuucuucacaagggggacuuauacuuccugcccuggccuugauccagaguugaguuuucugguggaaucugauggaugccuuccucuguuaauuacugggucucucauccuuuauguguuuauaguuuaggauuuuauuauaggcacauuuuguauuauaaguggccucaaaucauuuuuagaauugggcuuuggaaaucauaaaaaauaaauaaaaaguaacaaaccagcgcgccagccuuaccucuuacaaaucgguuagaucuucaacgacuccggggucugcucuggguuguuuaaagcucuucucuagggagaagguuccaggaugcgggaaaugaaacuuagcuuuucaaaacgacccauucggacuagcugguucuuguaagcggaaccuauucuccaacauaucaacuguggcucaacucuaaauaugagggaacacacauacgggugagcaagacggcccuggcagcuccgcucagcggcgguaugaauuacuucccccagacacaaacaaccccauggaaaucggcaaca

SEQ ID NO: 435 - RNA, 5967 nt, Mus musculus
uguugccgauuuccaugggguuguuugugucugggggaaguaauucauaccgccgcugagcggagcugccagggccgucuugcucacccguauguguguucccucauauuuagaguugagccacaguugauauguuggagaauagguuccgcuuacaagaaccagcuaguccgaaugggucguuuugaaaagcuaaguuucauuucccgcauccuggaaccuucucccuagagaagagcuuuaaacaacccagagcagaccccggagucguugaagaucuaaccgauuuguaagagguaaggcuggcgcgcugguuuguuacuuuuuauuuauuuuuuaugauuuccaaagcccaauucuaaaaaugauuugaggccacuuauaauacaaaaugugccuauaauaaaauccuaaacuauaaacacauaaaggaugagagacccaguaauuaacagaggaaggcauccaucagauuccaccagaaaacucaacucuggaucaaggccagggcaggaaguauaagucccccuugugaagaaaacacaguaauucuuuagcugucacaucacgugagcauggggggaggggcaccugguaccagcugucugcuuuggggagggacaaaugcugggacagaucugcauggaggaggacagaucuguaugacaggagagucuaagacaggaaccaugacuucccuuggaccaucuugaaccaaagaucucuucugggugggauuuaaacuuugaaggaauaauuuaccaaggguagacagcaggcacaggagugagugggaaaccuggacuggauacacggagaggaaacaaacggccaacgcaaauguaagggcauuuucccucuuccuccugaaccacuucccacugugguauccucgauccuuccuuugaccaaaaagaacaucagacuuccggcucacauccagacucgcacuuagcuuaccaaacccuucugggaacuuggguagaagccagugcuguaacguuguaccaguagaagguugaccuucuccuaucugcaaugugugaguggucugggcuggcugcuaugcagcuccagcugacugguaucucuuuacauuuauuggagugauucacauaaacgcucuggcuucuaugucuuuaauguuauaggauucuuacaggaauuacaggaauuaacauaugccgaguauuuagagcaguaucugccgcagacaaguguuugcuguuuuugagcaugucaccaagccgucuaacacacacuuuucacacauuuucugucaucacaaaaccucucugaagccaauacuauuuauagucacauuuuauaauacaaagugagagccugagaaauugagaaacauacugauuagcaaccugcagacaccagauuaaagucagucguguggcucuaaauauugcuccaugcuuucugugagcuguccugugaauggcuaaaaugaaaauucucccuuaaaugggugcuugauguaaaaagaaaaaaaaauuuuuuuaaagauccacagauucuugcuuuacucaaagucuaagucagugccugaaucugugacugugccaguuagucucagcggucaccugauugcauaggauauuagcaaagagaaaggcucugggugggucucugagaguauuuccugcaggcguaacugaagggugaagccccuccccuugagugugcagcaucuuccagguacugccaagaugugaggggaaaggcugcaagcuuugccugccugccuuuguccccugaagguaacucuacccuguaauauagcaccuaagccccuugcaucucucacccuuagcaucaacuacuuaacuuaggaucggauaccuaacuucggccuucucuuucuucuccuggaccaauuucaagcauucuaucugccuugaauuuacaccucauagacccuggaucccugaacagucucuuuaacuaagaccuuccagauuggaagauaaauuuuagcccuaaaagaacuaaggaaaucuugccauaacuccuauagacacugacuguguuaggaauuguguuaauaauuccaauuucauaauuuugaauguucaccaaaaaugaauuaauaaacaacaaauucuagccaugacauagaauuccacggggaaaagcaaagcuuuugaaacugaaagaaauucaggcuggagagggcgguuccgcuguuaagaauacaucuauucuagaggacccgaguucgguucccagaacccacauugagcgacucauguccaccuuucaucccagcuucaggcgccugcguucaugggcacaaagccacacaccugcacacauaauuaaacauagauaaauagucuauagaagucagacaaaccuaagacaauacauaguuauagccacaggagggcagcagagcgcaagggaucgucuggccuuccucggcccucgaaagcacugccccggccuagguuucuuuggcuguugcguucuccgugacauacuggcuuaacugaugcccacaucuuacauguuaucauccaggguucuggaaugcuccaaacagcagauaaaaauauacagaaaacuggggacaagaacaugcauaacgcaggagucuuuagucuggcaaaaggaggugaugaccuuuugucgcauuaaggaaucgccauguuuuuaugugugcaaacaucuccagccguggaaaauagggauucggggccuuguggcuagcaagauggcucagcagguaaaggugcuugcugccaaggcugaccaccugaaaucaacccccaaaacccaaaagguagaagccgagaacaacuccagaaaauugucuuccgccuuucacaugcuuagcgugggaugugugcguguggagcagacacacacaccacaguguuucauuguaccugggcacuccugucucccucccguccccggucaugggccucucuacccaucucacauagacaaacgccccacaguguaacagcucagauggccuccggcaccagcugcaccagcugcaccagcugcaccacacaugcucucccccguuuaggauccggucgagcuguugucuggaugguaugagguuagagccugccuguuuguucccauauuuuugcuuaagcccucagugucugaaccccuccugcuaucaccugagaacccuggaucuagguguagggugcaauucuaaggggucucuacaaccaaguacuugaacucugaucacacagaggacuugggggagaacugaaacccaacagcaugucagaucuguguauaagcagauaucuauaacaccacauaauuucuuuuuuuguuguuguuuuuguuuguuugguugguugguugguuuuuugagacaggguuucucuguguaucccuggcuguccuggaacucacucuguagaccaggcuggccucaaacucagaaauccaccugccucugccucccgagugcugggauuaaaggugugugccaccaccgccuggcuaaauuuuuuuuucuuuugaaucaagaucucaguauguaaucuaaggccauucucaaacuccuaaaagcuagggcuugcaggcauucacuacuaugugccugggccaggcucuuuucaggcagugaaaucucaaagagcaggauuucaggacugaugugacccagaaggcaccaggcagaggagaagcccggcuccuuguggacuacccugcaaaagccuuucaaacccagcucaacccuuucgugccuucagccacccaccccguccuguauccccaucccacagaaucaccagagcugugauaccacaggcccuccauacuccccuggacccucauaucauccauacuguccugggaaauauugggauauuauuuuugaguuuuauuuucagguuuuuuuacaagaauauaacaugcucaaacagaaaaacagugaucacauacacugcugauaaaggaacccagcucccuuuguuaacaauaaauaaauauuaacacaguggggagucccgugucccguucccccccccccccagcccucagugauucccaaggcuugcagagguagagucugguagggaggaggcgugaucaggcagcagcuccagcugaggcucuucaguacaggcaaacaaaccacaauaaauaacaauagcagcgagacaaucggcacaacacaacagaacacaauauuauacuuaaaagaguucucucccggagaaaccucaagugcagagggaaacaaccuaggucuccgucucgguggcuggugcuggaagucccaacuuggaaaguuuguucgguaagacucagaagugauaggcaggcaaguugguuucccccggccccauccuuccaggcagcccuccccgcacaucugcaauacucccuuggcugagcuaacuucuguuccagagcuuucuugguccuugacgggcuucuccccuaacuacagugggcaucucaugucaacaggaaagaagcacaaggcuccccuuccaccagggugagggguaggagacacuuuuccccauuuucauacccacaaagagaacugguuugacuucagcuagucuuuugggcuccuagauggauuuuucaaugacuucucucccuuagcucaccugcuggacaugagugcuggccccugugccggaagucuccuuccucccaccucccuccuuagaccccaucuuccaaggagcgcagggcccaguaagacuucucaguuagcccuguucacaagcagacccugcugcaaaggugaaggcagggggccaccuacaagacggccauggagagcacccagcuuagggucccaugagcagaauggcuucuuuugcaggauucaucauugacccggaaaggggcucacaggccgguuuuuugagguauagaaaucucaucugggccaagaaucagacagacucauugaccucugugagacggcaagaaugagcacaggaauauuaagaagccucagcucgggggcccugggugucccugggaaggcaaggggcaggaaaugaagguuccacacacacagccuuuucuaggcccaguccaggagugaggaaaucaagacggggaccaaagccgacugucuggcccuuaaauaacugcucucuggcuccuguucucaugguucccaaccacccagcaucccuuugugugugcccugguaaaaaguauaaguucugggccacccuuccccccagagcacccggcgcagccuugucgucagcccucagucacagguccuggaaaugaggagucucuccuacacuggcccaccacaguaucuggaggagaggggguucuucgcacucaagcugcggggauggauguccgucuguccuuccacuauccucuugcacuugcugcacaggaucugccucccacacagggcagcugcuuuagggacgggcgacuccaccucucuucccgauggcuucuagguugcugcggaggcucaagugugugaaggcucagcugggcugccgcugggugcagagguggaaguggccgaggcuugggcagccaggucgcgauaagcuggugacuugaggaagcgcggauaggaguccuucuccaucaaugugcgggucuuccccugagccacaucgaagcaacugguaguggcagcuuguagguuugucuuggucaguucucgggucucgugaucuauguucaccugugggggaagcagggcaaaccacaaaggugagugguguggagugggguggccgggcagggcagggcggagggggggggaguuuggugagcaagugaugucacugaaagaguaccagacaguaaauaaagugacuccuuucauauacauauauacauaugcauguauauauguguauaugaguauaugugaucuguauguauaugugccugcauaagugugugcaccgcauguacauaggagccucuagaggccugaaggauccccagaaaugg

SEQ ID NO: 436 - RNA, 2532 nt, Mus musculus
uuuacacacaagcaaggaagcccaugauuuauuuauauuguuagaguucacagagcagucagacauuacauuuacaagggaaagaaaaggggggccccggaaguaaaccuuauugagcauaagcuauauaauaaaugugcuuuuaaacuaguuauuuaguuggcguagaaaauaaagcuuacaguauaaaguuucauauagaaaugucauuguaccuugcuuauagcccucacuaugcccccaucucuucuccuaccucucucuugcuccuucuuccacccaaauuguucuccuagcagguaauaucguaugacucugagacaugcaaaagaaauuagguaacaauaggggcuggugagauggcucaguggguaagagcacccgacugcucuuccuaagguccagaguucaaaucccagcaaccacaugguggcucacaaccaucuguaaugagaucugaugcccucuucuggugucugaagacagcuacaguguacuuaauuauaaucaauaaauaaauuauuaaaaaaaaagaaauuagguaacaauaaacuacacuauguuauuaacuuguaagggguuacauuuuaggugaugaaacaaaaccuucccaagagaaagacaaggaaggaugugucugccgcaugugacacggacguaggagaggcgcuacggggacccagaucaagggaguaugagaacuuggaggaagaguccauugugaucauaacaguauaggagaaauugaugcuaguuauagaauaguauacuauucuauguaggacacuauagaauagcugugguaaaaauguggcugacaacagguuugguuuuugggaaaagacucacaugcaagguauagugaauuguauagauagugaaauauauaucaccacuaagcacuucgcuuuagucugauuagaggucaggaauaagaaguauguagggguucaugaaauuugguucaugccaacuuaaaaugagaucugaaaguauuaaucacuuauuuguucuugaagcaaugcuaauccacccacauuaaauuauacacgugugggauucuuguaauuccauccaaauggaguagugaauuguacuauaugucaugcugucucugcagagcagcuccacuuuaguuggucaacccaccacugucacauuccuuggcuaacucagagccccaucagugcuggaaucccugcggaccucugccccucuuuucagagguucccugccauuaucuucccaugguggguaguucuuguagcccacucuucucaauacuacuccuuguccucgcucucucuuucugacucgcauaaacuaggcuaugucacuuuuccaggucauccuuuuaugcccucaacaguuauagggucaaugacaggcauaaugguugggacugucauccuccagggucguuacuuucagcaaggaacaaaggguauauuacaagugcccaagggagcccacaggaggaagauggaguaguguauguacccagguuucuaggcccugucacagggagagaucuuugaaaggagaggagccugguuaucuuuguccugcugcucugccuccugcagcagcuuguagaagguuccugaagagcucuccugauacagcgcuuccuuggaccccaucagccucaagcugggacuguaacaacggugccaaaaggaagagacaccauagauucccaacaugcauaaggcguugaucaucacaugccagcagaagaagguggugacaaacaugaugucacugaugucaccauccucccacaggaagccagagacuggucuaaagagaaugaaggcugccugaaucagccacgagcccaucaucaggaacaggaaggucucuaucauccugaggugaaacauuucaggagcccagagcucugccgucaacaccagcaucagcaggaacaccaccaagaugaggagagagugaaccugcagcuccaccccagaugauucuuuaacgugagacaccagcagcagcaggagcacauagaagcucagcacaguggcaccucuuucuaggagcacgcaccucugccguagcacguucuugcuuaugacgucugcacaaccaucgagggcgaggaggaugaacauggugaggugcugccacuccuugggguacauaaaccuuggaggcaucccuuuguuaaucaacaccaucccaucaucaagacagaagaccacauaaaaugcuaagagggagccagucacuaucuucagccagccuccauaagauauuuucagcuuggcacaucucuuuuuauucuuaggagaguagguaacauacccagaugagucacugacuaucacggccuuggagaucaguguugccugauacaguccauaaaagaaaauguauaagcccggguagaaauggccgccaaacuuuccauuccccaugaauauagaucuauuuuauagaucuauuuguauaaaaagcaaagaacaaaaugcaagauuucucagcccuccucucaugggcccaucaaguuuugguugcgug

SEQ ID NO: 437 - RNA, 10870 nt, Mus musculus
uguaccacgcuguauuaaauauccugauaagccaggacugucaguguucgauaaaccaagcccuggcaccggaagugaaacagagguucccauuugccaggaaauucuagcagccuagucacccagagcugagggcagccgugaaaguggccaggcccaacgcaagaccuuaaaguaucugugucuuauuuugugucacuugauagcaugauccuugagucugaacuguuagacaacacugcuuucaaaauguaagaccuaacaugaaacugggaauugccuacucuggagcaagaacuuucaaguuaaaggccggacacuaggaccccgucucaaaauaucucgucaacgugacuucaucuuaaaagcauaaguacagauaagcacauuuuguccguaaacaagaaccaccccccuucccuuucuuuugauagagaaagaaggaaugaaauagcacuuaauuuuugagguuuuuuuuuuuuuuuugggaaccacaaagaaacaagucagaggaaaucuuauaaauguuagguugauuuauaagcgcugccuggcaguuacagucuguuuacagugaguuaucuaaccgaacauacuauacauggcaauuagaagucaucauggcaagagagaaaccacaguuggcccgcugccgacacaaacaaccagaaaacugaagggcaacaggcugggauggagguggggguguguuuacuauaaaagaaaaaaaaaaagacuauuggcuuuuucagaaggaaaguaacagucugcuggcagaggugacacuaggagacaaguguuuuaacucuaggccuguccuuaauuccccuaagagccaaguggagggagacauugaaacaaacaggcaauucuguaaaguuagaaacccuacaaaucugauuaaaaucuaaacuuguuuugcuuuuaaaaaacuuaauauaucaaaaggcccgcuuuagugacaugcuaaucccaccaaaaaaauaaccccaguaaacccccacccacccacccaucaguaacaguguucaaguugaccagccaacucauacuucuaacucguguguggaguaaguauacgcauccccuaaaccuaagccuggggacaggugguggcaagcaguggcaucccacuggcuaccuguccaacaucugcuccugcagagugggcagggaaacccuaagcaguaaugaagcugagaccccaagauaaccaacuuucccgguacugcauccucaccccuaccucaagggagccucacuucuaagccaagccccucaucacucaaacuuggcacccagugaauaggaugguucucucaauuagaaagacauacauccacacauccauauauauauaacuuuuuuguuuuuaacauuuaaauauaaaaauacuacucugcuuuguguuaugaacggaggaccaagaaaugccaacuuuuuucuuccuucacaguagggccauccaucaggugacgcggugagcuguguucacacagagggggacggaugcccccucccccaagccaaggaagcacagcgcaagaaaccaaccuucaacuccucaccuaacuuccauuuggaacagaaagcugguuuccccuuuagaaauaacagcucucuaccaacaguggaaaugucaaucucagccguugggccugcccuuucaacuauccugaagaaaaaaaaaauguccucuuucaccauaaguacacccgcuuugugacagcuaugccuaccggacaugcauacccgaugagaugaagcaguggguuacccuuccccuccccccucccgcucccuacuagaaagcuagauaggaaagaaaggguugguguguagagauuaagaaccugaccccucuauucugaccaacaaaagcaagauuaacugggcacgaggaauaaaaagaccuugguauuccauccuuuugaguuacaguggggacaacugggaaagggaagagcugggagagggaucacuggaagucuaguccacuuaguucuuguauuggaaggguucgucgccuguuucguugaggagacacgugcggacgauggcuucugucaccgcauaggggucacaauuggcagaaggccgacggucuucaaaguagcccuucuucuccuggccgacaguccggggaaugcggauacuggcaccgcgguuggcaacaccggcagaaaagucguugauguuggagguuucguggaauccagucagacgccgggcguuguccaggccccccuugggaucguaggcgcgaaugugguacuggugccucuugcucaguuugucaauggccuccucaaugcaccuaguggaaacagugaagaugaggguccaucgacaaggaugggagcgggcaugaaucccagaagaaagaaggcacugucucccucaggccagucuuuaacaugcagugcaaauuauccacuggauggaaagacccccaaucacucgccucuucccaccaguaagaauuaaguuucccauuugcuuguauuuuuacuuaguucgaaugcuuuucugucaauucuauuccuaaaguauuuacccuaucgccucuccaacaggcacaaacugacaggcuuagaacaaauaugcagagcuaggcauguacguacagccuugugaguacccaaagcccuucuaccccaugagaauacagacggcuccaaaggaagguacuuacuucagaccauucuccucccgcauggccuuggugcugaaguugguauggcagccugcaccauuccaguucccuggaaugggcuuggggucaaagguugcuaucaccccaaagucuucgcacacccgaugcaagauaaaacgggcuauccaaagaugaucucccauucggauccccucacaggguccuaucuggaauucccacuagagagaaaaaguugaccuuuaagauccacccucugugauugccccacuuugugauccaccccugcuagcccgaaguccccaugugccuaccuacccaggucuucagagaggaggaaaaagaugggcaccauuuaccugggcaggcauaaccuccgcauuuguccccguaaucuugacuccagcauacaagcaggcccgguagugagccuccacgaugucccugccguaggccuugucugcucccacaccgcaguaauacgggccugaaggagguucaagacacagcagggaagagucagucagggaauccaggaaaccccaaagcccaaaacuaggagggccuaaaccugcuuuccugagucacuaguccugccuucagcugcaggcgggagaauuuaggucauuccuucuuugccucggccucgguagaggcccugcuugcuuuuuuugaguggcuuuucauuaguuuuguguguacuugcauauuuacaguauggucagaggcuaacuugagggagucauuucuugccuucuaccaaaugggucccaggaggagauucagguugucaggccugguggguaaccacugagccaucucaccacucucugucacuuuaaauucuaaccaccucuggaugugagggaugcaaggucggucuacuguuaagauucugcugcuggucuccauuuucucauuucaggauugcaccuaucucuggggaaggggauuuccuggacaguaacaacuuaggggaggaaguuucacccuuuacccagugggacguaccuugggguccagggaagccauuggaaggccaaccaaauggguggccgucuguucccauaagaguauauuccugcuccauuccaaaccaggggugcugguugcucaccauguccauuauccguuuacagaugugccucaaguuggucucuagaaauaaagaaucaacaugccaucaggacuagagcccucucacacagcuccagugcuggucacaggagagacugacccaggccuaaccaccauguuuuaucaccaaggaaaauggaagaagugauaauuguccauuugcaggaaauggcuaauagacuuuuuuauaauuaaagucagccacgcagcaucaugggaauggaauccgagcaaguggucacccuaucugcaugcuggccaccaucccaacaccacacgccaggcacucauucucagauucacaggacaacugcuucuaguugucagauguauucccuagugucucagacacugaaggccagaucuguuauugagaauaauuuguccauuagguucacaugccaggugaguuuaagugcuaaguuuuacaguuaugacugguacaaaaguagauagguagacagacauacagacauauaauuauauaugaguauagcugaaaacaauucccaagcuagaaaaaaaauaaccaucugagucuaagguauuaacaaccuucauuuuggcagggcaugguggcgcacaccuuugaucccagcacuugggaggcagaggcaggcagauuucugaguucaaggccagccuggucuacagagugaguuccaggacagccagggcuacacagagaaacucugucuuggaaaaaaaaaaacaaaaaaaaacaaaccaaaaaaaccuucauuuucacaaauaagaaaaugaaaccccaagagaggguguuagguggcacacccaggugacaggacaggcacagagcacaccuuuuaccaauaaugcuacugccuuuugaaacagaagcacugaaggcccagggccaccaagccuuacuggcauugcuagaagauauuucacagaagugagacuuccccagguucaaagcuaucugaaaacggagauggauagcacagugcaaacuaaacuccacgcaugugcaggcaggguaaaugcacaucccgaagucucgaugcucauacuugugaguauucagacucaacaagcugucuggcauaaaauaguaaccgauaguuaacgugcaguacucccaagugauuguggcacacggucauucaugugaucuuccaaugacuucgggaugggcucuuaucagagaagacuacugagacggcucaguggguaaagguguugccacucgagccuggcaaccugaguuccaccuccagagcucacauaaacaggcaggagacaaccaacuccaacgcugcccguugacguccacgcacccagcaaggcaugcucuccgacgcaugcucuccacauacagcacacacaauucagaagaaaaaaaagcagguagaacagugguagaucuaguauuuaaauucaaaaacuacagaacuuuuaaacacaggcuuuuagaucagcagguagagguugcccgucagcaaacagacagaagagccaacacuauacaaacaauaaaaggaaccauggaagaaaggauugagcacacuguucccaacaggaaaguucaggguagaauagccacccugccaucccuacguucuuagagagcggcuucucaauucauugagaaugucaccucccuagaguuucaggauuuacagccagccacacccaucccauacuugccugcagguuuccgguuauacuugaaaacuucacauagcaccagcuuguuggggucuuugcggaaggggucucgaaacauggcaacaggauggagguacaugucgcuguuggagccuucagacugaaagguacuagagccaucaaaguuccacucagguaacucugggcaagacaaagauagaaaauuaaauuaacuuuaaacguguuauuugagccugcaggaagaagccagacgaggaggguuggaucucccggaauugagaguuacagaugguugugagccacuauguggguguuguuaacugaacccagaucggugagagcaacaagagcucucaaucacaugaaagcccacaacugucuguaacuucaguuccugcgguccucacucuuugauuucugcuggcacugagcacauggagcgcgcgugcgcgcgcgcacauacacacccauauacauacaguuuuaaaaguuuuuagugcacacgcuaagaagacggucagccucuuacucauccuuucguugcucaccaccacuuugucuuuaugaggagugaggugcaugugacugcaucuacaucagggauaaccugacgucaccuaucgcugucaccuaucccaguuucuccugaccugagaguccccagagcacugcaucccaagagccaccugagcagaaaaccaguccucucugugcaagucuccuguguacucugguaucacuuccagugugucagacacacacaggacaaaacccaaaacaaacaaaaaaaccccaccuccuccucuaggccaucaucaucucccuucucccauuccccacagguccaacuguuguacuucaaguuaugcuuguauauaaacaguugcuuccccaccgcuugcuuggucuuuucccuacugucuuaguggucggguuugacucuccaguuaccucugaguucucagaaagcagagacugaagaaccuacccacacucugccaaguaccaaguauacaauccaugcucuguuaucuggucacucguucacucaaacagaaacauccuuggaagaguaacccauccuaagccagguagauggugagggggccaccccucuccugagcagcuauggcuuacuuggucuaugcugagaaacacaggcuacaacuaaaauaaacuuagaaguauauacaauuauaaaguagcggcaaaaaccauuuuaugguuggugguugccacaacacuagccuuauuaaaugguggaagcauuaggaaggguugagaccgacuguucuauaaacuagauagcauauuccaguuacaccaguccucucaaacuagguuccugggguuggccagguuagcacacagcagccucccaucccccacaaacgugacccaguauuuuucuucaauguaccagcacacgccagaguccaucuaaagaaaggcuuccauuguugcugcgccuccagacuaugcagcagcuuacuuacgggugacugacuaaggucugaaaagccuugcaaaccaaacagaaggaagguggauccgaggcugugcguacacucccaggcgugcgcacacuccgccccggcacucaccuuccacacacuugggcucacaguccaggguacgggucuugcagcgcaguccuucuccgguaccaucaacccagauauacauggcuuggacuuucucacccuggggcagggacauguacauuugcuugaugccuuuguucaagugggaacuugcugagguggccaugguggaagguguucuggagagagacagaaaucgcauuuuauuaauaucgaauucaaagggauccacuguaggggacggcaagggaaucaggcuggcgugcguggugaucucgcuccucugggacuggacacacacaaaggugcauuauucacucugcuuucaagggguuuaaaguuuuauauuagacaaggaccaugcccccucagggggacuaguuaagggauuuuaauaaccguuaaacuugagaaauguuagcaggagagaacaaauaucaagacguucauuaacagaauaucuuauucuaccaacagaacuaccuuauugccacagaaagacuugacuaauugacuguugagucuugcuuugucuuccacucuuuggaacagccuuuuuuuuuuuuuuuggagacaggguuucucugaauggcccugguuguccuggagcucacuuuguagaccaggcuggccuugaacucagaaauccaccugccucugccucccaagugcugggauuaaauaaaggcaugugccaccaccgcucagcucuuggaacaaccuuaagggacacacaacccauuguaaucccuacauaccuacauuuagacuaucuacuuauuugagacaaagucucauuguggagcccuggaacuuaugccgaccaggcuagccucagaaucaaauuagaucugccccucucagcauccugaacgcuagaauuaaagguguaugccaccaccaucuuuagauuacacaaugaaauacuagggcuagcuguaagacuuuaaaggcuaacauauuccugggagaaagaaaggaccuguauuaucugccaccacuaaggugguaaaaaguaaagccauacuccaaggagcacacugcugacugguuuuuugguuuuuuuuuuuuuuuuuugagacagagaaaucucaacaagcccucucucuguccuaguaauuacuuacucauuauuuacaccaagcuuuccucaaaaucagaggaucuaccagucucugccuccugagagcugggauuaaagguaugcccccuccacaccaggccucaacugcugacuucauuacuguggugaaaagccuuacuccagagacagauuucaaugugaaaauuaacaguauuugacgaucccaccggauaauauuuucugguacguagaaaaaucccacuucuaaguuuacaagccacaggagucggggcaagaucuucgaugaaugugaggcuacaaaaaaccagccucaaaacacaagaggaaaugccccccucccucccuaaucuccccggauagcuggagagggaacauauuguucuccuccaaugacuugggcaacuuucugaaguacaguggcaaaguuucuaugggcaaccguccauguuugcccaagugaaaacaacugccucucccuccaaaagccucacccuucccccggggaacagaugagccucugcugucaaguccgaugcagaaccaaagccucugccuacaccacuuagaggcccggauuguaauucuagauggcuucaauuuacaccacucaucagcuuuccuccucugccgugccccccgccccccacacacacacauccagcauuaaugaacuguuaggggaaccugaguuccuccucuggcccugguucccugagaccagcugggugccagcagccuaguguacauagauagcaccaacuggugucccuguagugcaaaguggaauggguucuuaaaauucugaguaguuucugcggguugccagaugcacccgggguccuucgcccugacuuuuacucaccccagccaaugagaaucaaaugcacugggguuguacucucuagaccuccucuuuuuagagcaguguucaugccucuccucguucucgauuucucgcuggucuaagcaacggagcuuuuugggcgagggcgauggagugggggacccagaccguucggagggggaggugcuggaauaagacgggugcgauuuaaucuuaacccucgacuucuccccggaguucacagaguaggcaacgaagccuaaaguauuagaaggggacucugaggaccgagaaucuccaucuucuacgucuucaaugguugguuucuuugaguauuugcggcugggggaggauccccgcuucccgcccccggaggaguuggggcaauccacuuugaaagcagccuucccacuaaaauguccggaaagucggugccgcgacccucgggcccgcguagaucucaaggccucucccagggggccauaccccggcgaggguagaggccggguggcgagaguggggcgaccgcgggaggcacagcgcgccgcugcugccuccgcuuggcgcggccucuccacugcggagcccgccggccacuccggggcuccggcucuccauuguucggucauaugguaaaggccuaggacacggcguugggagcuggggaguggugccaucaacgcuuaggaccaccauccucaaccagaccacccacagcgugacgacgccccccaaaugcgccgccaggaagagaggaucaaggcgccugcgcccaccuaaggcaagaacccucucccgcugggaccaccggaaagcccccaucucagcgugaaccccagccaacggcgccugccucccggggcggcgccuccggccgcaaguauagaacagaucaaaacaacccgcaaccccgcccuucccggagcuuggcucacagcgcguccuaggaacaccaagcagagccggcccgggccgcacgcugcaaacacgcgggaggcacgagcgcugcaucccgcuccguacagcagcugacuggagcugggaaguagagugcgaccccacagcccgggcggccguacauuccuggacccuccgugcgcuuaccagagcgguggccggccggaugauggaugggugaacaggucaggagagcgaggcggagaggagaugggugagcgugcuguucagacacucugcucuacucccauucuccgcucugcagggucgcuggcugcucgguacuuuuuauugacagcuugugcccgcccccagucgccuugauuggcugaccuaggccaggaaacccgcgcccaucagcugcugcgcgccggggcccugaggccauuggccgaggaacugugcgggagccucaggguggggcgagcgagacccagaagaaagaaagagaaaggggagugggggaggggaggcagcggcggcuggaggagggccagggccgaaggugcaggaugcauuugcagcuugcguucuuaagcgaccucuggacccucggacccaggcugaggcuuccucagagucauuuggccucggcucuuugcuuccuuaacgguacagagguuuucgaggagaucugucacugaaaauccagaaccccagaagagaauuuuacccuuuguuuguugagcgagccuggggacggguugggcuggggagaggcagggagcccugaucaggcgcggggagagagagagagaaacacgauucccagaaccuggaggacccuaucuuccugguuuccugaguggauuugggggaaguggucagacugugauuucacgguuuaaacacaagugugauguuucuauaaagaggauucuggacguccauagucu

SEQ ID NO: 438 - RNA, 2261 nt, Mus musculus
aguaacugcuagauccuuggacuuccauucacagcugcgacugaacaauuguugggaauugggcugccgacugugagucaucaauaaauccccuuacuaucuagagacuauccauaaguucugugacucuagagaacccugacuaagacacccauaguucugggaaagucucuaaauguacuaacuuugauuuuuggcuucuguaguucugcuucuggauaacuguucucauuaacugaagugugucagccuggaacguggcuuuggugcuuagaaacucacccugagaaagauucaggcuacacugggauccugaacacucaagaauagcggccagauggcuaauuaaggcuuucuacuggcuuaagcccauguccaagcaguuuucuuuggugaguaccccaccacagugaguguugugaaugaauugaacucagguccucuggaagagcaagagaaguucucaacagcugagccaucucuccagccccauaagaucuaccucagcagccucagggagauggcagucugggaagccacuggcagcucacuuucuucuucuggucacaaacuucugugggagauuccauucgaaguaccugccucuucucauauuccaugauaugagaaagcugucaacguucuaagucugucuuccuucugcauugcaagacauuucucuuucccaaguuacccuccaagaguucuuuuccccagaacugacuggccucaugagagaagugacuugguucugagggcuauccugggccuuguaauauaguagcaugcaucucugguguucacuuaauagaugcccgccacacuccugccuuccauuuuggucuacagauguugcuacagggcuccugggagguagucugcacugucacugcuguaaacucagcaaaaggagggaaaguagaaguccuuguggucuucuauucaauauccaaguggguggggguggcugaccaccauaugcugauguucuggcuucuggcuuccucugcagcaucaauauaugaccaagaugcucucauugguccgaguaaacaagguuugggaauccaugguaaggcacuuggauaaugaaugucucuaauuugguugauauauuuuagcaaaggguuaucucaaacacugcuugucuuuccccucuggugagucacugauuucugaauacugugagucacugccuugcucccacuaaaugucaaagcaaacuucauaaaguugaaacacuuuuauaugcgauggaauaguaucccuucucucucccuuuacuuuucuucccucaccuucucuuccuuuucuugagacuuuguaaaaugggaaucucauauaucccaggauggcuucgaaccuacuaagcauaagaagaugaccuugaacuuuugacccuccugccuccaccuccgaaaugcuguguuuaggaaucuaccaccaggccugguagauucucuucucuccuggugaacgaauccagggcuuugugcuugacuggcaauuuuucuaccaaccaaguuauauccucagcccgcaucuaggucuugacugauuaauuucugaauugaaaguuuguuuguuuguuuuucucagugaccuuacaaauguguuucaauuuuaaaauuggccacuagccccagagaagaaaguaaaagagggauauagagucucuuuacuuuguccugcuuuuuaaauuaaaacuuccuuuuuaaacauuuuauaucuauuuauguauguaugugugcauaacuauuggaacucaucucucuccacuauguagaucucaggucgucaggcuugguggcagguacucuuaccugcccugcccuccuuucugagaaacuugcuugcagaaggaagagaacagaauuuccccagcucagaaguuaaccaugcuguuggaugcuuaagaauccugccaaggacaguuugcuugccuauucuucuauaagggcucugcagcuguugagcuaaacugggcuuucuggucccuucugcucugacagcauuuuaaaacucaguguaaagagggaagaagaaaugacucaguggcuaagagcaugaaccauucuuacagaguaacagauaccccuacuucuguucccagcccucacacuggucaauuuacaacugucuguaacuccacuaggaggggugcggggggggggggaucggaugcugcuuuccccucaggcagcuucacuggugugcacauacauaucucuaagaauaaaguaacucuuuuuuaaaaacua

SEQ ID NO: 439 - RNA, 4713 nt, Mus musculus
cguuacauacaguuucucauuauuuaugaaacuuaaccauaaaugaaugcuacuccugugaagggaggcaggaggaacuaaggcucacuggcacugcggagggucaaccccacacaccucuuucaggaaacaacuaguugauuuuuuuccccucauuuguuuuaacuuuaaaccaaaguuuuauugcuaaauuuuaaguugcugcucuagagucccaagcaucacugucaugaccaggcaggcaucccccuugcaucccagugguggaaauccagagaaaaggcucugacuguuguuucucuaggaacaggugcaggauacagucacccaaauaccagucacaaaaaugacgguuugccacgugcuucugcauguagaauuguaaucuuuaccaguggaaagacaggccuguuucaggccccucacacuuuauuagacauuuccccuucuggucucaccuucuucagccagaauuugaucaaauuaaaagucuuuuguggggacuguauuucugagcaucuagaacaaauccuuuauauucaucgacacaaaagaucuugguggcuauuuuuaaacccagcuguauuaaaaggugauguugaauuuuacgacaccccuaccauggccugcuuuuaaauucggggcuucuaaaccugguuguacuuuuuaaauuauauuucuuagaaaauucaggauauaaauaccuacuuuauucucuaucucacccccuuucuucauaaauucucuagagaagccuaaaaacauacagcgcuugacugucuugaaaaugguugguuucauaucugguacucaucagcuugucacugggaaucuagaucguugguaguagugacugcccagcauucuugagacccuugauuuucucuccagcaugggucaggguagagaaacagccauuauucaguaaaauuaauauaaauaccaggaaaagguaaauaaauggccccacccuucagaucuagauaaaagucccacguaggagggccaugaacgugugcccuugucagaugaacuuuagacuaagaaaccggugacuagggaaacagcaguaacacuuacauuguuuuaaaacuuggcuacugccccuuagcucgugcuugucauuagcuccuccugcauaucaaacccuuacucacuaaaguuacagcacugcuaaaauccuacugauuaacucaccagcuuccguuuacaaaguuucuuccauuuuuauucugacaaaguuccauuuuuuuccuccuuucucgauugagauuuuuaacaacaccuugcccccaucccccaccccaaaaaagcucacucaauguuguagguucuguugcuuuuuguguuuugccaagcaugucccuugccccaaaacuaaagagcaaauguuuauuuaaaguaaaaacaaaacuauaaauaaauuguauacuuuauaauaaucagugguaacaauuuagagacccuggcagauuaaagguugcauuauuuuuauuuagauuuuuuucccuuacuauuuuguacuuuaaagcuggggauagauuucacugguuucugagguaacagcaguaacgauuaggaauauauagaaaaguucagugaccagucauuucuuguacaaauaaaaucagugguacuguguauccagagcccugugaauugucagcuucuuucucugguagugagcugaguggcggcacacacuccucacaguugacuccugauguuccagcucucugaugucuuuaugucagguaacacagagccaguuuggucuuucucccccugccaggaucccaggcccuaaucaguauuauuucuuucauaaacaguaagugauggaguauauuccuuuucugauaucuguccuguugaccacucagacguaaguuuacaagcugugcggcuuacauggcagacgcuccaacguguauucagaugcucuggcugcaucccuucccagcucuaaagagauuucuccaucaaaagacuuuaggaaacgacauaugcauuaauuauuuuccuuugaaaaaggcaaugugcauuuuucuuuccucaguuucaucugccccaggcacugugagcaguguccugcuaaugugcucuuggauaauccuguacccugaaacucucgauggaacacaccaaugucaugucacauaaaccagagguaacacuuaucugauugcagccuuagaacucuuaauuuuaguuuuauuugaaaaggaccccauuuuuaauagcgcuugaaauacccccaaaagaaaugaaaaagagacuaaaguccacuuuucacuuuauacucaugcagaaagcaguguaguuggaagagauagccguuuguuguuggcaaauuagccuauaccgcagcugccucgacagugggguguugacaugcccucccacaccgaggcaguggcgggaucagcgaugaagucagccccauaguuggguguaauggccacgugcaggcuuucugucuccagcccccuguauuacacuccuuaaacagacuguuuagauucaggggacacagugagugccaguggcucagcaagaacccaggugaccucuuagaggaggcccucccuccugggagccaugacuccccaugugcuagaugagcucucaugggcggugucuuuccaccaugcuucccuguugucugagcaggugaaccuaaggcaaggcaagagcagagcugagggaggcacacugacagggagucagaguguaguugauggagaggacuggguggggcuguggcagcaggagcagggcacugguaaauccugugacucgggcugugacuuccugucacuugcuuuauuuacggauaguucuuuacucccaaauucaauuuuccaagcaguaacugcagagauuucuuauucuaagaaaagggguuuagaaauaacacuaucugugacauuauauuaaaaccaugggauucucuagugauuauacuauugcguaaauguuuuagguuguuguuuuuuacauaaaaauaaaauuugccucccucucaauaggaacuuuuuacuguaaacaauauguuucgguaucuagaauuaagguaacugcuuagacuaaacguugauuguguggaauccugagcuacagaagccacacuuuucucuauucuaaugagcugugucauuacugaccaagggaaaauagaaauucagguugaauuuugaaaauggugaucuguuuucuauuuuuuuuuuuugguggucauucacuuaaacaugaauuuuugcauuucaggcaucagucacaauaccugauguuaaagcucccagccugccuauuucaaguuuauacaaugccagaacacauggucgugugggauagaguugauuauauuguaguuugugguauucaguguuaggagccagcccucuagccagcgucaaccacacucuacucaaugaauauuuuuuaaaaagcaaaaacauuucaugagcccugcaagagcugcaguuagagaguacagagucugccugacagagaagaggcacugacgggcguggccccugugccuuucuuacaugaacuuucaaaacugauaacgaguugccugcccccuagaaacaaccuucagaauauauuuucuuaucguggaugaggaagugagggggacaagaugaguuuccccugaaguggggaaaaccauaucaauuuacaacugaauauguuuucuuauagcaaaccuucgguuuauuuuauuaaaccaaugccagcuucaauuuuuuuauacggugccauccaccuacggaggacaaucaagugaccuacuguuugccuuggauucagugucuauugauugaaucucaucuuguguaccuuugaacuuaauucccacuugacuccuguccaucugaaccaccacaaggcagagggcagcggcggcgcugcuggacagauguggaugugugagaaagggcggggucccgccucacugucucuccaacacucucuaaaguucuugccugcacuucuccuguugucccuggcaacacuaguaugcuguagacagggagaaggacugcuugugaccuuaguguuuauuuucaacuguuaagauaaaauuguaaaccacuccuauuucaguugcaaaaacaaaaacaaaaaacaaaacccuugaggcuuucuuacauugugaagauuccuuauguuggguuucuagguuagcacggaagcuuguaucaaugaagaggauuuaggagggaaauaggguaaaacuuguuacuuuucuuucaaacccucucccucugcuguauacacacacacacacacacacacacacacacacacacacacacacaccccguguugguuaggugaugcuguccggugacucccugaacuauaguugucaagaguaacuaugauugugauuaguccucugugggugacccuugccccaugugcacccuugcuuucuuuccuacucuccacucugguaaauggaaaaggugacaucaaagaaucaaugcuugcuuggacucacgucguaucugugacuaugcuauuagcugucuccuuuucccuucuuauauggguagaauucuuaugacauguggaguuuccuucuggauaaguagguuaaaugcacaaugugguacuguucuauagauucuagaugguguaaaaagcaaaaaaaaaaaaguuaaugugcuuauguguuuuuaaaagaaaauaagugau

SEQ ID NO: 440 - RNA, 133214 nt, Mus musculus
ccuccuucccuuuccccugggggcccuauccgggugaguuccggaguuugugacuccgaagucccccccaaaaccacgagcgacguccccugucugucaccgaggcccguaucuccaucccgcaccgcggccgccgcaacccacgcuagcggagcaggcggggccccguauccaccggcgcgugcccgggugcgcguccgacccgccgagcucgcgccccgcuucaccucccagcucccgucccagccgcacgcgccgcgccgccggcuuccccucaucuuccagccgagcggccuccagaccccgcaccguuggagcgacccgggcgaagcccgaggggaaaccgggggaggacggggcgguccugugcgcccggguaggcggaguggcagaaucaccugagaccgccagacagcucacugcguucccacucccgcucgagcuccgcacccggaccgguggaucaggcccgggaacccgcgccacaccggggaggaccggccacagcgagcuagugaacauggccacaccguuccuacccucgggggccaccacaggcgacagcgguggggaacugagcuccggggacgacucuggugauauggaauccuuccagacccccgaggccgaggggacccggaguuuggccgagcuguuugagaaggcugccgcacacguccaaggccugguucagguagccagccgggagcagcuccuguaccuguaugccagguucaagcagguaaaagauggguggaugagaggacgugggcuguuuccuccaaaaacuuaguagcagauugcguggcuaauggucgagcguaaugaaguuuguauguguguguuuguuguuuuuguuuuuuacccuggagaauagcaucauucuggacauggaauaaucucucugauauccaacgaauauuuauguagccgggcacugaaugacaauguuucaguggccuugccucugaaccuuuacaaaaugaggaugauaaaauaaaauuuggcauucgcuguugccagaaggacaugugauaggaaacaugguaauguuaauaauaaguuugaaauuuaagagaacauuacuguguauaagaugcuaacaauauuacuauuaugauucuuaggaacucuaaauauaguuguuauguuuuuggcugaauuugguccugcuagauauagucccuccacauuuuuaaaauuaagggcuccaugcagguaacauggaggucuggugaugaacuaacucuccacucagcuuccugaaucacuuucauuuccaaauagaaaacccaggggaguaggcaguuuagaaaguuacauggauauaucagaauuaaaguguaguuuuugucucuaaaacugaauuuuacccgauaaaguaaggacagguuugaguuauaaacauaagacuaauuuaucuuucaagguuagguaccagaaggaaagacuauugccuuccuucaguggacagauacaguucagcagaacacuggguguucugucuauagagaaugcaaagaugaaagaacaucaugacacugccuuuaagaagcuuacaggauuaguuaaggaaucuagaugcaaaugugaaaagaaaaucgaugauuaggaaaauaggaaaaccccagcucuuuggaacuuugaaagaaaugacguucuggauaguagucucuuuuauuuuauuagaauaaaaaaaugcuuaugguauaguuacauauauuucuccugaacucuuuuuuuuuuaagguagucaugagaacccuccuguauuucuaauuauguuuuuauugaguuugugugugucaguguaggucagaggacaacuugcaggaguuggcucucuccuuuaaccauguggguccuagggauucagcuaagguugucaggcuugguagcaagcacgguuggcuacacacugaacuguccuguagucuugaacuugagauucuggguagaggacgucuucuuacaggacugaugguuauuaugagcacaugcuaguaaugauguggacugagagauaucccugugcaaggauuuugugugaugccagguaugcuggcacauacccuucaccccagcggcuuggggaagcaaaggcagguuaucuccaugagaucaagacagcaagcugcaggcuagauggagcaacaugguaagacucugucucgaaacaaacaaaaaguuguguaaugggaagaacagguaagcacuucugcuacauaccugauuacauugguuauuuuaaggaaauugaggaaaaucagauagaauugaauuacaaaguccuuggacuucuuuguuuuuuuaauguuuauucauuuuauguauaugagugguuuaucuguuuguacaccuacaugcaugccagaagacugcauuagaucccaggauagauuccaggauugugagccaccaugugcuuuugcugggaauugaacucaagaccucuggaagagcagacagugcucuuaaccauugagccaucucuccaguccccucagacuucauuuuuauuuaacaaaaacucugugaacucuguuuagauuuggguguuuggcagaugguuucuugaagaugaaguaaaccuggaagacagauguaaauguucauugccaguggcaauguuugaguugucaaaggaaaaguagagguuuggaaaucgcagggucugccaccacgagcuugauaacugcccaaugcucacagagauaaguguugaggauaaugaaugugaaauuucccuaaucucuaauacaauauguuaacauuuggaaaugcugaaugacucugagguauuaucuguauauuucauaagauaauguuaaaaguuacugugagcaaaagucccauucaaaguggaaaucagauaagugguuuuucacuacaacuguguaaaaagauccauagugcauucagauuccuccucauaacuggucuuggagaaacuaucauuuauugaguuugggugucguaucaaagaauuccacaauuacuggaaguacuauaaaaguaauaauuucuaacacauaugugcaauugaaauuuccucauccgaaccaacauauagagauaggccacugaagaaugacaguacaaccaugccagaaaguaaggagauuuuaaaaaauagacaauaaggagauuuuguuuuccauuuuucuguuuuguuuuuguaguuguuuuucauaaaauuuuguuacuuaaauuaucauauacuagauuuauuuucaaauaaacuaauauuuuaaagauguaauuuauuuaccuuucuugugcauguguguucacauaugugcgugcauguguguagaggugggagguugauacagagacucuuccuggauugcucucugccauagucauugagacaggucucucacgguacucagaguugcuauuguagcuugucuggguagccagcuagucuggcaucucuaaaaucacaucaacuucugaacucugcugcagauauaacaggagacagacuguacacgcuguagcccaugaggcuaugcaacaucugccuaccuucuaggacuggcugcauaugaagauuacaauaaaauaccuugguuaaaaacauaggaggugggaacgcuggagagguagcccagcagcugagagcacuuuccucaggaucccugucuucugcaguuagaagcgaguugcccuguuuaccuggcauuuaauuugguucugggcaucugaaccuuagacuaggccuuacacuugcaggacaaaugcuuugagcaauaacccgaccccaguccaaguucucauuucuaaucuguauauaugacagauaaaauccauaaaaguucuguggagacuguaauucuaagaauucaaaggaaucacauugaccacagaguuugagaacuccuauuucaaauucuuguuccguggccagagaggcucaugaacacaauacacguguucuagcccaggcagagcaauagaggauggacuccuuuuguuuuuucauuauuuaaucucauuuagugugugugagugugugugagugugugugugugauaaguguauaagccacaaucuguggaggucagaagacaacuuucagguuaguugucucccuccaccauggguuccagaguuggaauucagguugucagaccugcauggcaagugcuuuuacccaccuaaccgucucacuuguugcccucaucccucaccucguaaaaaacuuuguguaugagugggugugccugauguccgcugaggcuggaagagguuaucagaucugcuggaacuggaguuacagauagguggaagcugccaugcggguccugggaacugaacccagaucuucugcaagaguggcaggcacucucuaccucugggcuagcucuccagcacucauuuauuauaaucuuuauauaaauccgguggucgaagcuagggagagguugcauggccucauguacuauagaguguauagucugucucccuuuguauuuguagcagaguccagcaguuuaugugauuuagagaugccgggauugaagucuagauucucuguaacauauaagacagaugauacagugaaggagucagacagacccugauaaauccugauagcuaauccaggauuugauuaugugugacuugagaacaugcucuuggauuucuguauccuuaguuguaggauggguuuguaaagaccucagggggaguggugauuauccacuuacaacagggcugcuccuguagaagugugcuuuuuaggaagugccagaggaccguguaauucauagcuaaggaaauggcugggugauacuuuguaagauuuauuuuuauuuauguggguguguguggguacacuuggagagcaaaaaagggugucacauccccuggagcuguugauggucagagagaguguugagcugcguggugugggugcugagaacugagcucagguucuucagcagagcagcaagugcucuuaacugcugagccggcuccccagccucaugagugaguaugcuaaauguuaaucauggagauuauuucuggcagugguaaucaagagcugaauucuguuccuguaugaauuugaguuuuacaaaguuauagugaaaacaaucuaugauuuagcuacaaaugucauuugaaccauaaaagucagcuagagugauauacaccuguaaccccagccuugagaaguaucggcauggggcuuaugaguuaaagauagccugagcuacacgagacccucccuuaaaacaauagcaaacguguugaccacauggauagcauuuauaauauuguugagccucugagcguuuuuuuuuuuuuccuuuccagcuuuuggcaucuaaauuuaucuacuauaguacacuuuuuuauuuuauuuuauuuuauuuuauuuuauauauguacauguauacauacacucacggcugugugugugugugugugugugugugugugugugugaagacagugucucacuguguggcuuugagcuuuuuuucucccagcuuuugacaucuaaauuuauuuaguguaaugcuuucauuauuuauucacuuuaaaaaaaaaagacagaauuucacuguguagcccuggccguccugaaacucacucuguagaccagacuggccuggaacucagagauccaccugccuucaucuccugaguguguaugcugaaaggcaugcaccaccaugcccagcuccuuugguacauuuuuaguacaguguguccuggauuggaggagagauaaaauucucguaggaucauggaaaaacagcauuagaaaacccccaauauaugaauucugaaaagcugaacuuuacauuuugucaguuaccuguuaaagaaucuguuauggggugggugaacugauugagcgugcaaagcacaugcuaugcaagccugauucaucccagaacccacauaaagguggaaagaaagagaagcuacuccacagaguggcccucugaccuucccuaugugcacacaccauaagaaguuaaaacuuauaaaguuguauuuuaauggcagugaacacuauacuuuuauuuguaauuugucugcuaguuuagaaauggaguuauuugccacccauuuuuuuuuccuguguauucaguaguuauguagaaagcugaggcugcucgugugguauuuuuauuuuauuaauuaguuaaucuagacaaggucucacuguguaacugcccagccuggaagacauuguuuagauauggaggguccuggacucauagcuuugacugugcagagcuccacgugccucuguuacagcaccaccacaccuggugcugcuccucacgccccuguugcagguguugcugcuguuuucaccuuggauuauuugauaguuuugucggcuuuuugcaaagaaugucaaauuuuguuauccuacuuauagcuucaaauguuuucugauguauaguuacuaaauauguauaauaaacuugaaaagacaaaaguucucagguguuccuuagaaucauaaaauaaauucuugauauuuuuccccuuuucuuuuucaggucaaaguuggaaauugcaauacuccuaaaccaaauuucuuugauuuugaaggaaagcaaaaaugguaagaacaauucuuggaaucuuuaauaagguugucagaaaugacuuagugguuuaggaauuagaaagggguuagcagauuaaggaauuauuuuuauauuaaucccucugcuguuggcugcuaaugacagggaguugggagcgggauuaaaguaucugcuuuuagaaggcuuuaaaggaucuuuggcacugaagucaguacacaggugcucacagcagagggcgcucucccgagagagcccuuuguuacuauugcucaagguuguuuccuuguguagccucuggggacugcugcuucccacauacagaagcaugguugcaagaaagccagagaaaaggagaagaacaagaugaauccccaacucaagacuuuccuaugccucugccuuugcagugggaaaauauaaaaaauccaaaacuagacccagguucgcucuauucugaacacauuuuucacuugcaauucagauucuugcauguuaucuuuucuuaccugggccaaguaaaaagggagaaaugguuaagcaguagugaacauagcuagagaaagggagauuuuugagcaucagcccuggugguuaaacaaacaaacaaacacaacaaaaacuguuguggguggaguuauuuacugcacugaaaucauuauguuaaggauucauuccuacauuacaauaauugugauaauucugauacccagauuuaagcaugugaacauacauuagaguucuccaucguaauuuguuauacuacaaugucuaccauaguccuuaggagucuuaagucccgugguuuaaggaggccuguaacaucccuuaggaacaccucccugaaguaugcuaaauacuucuuggguuagaggucuccggauagaguucuguuugucauguuuguuuuuagauuuauuuauggauauggaugucuugccuguacaaauauauaccacaagugugcuuggugcccauggagagcagaggaggggucuggauccccuagaacugaagugacagaugguugucagcugccauguaggugcugggaaccaaaucuuguuccucugcacaaagcaccaagugcuuuuagucacugaaccauccaguccucugucgaguuucuaaaaacaagagagagacagaaggcuaaugcauggguuugaccacguagucuaucacugccugcagaguaugcuccucugggcucgaguucagugccagcacucagcugugaggaaggcugaagcccaaaccuggacgugagauguacucuuuaguucagguggcauucuggggugguuguuguuguuguuguuuuauuuuguuuuguuuuuuugagccaggguuucucuguguagcccuggcuguccuggaguucaccuuauagaccaggcuacccuuaaacucagagaucugccugcuucugccucccgagugcagggacuaaagguaugcacuaccuuucugcucagcaucauucugguuuuuuauuaugugggauaaccucagggcuuugauuuaaauuuuuguuucaaauuuucucuugaugauaagcaguuuuuggaauuuuauuauucuggagauuuucagauguagccuuuauucugagcugcuuuguuugugaaauuguguugccuuacuguuuucucuaaugcagcccuuggcuuuccugguuguuuuguuuuguuuuguuuuaguauuauugaaaaguuuacauauuuuucucugccccccccaaguuucuauuuuauaggcacucuuauuaauaaagcagaaaacugucagauacugucauuaccaaaucaucaguauauuaguuaugggacagacugacaucaaguguccccagaaugauccuuuguaaaggacaugccacuuacauauugcucuuacugaaauauuucaucuaauuuuaaucaugauuaaucauuuugacaagaaugcuauuuaggugagaaaacaauuagacaaauccaaacugaguuguauuucauaaaauaauuguuuuugacuccuagaaaugucaacgucaucuagagaaagagaaggauaaaugacacagugcuugcugugugugaguuugcuuggcuucuggucugggaaggcagagucauacagggcguuguuguguugucaaggaacgcugcauagacauagauugugucuguguuauagaacugauacgauuuccaggugauacaagcuuauguauuauguaggagugagguguuauuauauguguaaguaacuaucaagagggccaguaaaacauuuagaaaacuucagaaagagcuugcuuucuucacagaagcaggaaaguagggaagaacaggaccaggcucucuuuauaauagauggaggauagagaaaccugguuagaaggggagaguugacuggggcaaacugagcagaccuguccugggagccugguaguuaauuuguaagauaggagguauucugcuggucuguaaaugauacagucucaguagggguaaugcuagacuuagggagauuuaaauaguggauuaccauaguuugugauauuucaaaauuuaccagguauaucugucuucuaaaaugucaugagagagggcaaauagggagaaaguauuuccaaaaggccccaagauaggguaauauguuuuauacuucucuaucaaaacauaauuggagugcuucuccucugcacaguuaucuuuauguccuuagaucaaugaaauauauguaaaauaauaauaggagauaugcuagcuggaugugauguugugaguuuaaggucagccugggcugcacacugggauccuauuuaagagauaugcuguuugugcucuuugcaucauuaaugaaggccuucuuggcuguucugugcuguagggaggcauggaaagcccucggugacucaagcccuagccaagcaaugcaggaauauaucgcggcaguuaaaaaacuagauccaggauggaauccucagguaagacuucuagcuguauacuuucugaaaacuuacuuucuccaaacaaaugucucuaacuaagcuuugguguaacgcgucuuaagcuucaguucaucaaaaacuauaagguaauuguaauauuuaucugugaaaauaacuacuuaaauauuaccaugagcaguaacugauacagaaaccucuggguaguaguuuguagaaguaugguuuaaucuuguaagaucugaaauuaugucagaauuuggagauuaucauuuugggaauaagaaaacuucuuucaauuaaaacaauuggguggucuggagagauggcucaguguuuaagggcauccacugcucuuccagagguccugaguucaguuccuagcacccauaucggguagcucacaaccaccuggaaagacaacuucaggggauccaacuccuggcuuccaugucaucugcagaaacccauacaacagauauacguacauaacgagaaaauaauuauacagcucuugagagucagaugcgaguuggaggccagucuggucuacagagugagucccaggauagccagggcugcacagagaaacccuguuuuaaaaaaaaaacaaaaagcaaaaauuugucugcuuguauguauguggacugugugagugcagugccuuugcaggccauaagauggcgacaguccccaagaaacggugucauaguugauagccaccgugccaugcaaagaacugacaugagcaaggguucuucacuacugacccgacucucaagcuccuuuuugauauuuuaauaagcacuuucuguacgaguuugagacacaagaugaauaugacauuauuucugccauuacguaguuuaaagcauaaggaaugauaaaacacauuaagauuaauguuuauauaugaauuuuagagccugcacggggacaaaaugacuggauguuaggguauuggauaauguuaacuuagguggacgaccuuuccaggguucuuauggagaaugccuagaaaggguuuagugcagacggggcuauuacuuuuauuuuaaaguauuuuuaaagacaucuaaaaguuaaauuauugggcuggugagauggcucaguggguaagagcacccuacugcucuuccgaagguccggaguucaaaucccagcaaccacaugguggcucacaaccaucuguaacaagaucugacucccucuucuggacagcuacaguguacuuacauauaauaaauaaauaaaucuuaaaaaaaaguuaaauuauuguaugugugcuugcaccaaaugcauuuggaaguuagaagacaacuugcaagggguucucuuuccuucuucuaccaugugggccaugaggauugaacucagguagucaggcucggagauaagagccuuuacccuccaaucccuccugaugccccugaaaaauaaauuaaaaaaaaauuauuuaauguguuucugugaguauuaacauguauguauguguauugugugcauuccuggugcccacagaaugcagaaaaggguguuaauuagaauuauagggguugugaguugccuuguggauccuggaaacugaaccccaguccuuagaauagcuauaugaccucuuauauauauuauauauuaauauauauauuaacugccgagcugucucuccauccccauuuaaaauacuaaaagaagccaaaauacugguguaaagguauauaggauagagguugggucaauaugauugccuuuaauuccagcacgugggaggcagaggcagacagaguucagugccagcucguucuacaguucgaauuccaggacagccagggcuacagagagaaacucugucuuggaaaaccaaaacccaaaccaaacaaacauugcaaucuuguaaagaugccaggcagaggcagagaaccagguagaccucagccugcucuacauuccagggccuauuaaaacccagucucagaaagccaaaacaacacaaaggcaacagccacacaagcuacaucuugugaagagggauuugcaucucacauagauucgugugccugcagcuguguguuguaugcgcuucaguccuggcuuacacacuccuucugguccuucuugacuuccuuuuuuuuccccuuuccuuuuagauugguaagaggcauaaaaccauaaccuuaauaucaggagagcuuugacauuagauuugacauuagucauuuuggauaaagagagugauuuucaaugacuagagaugagcccaguguuagagaacuugcuuaguaaucugaagcccggaguucaagucccagcacauccccucaaaaaaaaaaauuacuuucauuugcuagauuguuucuuuuuuuuuuuugaaucccaguagguauuuuuuuaauuauuuauuuauuauauguaaguacacuguagcugucuucaaacacuccagaagagggagucggaucucguuauggaugguugugagucaccaugugguugcugggauuugaacucaggaccuucagaggagcagucgggugcucuuacccacugagccaucucaccacccgcuagauuguuucuaagaaguaaacuaaauacacauuuuauauggccuagguuuacauguauuaucuuuugaaauugccacaaaaaucuuagaacuauuauugccuauauuuuaaaaguuaggaaauucagacauagagguucauuaacuugccuauaguuaguaacacacaaagacauuagaaaugaugcuggagagauggcucagcgguuaagagcaccgacugcucauccagagguccugaguucaaaucccagcaaccacaugguggcucccaaccaucuguagugagaucuagugcccucuucuagccugcaggcauauaugcaggcagaacauuguucugcaaaauaaauaaauaaaucuuuaaacaaagaaagaaaagagaagaaaagaaaaaaaauuggauccaucuuaaagacaagacaaaacaaaacaaaaaaacuucuacucuuaacagugacuuagccuugccacacacaccugccguuugaaacacacacagacagaaccaaaaccaaaccaaaccuuuauguuugauuauguaaagcuacagaccuuugagcaguuacaaagcuacauggugacauaaugcagcccccugccuguguuuucaucuguguuuuaccucaagagccuggugguuaguggggaauauaaaaagacuccuuugucuuaugucauuuuggcaggggaaguuaaguuucaauacagacaauuaaaaaaaaauuuaauagaaggagaaacgucuuucuauauguagacuuaucuagauuuaccaguuauauuugcucugucauucuguuuauacauucauacacauaucuauaucgauaaaaucuguuagcuuguuuuuguuuuuguuuuuuuuugagacaggguuucuguguugcccuggcuggccuggaacuuauccuguagaucaggcugggcagcuucugccuuugaguauugggauuaaagguaugagccaccacugcccagcuaaauuuuuuuuccuaaaucguuugagauaaauuggcaauauugugcucauuuuuccuaaauacuugaauauuuauuuucuaagaacaaauagauuucuuuucauaacuauaccuuaaucaaaauugggauuuuaauuuuuauauuuuuguauguauuuuaggcagcuucuggaaauauuaaaaauuuuuaauauugacccauucuuauuaaggaaucuguagcucauauuuaaaauuuucauuuacuuuaacaaugucuuuuccaauuauuugcuaaaauuucuacccugaccugauuuagaauugugcauuguauucacuuggcauauuucuuuaggcucuucuaaucugcaauaguuucaauauaaauaugaaaaguaauaaaccaguuauuuuugagagugucucccauuuuggauuguuuguaaucagcuucagaucgcacauuuuaggaguaacacagaaguguguucucagugcauuuuaccagcaguaaucacaggauuucugucuugguacugaugaugucaacuuuguucacuuggauaaugauggcaucugccagauuucucuacugagaaguuucuguuucuuuauaauuagugaguaauuugugaagaauacuuugaaacuaucuacauacauauauuguuuccaaauuggauuucagcuacuaguuuuaacauucaguaaugauuuuuaacuccauuguucuauguuuauuauuugacacauucaacuauaugaaaguauccaggcaaauuuuaugucaacuugacaugagcuggaguuaucagagaggagggacccucgauagaaaaaugcccccauuagaugggcuguaggcgagccugugggggcauuuucuuaauuagugaucagugugggaggguccaacgcauuggguggggccaccucuggcuggugguccuggguucuguaagaaaggaugugagcaguacuacaccauugccucuguuugcagguuccugcccuccuugaguuccuguccugacuuccuuugaugcugaacugugaugaggaagcauaagccgaauaaacccuuugcucuccgaguugccuuggucaugguguuuugucucagugugauaguaacccuaacuaaaacagaacggacuuuucauuucuccauucauccaucugcccauccauccaccauccaccauccacccaucagucccuuaaaaagagaagugugugaaaggucugagauuuugcccuguauacaagcuagguuaccccguuucuguuuaagugcuggcagaagccuucuggcuccugggucagcccagggguugucaaacugcaugaacuugauuuauuuugcauccguuuuccacaucucccaagucccacaggaugacacagguaggguuaguuggauuucugcauaugcuguggguugugcauauagggaaagaaagagcagugaguuauaggaauucaagccugcuuuuugucaggggcuggagagauguuacugcauucccaaagguguuuugguggucacaguccugagaaauagccuacauacagagugguaggcgcccagucaauugagcaagaauguauagggauuucagcacccaugguagguugccuuucccaauguccauauauuuguauuauauagauuuagggauuucuguuuuauucaugcaguauaauacuaagaaucuucaaacuagguccucuguccuuuucauaugcccuaauccuuggggcaguuucuuucuuacuuacacaagauauuccaacucuguuaguuuccuagggcugcuguagcaaaaugccgcaagcuccuuaaaacaaauugauuuucucauagucuggaggguggaugucugaaaggaggaguuagcaucuguagggagaaaugcuugcugcuucaucuucuggugccuugcagacauuaugugucuuguggcuggucuagcuugcucgucuguugcugggacaaaacaacagcugaaaguaaccuggggagaaagggauuguuugacuucuauguuacaguccaugacugcaggaaauuaaggccaagacucaggcagggcccuaaagacaggaacugaagcagagaccaugaaggaauggugcuuacugccucccuugcaggcuucuguucagcugccuuuccuguauagcccaggccacuugcuuagggaugguacugcucacagugcacugggccccccucucaauuagcaaucaagaaaacaccccacagacaugccuccaagccagucuguuggggacaaauccucaacugaacuucccucuccccaggcgugccaagcuggcaaccaagauuagcugucucaguggccgagcuccagugucugucugccugucuucacgugguugucuugcugagguuucucuugugugaagcuuccucucuuucuugugugaggccaccaguccauccuaauccggugugacuucaguuuauguaugugaagaugauuuucuuucuuucauuuuguuuugguuuuggagacaggucuguguaccccuaacuauccuagaauucacucuguagaccgggcuagccucaaacucaggcaucugcuuggcugugccucccuggugcuggaguugagugcaugcuccaccguggccccuccuaacugaagaugauuuucuauccuccuccccccuuaaagacaagaucucacuuuuuuuuaaaaaacauaguucuggaagaaguuuucuaaauuaaaaaucagauuuuuuucaagauccuaagaccacuugccauuucccuuaccucuuugaagagauucuuguucuugugaguagugugauggccaccaucucucuugagcucuguacaaugguuuccguguccagugcucacaaaaaguaugguuaaauuugaacucuucuccagaucucacugauuaaaauacacuaacauauuuuggauauguacuuaaauuucacucuaauauguaaaagaguacuguuuauugaaccaacuauaaaaagacuuuucuaagauuuaguuggcuuuauuuuguaauucuaguguugauaauccucaaauagauugguuuuuagaccuuaauuggcuuuauuuuggauucuagaaucagacaauccuucauucuauaaaauacaauaacuauuuuuucuuuucccuaacaucuguuaaagacuuauuaauuauuacccuaugcaucaguuguacuuuauguuauagaaguucuagcuugugggaacugggauauagcugcugguagcacaggcagacagugucugcucagaggagccugcacuguggcaagagugaguaguaauauaaguacauaguacaguguuguagaaggugaucaguacauggacagaaagcggggagaagcagaggguaugcaggaggcgggaaucauuucaauaugcugaucagggaagacucacuaaaaaggugaccuugaacauuauggaaaggagaagggagccauacguauggaaacacauccacaggcuguagagggaccagguaauacaaguuauggcugggucguaccuggugugcuuuacacacugcagggcuaaaugugggggggaacgaggagcagagaacuagaaaauucacuagacaauaaacaugguaguuuauugucaggauuauggcuuuacucugagugaaaagggaaauauuucuauagugagccuacuccagucauaagcuuguaaaaagauauaaacauucuucuauauuguccagcaaacaauaccuuaauaaaauuaguacaggcauaaaauauauggaacagaaauauaaaacacaugagagaggguacagugagaccuuaggaagccccuugcaacacacagcauacaccaagccaugcuuuuacaagugugguuccacgugcacagcucugaagagcugcuugugugcugcucagaugcuaaugccugcaggagugggaggaaaugagaggagugggggcggggcgggcagucagugcuuuaggaugcuuucagaaacagacagguaccguggccagugagcaucugcaaauacuaacaaagacugguaaguucuggugucucaugaaauacuucccaauugaaaugcuucuagcagauuaaaagguauaauuugaacauuaucuaucaguuccaugagugguaaaucucgauaguucauguaauuuaguguuucuucaucugaucagguauguuuuucugcucauuccuagucaaaccuccagugaccaccagagggcgcaaaguucauaggaaauaagaugauuuuauuuugggaguuaccagggcuuucugccuguuucagugcuauuguuagucccuuaguuuucacuaauuauuuccuuuuccuuaaaaaagaaaaaacagaaaccuuagaucuugaccuuuacucagaaugucauuaauaaggucauuucucugccucgcugaucuggugacucuuagauccauuuuauuuuaccuguguguuaucuagaaagauaauagcugugagaacagaaagucuccuaauaacgugguuguguagacgcccaguggccauccagccucugcaauccagcuccuguugaucaaguuuggguagcaucgucuaccggucuuuuauuuguaaauaauuauuaaaaacccaggcaucgaaucagguggcugucauccuagcucuugugggguggaggcaguugcacaucaaaauccucuuuaggaauauuuaagaauacagacucgaaucagcgguccagauuuacucagauauacugcaguagagaucuggcaucuguuuuuguugugguuuuguuuuuauuugcccccaaauuaauuuggagcauagcccagaguuguuagcaccuugugcccacauccugcuccuuucaggauuaguucaguugcucugucucuacuagauauguuucagccuucaagacucagccuagcccuuccgccugcaggaacgugcucccuuuuccuugagucauccucaaacgcaaacccugacugguuucuguggucugcucuuguguuguacguaccacuugaaguugaaguuaucuuucucucccauuguacugaaaacauuaucagaauuuaggcuaugccauauucacaacaccugaaacagaagcuguguauuaguaacuauuaggcugaacugaacucaauggcaauugugucuaugguaucaaacacagaugcaaaaagagggcugagguguagcucuguggugaagcaguugccucgcaugcacaaggcccugggcuccuuccccagcacugaacaaacagucuuacagaggagaauaauuuugcuucaggaacaagccuggcaggaaaauccaaaauuugauggcuggacuguauugaguaaguucagcugucauuuaaaacacuguccuguagagggcaguguuucccaguugacauagccuguucugccucuugugugaaauacauaaauaaccgugcucauuuuguguauuuaucacucuuguagacacaauaaaauaacucuuagggauuuaaaaagcaauuuuaagauguuguuaaaaauaaaauugaagaaucaagaugacaauuuagaaaagaacauuuuauaaucuuuguaucaaaaauguuagucuguguuaauagauaaaaacuauaaaaaaaggguuugcuuuccuauguaguucauauagguuaagaaaaguuagcaacccagacuucccaguggcccucaucugucgggagcucuggaggacaccaguguucugugcagcucuucacuugucgggagugagcgugucauuuuacuugugcaguagaacagggcuuuguaacaaacaguuguacguuuagguaaacuaacugaaucugaugucaaagccccaaauaagguaagaguaauuuuuguuugguuuaagaaaugauuuuuuuaaauuuuguguuaaguuaaaaaguaaccaguauauuuuaauuagaaauuauguuauagagaaguuauuuuaucuacuacaaaccauuauucuaauggcauacuuuuuuauaauauguucuguuauauuagaaacagaaaucuauuuugaaucaaauuuacuaucuccauauauagguuauuucugguacagaaaaguaccauguauuaguaguaacaugaauggucuaccauacugccuuuuaaaggguugaacaguuuuuuuuaagagcuauagaauucuuacuucugucucaugucugugcauuacccacuugaucugcuggaacccuggcuuaaacggugugaucuuuggguuaguuucaggggaacugggggaagcacacaccuggcacucaugugggggguuuucaguuccuucugugcaugcauuuaucugagcuuuagacgucuccuguccugucugcugaggaaaggaaguaauuuguuagucuguauuuucacauuuguauaaagcacagcuuuagucuucauuuaaauauguuauauauauauauauauauuuuuuuuaauaagauuugugaaagacuuuaaggccucacaucccaccuuuaaaugacagcucgcuguugcuauaguaaauucauauaaguuuaguuugggauaacucucuaguguccacacugggccuagugacauuagguugcuuugaaaucugaccuaauuccugucaauauuccuuaagauacauaauuaauuauguagacauaauauguaacuugacaucuuggaguuuuucaguuuuuccuuaaguugaguuuuuaauauguuugaaaaauauuaguaaaacucuaaaugcucugucauuuugguucauaaaaagaggauugugugaauuuagaaaagguaucuuuuucuuaugagucaugcacuacauucuucuauaauacauaaauuuuauguagaauuuuucuaucauuuauuaauaucuuuguuuuguuguuguauugcuuuguuuugguuuguguccuggcuuucuuggaacuugcuuuauagaccaggcuggccucaaacucacagagauuccucauugucugccucgugagugcuagaauugaagacguguaucaccacacccagcuaucgcauagugauuuucauuucacauuuauuuuaaaaauauaguaacacaaaaguuaaugcaauuauauauauuuuauaaaugaauaauuccuauuauauauuguuauggucaaauagcuuguauuuaauccagguuagugucaacuagcccuucugacaauccugaaggguauuaaucuuugcugacaggugaggaagccccggcuuaagaacuuaaccaguuuagccuggagacugaguuccuaagacaagcaagcacaaacauaaggcucauuuagccuuuugggucaugccacauuauucagcauucaagauuuucuagaucuuuggcaccuguguuuuauauuguuuccuuacggguccugagacuuuggucgguuucuauggagccuaugacuguccuaggacugucggucucacgcacuucuccuuuaagagaaagaacugcugcagaucaggucccuuacuuuauagcugcgugcucugccuuaacagcacacuacaguuucccuuugugauugugagcgaguaucagcagaguccuaacaaauuagcaaucauaaaacaauagacaauuugccuucucuauuucccggucucagcugaaucucuaaaaugaccucaucaugaguguguggcugcuagaaguguguauguguguguauuuagcaguguugcucuuauacuuagauuuacacuuugaaauuucaacauggauugaauauuacaguuucauaauuuuaaccauguuaagugcaaaaaugacuaagggcauauguaccuguacuguauaaacauauugguauggacaucacuuaaauguaaaucaaaaguuugaaagugaguuagcaggcggauguaggaucucgggguugguggcggugcuucccuuuucugcaugugcacgcaugugcauauaugugagcaugugcauaugcaugugcauauaugugagcgugugcauaugcauguacauauaugugagcauguuuaaucuuccguauucuuacuacuugcuacacaucauuccauauucgcuauuacagagaugggaguuugauauaauuguuaagaaauaaggcauuuaaaaaccuguagcagcaaaguuguaucucuguuacuaaugcugcauucuaaauaccucucugaccacuacuuaaaaguuuuaaaacuguuuugaaauuuucuuuaaguguuucaguucuuaacguuugggagucuuuaaacuugguaucuaaaucuauuauaaaucuauucggggaagauuugaggugaauuccuuuccuguaccugucuccugucagauuugacucaacauuuuauaaacugagagacugaauacuuuaaaugucuaauguuuauacccaacuaguuaagucauuuuuauuacuuuuaaucuuggguuuuuuuuuuuguacauuuaaaaaaauauucagugagcauuucucuuguauguguuuuaucuguugaacuuuguguuguuguuuucucugguauucugcuggauuucuuuacuucuaacuacuacaguuugucuguuuuuuaaauauauucuuauuugugauguaaaauugaggguagcuauguuaaacuuaccuuugggaauuaauucauuuaagauuuauugagccucuucaggcuguauuaguauaaacuaaugcuggaauccccuugaaaucuuacaauaaugauguaagauauaguuaugauauauaguuacucguaacuauauaucaucuucugaauuuuuguuuuguuucauuuuuguuuuuauuuuuuuagagacaggaucucacuauguagcucuggcugucuuggagaucaugauauagaccagacaggccucaaacucccagaucuaccuccugccucccacgagaaaggacuaaagaaaggcauuugccuuuaucacuggcuaucuucuaaaaauguuaaggaauuuaugugcuuucuaaugugauuuucccaguaaacucgagauuccaaauuacucaguuuuuaguaucuucuaccauuucugcugauuaguguagaaucagcaaaucauacaacuccuacauugucauugucuuaugacuuuuuaaagcugauuaguuuuuaugauucuuuuggagguuaauauccucccucuccuucgcccuugcccucccccaccauguuuguagugguuuccauggagaauuuaaagugaggaaauuucuuucucgaccaacaccugaccucuucugcuugaucagggcuuugguucauguugacagggugcgucagccgagcaugucccagccaugaagcuguuguuucugcuucccucugucugucaguaaugcuaugcuccuuuuucucuguaaucuaguuuuccaccuagugucauugaugcacacacucaccuuuaaaugugaaaugaugagagcguuaacauuuggucccagaugaugcccgcagagcaucccauaaaggauggugaugcuguuuaagguggacaacagugucguggaguuucgugggucaacaccugcucugugaguuuaaauugcagcaugucagaaaugacaucaguagaugcauagcuuuaguagcugggaauguaaauguuugaguuuacagaugugcacacauacaugugugagagagguguuugugaggaaauacacugguacaaaccucugagagucagaaacgugucuagaacaauuuguuguuaucaacaacacuugcuuggauaguaucugaagucuuuuuauuuguuauccugugcccaguggaagagucaagugccaguuuucuucugucuuuaaauugaccaaguuacuugaaauaucaaccacagagggaacagaacggagauacagguugccaguuucuacuuguuuaauugauaaguucugaacuuguaacaaguucugaaauuuggagacugaagacuguacuucuguucagacaacacuuuuuuucugagacuugguuauacuguauagcccaugucagccuugaacccacgauccuccugcccaggucacagggcugcagaugugcaccacaacacucagcuucaaauaguacuuuuaagaaauugauuuaguuugacaguuaaguauuuuuauccaguuugacacagugguauuugguuuaaauaccauuuaaucauaucuuguaaaacaaaaucaauucaagugcauguauucuuuuaaauauacuuuauagugugauaaaauguggauuagcucuuguuuguaugaaaaaaaugagaaaaaaaaagugcuuguuucuuuaggccuuuaaaaaauauuacuugagugucuuguuagugauguaaauacagauucauuggagccuuggaucuuccaggcauuugagguguuguagagugugcgugugugugugugugugugugugugcauaccuaagcuuaagugugugcuguuuuacagaucucccucauuucaugcagagccuguuaaauagcucacaucauugcuauucuaagucaugcuucugccgucaaacauuugaaaagugauugacuuuugcccauagcuucauaauuuauaagaaaacauaaaaugaaaagacuagaccaagaugauuuugguacaugucuauaaucuuaauccaguggcgcuuacagaaggaaucuguuuaggacagagcagccgcugacugacucaucagcuggaacuugauauguuaacuucuuuucagguuucaguugugggauuuuuuuuuucuuacuuaauuuguagggguugggugucuuugauuuuaugucuguugagaaauuuauggccaaguacuuuauuuaugacauuauagucugagcuuaggcaauugauugaaauacaauauagggaaauuuaguaugcauuuuuaaaagcucaaauugggaaagugagccaauauggauuugcuuuagagcaagaaggaaaaagcauaauagguuaauuucuuuauauuucuguuacuguuuauugcuaaagucuggcuuccaguauugacacauuugcuauuggagguuagcugugcauugucauguuguaaaguugagauaagagauuauaacuuaucaaaauuagauauauagaaaacagucuauaaacuguagguacaauucaaauauaaaguagagacaaaauuuuauuaauaaauaagcgagauucagugcuacuguugcuaggacuuuagucauacuguagcacucaguggucauuuuaaauaaaugaccaaggugaaauuacagaaaaaauuauugagaggcaaaacuauuaucuuuccuuucuguggcuguucaguagcaaacuuugauucuuacaaaaucuaagucauauuucuuuagaauuuggaaaauaguuuuucuccagagugauuagaucaguugagugaauuagguuuuauuaaccaaguugauaauaaacgcauuucuuguuuuuucaauauuguugcagacuuagguuuaaaauagugucagaacauuguuuuuagauacacuguauaguguccuuuuucugggacaaugcaguucuauuucacagugaauauggacugagacuuucugguauuugacacaaugcuuaguuuuaagaauuuauuuguauuuuaaauuaugaggaguggugguaugugcaugugaguugaagugccauggagacuagagguggaagacccuucuggagaugaaguuccaggagauuggggaacaccagauauggguauugcucacugaggucauagcaguguacacgccuaaccacugaaccaucucuccaguccccaguguuugagaauaagaacauugcuacuuuauaguucugcaguucaagcuuuaauaugcugguuagacuuuuacuucagagaauggccaagacagaauggggagaauaaggugaguagacugagcgguagguccgauccggaaauugaaucuaaaagaacagucaggggcuggagagguggcucagugguuaagagcacuuccaaagguccugaguucaauucccagcaacuacauaguggcucacaaccaucuguaaugggaucugaugcccucuucuggugugucugaagauagcaacauuguacucauauacauaaaauaaaucuuaaaaaaaaaaagggaacagucagguugguucuugaaaagggaaaaaacaauagaaaaaaaaagagaugauguuguuacagguacaggguaguauaaauacauguagucugaauuucccagugcccaucagaguauggacacaagcuuuuguguugaucaaggugguugucuguggucagaaucguaugugauaaaagaagcgugacacagucacuaagcaguacucguggaguggcuccuggaaguccuggcaagcaggugauguucuguaaacagcgaaacaguauucuauuugaagucgccgaccuuagggcagcugugugagugcaguuuccuuacaugcuaauguuuuccugaccuugcaaaauucgauucuagaaccuggggauaaguuaguugucaugucuuugccaugucuucuuuugcuacaucuaagggcaaaacaacuaucuuuaugguguggaauucaagcugacuggucgccuuaaaugucugauuuauaggcagccguaaguaauuuuaggaaguaggacagaacugaguguggcagauucuugcuguuaauugucuugucugugauaggaaagugaggagaaagcacaccuggaguuuauaggaaacaacaagugguggaagcacaacaagaugugaacaaagcagugcuugcugcuucucucugccagguugcauuagaaagcuguuggcagagcaaguaguagaagggacgggcaggaccugcuaggacgcacuucuuucuaccucuuuaaccugccugcacucaccuccuuuggugugagggcuagcuucaccaggacugccugugacucacaccuucagucucagaagacaaggacaggagguauucugaggcugaagccuucagugacuaccgagaaggauuaggugagcuucaggggcacacuugaccgaggagaggcaaaaggccuccugcugcaguugcagguuaugauggugcgcagucugaauggagacggccugugaggccuuggucaguggagcggcuaugucagcagaacucguauuugucucucuucuuugaggccucauuuucuuuccuucucaucauucauauacugagauuuuacaucccaagaauugcucauuuuggaaacuuugccucagguucuguucccuagggaauccugggcagaaacuaaugguuaacuucugaaaccaaauaacaauaucugcagguucuagaagggauauagauggggaugcacuaccaaaacauuaaaggcaaucaacagggaaaugguuacacagcagcauauuguucagagggauauucagggagaagaaguuucguacaggagguugacugugcaugggguauugagacaaaaggcaggucugucugucuucuaaucugcugucaucuuggaaauuaagccuuuaaaccuaugaaauguguguucaugcgugggcacuggcagguauuuauaggaaugguguggaucugggagaaggaauggaagagggguuuuuguuuuuguugguuuuuuuuuguuguuguuguacuuuuuacccccauauaauugcuguagauuaaaauuuucacaauaaggcaauggaaaaauaguuuauuuaaauacuagagauagugagauacuuauuuaaaaugaagaacaaauguuuaagaaacaacauacuagagugcuuauacuugaucuuagcaaaaggccaagaagucaugcugcuaaggcacauaguuuuccauuuuuaaaagugugugugugugugagagagagagagagagagagagagagagagaaugagaauguauguaaaauagcaggauugcauuagguagaaacauuauuuucuucccaaaauggaaauaacuuuuauuuuuucugacuuacuuuuguaugugcuaguauugaaccugagaccuugcucauccugagcaugcccuguaccauugagauauaacucaccucccacuccaucauacacauuuuaaagaaaaguaggugagaauagaguuguuguuuuuaauuuaucaccguuuuuuaaaaauauuaucaacauuuuuguguuccaguuuugaaguuuuucaaauucacaugcacacagagcuggaauuuugauuuuucuccauaugugugguuucuaaugcuugcaugguguucuguugucagggcaagcccuaacuguagucuuuguuauuuagcugcuuucucucucucucccuuucccccucuuucucuuuguuuuuucccugcuuauguaaugcugcaauaaacaucuuucuacuuauauuuuugcacacuuaucuaauuauuucuuugggaugaguuccuagcagucaguggccaaauuuuauaguuucgguuauugauugauggcuuagacucaucaaguaaugcauuauuugucuaggaagaaauacaggcucauguuuucuauuagucauuugugacuuuucauuagugguuaauaauuauugacuacucacaauggguaccgagaacacugugaacaugacaccagauuacuaggucagagcuuugcucugcuuagaucugagcaggcucgggcagagcugguucauagcaaaggauggaaaugccuuaugaggauacuccucuauaggguuuagaaagaaaaggacgaaauuuagucuuaaaacuaugggacauauaucuucuuuuacauaauauuuuaucugcuugcauuauaauugacuauuuacauguuucucaucuccuuuagaauuuaagcuccacaagaaaacauauuugccuggguuaugacuauguucccaguuagcaggcagcaagcaucuguugaguuauuuacuaaaugggcaagugcauauauccaaugaacuaugcaucuguuuccaguguuguuuguagaagcauggcuaccgagcuuuugggcagauguuaugauguugcuaaaaauagcgucuucgaacugcauaaaggaaccccauauucuuuauuuaauuaaauugcaucauuuuguauguucauaccauuucauaaagcaagaaggugaaccaucacucugcuuccacauuaugcagccuaauuauaaacacagggucagaccucuguacugggaggcagccguucaauaaaucaguauuacaaaugauaugccccaaaggaguauuuacugguuacuuuagccaacuuauaaaugaguagcuuaagaccacaaguaauuagauggggucaggaguaaagaauaccuauaaaauggauggcaagguuuucccuauuuuuugaggcuuguuacuucuuuuaugcugauuuguguucuaaauuaucauugauaugaguguuccgauuuuuccuuuuacuaguaaaacguaaauaauuuugauuacaagcacuaaggaacaaauggcucauugaggagcagggagcuuucugggcuaguaaggaauuguucuuagguuuugaugcucauaauccagucagugagacuaucuguacaguuacuuguaucaguuucuuaucauucauugugugugcacauacauacucauguucaugaaugcacauguggaggucagaggucagcuucugaguguucucucauuccacauggggacuuggggggauuaaacuuacacugucaggcuuggcagcaacuacugagcaaccuugcuggaccugacaaacuauuaauuagaggucaguuuuaugcagacuuacuauaauuguuuuuauaauaaaguuuuaaaauuuuuaauauucuaguaauagauucuuaauuucuuuuuuaacaagucaagaauacuagcagguauugauacaguguuaagcucuuguugaacaaacauuaugaacaaauugucagauuacuugucaaauauuuuaaauaccuaucaaauauuuuuauaugaacaugaucauaaauaauccuaagauaucccucucaaauauacuauaucuauauuccaguuuuauguuucuuuguuacugcuuugauuguaauuagaauaaauacaagucugcuguuuugaaucacaccuucaucuucaaauugugccuuaacuaaacacacaccauuuuuucuagcugucgagaaacccaacugcuagaaucgaagucugacauuaccggauauccuuaagcuccaugccagaugguggacucccuuugucagcaaggcuuucucuuccugggagaucccggaaccuacacccacuaccugaggaaugucauguagcccuuagggaaauuacagguccaacucccuuucucccaauaagaaaccuggucagcaagcaccugagauuccuggagugccuccccgugcuaaugaggcgucucaguaccuuagccuucagccaaugaccuuuguccacccuggauauuccuacccccuucucccaaacuauacagaccugaauaaaguugaucugucucccugaagcugaucccggagauaaguguuauuuuugcaguacucauggccauucacauacucugauacccugucaaucaacucugcucccuucgucuucaugggcugguggccuucuccuuggggagaagggaggaccacucuagcuuuaaauguuuugauuuuuuucuuugugaaaugugguaguguuguauagauacauguagauugugcaauauauaacagaacuccaaauaaggguuuauuuuguaaaaguugauggaauaaauaacacauuuauuuugaguuuucuucucugugacacuugaggaacuuggcaguaucuauauuuuggcagcuaagcugucagacuccuccgugugugauguuuaagccagugacuggagcaugugaggacacucacugggaacgggugccuccuagcaggcagaguucugcccauugccacaucaccagggcaccauuaguugcuggagaguugugagucccaacuuauuuguuagcugcugcagaugaauguucagucucuacuuuuaugagcugcuguucugugaagguucaaugccccaguauaggggaaugucagggccaggaagcaggagugggugaauuggugagccggggguuggggggauagaggguuuucagaggggaaaugaggaaaggggauaacauuugaaauguaaauaaaauaucuaauuaaaaaagaaaacagaaacuaggcuuuccucuuagguagagaccagggcugucagcuuaguagcaugaguuaggacugccagauacgcaggacucaccauucuugaauaggaaccauauauagacuauucaggcauggccccucucuacuugcuaagggauuuccuucacuagguggugcacuccuuuggagguucaggucuuucaggaauccauuuucaaguggagcagugcuuucuucugggucuauuuugguugcugaauugcucuagugugcuggccuuccuggggagucaggccacauguguaugcuuagaguauucucuuccuguuacuguuuuuauuucuucucccuuccugaugcuagauuuuuuuuuuccccuucuccucccggccccgcucucuccagcccgcucugacccugcuccugaugcuagauuuuuaaagguccuuuacuuacuuuuguuuguuauugaggauuucagacaauauauuuggaucauauucuuuucccaaacccagauguucuuccuucccuagucccuacccaucucacuuuguguucuuucucuagcaaaacaaaacaaacaaaaaaaggacaaaaaccaaaccaaccaaccaaccaaacaaacaaacaaacaaaaaaacaacagaaagcacaaagcacaaaaaaaaaauggaguccuauuuguuuaagguuuuuuaaaaaauguguguauugcgcgugugugucuguauacauagguguugggucuccucagauccucaugagccacaguguggguacuaggaaucaagcccaagcccucuggaagaacagccuguguucuuuuuuuaauguauaauuuauuuucauuuuauguauguuggugauuugacuucauauaugucugugugagggugucuggggaaaacaggaauuacagacaguugugagcugccauguaggugcuggggacugaaccuggguccucuggaagagcagccaccucuccggccccuaguuaaauguuuuauauugacuauuauuguuggucucacugaagaucaacauuuagucacauucucucugugauuuuuuuucugguauuucuaauuaauuagaaguagaaauaccuuuuauaaaaucauguauuaguuguaccuauuuccugcuuugucaagucucucagcaaaggaugcuucgugucugcugcgcuuacggcuggcucaugcacaccuuucaugugcuuccguagggugggcuuccugcaucccaagugaaguuuccugcagauguucuucuugguaguaacaaaacauggcagagcagucuuugcaugcucaucaacggcuucaaucuucaaacuugcauguaauugcugcugucgagugcaguuacugccugcccaaguuuccuuccuuggggccagcuaugccaugcuuugauaaagaguuauagagccgggcaugguggcacacaccuuuaaucccagcacuugggaggcagaggcaggcggauuucugaauucgaggccagccuggucuacaaagugaguuccaggacagccagggcuacacagagaaacccugucucgaaaaacaaaaaaacaaaaaacaaaacagaaaaagaauuauaaauugaggguuucugaaacuuuuuugaagguuuagaaccugucugcuucgaaaaauugaagcuauaaaauuacauucuuuuaaauauuuuauaaaacugacaugaauaacugacaguaauaagaauaacaaggauuugaagguuugcugauuauaauuauauuucugaauuaauuaugaauauauucccuuuauuggucacaguucaauacauguaauuccaaguucaugucacuucucuucuucaaauaucuguguauguaaguccugcauaauguagaguuaauucaguucugcgaguuuagugagagggcaggggucuuagcugaguggugccagguugaagauuaccuguuacagucaggccuucucugccccagaucuggacaaugaauuauaguuauaucuuggcuagcaacacuguaagacuucuucugucaguagaugauucuguaauugugugaacaucagaguguauuuacacaaacuaagauagcucugaugauucuaggcaaugcagucuugucuugugcucugucucugcaugccugucuucuaugcaaguggauauuuucagcuguaauuuucugaacacauguuuuuauuuucuuuacuucccaggguuaucaaaguaggaugugaugagcuucuaggucagugaaggaguaaauugucucugucuaguaaucuaagccauccugaacucauuguguguguuugugaaguccaaaugacaaucuccaguguuguuccucgggagccuuccaccuucuucgagacagggucucuuacugcccuggagcuguauaaguaggugaggcuagaaagccccaaggauccccuauucccaaccuccccagugcuaggauaagcguaugcaccagacuuggcuuucugugugaguucugaugaauaaacucaaauuaucaugcuugcuugacaaauaccuuacuguuugagcucucuucccuuuauagcuacaugauauucucuuguauggauguaauacauuuuguuuguuauuguugaacuguuggguuauuuccacuauuuuaaguuaaguauuuauuuguauguaugugagcaugcgugaguuuuuaugccccacaugcauguaggagcccuuggaggucagaagagggcauuugggucuagcguuacagguaguugugaaccuccaugugggugcuaggaaccaaacccugcuccugcaagagcaggaagcacuaauggugagccgucucuucagcucaacagugcuucuuuugaaucacgaugcugggagcauuuugugugcaacuucacauaggauauaaacuuaggacuggaguugcuugaucagaauuugagcauaaguauaaacacaguaaacccuaaauaucaaaaauuugaaagacaagacccuaaaaggucauauucccaaaagauuaaaauccugaauguuggaacccugacaaccaagauuauugaaguuggaguucccuuucgaaagagaaugucaccaaagaagauaaaagcuagucagggacauggcucauacccuaaucccagugcuugggaagcugaggaggagaaucacugaguucaagaucauccuggacuacuacaaagugacuuccaggcuagccugggcuacaaagugaggcccuuucuccgacaacagaaaggcagaaguugguuuucuggguaagggacuggugucccgacagugugcugugcuugccuuugagacugccccucuucgaggacaaguggacaagccaguacucuucuaacccaaacucugcugauauuugauuaucauggagauaguuucuauuuaaccaccagucuaaccuggaaaggcccgugcauacuuacuuugucuacuuuaugguauuuccaaaacugucucagugucuguuuuguuauguucuuaaaucaaguuauagaacucaugccuuuguguacacuggaaauuuagaacucauccucucauuuauauauuaaugggacuuuauagucauugauuuggagacuugguggaccuugcagaagaaaauggguuucaauugaauccccaagccauaaugauauauuugaggcagggugugacggaggcuucuucugaaggugcauuuaagauugcuaccaauaacauuccauuugacccaguacaucugauggaaauuuuugauggauuggacaaauaaucuggcaaugacuauuuuaaaaugcaccauuuaucugcauuggaaugccaucgagcucaugaaauuccagaaguacuuaauaaauuaaagucacauuugucugaagaacccauucagcugcugauugguuugaaaauaauuacaugcauagcaggauaagaagaccccaucaugucaccgcuugaucaacggcacuguucccgucaaccuugaggagugcuugugagcaccuguaaacuguauuucuucauagccaguguaacacgaguguggcccagaugagaagguaggaacagcuaguagggagugaccaugucucagauccuagaagacuuggaaaagaacagcagcauguagaacaugacuaaguacauccucagaggacagagugacagcacaauuaguaacugugguagacggccagcucuaccuggauuacccuccauucacacgccccagucauuuguuuuaguuuuuugguuugauuuuagggccuuaccccucuuaagugguuaacauuauuuuauaauuugcuaaguucuauauuuuaucucuacaucauuucuaguacuagaaguauaaauuauauagcgauuuagagaguucuaguuauuuuaugccauuuguugcaaaauagacucgauaaaagaguguuaucacuuacauugaacuccuauguaagaauugugcaugugcauaaagaaaucagaauuuucucagaagagguguccuuuuuguacauuuggauuugugcaacauaaaauuucuuacugccuugacccuuuggaugauuuauuugcaguaguaauucauuguaaauuuugauucgucucauuaaaacaauuacguuuccaauuuuauuuaauugggauucauguguguguguguguguacauguauguauauguaugcauguuugccauguguguucagguacccuguaagaccagaagaggguaucagauccucuggagcuggaguuauaggcaguggguacuggaaagcaaauucuggcucuuuuauuuugcuugguuuuuuauuuauucacuuuacaucccaauaccagcguccccucuccuccuaguaccccuacacauagcuuucccccauuucaccucccuuucuccucugaaaaggggggucccccaguaacacauagcaugcacgugcgcgcacacacacagcccaagucucugcaggacuaggcacaucaucugccacugaaggcagacagguaguccaguugggggaaugggauccacuggcaggcaauagauucagggacagccgcucuccaguuguugagggacaugcaugaagaccaagcugcauaucuacuaccuauaugccuagguccagcccauacuugcucuuugguuggugguucagucuuugggggccccccaaggguacagguuaguugacucuauuguucuuccuguugaguuccuauccuuuuuggguuccucaguccuucccuaacucuuccagaagacuccucgagcuccagcuaucauguggcugugggucucuguaucugguuccauugacuucuguguggaaccucucagaggacagcuauguuagguuccuguuugcaagccuaagagcaaacucugguucauugcaagagcaguaucuguuuuuagcuacuaagccaucuccucgguugucuuucuuccccauaggcuauauuagaugucagcacaauguuaccaaucacaaagcaagcuaaaguaaaguaaaauaaaauaaaauauaaaauguucuuugaaaagauuaguaaaauucuaaaaagaagggggaaagauuuugaaggcaugaagagguuauggaauguagcugaggcuggcacugugugaggaguggaaaggccauugguaaaauugaagccuaaguuucaguugaaggcccaggauugaaggggucauagagagaaguuggagcaugaugcccuguuuugggucccugauuagagcccaggagaggcuauugguaaaagugcaggcuacuugaaacaggagacaccagaguuuuggugauggcaguaccauggacaguaaccaagaccugcagcugcuguggaguggagcuggucugagccuaugaguuuagaagccgguaguuccagaagucugacacucacacugaguuuauauuguugaccuuugguccugcuuugguuugauugugaguguguccugguucuuccuucuuggaauaagaaagaauuuaacuuuuuuaaaaauaggaagcuacacuuaugagaucuuggguauuuuagaaaggcuuuagaauuuuagagauacuggauuuugguauuuuagagaaacuuugaaacuugaaagagauuuuuagguguuuuacauuucaaagggacugaacuuuuaaaaguguuugauguuuuagaggcugugggaccuaagguuuggaauauguuuuauacugauacugauauuaguaugauaucgugggacaauaagaacggagaggguauggcuuaacagugauguguuugugugucaaguugacaagagaccaguugugcuagccaguuugaugucaacuugacauugguuaaagucauuugggagaggaacucucaguugagaaauguccccaucagaugggacugaugcgguuuuuagguuaaugauugauguaagaggacccaggccauuguggagucuccaccccugggcagaugguccuggcauguuuaagagaggaggagcagccagaaagcagcuccuccauggcuucugcaucagcuucugcuuccagguuucugccuuguuuaaguuucuguccugacuucccugccugauaaacuacaagcuguaagaugaaauaaaccauucucuccccaaguggcuuugagucgugguguuuuaucagcaauauaaaccauaacuaagauacucuuacuaauaacuccagucagauagauuauauagcagaaaugugugaauuucuccaaaauacaguuuacucaaacugacagcucaggaguuaggaauucugaguagugauguaucuuuugaagaaauuaaaucuuuacagcucuuacuacaggagccgaggauguuccuuagugauagaggcuuggcaguguggccaaccgagggauggaucccagcaccguccauugacgcccucuccugaccagaacacuaaccacaaaauuauacaaagccugagguuaaauugucuucuggaauguuuuucagaauguuaacggaagagauaaugccugucuuucucuucuguagaaugggacauuuccuguuucucuuucuuuguuuugcuacaagcuggccucagacucacaguugcccugccuugaccuucccagugcuaaugccaccacagcacguccauguggugcuggggacagaacucaugaugccugcuaggcaagcacuugacugacuaaaugacuccuucagcccagaagagugcacauucucacugaccagauugucgcuguccagugaugguacagaagagcuugcagaagagucuagccuauaauagaaguaguauaagcucuggcugucagaguccuuugggcugaaagccacucucccacuugcuaugucauauagccuacgucaccucucuucagcuuuccaaccugucaaaccuaagagacagaaacccaacuuuguaacauuuuugaaaccugacuguaacugaugguagaucauacuguuuucuuucuucacauuguagacaguagugacacuuguucggugccagcgcagcucuguacucuuguuccgaggcugaucugggauaauguaaguuucuggaagaucguuaccagaugcuugucuucuuuucuuguucuccauuuuccagaagaguuugcauaaggcuggcauuauuuuuccucugucauuugaaagaauagauuaguuguccuguuuugagaaguuuacugauaauauguuagaagaaucacaaguuuagcaucauuaggaaccucucaguuggauccuuucucuccacauacaaacaacuggcaccugagcuucugagacgcuggcagcaauggugggaucguggcuguagacuuuauuacaucagcugacauacaugaucccuuuuuugugcuggauguucuucuaucuaaauagaccuaucuuuaaucccgaaaaaaaaucauaugaccuagguaaauauuuccugcuuuacaaaugagggauuaauuugcacaaaguuccauaguuugagcuguaaacaaguuaaacacaccaauagaaaagagucccaaaagggaaccauguggaaauacaaaaccaccucauguauuaucagugugguaauuuuugaaauaaguauuuuucaaacagaagagauugcgucuuacugguuuuauuuugacccaacacuguccuggagcaaagaugaaguggcaaaggcucaucuagcugguugcccuuugcucucaugaaggaacaucugaugccuuacauaacauagcuugggaugcuguaaggacaagcacguugucucauauuggcugccaagucagucuuucccuuuaacugcuaaugcaaccuaaaaauaacuucauggauuuugaguaaaguaguauaaaccucuaggcucaaaaaaaguaauuacauuuauuuauuuauauguuggugggggcauuuaugccgaggugcuccauuggaagucagaggacaguuuccagaagacucuuguuccaccaugcguguuuagaauugauugugggaccuuugccccucaguaugaaagcaagaggcaaggugagcccaagggcgcccgggucucuuuccuggcagccgauacugaagacaggcucagugguccacucuuccuuguuguaaggggaagagaaagccaaacacuaccuucaaagucucccugauuugagcuagaguuugaaagggcgaacacuggagagggcauucggccuagaguuccagaggucugcggauggaucccuuaggcuaaguacuaaccugugcaugagugaaaggcaaaugacaguccaggaaaagaacccccagaaaacaguggggagccauuuccccagagcugauacaguccuaagaguguuuguuucucaccggugagugagcaucugaaugagucucgaagggucagacugauuucggguagcuuuauuaacuugugccaaaacauugcccaccguaaugaaaguggcgcaacaagaucuggaaaacaggaauauaaaguccauaauguguggcuuauaauagaagucuuuaaagcaagcaaggaaaaaaaagauaguaaauacccaggagaaugaaaagauaauaaaagcagauguagaagcgauagugucugaguuaggguuucauugcugcgacgagacaucaugaccacagcaccucucauaaaggaaagcauuucauuggggcuggcuuagaguucagagguuuaguccacagucgccauuacuggaagcauggcugcaaucagggaaggcagagguaacuggcggcaggaagaaagagugagccacugagccugccuugagcaucuaaaaccucaaagcugccccucccgacauacuucuuccaacaguggacccaaggcgcugcugcugagcccgugggggcuauugucaucacagauagagaugacgaaacaccaaagauguuaaaauaccgccuguaaauguguuauuacacguuguucuauguuucacauaugcaaguucucagaguagaagaaaacaugagcaucgugcagagccacauggaggccacauaaagacccagaugguaaacaccugggcagcacaguccugauccacggugaaaaauagacagcagauuagagcugguguaaggagagagcaguggacggcaagauguagagaguggugcuaaucaaaugaggcaggcauaaaagaguaggaggacaggggaaaaaagccauucaugucaugcugcucaggacacugagcaucauaggucaauuaguagcaacucuggucucugucuccaaggugugaguggcguuacccuguagggagaaaagcagucaccuccugaugaaaaucaccccccaagcucacaggucuagaagcucagugagcaccacgacaaggaaaguuagcaaacuguaccaauaaacaccauccucaaaaccauugaaagacaaaaaucuuggaagcagccagacugcaaacauggcccagagacacaaagguggcaagaauggucaccagcaucuugccaaagugaaggacaccagcuuacucuggacaacgacguaaaguucaagagugaaagucaguguuguugacuuacucuauucuucgauagugcgucugguuuauaucuuugauuuugagaccugauucugucuuccauuuaaucugcccuguguguaaagcuuuucccgaauguucuagcuggacuacagagcuuuacaguuccaucuacauuucugcuugaguucccuucacugucucuaucucuacugaguuugguuuucagauccccgggccuuuuucaucucauucagccuuccguuuucauccucugaggcauuccucgggcaugucuucccuuacuauucgccuagcucuuucuuugugucuuuaacuuccuuuaauucuuugauggaguucaaaaguguggauacuucauuccuucuuagaagggggaaggaacuauccaugaaggaguuacagagacaaaguucggagcugagacugaaggaaggaccauccagagacugccccacccagagauccaucccauaaacaaccaccaaacccagacacuauuacauaugccaacaagauuuugcugacaugacccugauauagcugucuccgagaggcuaugccagugccuggcaaauacagaaguggaugcucacagucaucuuuuggauggaacacaggguccccaaugaaggagcuagagaaaguauccaaggagcuaaaggggucugcagcccuauaggaggaacaacaauaugaacuaaccaguaccccccagagcugugucucuagcugcauauguagcagaagauggccuaguuggccaucaaugggaagagaggcucuuggucuuucgaagauucuaugccucaguacaggggaaugccagggccaggaagugggaguggguggguuggggagcagggggaagggaaggguauaggggauuuucagagaggaaacuagaaaaggggauagcauuugaaauauaaaugaaaaaaaucuaauaaaaauaaauaaauaaaaccauauacacuaaauuauuaaaaaaaaaaaaaagauguguaccgugggauucagaugguucucauuggagaaguuaggccugguggacuuggaggggauguaguguuuugauugucauauuguuugugguuuugcagugagaccuagaugugauuuuuuuguuguugguuuugugucucagaugaacaucaugaauuucacacaguguuuuguuccaagccuggauguuuagaagauacaggcaggcuucccaacugggcccaaacugggcuggagcacugggguggggugggguggaguccaucugaguauugggacagguguaaggcgccuuaaggauaagggguggacucacccggcuaugccacagcacagggugugacgugauguaaggcaauggaguugggucuugcagagugaaagugaguauuuauaauaugauuguggacauuauacauuauauaaaaaaaacucagacaccacaucucugcgguaaagauggacacuuucuauuaugaucagcaagaaggcugguggcauguaucaccaaugcuaugcaacacugaacuguaaauccuagccaacaacaggaaaaaguaguaagucacuucuaaauuggaaaggcagcaguaccgacucucuguauucagggguaacuugaucuuaaauaaugacaucaaaaggugaccgcuuuuuuguuuauuuauuggugcuggguuuuuuuuggggggggugagcuguaacaccuuaggaggugggccacugggacacacaccuuuggggauucuaacccagccuugcuuccauucuguccuggucuguacguagugcacugagcucggcccccugacagauauuuugucacugggugugaagguugacucauagauuauaccaaagaaaauauacacacaacacauaagugagugaaaagaugcuuaauaucaaggaaacuggauccacgcuuaugaaaggggcugagguucaucaaggccaccagugcauggauggauuaaaagcaguugaccagggcuggugagauggcucagcgauuaagagcacugauugcucuucggaaggucccgaguucgaauuccggcaaccacaagguggcucacaaccaucuguaacgagaucugaugcccucuucugguaugucugaagacagcuacaguguacuuacauauaauaaacaaacaaacaaacaagcggucaccuuuugaugucauuauuuaagaucaaguuaccccugaauacagagagucgguacugcugccuuuccaauuuagaagugacuuacuacguauuuuuccuguuguuggcuaggauuuacaguucaguguugcauagcauuggugauacaugccaccagccuucuugcugaucaugccugaugcccacagaggccagaacaggguguuggaucuccuagcacuagaguuacugucagaugugagccaccacauagguucugggaacuaagccuagguccucuggaagagcacuaaauguucugaacuucugagucaucucuccagcucucaguuugcauuucuucaaugccauguauguuccaacucuauccaaucaauggggcggagauuuaaaauauaagaggauuaaguagagugaauucuuacuuuguacuuguucuuguauaaagaaaagcacucucagacuuauggcagcuguaaucucagcacucaggaggcugaagcaggagcauggccaugaguuugauuuuauuaaucaccuuaaaauuauuacuagcaugaagaauuguuugagaguaaaauuuuaguguuccuuagcaaacuguuguuuuauacauuuucaguaccuauugcauuaguccgugugucuuuuuccaucuugucuuuucuuccacagguaucagagaagaagggaaaagaaggcaguagugguuucggugguccgguuguuaguucucuauaucaugaagaaacaaucagguaauuuccuuucugauuuuugaugaugaaguauauguacaacaugcaugcaaugcauguuaugugugcaaauaguuucuauacguauguauuuuaaucugguaauauauaaccuaaaacauccuuucuuucucuuuccccuucuugccuuuguuuguuuuuuguucauucuuucuuucuccuccuccuccucuucuucuucuuccucucucucugucucugucucugucucugucucugucucugucucucucucucucucucucuguagcccuggcugucuugaaucucaguauguagaagaggcuggccuugaacucagagauccuucugccucuccuuucuauuugcugguauuaaagguguaugcccacaccacuggcuuauucauucuuuuaccuggauucugggaauauacuauuuaacagcucuauuaguuuuugugcuguguaaaaaugucauaauccuuuuucuucaacaccacgugagucaggaauggaauccugugcuacuuuauggaguagucuuuaagauugcugcuuuacagacuaaaggggagagcguuuaaugccuuuauucuuuuaguuaaccaaacauugccuuacuuccucuucaacgucaaauguuucaaauggaaaacuuggccuccccaaaauuuacugaagggaguuaucugucuucuuaucuuucuucuuaaaaugaagaggggauuguaucaaaaagagaaacuaugaaguuuaaccguaucagucaaugaucuuuauuugugugguaauuuaugccagggccccccagaaugaaagcauuuucuaaaauggcuugcugauuauagucucuuuuagaguauuggugaugugaaugaucaguaacuuggcagaacaaaaucagaucaaauaucuuccagugaagugagguagcacucugggaagaguauuccugagauagauuuaagcugauuugaauggguugauguugcggggcuuuggggauccugcuuaugagcuaauaacaaggacacagaaaccucuguguaguacagagcucuuggccuguuugccgggacagucuguuggcuaccccaccucaguuaaccugacuucucugccacugcaucucuucauauggcugucuuugcucuaccucccuacccuucuucccuucuccccucacccacuuccugaagcaggggcucuuagaucaaaucugauggcacagaauaauauugcuuguuuuuguaaaguagauuuuuuuucuuuguguugccuggggggggggcagggaauguugagacgggguuucuuuguauaccccuggcugucuugaaacucacucuguagaccaggcuggccucaaacucggaaaucugccugccuccgcuuccugagagcuacgauuaaugguguguaccaccacacccaauuauaaaggagaaauuuuaauucaccuuaccacauuuuuauauaucugcugugagacagaacauggauauuugucucuagcuucuucacuuuuuaauaguguuuucuuagugcuuuuuguuguucuuguucauuuuuugagacagggucucucuaucauguagcuccugcugucugaaacccacuauuagaccaggcuggccucagacucagagaccccagguacuggggauaaggcaugcaccuccaugacaagccaugcuuaguaguacuuuuguugcuuucuugguuuucuuaagacagggucuccuuugguccaggucagccugaaugcacuauguagcagaggauggccuugaacucauccucuugacuuucuugccuccaucucccgagugcugggaucauagguauauuccacauuugcuuuuucuuaguacuuuuggcauuuucauauauguauaauaaaauacuacugagcccaaugugaacuuuugcuauauagguaaaccugguuagacuuggccuuaguucacuaauaauuuuuuccugcacugaaguguuggauuauuacaguggggaaccagguauacacuucuagaauuuuuuucauaaguauuaaaaugugguucaacaaugaacacacaguauuuccugagauuuaugccacgggcauuuggauaugguacuauaugguauuuggauaugguacuauaugguauuuggauaugguacuauauggcauuuggauaugguauggcauuuggauaugguacuauauggcauuuggauaugguacuauuaccuuucuaagacaaauugugcuuuaacugauguuauuuacacauucuuaucagaauuguguucaacugauaagaaagcagauuaaauguagaguuggagaaguaucaaauaauagaugggcgaaaggaaaguuuccuuuugcauaauuguuuuuuaggagauaaaauaaagcauuuugcagauuauuuugaguauucucaaguucaggaaagucagcacgaguuugcauagcucaggauccauugcucuggccuuccugcuaacguguuacagcugagccaagggccagguuggguuuguuuguugguuugcccuuuuguuucaaaucuuuguuucugccauauaggagauagugucccagaggccaaacaggagcaucuaguucugaaguuaguuaauuguucaguacuagaaagguuucaauuaaguuuauauaacuauggagccagauggaaccugagcaacguacucaucuguaggaugggaugauagugucuguuuccuguggcauuuguguggaauguacugaggcacacaagugcccuagaacaauaccuggcagaauaugcaucuccauaaagcuguaaacuuuuaucaacacugcuacucagcacagagggcaccacaagagaccaagugcugaaagucggaaccaaaaauuacaggucauucuucuuacacagcagugcaaacugcauuugcaagagauuaugggaaacuaggaagggaaagccaaucuguuagauuuggaaccuguguaauaaucuuaucauucaguuagcugccguucugagaugggcuguauuucguucauacucccaugugcagggggguacuguaauaagcacagggcucugcacauggugcagucaucagaacgccuucagugugcagugaacagcugcuuguguuugcucuagaagucagcuuauacauugaaaaauuagggcaagaauucaaaacagaaaaaaaggaaagguauacugcuuagccuauccugcaauaagauuuggucuucucuguuauauuuuguaguuugaugccucauaaucuguuugaauuuuaauuccucuuacucaggcaggcaucuggaccuucguaagcaagaccagucuaguauacaacugaaaugauugaugggcucuggaauugauuaguuguucugugagacaaaugaaguguuuuggcagaaaauaccagaggucauugcuguggucaaacaaaaaagcauguagaauuuuaaagagauguuugcauuguugacuuacaaaguucccauuuuaaagcaguaauaacauuuugagacuauuuugauaaauaacuuuucauugguugcuaguugcucucuaauuuugauuauaaaguggaaaaauguaaguaaaaacuaggaugaaaaugacugcuuuguguuuuguuuucuugguuaaaauauaaacuggaccgaaaggguaggagcuugacaccgaugcagaaacuacuguggagguuuugggagcaauaugugauuggauaggcagcagcaugacagaguuuuauugcuauuuguaagaucuguugguauaaaauucuacguaggauuuuauucaaagccuucaguuguuuuauaccaaccuggguuuugcaggucuguuuaaggacuggcauuguuaaacaugucuuauguuuaaagauggaggacucggguccuaaugcuuucauuaggcuaagucguuaugagacaccacugucgcagugacagcacuguucuuagcgcuaagagcaucuguuuggcugguuaguguaauccuucccuauuucacuguugcccgugaucaacacuguguuaacacuuuggugaucggugauaaauuagaugacauaugucuuguuacagucuggcuguuccuugaggauacacaaguguguacaggcaagugggcaacucucucuugaggaucugacugcucggaaugaacuugagcuauggauuuauucagccuguaaaaccucagcuggcauaaauaauugagaaagcaaagguuugucuguggugcauccucagggacucagggccuccuuccugcucucuaccucccuuucuuaugaaaaugaucccaguugcacucccagauaauaacgcaccaagcaauuaaaagccauggguggcuggagagaggagaaaagguuuaguuaaugagcuuuuccucugcccgugcccaugagagccucaggaaugacaaggcgauuaaagcaaagagauaauuauagauuaugugaaaaugggucccuggggacuagcaggucuugacauaaacaguaaguguuguaacagucuccuggcccuccuagucucccuuuucuaaugugcuucauuuggcuucugaguguucagugccacgaugccaaccaagcauacaggcaaauccaccuguuugcagaucagcagcucuuugaaaacgaggucauucgucagccaaagccaccaucuaccucuuuaucuccauguuguguucccuuuucuuuguucccucucuuagcacuuguacacuuccugccuaaucccgcucuccuuccucuccuguccucguccuuagggggugacuuguguauaaagccuccuguguguuaauggacaugcacauaaaaggcuauaguacguaguuuugaagacaguaugaccauugcaauaccaagagaaacugucggggcuggagagagggcucugcagcuaagagaguugauuguucuuuuugagguccugcguuugauucccagcacccacgugaucugacucccucuucugaccucugagcaccuuggacacaugguauauggacauacguauuggcaaacacucauacacauaaaauaaacuuuagaaauuaaaaacaagagagcaguguaugcauuauaaguaauaggaacaaggucccucacugucucuuuaagaauagucuucucuuacgcuuucgucacuuugcucagaucacagugccuuauuuuuauuuuuaaaggucugaauaugauaaauuaucccacuuuacaacguauacuaaauuauuauauauuuuagauaaggucugacauagcccaagcuguccuugaacucuuucuugauccuucugcuucuaccuucugcauauucugcagcuaauauaaugacacuaucaucuauugacuauuuauacucacaaucauacuauguuauaugagcuauugcacuuuaauuuucauaguggcuuuauuaauguagauguuaguggggucuguauguuacagaugaggacacaaauucaagguuagguuauuuguccaaggucaguugugguuaguagcucuccucuaguuucugugccccacuggauccugaaaugguuguacagacauuguaauuguaaauuaaugaaauuuauuugauauccaguugguauucuaguacuauacugucuucaguuuuaaaauuaaauacuuuuuucaggauucuuuuuuuuucuuuuuuuuuucuuagauauuuucuuuauuuacauuucaaauguuauucccagcuuccccuccgaaaauccccuaucaccuccucccuccccuugcucccuaacccaccuucacaggaccaagggccucuccucccacugaugaccgacuaggccauccucugcuacaaauauagcuagagccacaagucccaccauguguuuucuuugguuggugguauaguuccaaggagcucuggguguacuaguugguucauauugauguuccuucuauggggcuucaguccccuucagcucccuggguacuucucuggcuccuucauuggggaccuugugcucuauccaauggaugcuugugagccuacacuucuguauuugccaggcacuggcagagccucacaggagacagcuauaucaggcuccuaucaucaggcucuuguuggcaucugccuaaugucuggguuuggugguuguuuaugggguggcugcccaaggugggcagacucuggaugguccuuccuucaggcucugcuccgaacuuugucuuuuucaggauucuuaagaauauaauucccugaaaaaaaauggcgcuagucucucauuuauuacugaacuggugaugcuuccuuuguauuguuuuauugauuuucaacucaguuuaaugguugggaauguuaacugacccuagagaaggcuuuuaacaaagcagguauaugaauuuuucuggugaauuuuuccagggguagaucagaauuuuuauuuucuuggacacauuuaaaguaccacaguuucccuucaacuuuguuaagaggcagguuugauuuuaaaagguagaauggacuuccaguagucagugucuucauaaaaucgcagauaaauaacuuuuucaauauaacuaauuaucuuuacccaguaggcaacuuccaaauaucuauuugacauguaggguuucaagaauuauuuuaagacuaacacuacaacaagccagacaguguguaagggcagcaugccuuaaaugugauuccuguugaagcuguuuuccuccacagggucuuugccucuuggucuugcaacagaguauuucaggagggagcuaugacuugcaggauuuuccugaggcucacagcacaaacucucagugaugguuuuugauaaaauuaagacucaaaaccaguauucuauagggcaaacuuaacaucuaagauuuuaauuacauauuaaauagaagcaagaauuuuuaauacacuaaauuaacccuugcuaggaguuggcuuuaccugaucagcuuuacuaaaccauuaacagauucuccuuucagagagacaucugggaguuaaauggaaauguaaauauuuccuguugcuaucuuuuggcucuggauaguuuuaacacagcagaggaagguaccugcagcugcaaucugcugagcauccacaagcagagcagucucccucccucccucccuccaugagugcucaccucaguaguguaggaggacagcguggguuccucuuaccccugauauagacgguagggagcuuacccaacucuguucuuccccagcuaaccugcuccugcccauucgugcagggcccauacugaugguuguccuacuuccuccucaguuguuucuggcauccaacacccugccacggacuguggcuucuuuuuuuguucauccagucuuuuuuauuuuacuuuuuauuuuauuuauuaggucucacuugcaaacucaccuucuaaugcuuucuuugaccauccuucuuguuauuuauaucuaauuuuauuuuacauucacaaaugaucauguauguauguuuaugggauacauuguguuaucuugauuuauauaugcauuauagaaggagucaagcaaguuaaugucucugucaccucacuaauaugucaccguuugagguguagacuuaaaauucuagugauuuuauaauacacaagagcuuauguaacugugagcauucugccgugcaguagcuuucuagaauauguuccuccaguguaaccaaacuuuguugcuuuaaccaacaucuuuguuucugaccuguccucccucuucuagucugagguaaccacucuucuugcuaaauugaugugaaguguaccuuuaagaauccaccaaagagugaggucauacaguguccuucuguguuagacuucuuucccgcgucauagugucuuacauacggcucuauugcugugaagagacaccaugaccaaggcaacuuauagaagaaaacauuuaaaugagguuuacaguuucagaugaugagucuacuauuacaguuacgguggggaacauggcagcuggcaggcaagaaugacucuggugcaggagcugagagcuacgagggaaggagggagggagggaaggaggaagaaagggcaaguguguaugugugugugugugagagagagagagcaugcaugaguccacucccagugacacaccuucuuuaacaaggucacgccuccuaauccucccuagcccgugcuugggaaccaaacauacaaguauauuagacuauugagccauucucauucaaaccagcacacauaguuuucuguggucccgccuguguugccucagacaguagaaucuucuucguacacuauguuguguauguaugucacguucccuucacccagccauucauugauagacacaggcugcuuccauaucuagacuauugaaauaaugcagauacaaacauggagugcaaauaucuccucagauuacuuacuucaacuccuuuagcuauacccagaaguacacuugcuggaaacauggaaacuccauauuugguuuuugagguaauucucauuuuuucaaaauguuuuauuauuaccuguauacagugguuccuuuccuccaugcucaccagcacuugucaacauacaccuucuugguaauaacuggucuaguggcaagagacggaucucauuguggcuuuaauguacaauuccuuucugauuagaauuuaaauuuucaugaggccaugggccauccauauuacuucucuucuuucuuccccccccuuuccccuccuuaaccccacccacccaagaaaugccuguucagaaaugccuguuuuccauuuuaaaaucuagguauuugucuucuuaccguugaguuuuuuuuaguccuuuauacauuuugaaucuucuuuauuuggguagcugccucuuggcuucucaccacuccuguguagaauaccgggucagagcagugguacccaagcauccuuuuguagugcuuaaggaguccaggaaacauuuccacuguuuaauaauuggaaaagauaugauuuuacuuucuauaaaugauacaauuaaaaaauaaacuucaaaaauguggcuaaugaaaauuaaauaagguaauaauaauucuuuuuuugcaaaaauacaugaauguuaucauugaaaagaauuggacuggugggauugcaagcuuguacaacuacucuggaagucagucuggagguuccucagaaaauuggacauaguacuaccggaggaucuagcaauaccucuccugggcauauacccagaagaaguuccaacugguaauaagaacacaugcuccacuauguucauagcagccuuauuuauaauagccagaagcuggaaagaacccagaugccccucaacagaagaauggauacagaaaaugugguacauuuacauaauggaguacuacucagcuauuaaaaacaaugaauuuaugaaauucuuggacaaguggacaaauggauauaucuggaggcuaucauccuuagugagguaacccaaucacaaaagaagucauuagauaugcacucacugauaaguggauauuaguccagaaacauagaacacccaagauacaauuugcaaaacacaagaaaaucaaguagagggaagaccaauggguagauacuucauuccuccuuagaauagggaacaaaauacccaugaaaggaguuauagagacaaaguuuggagcuaagacgaaaggauggacuaucuagagaccaucccauaaucagccaccaaacccagacacuauugcauaugccagcaagguuuugcugaagggacccugguauagcugucucguaugaggcuaugccagugccuggcaaauacagaaguggaugcucacagucaucgauuggauggaacacagccccccaauugaggaacuagagaaaguacccaagagcugaaggggucugcaacccuauagguggaacaacauuaugaacuaaccaguacccccagagcucgugucucuaguugcauauguagcagaagauggccuagucggccaucacugggaagaguggccccuuggucuugcaaacuuuauaugccccaguacaggggaaugccagggccacgaagugggaguggguggguaggggagcagggcggggggaggguauagggaacuuucaggauagcauuugaaauguauaugaagaaaauaucuaauaagaaaaaaaagaaaagaauuagaaaagaggugcguaggauugcauucuccagaugcauggaaagcuucaguuaucuccaaaaguuaagucauaucgugaccuugauucaaaagcacgugagugaacucuauaaagaaaauuuauauacauuuucuuauguuucacuuccaucuucauuuagaacuaauguguuucuauguagucaacauauuaucauaguucucuacaacaaauauauauauauguugaaguuuuuuaaauuguguuuucuguaacaucaguguuuuaaguauuuuuuuucuauuugagcuaucuuuucaauuauuauaucuguauauuugaucaaaacacauuauacauuuuguuaaauaauuaacuauacaugcguuuuaaaauauuaauggaaacaucucugaauaagauaaaugagcuuugaggaauaguuuacauuucccugugcuagguauuacccaggaccuagagggacuuggcgggugcucaccacugaacugcaccucaggcccagguccuggcuggaugagaaggagcagcacucagcaagcagcccguugucagcuuccucucuuucaucaucuuuuucgcugccaucagccaugaguagguccugauaccagguuucaccaaacucuguucuugguagcaaggguuuuguuucuuggagcacagcaacuaaugcaguguuuuauuucacacuuccuuagugugucagauacgucucucuuagggaaagaguaaaugacucguugaacuaacagucauuugcuacaccuagucaagucuuuggcuguguuucuuacaugugacauaaggccagaggcagaggccuuuuacaaaccaagaagaguguguuugagugaaggaaacccagggugaaagcccuguggacagaagagcacagugggagggguuugcuuaggagacgcuggagaugggaugggcucccuuaagggccuggccugcacaucccgagaggucuccuccugggccucugcuuugaguaauuagcagcauuuguuugugucuuuuuggaugcggucuugcuugucauuuaagauaagauguaagaggguaaugucacaggagauugcaaggcugaggcaggaggauugcagauuugaagccagccugagcuacauagugagauccuguuuacaggcaucaaagugauuagggaugcggugugggaauaacgguuugauuuauucacuuguaaauaaaauaguauuuuggugugaguaucaauauauguauauauuuaacaaauaagaccaagaguaucuuuaguuuuuuuaauauuaauuuacuuggcuuugucguacauuugcagugauuuuauuaaaguuuuacuauuuaaauugaauacuuuaccauguaguguuauuuuagaugccucugccuuaccuauuuaguaguaaaaacugccuauuauaaacagguauuagauuuuaaaaugucugcugcuuuuuagaaauucccauaccaaaccaaauaauugauauagguaauacaucuaaggaacauuaaaaauauauuauuagacaagauccgcaauugaguaagucuugugcuguucugagugcuaaggugcaggcauggaugcgcaucaggagcuaggcucaggauggagcaaguuaacugcccucucccuuaugaguagcccuugcguaguaccagguagugguggccuggguggccucugguuuuccauucugugccccaccaccagcuucccauuauucccaagucaaagcaguuguucccaagacgauuaugacuuaagaugacauaaucauuuucuccaacaguugagauuguugccucuugaaucccaaggguccccguuguucccaaaauggaaauagaaauguucuuuuuuaacagaaguaguauugacauugguagcuaauuauagcuaaaguaauaguauauacagccauaauuguaaaaacagacuuuucuaggguuuggccucaguuuuccacaguuuugcuuuuguuguuguuuuuagggaucuaaaaggacacuuucaauucuguaaaacaagagaugguuucguccuuaaagcucagcucgcugucucuagcuggaagcaggccguuccuuuuuuuuuuuuuuuccuucaguccuuuugcaaggacacguucugccuuauuuaaugauacuuagaguuuaucauuuuaacuguacugucuaugucuauguccuuguuuagucuuguauccaauugacauaaccuugcccagugccuucguguccuggaugcacgcugaaacacacuggaugcuucagaacggcuuaguguucuuguuccgaaguuguauguuguaagauaauuagcuaugauuguagcaauuuuucacucuacauaguuauucagauugucuauuaagauacacagauucugauggguuugauuuuuaaaaaauaaauaguugauaaggucugauaaugucuugaacauaauaaaacucauuaauagccaguugguagugguauacaacuuuaaucccagcacauaaagaggcagaggcauggggaucugaauucaaggcagucugauccauggagugaauuucaggacagccagggcuacagagaaaccucgucucaaaaaaaaaaaauuuuuuuuaauuuaauuuggaaauauaaaaacauucuuuuauaccuguccauagaguucaguccacauguuagagauguucauuuuuauauucuaaauuacauauugccauuuuaugagucacuaauuacaggaauaauuuuauguaauguuuuugagguuuuauuuauucuuauuuuauguguauguagguguuugcuugaaugugccagcugugcucuauauguauguaauguccaugucagccagaagagggcguuggauccacugggccuggagucagagacaguugugagccgugugggugcugggaauugaacccagaucugcuggaagaacagccaguauucuuagcuguugaagcuccagcuuuagguaauauuuuagagagcuuauagaccucauacugacagaaucugcuguaaauucuggaauggacugugguugacuaguggaagcacuugauauaauagaaaauauauuauauuuuaaaaucagcugcucugagugaauuuuaucuuuacauuuuuaaaaacuauguguacaugggguguauaugguauaugcacuugggugcauaugucacagagaugugucagaugccccuggaacuggaguuacaggugguuguaagcugucaaggacugaacuuagauccucuuuaagagcaagcaguaugcacucuuaacugcugagcuaucucucuagccccacagcuuuguuuguuuugacguuugauaaaugugguaucauuugcaaaguuacuuaaccucucuuugccuguuaagugagguuauuauaaagaauaaagacuggggagaggggaguggggaaggguuugccucacaagcaugaaaacugaucucagcuuccaggccuaggguagguguggaauaaucccagaacucaagagcagagacaggagaucucuggggcaagcuggccagcuagacuuauggaauuugugaacucugcgaucagcaagugacccugccucguguaaaugaaagaacaauuaagaaggacauccacacaugcacacacacaggugugcccucacacugugaacacacaugugugagugagugcaugacacacauauacaggcaaaaaaaaaaaaaaaagaucaaaugaguuuccucauaugacauauuuagaauagcauuucccuccaaaucgccauguuagcacagugcugcucuaaaugaaaugcccaagucacaggaguguacugucaguauaugaaagugacuggggcaggacagggugcagaaaacccaccaugaggcaacuuuagagcaggugaagucuuuccuacaaggaccacgguuacuguaguccuuuuaggauucauuaugucagcugggaauuuaaugcgcugccugucacuuuaaacccauuaaugucuauguccucagaggacaacuuauguuaagaacauguaaccuuuguguuuuauccaguaggacaaacaacggcuuuuuuuuuuuuuaacucuaauuagggaagaagacaaaaacauauuugauuacugcagggaaaacaacauugaccauauagccaaagccaucaaaucgaaagcugcggaugugaauaugacagaugaagagguauggaaagcaagcccugcugggcuggggucaugccugggugcugggggggacccgguauuucuuauguauuugguguuccacugcaaugccacuuucucacugcugugccucucugcuacauaugacucuaaguggaguauggccaaaggcaucucagagagcauuguccaccuugcaaauuaaguuaggagaugaaacuugacacagccaaguagcuuccuuuugucuguaauaaaggagaggagccgugaacaugguaagugauaucuguagguaacagcagaguuucacuuguaguagucuucugcuaugcugcaaauagguaagugcagucauguguugaguuuuguacagaaauauuucuggaaaucugucagaauuuugauaaauccaguaauuuaaacacuggcccacuauacuaaaugauuuuguagaacauacuaugcaguuuauuuuguacauaaaguugcuacauauuuaacaguugaauuacaguuaacaaaggaauaaaauuugcuaguuaacuuuuaaugauuucuuguuauauugugacucuguacaagaaaauagaaagggucauagggccuuggagguguggugugcucagcuguguagugcuuauacagcaugugcaagaccccagauuccacccuugccaccaacaaaacaacagagaagggagaggcuaauaugaaauggcuaaaacauauggcucuuaggaagaagacacagaguguuugcaggccaucugcugcagguacagauaauaacuguaugcaguuaagagcucugucuacggggcagucuuugauaaacccuuaccuuuaggaggcauccucacugugcucuguugucaaugacuucuggaauugaaaguauaaauuacuauucuacaaauacuagaauacauuugauucuagcucaccugaggccaaaacuuugauuucucuuaauugcuucuuuuguaauuuacacauauaauacuagaugauauacuuuugucuuuuccauuauuaaguuccuucuguuuuauauuugcacuuaccuguuuuaaucaucuugcugucugucuuucuguacccucuuaaauuucagcuuucugguugaauauuaaauugguguuuaugauacaauacuuaguaaauacugcuugugguugugugacuguacuauguauauuaaucaacuuuugcuguaguaauaaacaacucccaaaguucaggagcuuauaaucucuugcuuauauuaccuucuugucauggauaauaacauuucacauauucugauauucuuuuacuuuguuucccguuugguggugaucuuucagaagggcuugggauuaguugaggcuucuugcuagguucuccuggcuuuguuugggcccaguuucucuugauuucauguggcuuuucucacaaagguaaaagaucaaugaauuagauacugugguauaggaacuaaagauaggcacagcuaggcaucccucuucacacaccccaaguccauaaauguuuuacuagaagugcuguauagcacaucuaccuaccuuccuuuggccaaaacaagucacaagcccaagacucuuuuuagugggauguucauucugauuacaaacaagcaaggcaagaaagaaucaaugacuaacugcauaguaauacccacuuaccauggaacagcauuguuucucaagucaggauuacuucugaauuuguuuuucgucugucuucguuuucucuguuccuaucaugaguucuuuccuccuguuacucaaaagaaaguuguuggugcacucagacucauuugucuuagauccacaccuucuagggcgccccuuccugcuucaucgcuagucccuacaagcuggucuugaccuguugcguggauaucaucaugggccuuuuccuuuuuacuguuuggaaauuucuccucucucuuugccuggcuucguguuuucugggucccgugacucuuuuguuguuuacuuccuugauuuccuucauaccuuuuccuuuauuauucauuucccacucuugugggucacuucuucuaguagcuuccuuuuuuaaaaaaaguauaaauggcuugagagcucacugaaaugcucucagaauucucagcguacucccugacuauuuaaugaacuaaugaaugagguccagcagagcacucuccccucugggccuagaaaggagccgcaagcaggagaagcugugcagguggccaguucauggagguuaugcagcaacagcccugccaucuuucuucccucucucccucccucccuuccuuccuuucauccuaaauaguuguaaaggucauauccacgugugcucucugcaaagauuggguagucagaguaagucagugccuggaacagaaacagcauauacauacaguccauuucuguugaugaaccuggcagcacuugggacgcugcuccugaccguucaguguuugagcagcgcugcuccucagccuucggguuucuuacccaugcagcugccgagaccccagccugccagaacauuguguucccaugaacagaugaagugcuuacacauucauagacugagacaccaagaauucaguuggguucucacauugcuccaagcagauuucugccuuuucaaccaugacaacgcaggcugagcuuugaauacuuauggcaagcccuuuauuaucaaucagggauuucuaugaauuaauuuaagaacauggggacuuggagcuuaaaaucagaaucaaauuugauauccuaagugaaauaaauuguagugcuucauggccuuuaaagcucugacaaggagaacauuugguuagcguugaugauacuaaaguauauaccucaaaauugugcuucucggauguaagaaaguuuaguguugaaagggaagcuuucugauguuugaauuuaaggcauuucuguacaaauuguguaggauuucuggagacaacauuauccuuauuauuuuuauugaaaauacucgccuaacaaguucaaacaauuuuagucuugccuuuaugugacuaaaaauuacauuuauuauauguaaaauuugcugugaacuauauaaacuucauuauagucauaaagugaaaagaauacauaauaugaacuauugugcauuaaaaaugacacaauaaauuguuaaauaauuuuaaauauauuaaucauuuuaccuaagaugcagauguguagaccugacuaucauaacauaggaaaaaauguacaugaaaugccuuucaacuaagcuguguuugucuuguacacugaagcuaccugaguaucuacaggcccacauucauccacauucacuauguaauugcuaaugacauaguaaagccagagcuauguuuucuuuaauuuuuaauuuuuuuauuuugcugugugguugaaucgagggccuuaggcauugggauacaccuucagcccauggcauuuuuuuucaaacaaguuuuuuuauuuuuugagaauuuuacauguaugcuuaauagaauauguucauauuuaccacccaagacauguauuucucauuugagaaaguaauauggucuuuuuuaguuggcaugauuaggagauaguauuuuacauaagaggaaaggucuuguaguuauuccuucuguucaagaagauuuucugucugguguuucaaagcccaaguuuauaugaacguggugucacauguacuggcuuuuacauuuaaauuacaacuuuuacuauaauuuuaauaucuacaaauguuuggagcuugaguauaugagaaaaccugaaggguugacuucauuucauauacuagcuuauauugcuacagcucgucauacauaccaagcauucacaguuauuccaagaaaaucuuguuuucccaaaagauuuauuacuuuuuuuauuuauguguguguguggcuguguguggcuggcuguguuaagugcucacgcauguguagugaugucuuugaaggacaggaaaaggcaucagagccccuggagcuggaguuaaaagcacucauagacuccugaugaguguauagacuaggaaccaaacuuggguccucuggaagagcagccaagugcuuucaaccucugcacuaccccuccagcuuccaagaaagugucuuuuaagggaggaagaagguguaaauaauuugucaaguauauuuauggcauaagcaaauuauuaugaaaaugggcauaaauaauauaauccuuaucuugcuuauuucuucucaauaaguuccauaaauaaaccuaauaauauuuacugaugacauuugauauuuuaaaucuuuacaguauuuugaguuuaguuuagaacacaguaguaguaugcuaacaaaguuagaggaugucuuaggguuuuacugcugugaacagacaccaugaccaaggcaagucuuauaaaagacaacauuuaauuggggcuggcuuacagguucagagguucaguccauuaucaucaaggugggagcaauggcaguauccaggcaggcauggggcuggagaagcuagaguucuauaucuuccucugaaggcugcuaggugcuuaggaagaucucaaagcccacacacacugugaagcacuuccuccaagaaggccacaacuccaaauaaugccauucccuaggccaagcauauucaaacuagcacagagggcguguucucagugugggucuaccaugaguccccagugugcucacacacaagucuugauucucuguacuuacccaaguugcugauguagcgcaguucuuucccuucugaccuccagagccacaguugauaucaucagcuacuuucuguagaucuugguucuuuuggauauuuugaaggucaccuuucugucgccccuccuuacuuccccccuugcuuuauuuuaaaucugugucacauagcauaaugcaauguacauuuuuggcucaagaaacgacuugaaaacuaugauaaaacugacaauguuaacccaguaggaagguaaagauuuaaguagccuucauacugaagcuaagugcaugcuuuuauuuaagauuuggaaaggaaaagaagaagaagaaaaaaaaaacccacacauaagguacuaauuugaaggaacuuuuguuuuccacgcugacugagaaaugcauuacuaacucccuaauuaugcacauuugcacugauacagacaauggcauuuaaaaaucagcggcuauaauuuucacuagcacuacugccacagucacacaucacaccagaaacucauacuugacgcugagucagaugauagcaaaguagcuugcagucgauggacuuugacaccuuguuuuguagauuguaagggacacaugccauugcugccggguuccugugguuaggucccugcagccgucaccaccucccacacagaacccaccccccucagcugcacucuguacacacucaguccugucuguuuuauuauuuuaauuuuuaagaaaaaaauuaagaguuuuuauuuuuaaaauaauuuaauuauuaguuuucacaaauuuauuaauaaauuuaaugacaauuuaauaguuaaaauuuauuuaaagguuacagaaaagacaaaacaaagcauucauguacuuuauaguaugcuuauuaagccauaaugguuuuuuguuuuuuuuuuuuuuucacagacaaacauauagacaaguaugcuacaguuaagagaccuucuuuucaugaaagagucagaagucgcaacguaauucuaggggcucuucagugacuuuucuuaguuuuggggccucugggaaauccucagcuccuccagcaaccacaaaugaaucaaauccccaucugaccccuuuaucaacaccuguggaggaagcaguguuugccgggccuguggagucucagucccugagcagcagcuucugcuggacaguugcuaauggugucuccuugauuuccacuguccguagugggaaaguuccaguuuacugugaccuuguuccuguuccuguccacaucuggggccaugucugacaucagucggaccucucaggacaaccccauguuuuguagcuguccacuagaggccuuaugccaguuggaucacaugauucugucuucuucauaguaucucaucugcuaauuauauggcacccccccacacacauaaauauuugauacaauggcaaggggagaacucucaaaaaauguauauauagcagcuucaaccuguccuuuuuuuuuaaucuauguuuuuuaucuauguagauaggguacaugcacuuuguauaugaucuccaaauaccauaagaauacucauaauaaaauauccacauuuaauuuuguaguguauaggagaaaaguuucauuuaaaaauucuacauaguuuaggacaauuaaagauaucaaagaagcauuuacaauauuaagacccacuuucuguuuccuagaagauauaaaaguaauagcacuuaauagguuaguugcugcugugcacuuugaaagcacuuuagagucauuugucugucuaagggaggacaugcuaacaccauugcuuaauagaugcgaacuuucucuccuugcauuuacugcauuugaauuacagaauuuacccagagcucuccagacagugcuuguaguguucugagguccuagcagaauccuuuuuaauaauaauccccucaucuccuaggugcuaccaagguaauuuuccaguaggauuuuagaacuagaaacaaagacguauuuuguaguaacaagaaaugcacuuagcuggaagauuuguauauuauauuacucauacaaauuuggaagaaguuuuugagcaaauguugcucaauuccuguugagcugcaucuuguuggcuuauggaggauguuaccccacaguguagccccugcgguugucuuccugcugugaggcugcaucucugcauuacuaguuauguucuuacugggaaugaucuccugcgagggcaugucuucagaaacgauaaccugaggagggaaagacgccgcuguccugacccucccucaucuaauuguacgugggggggggaccccaagccugcuuugcuuugucuguuggugaauguuuaccccuguucuuguuucugaacguuuuaacauugcauaaaguauuaaucauuagcuagucuuaauguggaucugucucuagcacuucuacagaaagucauugucagagaauuuauucuaauucaagguuaauuaguguaccauuaaaauaauguguugcaaaaauuaauugcagugcaggucagaauauguguuaaaaagcguagucugcgagugcaccauccuucuuaaagucgacugugcgccauccuucuggaacacgcauccgaagggagaaucaccccugacuccggucacaggugucuccucuaaaguaaauuuuggcaccacaugugacaaacuuaaaauauaaccccauuaaccgugaaaagugcugcucaccugcucucccauuggaacagugaaggauucauaguucagcauuaguuggugaaacaugauugggucagaccuaaggaacaucaggagccugcuugagaaguagaaauuaucuauacaucuugugguauaaguacucaguacuaaguuuucuaaugaugauauaguucuuauguacacucuguaagcuuuccacacaccuuaauuauucaguaagucuuauuaauaguugaacuuaguaccuacucucuaaauacuuaaauuagacuaaaaauaauaaacuuuuaugaucuauuucuuuuugagacagggucucuguguaguccuaucuaucuuggaucucacuaugcagacagguuggcaaagguuagcccaccucugccucccuuguguggaaauuaaaggggugugccaccacacaaggcugauuuacccacauuuucuaacuucuguuucccucuuuuauauuuuuuaugugugcaagauccuuuuuaggcuuuuguguaagaaggcagaaacucacagguaaguaaagucaguaagcaaguagaaaccauacaaaagggacucugcaaggaggaggcugucuuagccgcauacuccgccaggugaaccaaugcaugcauccagagaguccaaacggaaaaaagcagcguaggcagcuguagaaagguaccauggaggcugcauuuuaaggucucccuugucccaacuugaguauauuuaaaucuuuucugcaguguggaaaaucaucuuacucuuuaugaggaaucacugccgaccugagaggaguuacacuguacaucaccuacuuguucagaagagcccagcaacuuugcagggcuuguuuguuggaguaggaaaguaggccucauuuauuucauacaccaagaauuucugacagucagaaaccaaauaacacaguaauaguaauuguaauucuuugauagcuaaaagucaaaaguaguaugucaugcagccaaagacauggcuuggccaugagguuauucacucagcaaauacugugauuauauuuuauauauuuauuuguacaagucugugcacacauguguaccugcaugaagaucaaagaacagcuggcagcagucucuuccuggaaauggaccucgggucaucaggcuuguaacaggcaucuuuaugggcuaagccauuuugacagccuaacuuguauuacugauuuuguugucuguauuaccauuuuuccuuauucagguaagggaagugauuaaaccaaagcaguuacaggcuggugugugauaagaucagaaguagagcucagggcuuccugcugcuugucugucgcuuucccauagugcaucuuguaucauccucagaauaauugaucuacaguuuuacauaccaguuuucccaucuuucuuagcaugugaguucuguauggcccacauguagauuaacaaguuccuuugcuguuugcuacuuguagggcagagcucugcuccacugggcaugugaccgaggacauaaggaacuggugaaagucuugcuacaguaugaagcuggcauuaauugucagguaagagugcguuuaaaaggagcuugcucuuuuuuuuaauuaacauucauuacuuuuuauuguauguguaugggugguuuuccuguauauaugucugugcaucauguguguacagugccacagaggccagaagaggguauuggauccucucagaugaggguugugagucuugggaauccaaucuggguccucuggaagagcagccuaugaacuagcucugcagcccuuacaaaggagcuuuaacacacacacacacacacacauacacacacacacacacacaccccugcaguaaaauucucauaagaacaugcaugugauuaaaugccuuaaggcauaugucacugaaggcccugcuauagaguuccacaguuaucuucugcccacauccagccucaguccuacuaaccugcuuuuccucuggccuaguccauucaagcaggaucaggagguagguacucucuuguuuuguuucuuucucacacauauucucaagcuguguuuuuggcggaacacacuacaggaccucauuuuuuuuuaaaaaaagauuuauuuauuuauuauguauacagaauaauaauaaacacuccugcgugugccugaagaccagaagagggcaccagauuucacuaaugaugguugugagccaccaugugauugcugggaauugaacuccaggucucuggaagagcagccagugcucuuacagccaccucuccagccccaaccucauucauuuuuauggcuagauuacuaauauaugaguacccaguguuuccuuuauccauucaucaguugguggacaguguuauugcuucuaacuuuugacaguugaaauaauguuauaagcauuugugcauuuuuuuucuauuuuuaugcuuauuuuaauaccucuuuuuuggcuauuuugguuaucuaccuaaagguagaaugcuggaaucuuacacuaauuuuuuuuuuguuuuacagauuuaucuuuauuuuauguguauaaauguuuucccugcauauauauacacguauaugcaccaagugugugccugguguccucagaaagcauucgauccccuagaacuggaguuacuggccauugugagcugcagugugugaaucucugagaaucuagcccaaguccuuugcaaacucaacaaauacccccaccgcuaagccaucucuccagcccaaucuuuugguuauucugaauguaauuucucacauguaacugugaguaaucucuaacccauucucuguaggagcuauaccauaacuccccacacccugccgccaguguuugcugcuuccagcuucauuuguccuuagcaacacauauuuucccuucuuuucuaaaaagcgauauuaacuuuaccucagggugacaugauuuugauuuacuuuucccuaauggcuaagaaguacugagcccauuuuggggggggggugggguaagacaugggguuuuuuuguauagccuuggcuguccuagaacuugcucuguagaucaggcuggccuuugccucccuagugcuuggauuaaagguguguaccaccacccaacucuuuugguauauuuuaaaauuuacauuuuuaugaaccuuuuguucaugucuuuuaccuaauuuauuauuagauugauaauuuuagaagaauuauauaaacauuuuaugugucuuaagacaacuguauauauggccugcucaugcuucuucccggagcuuucucccuuccauggcuucucugugccaccuagaauuacccuaugacuuacacacauuaacuagagauuuuauucuguccagaugccuagccaguugcuguaauaauguuuacuaacucaccugccugcuucuugugacuugcagcauguuccuuaccuuagucucaggcuucaucucaguuuaucagcagcaucuuccucaccauagucucuggucucgucucagucuauccccggcuuguccucccggcccauuacuguguccuucugucccuccguagguucuuaggccguguucuuaaugagcguggcuucaaaugugugaacgucggauaagacgccacuguucauucggaaacuuuacaguguugcuucucuuuuuguaaaugugugagucuucuuacuuucacuaaguuaaagcaagccaggggugcauuuuggucugcacacaauuguaaacacgucaaggguacgcuaaaaaaaaguuucuuuuuuugucuuuuuucuuaagauuuguuuguuuguuuauuuuaugugaguacacuauagcugucuucaggcacaccggaagagggcaucagaucuuauuacagaugguugggaaccaucauguggcugggaauuaaacucaggaccucuggaacagcagacagugcucuuaacugcugagccaucucuccagcccucaaggguacuuuaaaggagagcguccccaugugaggcacugucugagguuucugccgguucuguuguugggauggcaaauagucuccaucucugccugugcacugaacaccagcuuuagugcagcugagguuuccuguggguuuuuaggacagaucgguuaggacagcaugcuaccugucacaggguuuuccuugcucccugcauucacguggccauucuguguuggucugacuuuguucucggugauuauaaucugaccucucuagcauugggaaugguuuggcucugucagucugaguugguaacaggcgagucagaaggauccugcgcucgggucucugaagggcuuucccacugucacuucucuuuugguuuccuuaugaacagcacuuuucaaguauagacaaugcaagcguaauaaauggaaguaaagguucaccucucucaugacucaaucuuucuuaaacaauauuauuauugacuggcuuauugguugccaaaaaagaaaaucaauuuuauuaggacuguuugcuuggccauagaucuugguacuaacccagcacaggcaggcugguguuaucaacugucugaagaauugccuuccucagagccuggaaugaaaucauuagagcugggucaggucugcucuguguauucccgucacuuuacucuuuggccuaucucauaaauuccuucacugaacugcacuggcuggauucuguggaauuggugagguuggaacuaaugucuguuucuaagaaagagccuuuaugaaaagugcugcaaggcuagagagguggcccacacaggcaaaacaacuggaguuugaguuccuggacccuuguaagugcccaauaugcguggcagccugucuguaauuacaagcugggagagcagagacaggcaaaucucuagaguaagcuggcuagguuagcagagucaucaggcuuuggauugaauagagacccugcguggagagugcccaggaagcacaucugacaucccuggccuacacacacacgcacacgcacacacgcacacacgcacacgcacacacacacacacgcgcacacacacacauacacacacacacuuaugcaugacauuccuccgccaaccaaaaaaaaugcugucaugagaaaacuacccugauucauuuucuucaauucuacuuagaaccagaaaccagcuguauagauuuuauacauuuuucauuuacuguuauguagagagcacuuuucugugccauuugguuuuuuuucaaacuauuuuuuauuuucuuuuuuauuuaaaugucuuucccaacuguagguuuuauauccuuggcaagacuagaauacaugguguaauuagaauauaugaaaaacuucaagauaaaugugcugcaucuucccaaaggaaccauuuuccuuaaagguuucagagugcaaauaauuuaauuugaaagaccuguaaaucacuuuauauauaaacauacaguuguagauugagauguagaagacacgugaauuacuuagccuaagccaggcaugauuuuaugaucucauuacagccaugaggaaaggucaggaaguagaguuaggaaacuuucccaguucuuuugauuuuucaucaguuuuuccuuaagagguaaauuuuaguuuagauuuagugucccuuuuuuucaguccaauacauacacaucaagugucccauuuuguaauuuaaugacauguuaaguuuucuuucaagagugucccuuaaagaaacacacucccaaagaaauaagaggcagccuuucccucuauuacaaaugcaggggguuuuuugggcaugaaauaauaaaggauauaugccauaaguguauauagauuguaagcguaucagauaucugcaaaugguuuacuguuuucagauucucaaaaucuuugacacauuuauaaaagcaguuuucacaggcauggccagucugcauccagagaugcuguagaugaucaggguugaauuggagucuuggaacuguaauagcagcaggauuuggcuggaacauucuuguugugugguauguuaaacuaccacauuucaucaacuucaagaugaaguucuuuccuuuacauuuuaacaucuugaaauugagaagcagcuuagucuuuguuaacuuaguaauacgugugucagagugugucugaguggagguaaccuuugacugucaguauugucaguucaguugaguacauccacuauuguguuggcuuuguuacuuaaaauaguuucagaggggcuggagagauggcucagcagguauggccacuggccacucuuagaggacacaaguuccguuccaguacuuacauuaggagauucacaaccaccugcaacuccaacuccagaggcucggaauccuccaaccucugcagggaccugcacuuauauguccguacccacacagagacagacacauaauuaaaaauaauuuagaaauaaaucuuaaaucuaaaaucuuuuuuuuuuagaaaauaaugacuauaauugaguaucaaaacaaacauguuauuguauauguugagaaacaaaaauaggaguaaauuuaauacuaguugagcaaauguucaucguacggagaauuaccauuagucuguauuuauguaugaguaugugagagaacaggcacacauagguuuucauauaaagagcuacacuguaugcuaauuaaguuuuuaaaacagauacuuuccuccagguuguuuuugguccugguguuuaucauagcaauaggaaggcauuuaggacagaaguugaugccaggcaauggauauugcuguaacagauuuaagcauuuuguuucggggagccugugggaauguuuagaauuugggguugcggaagccauugaguacucaaagcuugauaaacuauuuugugggaccuuggaagauuaaaguguugagaggaaauaaaggaagccuggauugugaacuuucagagggaagcaaagacuaucagggucauuaaugugauaauuugaauugaaaaucuguguuuucuagucagcuaugauuaacaagagaccaguacacugaagugaauccuuuuugcuacugggaaaauagaugccaauuaguugaggaugaaaaaaacagugugauuauuaagaggccagaaucauugaagccaaaucuucugggaaguauuucuccagcacacagggccagcacacagagggaagcaauccuauccaucucaggcuggauguguguuacaggucucccaccuggugcacacuuugaaggcauaaagaggucauggagaauagcuaaaggcuuggcaccauguggcagagucaaaguuccugcagaguggccaggaagccauuggugaaggugcagacuuaguugcuguggagaacccaguauauuggagauuccaggacuuggggaugaccaucagggacagugggagguguggcaugaagucagccugaacuuacaagacaggcuguguguguugugguggcagagccagagcaguaugguuuuccaagcuguuuguaccucagaaguucaugagucccaaguguuggauacugaguuauuuauaguguuagagcuguuuggguuuucuuuuguuuguuuguuuguuuguuugguugguugguugguugguuugauuugauuuuuacugugcccugauuauucauucuuagaauaagaaguauguaaccuacuuuuuguuuuacaggaauccagagcugaagaauuacuaagagauguuaaauauuuuauuaauuaauuuauuauuguuaauguauguguuuagccugcguguaugucuguaccacaugcaugcuuggaggcugcagaggccggaagagggcaucagauaaccuggaacuuaaguuaaaggugguuguaagccuccuuguucugggagaugaacuugaguccuauaaaagaccauccagucuuguaaucagugagccaucuuuccaguaucccugccaccuugcuuuaucaauuaauuuuucauuugagauauugaauauuuuaaagagauuaaacuuucaaaguauugaaaauuuuaaauacugugggauuaaguuaugcucuguuuuauauugugauacuggcauaagauauuggggauaaacaagaaaggaaagguuauggcuuaauagugauguuuuguaugucagggugacacaggugucaguuguguuguuuuauuuggggugggggaggauuguugcuguuuugguuugguuuguuguuuguuuuuguuuuuguuugaagcaggauaugucuauauaguccugucuauccuggaacucacuauguuaaaccaggcuggcucucagauauuuccugccuuugccucuugagagcuggaauuaaaugugugccaccauaucagcugccggcuauuuccuugacuaagauugaaauggaaagauacagcccacugugggcagugcuucacucuagacaaguuguccuagguuauauagaaaaaguaagcaggauguaccauaaagaacaagccaguaagcaauguuccauuaugguucuugccuuuguuuuugcuugaguuucugcucugacuucuucagugauggacugcaaaguugcuuuuaaucauggucuuuaucacaccccaauagaaacaacuuagacaauguguuuacauauguuccuucuuacuuacuuuauuaacauauuucagauuuaucuuaaaguguguguguguauguauguauguauuaugcaggugucuacagaggccacaggugucagcucacucugaagcuacaguucuuauagucagcuguaggcugccugaugugggugcugaaaccaaacuugguuccucuacaagagcaguauguacucuuaacuccggagucauuucucuaguccauaaauuauguauuuaaagaaauuauauuguguguguuugggugcacauuugccacggcaccacauguugaggucagaggacaacucuuaagaauugguucucuccuccuucuaccauauggguccugggaaucaaacucaagucauugggcuugguaacaaacacuuuaauccaucaucgaccaucuucuuucuucuguguaagguauauuuuagggacucugaaacacacacacauuacacauaauaacaauuuuuaagauuuuucaaaauauucucuugcaguucacauaacauauucuacgaguuacuccaucucauuucucugagugauuucucuuuuauucauacauaaguuauucaguauuauucuuugugcauguaacauacuuuauucaaagcccugucuucuaugaaugggcauguauguuguuuccaauauuuggcaguuaucaaccuaauacauauguauuucccuauuguuggaguuaugccuucagaguagaguucuggaagaggaauuagugggucaaaauguacgugcauauauaucuuugguagauguugucaaauauacuucuagaagaguuuccuaguucucauuuccccagcaguacaugaguaugccuguuucccugcaacccugugaaugcaucaugcuauuguauuuuuaaauuauugccaguagauuguacuuuuauauuuuaaauuuuuacccuugacagaacuggccucagugguacuagaguuugcauauuucuguaagugaaguguuaaucucgccauacgcuuauauguuugagagacaguuuauguccauuuuucaguaaauuguccacacacuccuaucaaguuuauucuuuugauguuuccauuuugacguauucucucuauauuaggaauauuaaucuguguaguauaugaaucagacauuucccccuuguuuuuauuuaugcuacuuuuuugcuguguaagugaaaaaaauuuaauugcuaaguagucaacuuaacagaauuuuuauugcccuggauauuaagucauaguuuucaaaagcuucuccuugcugggcaugguaacacaugcuuuuaaucccagcacucaggagacagaagcaagcagauuucugugaguucgaggccagucuugucuacacaguaaguccuggggcagucaagucuucauaaugagagcaucuccaagaaaggcacuagacaaauaauccuuuucuuacagaaaacuuaaagggauccauguucucuuuaagugcuuguaugguuucaugucuacauuuagaucuuuggauauguagugugagagucagauuuacuucauaucuuuccccaaaugucuuccuagucuaaccagccccaaugauuaacauggggccuagaagcugccacacucauuuccuguauuccuaugugcauuuguaucuaguucuggacacaguggagcuguccuggucucauauuuauguacacuauuuuaauuaaaagucuuuacagaagacuugacuaucagggacagcuauuucucuuucguuucucuuuuaaguguuuucuuggauguucuugccuuuuuaaaauaugaacuuagguaucaccauuuuacuccaaaaauuagcuuguauuauuuauacuggaguugcacugaacucuauccaaggaaaauuucaucuuccaauuugauaaucuauuuuuacauauucaggagucuuuagaauucaccucuaaagguuuuuccaauuucuuaaauuuguucuauuuuuguugcuguuaaugcuuugcaaacaggaaauuuuagauccugauauuuauacuuucguguugauuuuauuccauuucuugauuuuuaaguauuagaaauaaguucagggucucaaagaaacaaaccaccauugccacugacaugccuggguaagaccaagugcacucuugcuccagagggugugcccagcggggaggaugcagguaaggugaacacaggcugggaggauauggcgggguggacacaggcaguggucugagagaagcuggagcacaggaaguguggggagaggaaaugggagaaagugagaccuggaacauagcaaggccguugggggaccacaggcuucauugacuugggguuaaacguuugcauagaggucuugggggcgugucaaaagguuugaauuccuuguccuaaacacguuuuauagucguugauagaaaggacacauuuuugauauuccuuacauuaagucauugucaauauuuaaaauacucacauguaaguaacagugucaugcuacuaugcuuaacuuuccuauuuuccuucacguauuuccccucauuaaggagucauuggaagagccugggcuaauguguuaaagcaccuauaugauuugguguuauccuuuaagaauauugcaaguugaugagagccaggugugaaaacagaugcucagugccagaagccuguguguuuuguccuccaauuuuuccugcagacgggggcacuguggaagcagcuuuccccugcaaauuacuucuuaaugacuucucuuaauauuuuccaugcagucaguccucguaugaauuuuacuuucuuccuagauugcuagaguguuuugagaaagaaauguuuacuaguauuugagcauaucacccuucaaugagaaaauguaaaacucuucucuaaaaugaguguuugauggacucugcagaccccagagagguguguccagugacgugguagggaaaggaugagcagguggccuuuaaauccacuucuaaaagcagagcucuuccacuuucuguuacaggcaucauuucuacuccacacaaucacugguugggacaguuccauuuuuagaaguuuccuaaggcauugauugauuauagcaucauuugcaguuuuauauugaagaugugccuuccagauaugcuugaaauccuuaucaaucucagugcagugauuuuaauaauaaaguaauguccagcucuguggcuccuggucuuauucccagcacucaggaggcagaaacagguagaucucugugagcucuaggccagucuggucuaccuugugaguuucagaccagccagggcuacauaguaaaaccuagauuuaaauaaaaagaagaagaaggagaaggagaaggagaaggagaagaagaagaagaagaagaagaagaagaagaagaagaagaagaagaagaagaagaagaagaagaagaagaagaagaagaagaagaagaagaagaagaagaagaagaagaagaagaaagaaagaaaaaagaauaaauuagagccuagagaaguagcugagcaguuaagcauacuuguugaucuugcagcggacucacguuuaguucccagaccccacauaauggucacaacugucuguaacuccaguuuggagggauccagacucuucuguccuccacaggcaccaggcaugcacaugaugcccauacaugaaggcacacacauaaaauacaugucucauuuuuuaaaaaaaucacuauuucacuucaucugauugagcuuuuucuguauguucuuuagagccaaucaaaaaucaguauuagacacauaaaauaauugucuaauuuuaaaaaaaucacuauuucacuuaaccugauugagucuauuuuguauguucuuuagagccaaucaaaaaccaguauaaauaaagaaguaagugaguuuuuacuacaucagaauuaucaacuaauuauauauguuuuuaagauucucuuuauacuuuauaaaaguuggucaaaguaccaaauaccaaaaaaaaccuguaccagaauauuaacauucuuauguaauauucuuuacauauucaaauaaauuuucauguauaggguuaagucauaacguuagaacagugcaguguuguucuaacuguuguaaucagcacaauguagaauucccauccgccugucucacuggcuucggaauuaaaggaaauagauuugcacauuucuauuguuuuuaagcuuggacauugcugucuugauaguagaucuguauacuuuccguguucuuucuagcuagauaggaacacugcauuuagcuaaugacugguguuuuucugagaugauguaguguguguguguguguguugcucuuuucuugaugcacuuaugaauuuuuucuuucuuauuucuuauuuauuuaugcaaaucauucuuuggugaguuacugucuagugaaacccuaaaguagcccagaacgcuaacauaagaaauucuucugucucacugcccaaagaaccaguuuagaaacugggagaaaaggugaguuugcagugaacaaaagggaauaaaaaguaaaugaggaaaucagagucagagaaacugauauuggcagguuguuccuagaugagcaaucuuucaaaauacuucuuguacacugccgcuauuccuuuauuuauuauuaaaauaacaugauccaugaggagcguggggugacucucggccuagcuaauucuaauuaauccagucagagagcaguaggguaaguggagcagucuaucggauugaaauucauaacuuaauugaggucaaagucccggucugggagaacaaaagucuuuugcugggaccaggcagaucaauagcaauaaauaucuggcuuggauacaagucgcuuauagugacagauuaucugacacuggccagaggucuugguucuguuaagggcaaagucuugagcgugccaugguucuugcagauguccaguccauacccaugacacuuggaaagaagucauucucucagcaacucugggaagucuaagaaagcaguuugcuugaaccuuccauauggcuuguuauuaucaagugaaccuuuucuaaagauacauuucuuuaaauggcagaguguuucugucacauugcuggugagaccacagaauauacaguguugguuaguccuuuucaguguguauucacuauaaaaaguaaugaauuucauuaugacaguuuccuuuguaugccaaauauccuguccucccugcuacccucccucauuacccaccccucauucuguuccucuuuccaaauagucaaaguugauuauguuuuaaaaggugugugcaggugcucacagaggcaagaccccaggagcugguguuauaagcaguugugagccuuuguacaugggugcuaggagccaaacuuggauccucuugaagagcaggaagcguucuuaaccaagccauaccucuagccccuauuugaaacaaugcauagaauuguucucaagcagaaacauaauaaacuguguugucuuugucuauauauaaguguaacagugcgaaggacagugucagcguauaugaaggagugguauuaacucauuuagaugugauauggcauuguggucacauaggaauauauuuuuguuuuuaggucuauacugauauguuuagaaaugagguaauaauaucuaauucccuuauuagacaaaacaaaaagauaaacauuagaagcuauugaaucugaauaaugagucucuacuuuccuauauauguuuuuuuuuuuuucauacugaaggugacagcucaaaggcuggagagaugacucagcaguuuagaauacugacuguucuuccaguggaccugggauuaauucccagcaucccucugguggcucacaacuaauuguaacuccagauccaggaguugugacacuuuacacagacauacaugcagacaaaauauccauguguauacaauaaaaguaaauaaaacucaaaagaaaaacccauuaacagcuuagagagcauguacaaugaaaucuagacugauguuauaaaugguaugagaaaagguuuacugcugucucauucuguuuauaauuuccaggucucuacuuauccagauguaccuaucuugauguacuuuuauccauaacuucacuauuguaauuauuacaacauuuugaugucccacucaucaaucaauauuguugccacugagauucaacaaccuuccaacuauggaaaaauaaacccuuggggucagcaguuguuggccuuauggagugugagagcuugacagucaggauccccguguguuuucugacgcccagugagcuccagucucagccaguucaucaguguagagugaagaaggcuggcuccguggggaagaugccuuccagcagaacaaacaccagggcagccggcuccaggucauucucccagcauaguuccuguuaagauagauacugcccuuucuuuacauugagaccuacauaucucuuauaaguuuacacacacaccaaaauaauaaugaaacaauaacuccucuuauacuaaauuaggagaacaacaguacaguuuuuaguggguuuauaaaagccaaguauaggccaagucugauaucuuaaacaugagaaagcauagaaaaaguccuagaggaguuaacagggucaugugcuuccuggaaaacuuacagacuugccauguaauuuuaucaauccaacuuugggacagugucgcauugugcuuugcacauggagccucugcagaguccugcuuuaaaucauccacucuaagaccuccuuguugcuguuccugcaaaaucuuuuuuaaaaucugugguagcaaaauuuaucacugucuuaugauuuugucuguuccuagauucugggcggaguguugagcuugagagcugauguuuuuccuguucucaguacgugguauguuaguggacauagcacuuaguguguucaauagaagcaaagaauaaaacuguagaguagaaagaauaguacaucaaagaagugaugagugacaugguuuaggaauugagggaaauggaaauaauuuuuuaaaguauccauguauggggaugugauaugugcauggugugugcacacacaccuguguguggagaccugccucaacauugggugugucucuuuguuugcucucugugucuucauuuuuugagacagcucucaucgagccagaaucguguugaguugguuagacuggccaaccaggaagcuuccgggauccuuguucuugccuggaaggaaggugcuucaucuuuuuuuccccuuaauuauuuuauuauuugaaugcauuuuauaaucaaacauguuaauaaugaguauuuugagaaucgaauaauacauacaaauuuuguucaacuuuuacauucauauccuuucauacccuaaaaauagcauuaaugaguauuuaauacuaucuauaacugaggggccuauaucuaauauugaauaccaaauuguuucaaaacauacaaaauauucuuuagagacuaagcauauaguaaaagagcauaaaauacuaaaaaugaaucguuaaaaaauacauucaaaagcccuuauauguccaccugacauagugagagaauauuuaaaaagcauuauauaucuguguaauugucuaacaaucaguuuacuuaaaaaaauaucaguguuucuaggagagaaauuauuuuaucaguaaguauauuuuaaaaauuuaaaaauagcaagaacucuuugaaguuaaacauuaagaaaaugcuaauuucaagcacagugagaaaaauuaucaauaauauuuccauaauguuuguagaacaugauuuuaauauuuucaacuguuaauauucaacaaacagaauaguuauuuuaagauauauuuuguuguuaugccucucuuuucauuucugauuuuauuaauuuggauacugucucugugcccucugguuagucuggcuaaggguuuaucuaucuuguugauuuucucaaagaaccagcuccuaguuuuguugauucuuuguauaguucuuuuuguuucuguuugguugauuucagcccuguguuugauuacuuccuguggucuacuacucuuggguguauuugcuucuuuuuguucuagagguuuccgauaugcugucaagcugcuaguguaagcucucuccaguuucuuuuuuggaggcacuuagagcuaugaguuuuccucuuagcacugcuuucauugugccccuuaaguuuuagaaugaugugucuucauuuucauuaaauucuaaaaagucuuuaauuucuuucuuuauuucuuccuugaccaaguuaucauugaguagagcguuguucaucucccauguguaugcgugcuuuccauuguuuuuguugguauuuaagaccagccuuaguccauggugaucugauagggugcaugugauuauuucaaacuuuuguauuuguugaggucuguuuugugaccaauuauauggacaguuuuggagaagguaccaugaggugcugagaagaagguauauucuuuugcuuuaggaugaaauauucuauaacuauuuguuagaucuauuuggcucauaacuucuguuauuuugcucugucucuuuuuaguuucuguuuccaugaacuguccauugcagagagugggguguuaaagucucccacuauuauuguguggugugugaugugugcuuugagcuuaaguaaaguuuuuuuuuguuuuuuuuuuuuguuuuuuaaugaauguggguggccuugcauuucgaacauagauguucagaacugagaguucaucuugguagauuuuuccuuugaccaguaugaaguguccuuccuuaucuuuuuucauaacuuuugguugaaaguugauuuuauuugauauuagaaugacgacuggagcucauuucuugggaccauuugcuuggaaaauugguuuucaaccuuuuacucugagguagugucugucuuugucauugagaugcauuuccuguaugcagcaaaaugcuggguccuguuuauauauccagucuguuagucuaugucuuuggggaauuggguccauugauguuaagagauauuaaggaaaagugauuguuacuuccuguuauuuuuguuguuagagauggaacuaugagugacuaucuucuuuuggguuuguugaaagauuuuuuuuuucacuuuuucuaggguguaguuucccuccuuguguugguguuuuucaucuacuaugcuuuguaggacuggauuuauggaagauauuggguaaauuugguuuugucauggaauaucuuguuuucugcgucugugguaauugagauuuguguuggguauaguagccugggauggcauuuguguucucuuagggucuguaaugacaucugcccaggaucuucuagcuuucauagucucuagugagaagucugguauaauucugauaggucugccuuuauauguuacuugaccuuuuucccuuacugcuuuuaaauguguuucuuuguuuagugcauuugauguuuugauuauuaugugaugggaggaauuucuuuucugguccagucuauuuggaguucuguaggcuucuuauauguucacgggcaucucuuucuuuagguuagguaaguuuucuucuauaauuuuguugaagauauuuacuagcccuuuaaauugugaaucuucgcucucuucaauaccuauuauccuuagguuuggccuucucauuguauccuggauuuccugaauauuuuggguuaggagcuuuuugcuuuuugcguuuucuuugacuguuguauuaaugguaucuucugcaccugagauucuuaauucugucucuuguauuauguuggugaugcuugcaucuaugacuccuggucucuuuccuagguuuucuaacuccagaaaacccuuugugauuccuucauuguuucuguuuucauuuuuagaucuuggaugguuuuguucauuuccuuucucuguuugauuguguucucuuguaauucuuuaagggauguuuguguuuccucuuuaagggcuucuagcuguuuaccuguguucuccuguauuucuuuaagggaguuauuuauguccuucuuaaaguccucuaucaccaucaugaaagaucauuuuagaucugagucuugcuuuucuggugugaugggguauccaggacuugcuauggugggagaauuggguucugaugaugccaaguaaccuuggcuuuuguugcuuauguucucauacuuguuuucugauaucugauuaugucuagugcuacccgcccucacuauaucugacuggagccuguccuuccugugauccugguugugucagaacuccucagaguucagcugucucugugacccugugauucugggaucuggugaucuugagauccugggugugucagagcuucuagaagucaagcugccuuugggacucugagauccuggugugaccaagcucccaucauccugggauccugugguccugggcauguuagagcaccugggaaugggucuuccucuggguguugugaaacuagcuguggaguucacgcccaaggucugcuuggggcacaaacccagaccagaagggacccaugccgcuggucgggcagaguuccugguugccugggucccacuggucccaguuacuuaugguguuggggaagauauguccuccucaccucugauccuaugguccuggguguguuagagcaccuggguggagcuuccucugggugcuguggaacuggcuguggaguucaugcccaaggucugcucggggcauaggcacagaccaaaaggaaccugugccacugguugggcauaguuccugggucucacuggucccuggaaggugcuuuaucaacugaacucucucuauagucccagaaagggaaaaucucaauagaaauacuugacacuauaauauuguaauacuucaugacuuccuucauacaucugguuaauauguuuauuaguuuuauagagacugcuuuaaauguagugguccaaacaaauaugagccauuauugaacagcaaauguuaaaaacuuuguuuuagagauaaauuagaccuacucucuuucuuaaaagcucuguguaugcguguguguguguguguguguguguguguguguguacauauuucuguguaugaguaaagacauuugccaagguguguggugggggaggucacaggacaaccugaaugucagugcucuccuuccccuuuaagacagggucucauguucucagcugaguaaauuaggcuagcuggccagugcgcuuccaggacuuccucucucccugccucccaucuugauguaggaauuuucagauacugggauuucaaauacaugcuacugugucuggcuuuacauggguucuagguaucuacacucaaguccacacauuuccauggcaagcauuuuacccacuaaaccaacuucucagugccagauguguuuuuuuugguuuuuuguuuuguuuuuguuuuuguuuuguuuuguuuuguuuuguuuuguuuuguuuuguuuugagacagggucucacuguguauccuuggcuggucuagaaugccuagacagccuaccugucucucccuccucaaugcugagaacaaaggccugccaccaugcccagcuauucauacauacauauuacauaaguuuaaauaacuuauuuucuuugacagcggacugauauauuucaugaggcuguuacaugccuuuuuucaaacauuuuuuagaaaccuauuucuugauauaauauuuauagcacuauaaaugaauugacgaaaguacagagaauuuucuuaaacugguaggucuuaguuuguuaugagagcagaaggaagagcugagguaucagacaaaagugauaccuauuuucuaauagcgucuucuaacagaauugcagugggcuucuguagagaccaauccaaacugcacagcucaaggucugcacagcaagggcagaucuugcugcugguuuaugugccccuacgccugaagaguggccaagggacaaaugaaugagaacuacaggaacggaugaaguguggacuggggguugccauggcuguucucauguaggggaagcccuuugucauguggggccucuaucuguacuuuuacugaagaacccccuacaaauguugggggagauauaugcccaccaccucggugguuucagaauggucuguaaaccuucacaguggccucaaacuuuccuucugaaccuagaguuuuaccuguguucagauuaagcuuccaaaagauuuaguuuuuaaaaaguuuccuauaaggggcucuucaagauuauaaaaguagcgucuugguguucauccacuucgcccucacaccccacaaugaaauccuuauacgugaacaucauacacauccaguucccacguuagucagccuguuuauguugaguagucgcuucugcuaccuuuguauaugagaauuaacuggcucacaucuacugugaaucaaguucaaauuacuuugaguucagagaacacccaaugucauguuauuuuuacaucuaacugaauuauaggacaccaucaaaguguuguguccugauauaguaaauugcaccuucucaacaguccucuggcuacauucucucuugccauugcuaaaaccugcaguuguugauggcuuacauucuuguaaccuuaaaaacaaaagaauuguuuuuuuuuaaucccucaaauaaucaacccucuugaccuagagauuucauaccuucauaugaaucauaucaucuuuuaguguuuaagguuaauucuagccuaugacuuuuauuaauucuguaauuuucuagcuuuugaagaacucuggaauagagguggauuguacguacagaacaaucaccagaaagucugaugaucacagugaagaacucaugaauaguaagacuacaguguagugcugaucacacaggaggugacggcacugccugccguauuacagaacaggaagauaaucuagaaaagccacagcaaauacuguuacguaugugcaguuaucaaacuguuuuaauauaaagcauaaaguuuuggacuguugguauuucagaaaagauaaggauaaauuugaagagucuagaguaggaucuuuaaaaauuacuaguuugcauuuuuuuuuuuuuugaggcauagcguauggucacuugggugaugucuuuuuguuugacagauguguuauccacaaguguuuugguuuuaacugccgguuaauuucacagaagcacagguuugcuucuccuuaaaagacugaaauuaugcacccugggccgugugcucagacgacaucagucaccagagcucgcacugcugcccaccauugacaggccugagugccccaguuucccaccgugcagcuucucugcucugacccagacaaccucacacuaauguuuccugcucgguggcauuggagggguuaguaaccuguuguuuaaaaagaacagccuugcuuuucagauacuugguuuucaguuucuguuuugcugcuuuaauaaaucauaacagggaauccuaaagauagagagaaaugugcuggucaucugguucaacaucugacauugcagacauuucagcgcucaacauccgaaggugcuuagcccaacuagcccuuuaacuuacaaaggagcuugugccaguuuagaaagucugguuguuacaaguguucucuguugcuggauccaagucuaucacacucaagcacgugcacgcagucacgaaacccuuggguucaaagaagacaagacaagccucccucucuccugugauaaccauuguuguauuugaggacagcagucuuuuccuucccaagucaucuaaaccaauccuaccauuccacuugcacagugaaucgccuccuuucugaagcauauauauuuuaaggcacucaagcuguguauuguauuaggcauccucacaguagcacagaacagagccgagccguggaacaguggguggacagcaagggcaggcgucugucugcuuucuccuuggucuuguuaaaguaugcuuaugagaaaauguccuuagcuaucugagugaaugguuuuaccgcaaagcauuacacagauguaucaugauagucugauuucagcccaagcagcuauagaggguuuuuguaggcuuuguagccagccuauauuguagcuuuauuucaacuacuugauaucguuaaaacaaacaaacaaacaaacaaacaaacaaacuuuaaagguuuuaaagacugcagcucuggacacaucuugcuuguuuucuugcugguguaauggcauuugucaguguggucauacguuuuaauuuucugggacuugcagacuuaaucccaugagcucacuucuaauucaggaaagggucugagcugucuguguuguucaagaugccacucaagggcuucuccuucuguggagcuuucuaauggaauucagggcuccuucuaagggugagcauuacagaaccuucccaggcugcugugggagggauuauagccuggguucaaggacacgugcaagguuuaaugugcacagcgugccccugcucuuccucgccugccggcugugauuggcaagguuaacucugagaggcugcagccccuuagugauuugauuagacccagcacucugauccucucaccccucccuccucaagaacugcacagcacucuuugucuuuaccuugccgauauccuuuuuaucccaucccauuucugagucaacuuugacauuaugggaagcaaaauaaagaauucaaacagaaaguaacuugucuuucugaaacuuuaacacgacuuucauuuugacuaauggcauaagaaaacacaggcucaucaucauuuauccuagcaacucacauagauugacagaugucauuccccaaaccuccauuaagacuagguuugugcaaaugaguuucccucauggcggauguuuaaaauacuuuuuaauuacaaaagcuucagcaaugcuaagaaguaaaggucagcucccuguacuuggacacaccucugucuauaacucaguuuccuucaguuucagccacucccucugaccagucuuguucagucuuuacagcuguccuccugcaguuccucuggcaucuguggacgccagauggaaaaaaacaugcaaguccagauuuggaaacaguuuuaguagguguacguauuuggaagugcugacccuagauagccuagaacuuguauagacuaggcuggccucugccucuagagagcuaagauugaaggcuuauaggauucuuuuuaacaugcucccuuauuuccagguucaauuuguuucccucugauugcucauuaccuucuuuuuaacgaugaugcuuguuuacugauguugacacauuugggagacuuugagugucucagcuuuaaagcccgacaacucaaagacuuaucuggagcuccuaaauuauaauugauagcagaaaaaaaaacaaaaaaaaaaaacccaccacacuacauaugaaugacagaauaaaacaguaguuuucaggaaauaagauacugguauuuauucagauaauaacucuaauuauuuuuuaaaagcaugccuucugaaaaucugaaaauagccaauuaguacuugagcacgggguggucuuuccuccgcaugcugcuucgccuccuuugucagcuggcacuugacucagccucuuccugguacaucuguggucagagcaaccaguaagcgugugugguggugggaacucguaacgguagcagguugaggcagcaugaucuugaguucugagcugugaaucaguauccuguguaaacaaacaaacuggaaacaguuuuaauuuuauugaaaauaaguuuuauugaaaaugguggaguggccggcccagcaaauguccugaaauauuuagugacucuauuugacaaauaaaccaaaauaaauagaugccugcggacaguaaauauagaucaccuugucacccuuucugugagugaaugcaauccacguuuauuaacuggugguccugugggaguuugaaggcugaaaaccugaguguuuacccccacuguauguaucaaucccuuccagcagggcauacauacaucuguuuguuguauagcguuuguuggcuagaagcuguugaauggcuaauuaaccauaaccauuguuugagguuggcuuuauucaagagugucacugacaaaaucacuaacuguuguuuucaguauaucuuaaaacuuuuuuuuuuuguuaaaaguaaccauaaaauuugagaugcuuuauagauuuugcuauguuuuauuuguuguuugagcugaaguugcguacuugguuguuugagggugugcccuguauagaaaagccuacaugugccuaaacaccuguuuuaaagaggaaaaguuucuucuaaugaaaaugaucuccaccuacaacuuauuagaccuugacauacugcguuacuuaagaguucucagagaaaauuaaaaccccuuugacuggguuuugcaaugcagggaaauuuuuagugacauuuaaaaggguucucuugugucccucuaaugggauaaauaaaaaaggcuuguuuuagcccagcaaauggggggacaauccaauuuccuugauuccaucaagacacucuuaaagcauuagcugugcaguuaaaaaaaauuuuuuuucagcugacccccuuugccugauggcuuugaaaaguguccugauguguagguauuugcucaauacagcacacuugguuauugcucucccaacacauccguugauggaagagucuuaugugaagcuccaauaaaugucaguuucuguuauagaacuauaaaagcagugcagacuguagcggucucccaccugcagccucucacuugaagaugagaagaaacccugucaaguaagcuuaaauuaaagaauacaaugaaucauguaaaguagcauuuuagcaagcauuuugaucacuuuaaugacuucacuuggguucauauuuacuuuuguuguucaaaagguggugcugauuuacagagcuaaggacagugguucucacagaaccagccacagaagcgaaggaguuuugauucaguagggaugaagcaagaucugagaauuucaguuuuuuaaaagauugaacuaugaugugugcuuauuaaaaauauaaguuucuggguugaaauccccaaaauucaguucuaguaaaguacggguugugcuggugguuguuuuguaauuaaauguaauuacaucacuuccuccuucccaucccuuccucuaacuccucccuccacuuucugacuuuuuucucaaauuaauagccuugcuaucuuauuauuauuauuacacauagacgcaacuauauacaaauacauccuucugaauccauuuuuguguggcuugggucuaggaccuacacuuggauagcagcugggcuuaggaccaugcaucaagaagaguagccucuaaauuugagguucaaauucucaaucaaguuaauuacucugaaagucuuuaacaucugagcaucucuuagugugugagaaagggcacggcugcacaucaauaugucucaugcacccgcauuuauuguacauuuggcuuuauuuugccccucagcaaaguguaggugaauugaauccuuaguacccaguguuaagguggaaacucuaucuucuagcaugaagauagaauauuaccuucucuaguuuuauuagcuguacuuacuuagaacugcugaaauggucuacuuguacgucagagcuuagagaucagacauguuuuguucaucuaucuguaaaauaaauggaagacacaauguaaccauauuugacaagaagauaugugauagagauuugcugacuuaucuaaaagucaucgaaggaaaaccaagacugaaagagacuucagaaccuugaaguuguaaaagcccugggucuggcagguacuuccagcugucuccuggaagaauguguugcucuugucccuuugcugcuuaccugcucuggagaggggcgccaugcuccaugucauacaucaguacaaaaauuauacccuuugcacaaaauaauauauauuugcauaaaacuauuuuuaaguggagucuuacaugcauugauuucacauuauccucagacuaaagucauggaaaacugaacauuaagguagaggagcagaguccucucuccccagagggaacaagacuguauaagcaucaucggcauugucaccuucuaaaaauauuuguuggguuugugccuagcuuuggagcaaaaugcagcugcuuuacagaguggucacugacaguaccaucugcaucacuucagagccaguuugagaacagcucaagcugacuuggagucgccuuggguuaggugaaugcagucaggugagcagcacccgggagcccuuuaccauuucccuauaucuugugacuuccauucagccccaacuuucucauucacuccuuuuuuccuuggcuaaggaaagguaagccagguuaaaugacaaccugugcaugguaacagguauuguuagucugagcuguuccgcagauacagagauggaguccaggggagacucagagauccacggagcuguggcaguuaaccucucugccucucugauauccgacagcuggucugccgugggcccggggccagcagugucuuuacaggcuuuguagcagagauuauucaaaggagauuaaucgcucuaaaccccuuauauuuuaauuauuucuguauguauuuauaaagccugcagucugcuaguguuagagcacaacuguccaagacugucuuuaaccugguuucuacugccaggaaguguauuucugcuaccacaaaggauacacuuuugguuugcuuuuuuuuuuuuuuuuaaacuauuaaacuuguuuuuauuuugcuuucauuguuuagguuuucuguucaauguugacaaaaugacuuuuuuugaugaaggguaacaauuccaggguucagggaccaucuugaaaaagaaggcaaaaagaucuuaagagccagaggucagggaggagaaguguccucuggccaugacuggagcucacagcagcuguggcugucugcacagaucaagacaguguucuaacgccgagcagguagaggcucccaagcccccccugcuaauuaaggagcuguugaccacuccuggcuucugaagcugaagcccacauuccaggggacuucuguauagcuaugaguauacgggcaguacaaacuguauccaguagguuauuuuuaaaaaagaagaagaagauaagguuaagucagguagggagguaggauuguagaucugggacaaguugggcgaaggaaugggaggugaaaaaauauagaaguuuaaagaauuacugaaaaauaauaacugaaguuauuaugacuuauguuaaaaugcuguuuuguguuacaugauagaaauaugaaguaacagacugauagaauuuggaaacccucuaguuauuaaaaaacaguaugccuuucagaguguuuuuaagacuuaauuuuguuuauguauaugugucuguaugugcuacacguguauggguacacucagagucaggagagagcaccacaucgcuugaaauuguuacaggugauugugagcuacccaacauggguucugggaacugaacccuaguccuguggaaggcagcaggcaaucuugagccaccucuguuggauccccucccuggcccuuuuaacagugauugauaggcacgcguauuguacccuucagcauggccagguaaucuuacaucuaaccagguaucuagaacaaagguuuuauuggggguucuaaaacuuuggcccauauguaagggcucgcacaguauggaacagcagaggacugugaaggauccggaagcacgcuguguuggcacuagagcaucaggguucauggaagugcugccaaguccuuaguauaggcagaggugcucuacucuguugccccuuuuacauccagagaaaagaggggguuggagcacugaagcucuuccagcuucuaggggaccuuuaggacgaccuguauucauccagaaugucugcucuaccucccagcacuuguuuuagaugaguguaguguuggauacuuuuuaaaugauuuuauuauuauugugagguggguccugugcuguacauaccgcauguuggcagaggucagagggcaaccuuguggaguuggucucuucccuccaccuguaugaguuccagacaugcaacaggugugcccagcgaacagccuugcuggccgagcugucucccuagccccgcaauugcccuucccagucaccagacugcccucucuccuguuucuucauucuuaaucgaaucagcagguuuggggcaggugugcaaagggcucuugguuagcaaaaaauagcaguaaauaauguuucauucuccgugucagugguggcuuucuccucugcucuguaagcagaggugagacacacaucucauaaccugccgcguggauguuuacgcugcuauaggucagcagccuaaauuuaaguuauaauccuaagcuguggcuuacuguauuguuuuagacaauuuauuucaacuugcugaauuugaguuuccuuauucagaaauuggaucuauaaaaauugcccacuucaggaugcuaguugaaaaugaacuguuacauaugaaaguagccuauaaaaaaacauacaagcauauggcuuuuuuuuuuuuuugcuuuuucagacaagcaugucugaaucaagaagugauauggaaugauggguaguauaaagauuuuacaguuuuuauucaguuuauuuauuguuuauuauguguauugugagggugcacacaugcuacauguagagcucagaggacaacuggcugaagccaauuuucuccuuuuaccaugggaaucccaggaauggaugucagaucacaaguaccuuuacccacugcuccaugccgcugcuccccugguuacagcucuuuuaugacauccauauuuugugauugguuuugaaauugauguuaauugagcuuuuucccuugucuauuucuaaacaguauaaucuuuucuucccuguaauuguuauguuggaaagugucuuuuagcauaauggcuguuauagaguaugccauagaaauuaaacuauaaucuaauaccugguauaagcaaccuauguuguucauacaacagauucuuauauuugagcuaaucuaagcuuccucuauauguauccuuaauuuuaguguuaugccaaucuaaucaaaaccaagaaaagugaaagaaaauuuugucggauuugaagacgacuagaauacacuuaaaauuucauaauuaggaaaaucccuacaaaagggaaaaacccagaaguaugagggcugcucuuguaggaguuaguagaugaggagguuagaaccuggguacagcaggauucauuacugugaaaaagaaggauccgagacaguacagaugaauccagccaacgucacaccaggaagggcaucuuuaaagucaugaugaaggaguaggcucuuguucugcaugaugacuguggagggcuaaugugggaucccugaagaaauguccuuaagaaaagggagucaucaggcuagagagauggcuuucuugguaaaguacuugccauaugaucaugaggaccugaguuagaguccccagcccuugcugaugugugucuguaacccuggucuuagggaggcagaagaacacuaaccccugauaggccaagcuaaccaaaacugugagcucuggcuucagugagagguccugccugagaaaaugaggcagagaacagaugagaaagauacccaacauugaccucuggccuccacaugguaugugcaccaauaugcacacaccuacacaaagauguaugcacacauacuugccacauauagagacgcaaaaaagauaguguaagacaugcaugcauagagguguuuuuccaaaagaugagugauagacgaaugcugaaaaaucuccauguaaacauggaaaugcacaggaagaaagaaaaacaaaacauggcgucugugcaguguugaagcauaagcuguagagcccgagaaaugguuggaguucacucugccaccuguaaaucaugucaccuugggcaagauggagcuucagucucaucacuugugaaaggagaucaugaaaugccuacuuguuggguggguaaaauaaaacagcaaaccuccauugccuagugugcugagcagcguuugccaugacugucaucucucuacuuaggaauaaugaaaauuugugugggauuucguuguuguucagccuauaguauacacaaacaauguaugaaacaagguauuauuaaagcuguguaggacaugggauagaagaugguguguauguugcugguaugcaauucuaauacauagcuggcuuggguggcauuuuuuuuuguacuguauuagaaauaagaccuucauuuguucuaaguuguauagccauacacaaagguuaccuaaucacagaaggauggggaaagagggagaauagagggauaaacugcuaacauuuacugaaaagcuacuccuuuaguacagucaugcagucccuuuaauaaaaccaguuacuuaugccaggaacuguggcucacaguaguguccucuggacuauauggucuuuguucaccccccaccccaccccaggcuuugugcccuacucuuauugggucccaagcaaagcggauuauuuaacauuucuuuaggaagcccaggcaaggauuuagaaggaccaacaugcacauuaaaaauugagguaaacauuguuccuuguuuguaaacauuuugaaaaaaaaaauucccuaaaaagagaagaaagcuugugaaugguaauaaaaaucacaauugauaauauuuguaggcaaaugguucugaauaaauuauaagacucaaaaaaaauagagauuguggcuugaagguacauggaggguuaacucucugagcuguaggagcagauugugucuuccuuuugugaucuggucugacaagacaucaguauucuauucaucuguugggaauuaggccguuaauccaaucaaugacuccugagugagcuguggccuaccucccccacuggggaacaagcggaucaaacugcagauuguuuaagagcacagugcuguccucaugucagguggaauucucaaacgcucccuggugacuuggggauagggaaagcugucuuggcccauuuauccugcuccuuaaauaaccagguaucugccucaucccuaggaaagcauuuggcaguaauggcacaggggugcuauagaaauccauuaaccuuaacucacaaagaugugggugaaaggaagggacguuucaaauacccgcaaagcacugagguaggguuucccauuuuauucauauauuuuccuacuccacugcccuauaucauuuucuuugcuaggaugcuauuauuauuaauuaucauuuacucuuuugugucauugaauuuuguuagccacuaccagcucuuguguauuuuucuuacccuggauguaugcuuguaagucagcagguuacaaauaaauuuuaauauagauuaugggaacacuaauuaaauaaauuuuuaauuuaaaaauaucuuucucugaggaaugcuaauuaaauaaaauuuuaauuguaaaauaucuuagucugagcauacauaauuuugacaucuuuugcagccuagcaaaauuugauuucuaauuacugguguaauaguccauuaagugcauuuggaaauuauuauugaacugauuagacagaggcugagaguugcagguauagucuauaaaauacugucccaaaguuuuucugcuaaccaguaaggugacaugagcuaccaugggguaaauuauccaaacuggcaaaggaaaaucccacacaaagaaguuacauaccuucccagucuccaugauguuaagcuuaagcaauauuuccauuguuuccuaacuggauuacauuagcauauuccagaagaguucuaaauaugucaaauuuauccauucacucugugaauggauagcuacuguccuuuguguauccaggcuucugaguuccaagucaccacagugaaggaccaaagucuaugcucuugguauagcaguuccuagugagcgaagcauaacaaggcagucucaguggugcuaagagaugaagaggaggguuaccgugagcgaugcucaagugagacuaagguuuacuaaggugacaguuaaaccuaagguuaaaugaagaaaagcccugccaaucaucuccagaacaggagcaucggcaugcugaggaccagggugaugugccugucuccaggaccggcaguuuccagccagcuaaagcaucuucauuuucuuaagaacuugugaaaauaaagauaucagauugucccuggaaacgcugaaggccuggggcugagccaaccagccugcaacgguguugaaagccauggagucccccucaacccacugugcaugccugugucacaguaaggaaaaaccuuacugaaauacccacgcuugcuccucugcacacagcugcccacacucccucaaauccccaccuguuucuuuaugauaguugcagccaauuuaaagaaauuuuauuaaaaauacauguuaugauagaaguaacugguuuuuuuuuuguuuguuuuuuuguuuuuuuguuuuuuuuuuuuuugagacaggguuucucuguguagcccuggcuguccuggaacucacucuguagaccaggcuggccucgaacucagaaguccgccugccucuuccucccgagugcugggauuaaaggcaugcgccaccacacccggcagaaguaacauuuuuuauaaguugauaagucugcacucagagcauucuacugaugagcuacuucuauggcccauuaguaguguucauugcaugcauggaaaagcacaacuccguuuccugauugugguguugguuuagagagugugaaugaagauccagauaggcuccugcauccauuucuuuucuuccuccuccucauuuuguuuuuguuuucaagagucauuuugagauguuucaggaaggaagaacaugaaaucuggaacuuggcuuaugauacucaaaaaagaaaaagaaauaaaugaaauagauaucaaaaucuuuauaguuauugaaucugagagaugguucaguggaagauuuguacaugugaaguuuuucauuucaauauuaaaagaacaugaaauuuuuauguuuaucuaaaagcauaaauauuuaaaaguugagaaacaacuuacacuauaaaggauuuuucuaaacuugagaaauguuggcauuuucuagagcguuuaggcugugucuugacaugggccucgucugcaggaacaaucuguugugugaaaugaggccagcucgcagccucccagaacuucugauuuaaacuuguuuuguugggggaauaccugcuuauuuaggauuucucuagcauuccgaauauuuaccuuuuuuagagaagcacucauuaucuggccccuagugcaaugaagcuuagcuucauuuaccuccccaaagcuuaacuuucaccucaguguuuagugaaaugggggaaagagagaggcaguuucaauccugccuucuguaagucuaguaggauuauaggauaaugucacaauaagugaagagguaagcccaaagucaugucuaaagguaacauaccgcuuauuucaaguccccugacauaucuuaugcagccagcaaaggccacagguaccugauccagcugcauuaguacagacagcucagggccgagccaaauggggaagaaaguuuuuacauucaggaacaguggcucuucccauagcaauaaagggaaaguaaaacaaaggaaaaacaaaagaaaaacaaaggaacagaaagucuaccuuuaaaauggggucuuucaagguuuauauuuauguccauaauuagaccacuucuauugucagaaauaugggaaaugaaauugagcauuuuaauuauauuuuauuuuaauuagaauagaauuacuuccccccuucccuuuuuucucuccagccccuccgauguccucuaccauaccuccucauucauggccucuuauuuuuuuuauuauuguuacaauuauuguuauaacuaugcaugugugcauaauuauauaacuacaaucuguuggcuucauuuaauauugcuuguguauauaugauuccagggcugaucacuugguauuggauaaccaguuaggggcguauuccugggaaaaccugauucucccuuucucagcagucauuaaguugccuguaguucuuucuuuagggguggggccccgugagauggccugcuguguuagccugucuguugaugucacuguggggucaccuguacuguugggguauucuccugcuuuucucuugcaaucucacagcagacuucuugguccugugacucuuaaaaugucucugccccuuccucggcaugcucccugagccuuugagacaggaguuguauuguagauggacaauccaucaucacuugauugaucucugcauuuugaucagauguaauuuucuguauugaugacuauagggauaagaaugagucuaggaugcagcuagcaauuacacugauuuaguaaaggggugguaguggguucuccucuaacggcagugaccucagcuuggccuuaaguccaagcagaucgcuguuggcuaccacggagguaugugcaccuuucagaguaucuugcugugcuguugugguucauagcacagcuggguggagucccuuccuucucuugguagcccgaaugucaccugguccuaucaaagcuggaacucuuucaggucaaaucuagcuugaaucuuccaaauccugugucagcaguaugugcaguccucagugauagggacuuaccuccaacucuaugaagcaaccaagggucacagcaauagccguuuugagagugucuuggauuacccugaccaacaacuuuaagaaguuuucucaugucucauacuagguuuuuguuagacuauuguccuugaggaggacuauugucaguccaagaggcauaacuuuauuuaaaguguguguguguuguauaugucauuuuauguaaauauaagauaaugugauuccuuaaggcuuuuccaagcaucuuuggugguauuugucccucuccaucccuuuuccucuguaucacccuccuucccuacuuucugcucauuuccuuuaccccuuuauguaacauagauccuagugauccuauuccuagcccuugcugcucccuacuccuccugccugcacaacuccuugauucuguccugguuucugcaguuacuccagguuauagguuacaucugaggauauagagcuaggagugcucacaugagcaagagcaugggcauuuuuuucuuucugcagauggguuaccucucucaauagaauaguuucuacuucucuccauuaccuacaaauuucacauuuucauuuuucuuuacagucaaauaaaauuccauaguguauaugcaccacauuuuuguuauguauuugucagucguaggacauuuagguuguuaacauuucuuagcuguuguggauagagcagcagcgaacauagcugagcaaguaucugugggauaggaugucagguccugugggcuuguaacuagaaauggugugggugggucauauaguagauuuauuguuagcuuuuuaaagauuuuccguacugguucccagauggcugaacccauuugcauuccuagagauagugaaugagggagggcucccuuucccggaggcucaccaguuuuguuugucaguuguuuuguugaucuuagucauuuugacuagggugaaaauuuuaagccaacaguacaguagcauuaagaaugguuacacuggggccuagagagauggcuuaagagcucuuguugcucuuccagaaaacuugaguucaauuccgagcacccauauggcaacucacaaccacuuauaauuccagucucgggaucuaaugucuucuucuggccucagugggcaccaggcacauauguagugcacagacauucaugcaagcaaaacagcaauacacauuaaaaauaauaaagaaaaagaaaaaauuuaaaaccacccagauuaaaggaagcuagcaaaguaauauagguuauagaaugacaucacaaugucuguacugaggagaaaacuuuauauucuuuuccauuuuaugugggaguagauagcuacaauuugucaauauucuacuucauggaaauuuuuuaucauaauuaaaagaguaauugcuagaaauuuaguauauagucaaccacagacgucaauaaugucaacauaacuguaacaacugggcaguuguuaggcuccacauaaauauucucauuaacuauucuaugaccuugaugugccaagauacuaggagacacaaaagaaguaugaguguagucucuguccuuaggucauuuccugucuaauggagacaguaaggagcucauuaaacaacuggcagauaguagcagaccagucuguagucacgugccauaaugagagagacgcuggaagugcaguggugaugagagaacugagggaaaucaauaggacuggaguagugagagccaugcuucagugugagcuguggccgacuugaauugugagggaggccaggugaugcuugacggaugcucacgggaggcugggguagguagcagaagcagcugggcagaaugggagaguugaacaugcucagaucaaaaugucucccccgucgucccccuccaccuuccccucucucucuuuugcucuguguguguguguguguguguguguguguguguguguguguguguguguguguguguguguguguguguguguguucaaaacagaaacauauugucucucaucucuguaggccagaaguccagcauuaguugugagaugcauagguugcuccguuugggaagaaagaucccauaucuucccaucuucugguggccuggacuguuugauggcuuguagcucuagcauuccaggcccaagccaucuucuuaggcuuauauuaagaaagguucuuggaaaaaauuauaaaauguguuuucaaauuucuaaauugacagauuaauuaucuacuguuauagacauagaucugagagguacacagucuaagcuuagaaauaucacuuggaauuauauuauauaaaaauucaaccuuuuuuaucaccacaucuaauuccucacaaacaguuuucuugagcacuuccuuagcgugucgugucucuacauucucuuccuucugugguguaugugugugugucuaacauggaauaaaaugugaugauuuuuuagcaugcuaauuugcuguaagcauuacuauggcucuggagaagggcaggaagacagugaagauauuauuguguuccagugggaauugguaaagcuccugcauuuggguagaaaauguguauugcuuucacacagguacuugaauaggcucugaacaggcugguuaaagagugcugagagaaaauauuaaaauuagguguccuuaaaagugguucuacugcuguuacagaggccaguugauuauaucauaacugugcauuguugaggggacaagaacacagauuuaacagugcauccuaacagguuaaggacuucagaaauaaacaucaguauuaugauuaaauucagagaaacacauugaagaagugguaauuuaauuuaaaaauguuuuguucuuuaguuuaacuaaagcugaagaaacauaacuuuaaaaaacauaagaaacauuaaaagacagaaaauaaguuauuuaaacagaaaagguggaaucuacauggagaagacuggucccuggagacucguccuugaggacuguguuuugucccuggucccucugucucucugucucauguuucugugaagcaggccucguugcccugacucucaccagggugcuccuccuccucagcagcaauagccacaaacaaugggaucauggauuggcaucuuugaaacuauaagacaaaauaaaaccuucuuuuuuuuuaaaaaaaaaaaaaaggauauuguuuuuucagugucuuaauguagguuaaauuuuucaggaaaaaaauucaucuguaagugaugcaaauaaugacuuuggugauuaggcguauucuuaccacggauggcgucuaacugaaaagucuaggagcaaagucuaggagcaaaagaagccaauaugaacuugacucauucauguauuguuuaauaugucuuaaguucuuagaaaaagcaaucaaauaaauuuagaacuguuuauauaacuuuaauaaguuuagaacuauaaauauaacugucaaaaaggaugcaguauuuauauguaaagauugcacuggcguuugcuguugagugcaggcucgcuguuccucugcuccguucuacagucugugcaggcacucgcuccucagucucaggccugggcugcgaggcaccucaaugcuaccuacacucguccuuguuucauuuuaacuccugugcacacuaaugugucugauccugcuuccugccuaaaccucaaacccagauaauucucuagaccauuaccacauuuuaacuuaauuccucaucauuuauuaguuuguggugcuggagaucagaaccaggaucuuuagcacccuagguuguaccccugaguaguuaacucacuaauuguuuuuuuuuuuuuaauuuaguuugugggguaugugugugagagagggaggagggggagggaaggggaggagaggggauaaugugagucucucucucaggauaaugugauccugcuggccuggcuguaauucaccgugugacccaggccucaauuucuccuauuuucucuguuuuccugauccuuaacauggcucucaacccaguccgaaucccagagcuaaucuuuuuuuccccaggguuuagcagggacugagaguggcagugccaagauuggagcucacagccaguuccuuccauuuccagagaaugacuuucuuucuggaaaagacuagcuacugccagcauuauuaccgucaagguuuuauuuuuaauuugcccaaaaagaaauauuaagagauuagugggcccuggcauuacucucaucacuuccuuuugugcauuuaugcauucaacagguaguuacuguugccuacaacguaggcacuguacuuuuacagcgaacauaaagccagucuuuguauacacccaguauuuaaagguguaaaugccuaugaacaagaccaccuaaagacucuuagccugaccuucuagaaauguccugguguucuuccuccugugccuacuggucaguuguguaagaaaacaucccaggacaggguggccaaggaguguugaggcaacuauucauuuuauguugggaagcucuugcugucuguuguuguucuaaagaugacugauggcuguccucucucccucacagugcgguacuuauccacuuccuggcagucuggauuccugcuuucuauuauuuucucuguuguugcugaguuauuuuacuguccagacuggugucuggcuuuccaccgagcccccuuuucuguccuuuccuucucuuuuccugucuuguuuguuuaguugguuaguuuuguuuuuguuuuguucuuuuaaagaagauacugucuugcaacagauguucugguccucuggcucuuucugguuuuaugcccccauucugccuuccccaagccuuagguguagggaucauguuguaaauguguuaaacugggagugggcacuccagugaucagugguucucuguauuuugacccaguauaacuuuuguacuaggcucugucugcugcaaaaagaagccuccuugaugaaggggcagagcugcacuuaucugugaauaugagaauaaguuuuuagaauacaguuagaaauuacacugacuuaaggaaguugaaacgguagguucuccuuuaagcccuuggucucaccagccauggguaguuggguaaguuuacagugugaggcaugaauuccuuccugcugggugagugaguccacguagguggccauuggucuccaccacuguaagugccgcuguuauacccccagaauaucuugcuggugugcuuuguaagcauuuucaguuggaugagacuauugauggcuuuucuccuuuggcagcuugcaucacugcugauauuaucagggcuaguccucaggaaagaggcuccuaggucacacccaguggguuucugcaaguccucguaggccuaucguguauguguugucagcaauagggacuucagccucugggaagcagucaagguaacagcaauugucuauauuauugggaguaucuuggacuuccugaccaacaacucugaagaagguuuccuaugccugguacuggauuuuuuuuuuguuuuguuuuguuuuguuuuguuuuguuuuguuuuuuugugguuuguggaauaggugcagucaccccaaguaguguugcuuaaaauacaugcauguauauuuacacacauuuuuauaaauauacacauauguauuauaaauaauuuuaaguaaguguaaaauaacauuauuccccaugguuuuuuuuuucaaacauucuuguuccuccuccuucccucccccaccauaagucuccuucaccaacccccaccauuuuuccuguuuccaccuucauagcaacugagucccaccagucccucucuagaguugcuuucccuaacugagauacaaguauuugggagagaaaucguucagcacuaguuguucuuccacaggaccugaauucaauucuaguguguguuauaaaggcaaagugugaccucuuguugccuucucagcucaucuuccaugaagugagcaauucauuauuuauagcauguuuaacagucuucaucugcuguuuucucuguacccagauccuguggccagguacuuugugccaaagccaaaaaagucagucaaacugguuuuccuucaaauaguuuauuuuccuuuaaucuuguuuaacuuuuauuauuauaugaagagguuugucuguacagaaggugugaaggaaauuugggucuaucaagcuaaaguaugccauaguccuugcuuucagagagcagaaguugaccuacaaucacaaaaaaaauacaagaaaaagauggaggagaucagggagaguuuuagugcagaauggaaaaagcucaagauucucuuguauuuucuaaaaagagaguugcagauguaauguacuguaggugcaauguuuugugaguguacuaugguguaguuucuauaaauguacuauaggugcaauguucuauaaguguacuauaggugugcagaguucuauaaguguauuauggguauaguguucucuaaguauccuauaggugcagaguucuauaaguaaguguacuauaggugcagaguucuauaaguguacuacuauuauuguguuauauaagugaacuauggguauaguguucuauaagcauacuauagguguaguguucuauaggugcauuguucuagaagagagggcagccagauaaaaaggggcuuccaugauucugcggcauuuuaaaagugaugguaaauaagaauugugcacaugaugacugcaucucucucucuauuugggagugugggugugcacagaccguacuuuacugcgucgcucaccucuguccuguguguguagaguggggaaccugugcuuuucuaccuuuauaguuuccauuuuaggcauugauggcuuuugauucauuuuaacauuacucuguuauuuuuguuuacuuuuaauucaacugaguaguuuuauuuuacccuaauguaucaucuguuacaaagauuucaaacacaugaccgauucuaauguauuggaauagauuuggcuguucuuuauaauauaacuccauauuuauuacauuugaacauuucccuuaagcuaaaacagaaaggaaaagcauaaauaaccaugacaaacagcuuucuucugguguggucauuugaaaugaaacaaccaaaaaauuuaaucaauuuaaaucuagaaaaauuagcugauauaaguuguaaaccaaaugaguaagcacugucacuuacucauucuugacauucaauuccauuuauccuuucuaauauauuuaaaacagaauaucuguaaagaccaacguuugagcugcuguuuccuuuucugagguuaugcuuuaaucuaaaacauuuuaacauguagauauaaauaauguuuuauuugagccucauaauuauaguaguuuauuauggcaugagugauuuaaaauaauuguuaauugugauuuuaaaaacuaaacaggcuuuguuauuagugggccauaaucauucacagaaggauuauguuuugagugcuuauuauuugcuagauauuaagaaaaauggauaaaagcacaaguuacaauuguuggcuagagcuagguaaagaguagcuuaaaaauaacucuuuuccauuccacccaaauaccuaucucccuuagauauaaggugcuuagauguguaagcaauucaaaguuuaagaaaauucuuuucuuaagacugcuucuuuucucuaauacuguuggaaggcagaaaauagaauuauaagccagcccaguuggccucugucuuccuauucccccucugccaaucaguuccaugaguggagucauggcucuuaugugcauguccuuacucuaauugauuucuaggugggcaugggccuuaaguuaaaggaaaaacaucucaauauuucguauuaagcaccaggacacuucaaccugcaacaucugaacucaaaagcuucaaauuaggcauggugacuacagaauacaucagcaaggaguggagcaggagguggagaccagcuugugcucguacuugugagcagucauuaauugacaaagaacauuuuagcuggcuuuguacuagaaacaacuaguuaacuggaugguauuugcacauauauacauuguauuuaaauucauagaaaguacaagugauuuuauaguaacuauuuuuaaauugauaugaauaauuuaaauuuuuucuaaauaauaacuaugaagaaaaauuauagucauacauuguguuagcccccaagguaacuucucacuuauucuuuuucuuacacagacaugcacauuuuaauucccaauugggaucauccuguaugugauuucauaacuuaauuaaaucacagcuuuauauacauacauacaauuguuucuggugggguuggagagaugccucagcuacccuucuggaggaccugaguuggauuccuagcacccacaauggucaguucacagccuccugagacucuaggugcaggggucugacguccucuuccagcuuccacaggcacccacacacauguagcacacacucacacacacacaaaagcaugaauaaaaaugauaagauccauuguaucugguuuuauguugagguucuugauccacuugaacuugagcuuugugcaaggugacaaauaugggucuguuuucauuuuucuuuuuuuguuuguuuguuuguuuguuuuugugggguuuuuuuuuuuuuggugggguagguauuuucauuuuuccacauacacauugccaguuagaccagcaccauuuauugaagaugcuuuccuuugucuauuguguauuuuuggcuucuuugucaaagcucaaguguccauaagugugugguuuuacuucugggcccucaguuccuuccauuccacugaucagccugucugucucuguaccgauaccaugcaguuuuuaucacuauugcucuguaguacagcuugaggucagggauggugauucccccagaaguucuuuuauuguuuuuacuauucuggguuuuuuguuguuguuguuuuuccauaugaaauugugaauugcuccuuccaugucuuugaagaauuguuugggauuuucauggggauugcauugaacuguagguugcuuuugguaggguagccauuuuuacuauguuaaugcuaccaacccaugagcaugagagaucucuccauuuucuugaggucuccuucgauuucuuucuugagagauuuggaguucuugucauauagaucuuucgcuuguuuaguuaaagaguuaccccgaggcauuuuauauuauuugugacuauugugaaggguguuguuccccuaauuucuuucucagccuguuuauccuuugaguagaggaaggcuaccaauuuguuugaguuaauuuuauauccagccacuuugcugaaguuguuuaucagguuuaggaguucucugguagaauuuuuggggucacuuauguauacuaucauauacauaucaaauugugauauuuuuacuucuucuuugcuaguuuguauccccuugaucuccuuuggaugucuaauugcucuggcuagaacuucaagcacuauauugaauagguagggaaagagugggcagucuugucuugacccuggcuuuagugggguugcuucaaguuucucucuauuuaauuugauguuggcuguugguuugcuguauauugcuuuuauuaugucuagaugggccuugaucuagauccugaucuuuccaagacuuuuagcaugaagggauguuggauuuuaucaaaggcuuuuucagcaucuaaugagaugaucauguguuuuuuuuuuccuuugaguuuguuuauauaguggauuacauugauagauuuacguauauugaaccaaucuugcaucccuggggugaagugaaugaugguuuugauauguucuuggauucaguuuccgagaacuuuauugaguauuuuugcaucgauauucguaagcaaaacuggucugaagucaucuuuucuuguuggaucuuuguguggcuuagguaucagaguaauuguggcuucauaaaaugaauuagguaguguuccuucuguuucuauuuuauggaauaguuugaggaguauugguauuagcucuucuucaacggucugcaauaaaaccaucuggcccuggccuugaggaaauggcagcccagaagcaacaagguuucuaagaaagaaaggagccaagggcccaaaauccacucaaaggcacaccccaguugaccuaaacuucuucaucuggcccaccuccaaaaguuuccaccauccauuauugccacaggugguaacuaagccucuacuucaugguuuugacaucugcacacauguguaccaugguauucugcucguauuugccucuuauuacccuuucuuguuccaccugcccucuuuguuagucuccaguuucccacuaaacaaucccuucuacuuugaugccaugugugagcaugugugugcaugugugaguguguguguguguguaaaaucuagauucugagcuaaugaacuuaucagcaugucagauauaguucauugccaccaagacagaugaccuaaguuuggucuccaugacccaccugguauuaguaaagaacagacuucugcaacuuguccucugaccuuaacauauacaccauggcagacacaugcacccauaccacaaaauaaauagauauaauaaaaauuaaguuuaaugaaguuuagcuugaaauauguauucaucuugagcuaaaacauacuugucuuucugugucuagccuagcuugcuuaccaugguaaucuccaguuccagacauuuuucugcaaaugacauaauuucauucuccuuuaucauugacugaaacucauauauaugaauuucucauauuuuauauuguauacauacauaauauaugagcauauaucacaugauauaauauauaugagacacuuguguauauuguaucuuccaucaaagaaacaaagaacauguaccauggaagagauucuuguagauaaaguaggacagguggaguuaacaaaguccuaugauagucuuuaagcuaagcuucaagagcaguggcuaccacccugugggucacaaccccuuugaggucaaacaacccuuuuacauauuagauauccugcaugucagauauguaaaauucauaacacuagcaaaauuauaguguugaaauagcaaugacaauaguugauggaugggguuuaccacaagguaaggaauuguauuaaaggguugcagcacuaggaagcuuggagaacuacuauucuggaggaaaauucugacuaaauuagugccauauuguggaauugagucuuuuuugcugcuggaucaaaucuaaucuuucacuuaaaaugucggaguuccuuguaaccuuuggagguaaggguaacaauuauauacucaauaaucuuauuuaugacaaaugaagucccuaauuggucaguuaaucuagacuuagagaaauugcagagaaaugauaaauaucuaguagagacauugcauuuuggacuguccuaaauuacuucuaaaaaauauuuauggagcuagagagauagcucagggguuaagaacacugacuguucuuccagagguccugaguucaauucccagcaaccacaugguggcucacaaccaccuguaaugagauccaaugccgucuucuggugugucugaauaccacaacaguguacucacauauauaaaauacacaaaucuuuaaaaaauuauuuuuaagauuuauauauuuuguuuguaugcauguuuccugaguguauauguagaccuugugugccaggugacugaggaggccagaagagggugucagaucccuuagaacuagagugacagauggcuuugagcugccaugugagugcugggaaccacacccagguccucugcaagagcagccagugcuguuaacuggugagucaucucucugguccccugaguuccaucuaaugggcacauccuguguguaauccugagagcuacugucagaagcugucugccugggaagcagcagagcaucugagcagagacacaucuggaucuaguggggacuucuucucucucugucuggguccuauuuucuggagcucccagguggccggguugggggugggaggaacugaauuaugugaauuacuuugagucuggcucaguucuuaugaaaaauucugaauuaugucuggcaggaacucuugaauaguuucaugcagugccuuuagcagccugugagugugaaugauucgugccuuguagacaaagcacauggcuacccauucuuugguuucugcucaucucuacugugccccuucgcuccagucucccucacuccaguuuagugcugucuaaagucaaugcaaccauugcagcucuccaaacagacuuguucuugagaacguugguggagaugagaaucugcucagcugcuuugagaggaugaggaaugagcccacgccaccucuggugggcuugcuguagucauuugucugucccguuuaugauggcuacuuaccaaugugcauaucagcugugaagcuguuuuaccgcugcaguccauaggacacacacugcuugucugcagaagguguagugaugccaaguagagcuaaaaauacccagcucccuaccugucaagcucugucacugcagugaagcaucagaguugucacugcaucuccaguguggacuuucagaucaaguccuuuguauuuugcucuguucuuucagcuuuuccaaguauauccaaugcucuuguuuuuuauucagagagaauuauuacaaaaauucaugaguggucuagucuggaaaaguugcuuuaauuauugacaagcuaacccauuauucuauggaugauaagaccaaagucuagaaauagagccaguaaaauuuacaucuauauaucaaaaaaacuugcuagccagcauccuuaggucccuagaaaaggguuucaaacugcacuguggggacacuuuccagcugauucugcuggcagcuggugggggugccaaggguauaggacuuaagucacuguuuugcuccaccagugcagucucccuuuaugugaacuucauucaccacuccggagugcacucaaauaaacgcuuccagcagacuuuuuaaaaaucagaaacuacucauuauaagaauagagucuuaaaacaagauauaacccauccuacaagccuaccagcaaaucaucacccgcguuuccugagacacagggagaacacacgcaucugcuuuucagccuccuguggauggcaaguagacuaugucaaagauuuggauccagugacaauaauacagaguaauuuaaaaucuuccagcuaaaaagaagcugcuguuuaagaaaagaacaaacucagacucaauaaaacaaacaaacaaaaauaacuugcaacuacuuaucaaauaaccuuaccuaccucguacucuccaaagcaucauuuauaguguaacauguacaauaaauuaugguuuuguucacucaucuucuccagcauuugccuaguucuagauauugagggaacauggucagcuuaugauucuaacuccaaucaucaagaaaaaguuaaauggucuccacaggacaaagagaaguaaaauacuuuggaaagaacuauaugcaagagagcugucagacauggacugcccagcacaggaggcagagacaggcagauuucugugaguuugaggccacccuggucuacauagugaguucuagggcagccaggacuauguagagagauccuaccugggggggggggcgguucaggugcuugaagguagcauuccaguuauuuggaaaaccugcuggaugaccuacaugguuuccuaaagaugccaguaucgccauacguacauuuccuuuccaagacagacagagcaugcccagaacuuucaguggacaacauauauuaagaaaaguucuuagaagaauaaucauaaaaugcauuuucaauuuucuaaauugucagauugauuuaaucauuuucuguuacagucgaagaccuaagaggcaguacaugccagacuuagacauaauuaaaacuacgaugaguaacucaaaaaaugucaucccugcaucugauuccucacagccaguuuccugagugccucuguuuuuauauagcgucuuagcaaugcuguuaagugugcaacacugcacagaagaaaagaaucuugucuuuguucccguagccaugucaugggaacaugcagucccugcgguguugcuggcuaaccuaagaagccugcgggcgugggguaggcguccuuagaaggacaagagugcaggcugcugcugggcacugcccagugggcuugagagucuacccuucucucccuguggguuucuccaaggggagccuugcccuugcucuuuaaauuuuguaggaaauuaguuuguaggaaaauccuacgaugaaguguauuauauauguuuuguuuugagauaggaccuuucauagucuuggcugcccuuuaauuugcuauauagccaaagauggccuugaacuccugauccuccugccuccaccuccccagugcuggguuucagguaugugccacgacagccaauuaaaauuuaucauuuuuaccacuguuaacuguccaguaauuggcauuaaguaugcuuauacuguuggcagccaucaccguaucugucuuuagaacuuuuccucccaaaaugaaauugugccugguaaacaccagcucccaguggcuccucuuucuuccucuggaaauuuaagcaccuuagagaccucacauaagcuaugcuuuuaaaucuguaaaaagaaaagggucuucuuuacuaaacuucuacucccuugcuccauuuugaagacuccugagagaaaacucagcauggcuuggguaacaugcuuguuccagaacaagcugacaagugcuguuuucuaagcuggguuacaugccacuugggcaucuuucccaaucuuucuucuaaaagguccaaaguaguacccaaaaccacucuacuaaauuacucuaguuuguuuucuuccagaacaugcauguacguguguguguguguguguguguguguguguguguguguguguguguguguguacauguguguguguguacuuguguacuggcugguuuugugugucaacuugacacaagauagagucaucagaaaggaaguagccucaguugaggaaaugccuccaugagaucuagcuauaaggcauuuucucaauuagugauuccugggggagggcccaguccacuguagguggugcuaucccugugcuggugguccuggguucuuuaagaaaacagacugaguaagccacauggaccaagccaguaagcagcaccuuuccauggccucuguaucagcuccugccuucagguuccagcccugcuugaguuccuguccugacuuccuccagugauuaacuaagaucugaaaguguaagccauugaauaaacucuuuccuccccaacuugccuuuugguguuccaucacagcaauaaaaacccuaagacuguguguguguguguagcuaccuauuuauauuuauuauagauaaaaggaaaucaacucucucuuccaagugagggucuguacuuuugauauguauaaacacuguaauuaaacaugaaaguuugcucaaauagcaagauaauguucucccccccccccccagguuuuuugauguugguugguugguugguuuuggacagggucucacuauguagccuuggcuggcuuggaacucaguauauagaaacuauuggccucaaacucacagugaucggccugccucugccuccugagugcuucgaugaaaggcuugcaccaccaaaugcccccucccuuuugagacagaaucucauccuguaucccugacucauuuggcauuuacuguguagcccagacugacccugagcuuaaaacaguccugccucagccuccuaaguacuggaauugcaguuguaugcuacccugucuaacugagaacuauacuuugugagaaauuuaaugaugggaaaaaacaguagaguccuaauaucauaguagacucaagauugcaguagauuucuuucugauuccuuguacuguuaggcauuuguacggagacuauaaaccccugaggccguacggacauuuucagcaccuaacauugaaaacuagcgagauagauuugagucugaccagugcugcucuuuccaguugcccuuagcuauacccugaccagguaaaacucucuggcaugaaacucgggcuccacauuggcaucaugcugacccuguucauagaccucagugccccuccacacucuugccccuaaucuugggggcacacacccugaccaaagcaacucacauaggaaaaaacauauacucucuccuauggcuccagacggaagagaggcccuaaugaagcgcuggcacagagcaagccuggagcagcuggaacaggauaccgagacucgguacuuuauauaaugaacgcucucgaagcagcgagcauuuaaaacgcuguaaagacuuuucccuccagccuaccuugagugaugaagugaugacuucuccaccaaggcugcaccaccuaagccuccccagcagcagaaccaauggaggaccuaaaaggaugccaaaaaccuguggggacaguucucacucaggccacaccggugaccuucugggcuccuuauuuuugguugccguguccuguauuuuuacuguucuuagaguuuauuaucuuuauuauuguuggcaggaaucccaaacucugccacuguggcacccuagccagauguacccuguccacuccucccuaguuacuucuuuccuaucuuggcucacucccucacauacaccucaccucuaaauccucugagaagcacaccacacacacagucccugggaggacacagacuacccggugcuugccccgcccaccccacccccgccauccguaggggcuucuaggugcuaaggaaacccuuaagaaaugacuuguuuucuuucuuacuuacuguccaaaucaguaaauaaguucuccauggcagcuucuugcauuuuauuuagaagcuuaaauugagaugcccauagccgaaaguuuuggaguuaagccccagccccacauuacgugggaaagcagguacaggacguuccagaacaguuugaugcuaguucagccauccuucuuccugugguagaacaguuuccauaggcacaggcucuguauucagaggagcugcuaaacucugcccuuacuuguaccucugauaguuuguugaauauauucauucugcagauugcucucagucuaaaagguaauacuacuuagaaguagcagucuguuccauuguuuuacacguguuuagaauagcuugguuuauuuauuuauuuauuuauuuauuuauuuauuuauuuauuuauuuauuauauguaaguacacuguagcugucuucagacacuccagaagaggaagucagaucucgugauuggaugguugugagccaccaugugguugcugggauuugaacuccugaccuucggaagagcagucgggugcucuuacccacugagccaucucaccagcccccgaauagcuugguuuuaaagaaaaauaaaaacuggaauaucucacuuuccugugugaucuauaggaggucuuguucuuaacuucuggaaaguugcauacuuuccggaacuuaucuuuauaauguuugguuaaaaagccuaacgucuuuagccuggaauuugcaaaucuuuuuaacuaaaaguagcagauucuguagauuuggguagagacuuagaaaacagcaucuaggguuggagagauggcucggcgguuaagagcacugacugcucuuccagagguccugaguugaauucccagcaaccacaugauggcucacaaccaucuguaaugagauauggcgcccucuucuggugcgucugaagacagcaacaguguacucacauacauaaaaaagaaaagaaagaaaucagcaucuaacgaguccaggguaaacacugcaguacuagcucuucccucucuacugcagugaccaugccaccacaccugacugacucuccacagaucuguguguacacuuccucugcuaucgcugcuacugugcacugugacgguaagaugcagagaagcaggggcuuucccuguggcugacaagccuauagaacguuggugcccuguaugcuuacaguaguuuguguacuuuuacauacuugcucaucuuuucuaaagucauuauuuguguucuuuuauaggacaacgaaggucagacagcucuucauuaugguaagguguuucuguguuacugcuccuauccucucaccuaucugagccuauaugacuguagagcugguagauacgcagcgauccucaucagcaaugggggcuucuccacccacugcuaagaacuuaguucauucgugguacugucaggaacaaccaagaugcuaaucuuuguuauuguagaaucuaauuucuucccuaguauuuaagaaaaacaaaaacaaaaagcaaaacuuuguugagguuguagaaaugacucaaucgguaaaguguacugugcaaguacgaggaucugaguucagauccccagaagccacacaaaagccaggcacaguggcauguaucugagcccuggacaaaggcagagagcucagugacagaccuugucucaaaagauaaggugaacguuggcagagaaagauacauaccguggaccuccggcuucccugugugcauacaggggcuggcccccccucacauaugcauacaccacacguuaaaaaaauaauaaccuuugagucccuaacgugcaguuuuacuauuuguaguuuuaauugcccacagucaauuacaauccaaaaauaugaaaaugugaaaauucuacaaauagacaguuaaucaauuguaaauuaugugcuguuccaaguagcaugagagacucacaccguccuugcuccuucaguuugggaugacccaucuuuuucacugaccuggugaagcuauguauauaccacacugcucccguauuagucccuugguagugucucagcuaccagagcagcugaucacagugccuguguucaagugacccuuugguagcagccugacaacugagcugauagcuccauccuuugccucacuuaccucagagcaucacagacugugagcacaguacacuacaauguuuucagagauaguauauuccuuuaucucauuccuuacagcugguaaucucuauauaaugcuguauauagauauuauauagagguauuauauauauauauauauauauguguguguguauauauauauauauauauacauacauauauauauauauuacugcuggaaaugugugugugugugugugugugguguguguguugcuugguccugucuucacuuucuugaauuuuuuucucucagauaaagggagacuucuauaauugaaaaaaaguuuaauucuuaauuuuuguuuucucuacugauuaucuuuacuuaagcaauguauaaaauaugacuuguaaaaacgauuuguaaaguagaaauauuagcauggcucuuagagaacuauuaaauaaauucaguuaaauaacaagauauuaaaguauuucauaaauuauaaaauacuggcaaauauucagagauuuuauuguuuaugauuauuauuaaaaaaaaauacagcuaucaguguuuaaaucaagcuaagguccacccaccugcggccgucucagacacgaacacacaggcugcuuugccaggcuugacccugcugggcuaggauuaguaucagggccucagaugcccaucagcaccuuugucugggccugcacagcuguuugguugcugugagugucgcugggucaccugggagucuagacuguaguacuagcuguuugcaauccguguaaaucagacugaugaugaaaacugaaaugucuacaaauuuaugaguuuacugguauuaccuagauaguaaaacuagcaggaagaaaggaaacuugugagucuaauucacuuuugaacauaaauaccaaaauccuaaggaaaauauuagcaaaugaaaccaucauuguacuuuagacacaaagauauaucauaaucguguugaguuuuucccacaaauugaaggguggugugagguuuuuaaaguuuauuaguaugauuuucuacauuucuaaguuaggugaaauacccaauuaaguaauucagauguauaaaaagcuugagagaaaagucaacucucaauuuaagaaguuuagaagaguggcucagaccucauggguuuaagccagacuugugcuugacauuugcggucuccugcugacucugcacagacuguuuaaaucacgcacuucaguucacacuugaugaaauggggaccauggccucagacuagguaugaggauauaagagguuaauuuaugcaaagugcucaggaccgaggcugauuccugcgaaggauguagcaaaugucaacagguucucugauaaaguagaaauacaguauuaggguuggacccaagagugcaugaucuuucuguuacaggagagucaaaaauggggagacuccagcaucaggagacaggggaaugauuaauuuagcagaaguggcuugguaaaacuaggaggggugcuucugggauucuuauacugaugugauacuguauguacacguuacaugaguauauucaucuuaagaaaacauauaugacugauacucucaugcauguauuuuguagccuaguaaagcuuacacagagagagacagagccugucugauguagagaucggguagcaguguuguccugucuguucucagcuucccaccaaauggccaagcuuaggugcuuguuucccccgcugugggaugaaacucugguggcuggaaaggugcugugagcuuuucagcagucgagcugugcgagcagaggcacugugcauccaggaugggugguuccaugucgacuccuguuugcuacugucaugcacaucugcagugccagagagacccacaguauuuucuggaagauaauuaaaaagaaaggaggaagggagggagggguguuauauuguuuuugaaacaaggcccuagucuauagccaggauuagccuggaacuugcuauguagcccaggcuugcuucagacucauaauacuccugcccagccaaagugcuaggacugcaggcaugcacugguccuuggacagugaggcagagccaauauccacaacuauaccaugaguaaacacauaucaaugcugauauccugugugcuucuauaaucgucuuucuguucacugagacauuacacauuaauaaaagugauccuuaauucagauuguguccaaaauacaucuauugaaacacccucuauuucugucucuccgguuauauuaauuacuguggaaagaaccaagcaaagaacuguauauguuacaaucaacauaauuaaacacuaaaauaauaucacuagucagacauuugacauuaaagauauauaaaacuaaaauauucugacaacucaguaauguuucaugaaaacacuuuccaauuaauaaucacuuuuagaggauuucaccuucaguuuuauuucuuugcuaguuuacuggacuuguaauagauacuuugagaauagugagaauugucuuauaugugauaauaauagugaccauuuauuaagcaccuauuauaugccuaggagucuguugaacauuuagucaucuaauguuauuuaauccuuuuuauuuagugggugcucagugacuguugauuugauuugguuuuagggccuuaaccuauucuuggaauuuucacagaacugugagugugguuaaauacagugagugcagacaguguuagggaggucuuuaggggcuuagcuauuacuuuuuaugaauuaugguugagcuugacagcuguccuuguguugacagcucuucugauuauagcaguugucaaacuccauccuuaagcaggcuguaaauccuggcuucuuccgauuaaaacugggucagagccaaucgcagguuaacuagaggccauuauuguacuacuggacgucuuuacuaguuuguccuaaauggucuuuguguggaaacauauuaaaaccccuauuuacccacauuuuaccugaguguuuugagucuucagauacugguccucuuguuauuuuguguuucacugugauccuugcuggaguacguugcaguaaguguggucuuccuuauaaauggccuguuagcuuuccccuccucuuccuccacugggaauacuaauaucauugcaucugugucucccaggggaaaucaaggcuuuuccuugcacguguggucaugugauugcagagugggccggcuuuguauccuccugagcccucaggcuuccacggaaagcgccaucuguucugcuccuuccguacuguuccagggcagugggaggaggaauuagagagaaaauaaauaaaauaaaaaaaagaaagaaauucaucaucagaaccccgaggauuaauggagucagaaggcucccugcccugacugggaauccaucuucaccugggccagugucagggcugccuguaaggcacuugacagauagagguucccagggcaccauaaauucagcaacugugcuggucccuguagacuggcucaggcuuuuccaacaugggcuucagacugugucugucuuucccagcacagugugggcaccgauguggccccuugcugauuuggugacuguuaucacuggucccccucucuguucuugccuucuuucucuugccaucuuugccuuuguuuugagaguaugagauugcacguucucgcuugugaccugugauucccuaaauaugcaaaagggaggagaaugaauuuugaguaaauucuaacuucucucagcaccauucuggauagagaggacaaaaccaaaccaaaccaaaccaaagcaugcucugggauagcucaccaugggauuggagacccaggucaguuucuucaauagcaauuuguugggcaucugcgugggccagucucccccagguaccagccugccccuaacaugcccgcuucacaucagcacaaaauaaacuuguguggcuuuguaggcgggaucccaccauuuaugucagccccuuuuuucuuucugguauuacucccugcuugcuuaugcuucugugugggucugucuuguucauaaaccucaggugcuuguuaauaaaaucccuuuuauacagguuuguacaccacacccugcucugaaauacugugaguuaaaucucacuucuuaguuagacuggagcuaaaauucuacucacaucuguccuacuaggggacugucacacagcgcaaguacuguuuccuuaggagagcugcagucagcuagccaugggauuaaauucucucccucugcuccugagucugaauccugagauuauagcacacuucacugcugggacgcugacuccauggcacugcacaugugaggccaccccuuugccugaaaggucacauucugcaucuuuaguagacgucugcuuagccccaucccccugcuuaaguguuggcuuuccugagugacagauuuauauauggaguuucugacucuguuaaaaaggucccaagcaaaccucacaggaccuugauucuggcggugugccguaguuuagaagguagcugucccauggauaguuccucacagcuugugucuccucgcagcuucugcacgccaugcaucuuuaacuuucuucuauuuuaugggacucugugcauuucagccuaaguagauauucaguuauucaugauuaaacuccagaaauuuggaguaacaauguuggcugaaguuauuugagggugcaauucuaaaugaccagugucacuugguggucugggcauauggcucugugguagaaaacaugcuuagaacacauaaggccccagcaucacaaaacagaaugucgugaggagauuuggacagaaagguucuaauuuuaaacccuuuauuugaucuugggccuuggcaaagacaguccugccucuaccugucccuauuuugauguugucucaggauauaccacuuccguuauaucaccacucagcagcugcccuagguuugugucuuagucaggguuucuauuccugcacaaacauuaugaccaagaagcaaguuggagaggaaaggguuuauucagcuuauacuuccauacugcuguucaucaccaaggaagucaguacuggaacucaagcuggucagaaagcaggagcugaugcagaggccauggagggauguuccuuacuggcuugcuuccccuggcuugcucagccugcucucuuauagaaccaagacuaccagcccagagaugacaccacccacaagaggaccuccccgcuugaucacuaauugagaaaaugccuuacaguuggaucuuguggaggcauuuccucaacugaagcuccuuucucugugauaacuccagcuugugucaaguugacacaaaauuagccaguacagguugaaacagacuauugcuucuccucucuuccuuuucuccuauucuucaucuguccauucaucaaaugcuucucucacauacaagagaccucacagcccugagggcagagagagggcucucacacaggcguguauuaguucagaaauucucuacuuuggcucacuuagaaccagguucucucugguuauggacaggagcuuagugacuaaguauauuaggauagggaauguaaaaagaugucagagggccacugagaugguccagccauggcaagacuaggcucacaaccaaaagaauagaaagacaccagagcuacaccaguuuauagcccaccauaaccuggcuuuugcucaacagcucuugccuccuucacagcauaaaaccugaaaguucuaagcuagaaagcagcacccgccugggagugaagauagccagguccuugaauuauuaauaccaauagggcagugcacgugcacacaacaguugggccagcuugaagauuuggggaaagguagacaucaucaccccugaaagcugauugaggacuguaaccaccucagaaggacacggagcucccaucucaucccacgaucagccucaacccgaggaauaagcagcagucgucuccggggugggagcuuaggagggaagaacggacggacaagacuccugugguucugcaucuggaaaaguacagacugauucagaaaacagagaacacguuccaagaauauuagcaaguagaauauacccaaguacaaauaaaguauuacccaggcauccaaauugguuugauaguuugaaaucauuacauuauaccauagcagucaacacaaagcauuaaaaaaucugcuauaggugggaagggcuguuaacaaaauucauccuccuguuguggcuacaauaaccauauagagagagcccagugguguucaccauuaaucccgcacucaggccacaggggcagauuacucucugaguucaggaccacccuggucuacaugguaaguuccaggacagccggggcugcauacugagaccuugauucaaaagcaacuagcaaaauaggaguagugggagcguccucagcccguggagaccaguggcuaaaggccaagugcucuuucccccugcacagcacauccucauuccucuacccuagaguuggcuguugccagguuuauaaguucucagagcaggaaucucaacuguauccuugacagagcuggugcagccccugcucaauaaaacagccuccgugccuuuucucagaaggcuugcugcuguugugugaugugucgcaccacaaaagccacuguaaaauaucugaguaaggggaauuacagcuguagaaagggucuguccucccuagcuuaagagucaggaucaucaccaguaucaucuggugagcccuccugugugccuguccagucaugucccuccuuagugcccccuguaaccauggugauugccaauauugcacuauuucgguuuuuguuuaguuuuguugaaacagugugcuuccagcuggccuagaauaaccugugcagaccaggcuggccuugaacuuugacccuccugccucugccucccaggugcuggauuucaggugugugccacccugcccagcuuuauugcagauuuuauaugaaugcuuucucuuauaguuucucuacauauuugcauaucuaagagauaauauuuaauucuauuuuuacauauuccuuuaaauagaauaauaaauaauucuuuaaauagaauccuacuagacugcauuauucugauuuuuuuuaauucuucaacauuaugucuuugagaugaacccaaugguguaugaaguugggguuccuuaguuuucccuuccagaugaacagugucugugccuacauguuacugcucaugagcaguugagccgucugcauuugaugcccguggagaaaggugcugauaccuacagucuucaacuaucagcugggaaugaacacgggcagaaaaaucucuguagacugucaggagaagcagauccuucuuuggagggguguguguuuagggacaaccuguaaugacaaguuauuauccaaagugacugccccagaguucaugcuccagaucuaagggcgcuuucccugcaccaggccucccccaucaccuuucaugugugcguguaugcgcgugcaugcaugcaugugugcgugcgugcaugugugcgugugugugugaguguguguguguguguguguguguguguguguguguguguugcuguuaugauucauuugguguaaaaugucugcuuuugccuucagcucagucaucucagagccuucuaauuguuagauauuuguuuccuccuugcuuguaauccuggcuuugucauaaaucugauuucuguauauaugcugaagaguagacagcucucugcucuaaucuuuggucuguuugucuguccugggggcaguaacaauaccaucuucaucacaggucuugguguugggggucuccccuccugugccuuagacucagcgaccccaauaaugcuuuucacuccucucagggucuucgggacugggagauggcucaguggguaaagcacuuacuggaucaucacuagggagugaguccaggcccugccacacacacacaaaagcagggcugcacgucucuaaccccaguucugaggaauggagacaggauuccaggagcuugcuggccagccagcuccaaguucaggaagagacccuuguggggagcaauggaggaggauguuugcugcugaacuuugaccuccauacacacacacaccccugcacauacaucugaacguacaauccuacacacaagauuucacauagugagaccaggcagugguggugcaugccuuuaaucccaguacuugggaggcagaggcagguggauuucucaguuugaggccaaccuggucuacagagugaguuccaggacagccagggcuauacaaaaagaccuugucucagaaaaaaaaaaaaaaaaaaaaaaaaaaagauugaacauagugauggucuaauuacuagaccagcuuuuuuccuaccuaaauucaauuguguguguguguguguguguguguguguguguguguguucaaaaacaaaacaaauagguuuauuugaugcaauacauuuagccuuuugacauugguuacccaacuauuauuauuugaaaauauagaucaacauaaagccauugcauuuuuuuuacucuuugcuauuauucucuccuugcaaauagggucaaaagucucacaguuuuacaaaagaacuguguguuucugugugaugaaaagauguaguuucuuaagacuuguucuagcaucaaggcccaagcauccugcagcuaccaucagggugggcaauguguaggccuccuugcuacccaccuuugccguuccugcugcacggagcggcuccccugaccuacaguaaacccguuugugugugucaauucucuugcagccgcugccugcgaguuuuuggacaucguggaacugcugcuccagucuggcgcugaccccacccuccgagaccaagacggcugcuugccagaagaggugacgggcugcaaagcggucucucugcugcugcagcggcacagagcuagcaaggcuugauccaaagccugaagaagcacaguuuggcagacuaggacuuccgggauaaaagaaacugcaaaaauaauacuucuuuuaccgcccaucuuugguaugcauuggcuaauaaaaucaguucgaggaacugggauuucgacgucucagcaacucauucuccaugcauacauugugggggagucugggguuggugaugaacauguguacugugcauaauauaauccaauucugccuagcaugcuuugaaauuuaucacugcuguggaagguggggagaggagcagacagaucauauuucacaauauuaaacauggcuccccucuccucugugccccucucucucucucucucucucucucucucucucucucucucucucucucucucucucucucuuucucaaaauacagaagcaaagugugcccaucagcacuacagugacaauuaggaaaguucugugaagucccagcauaguagaaagcaaaugacccaguagcauuucacagcuaaucuguauagguagguaagauggcuguucccuaaagacaugcuugaaaauguaaggagaaagaggguguuaaagcaaguagcagagaugauggccuagucggucaucaaugggaggagaggcccuugguccugugaagguucuaugccccaguauagggaaaugccaggaccaagaauggaaguggguggguuggggaacagggggagggggaaggggauaggggauuuucggaggggaaacuaggaaagguuuugaaauguaaauaaagaaaauaaugggcagugguggugcaugccuuuaaucccagcacuugggaggcagaggcagguggauuucugaguucaaggccagccuggucuacagagugaguuccaggacagccagggcuacacagagaaacccugucucaaaaaaaaacaaaaaagaagaaaagaaaagagaaaagaaaaaugaaagaagaaauuagucgcagugcaaacguagccauuaagagcuaguucccuaacaggugugacuguuaaacugggaaguaccuuacauagugcagcccacugcuuacaguuuuuguuagcuugugcuagccuauccugagcaaaccccuccacaacauaaggcauaugaauacuguuuguuuugugauuuuuuuguagccuaccuucguucaaccugagaugcaaaaacaaaccauucaccaagacuaaucauuuuuaaaucauugcuuaaggaccuaccuguggaaauacacacauuggugcauacugaaauguggggguaauucucuggucuuuguuccuuuaccacagucccugcugcguugaggcuaccucuaaccuaagccuuuuaugguccacauuuaucaauguauuuuuaaaaaauacuauacauuggguacaguaaaagucacccaaacucugcggguuuuaacuggcauuaccucguucaucuuuagagcauuagcaaaucgaguuacucguucauuuaaacauguuagacuauuugucugagcaagaaaccauccaggaacuucauuuucuauauuucuuccuuuuacagacugagaucagcauuucuuagacacaucuuuauugcuuguucugccgcauuuaaaacuauauagacuuuaaaccccuauucuuuuguucccaauaucugaauuuccaaaaaccguacuaucacauaguaaucuguagaucauuuuccugggucuucuaugaagacuucauccauaaaugucagagaacacugagucaugguuaauuucauucccuuuaaauuauugaauuacuaugccagcacgucacauaccagucggauccugaguucauuacuaaaggcugcaguucaucaacaaagaagcaggcagcccgucaucuuuccugauacauggugacuguguuccccuacaguccagcgagcuauguagaaaccaguagauaccuuagcuucaucguguuagucaacugauuauuaggaaaucccauagaaagccuucucccaggagacucacuucuguuuauaccucaacaaacacuuggagaugucuagcuuuuuugauuuugcuuacuaguuagaauucauuuucucucauucuugcuuucagcucgcugauauuucuaauguauaugaguauuuuaaaaauugauacuagacacuggcaggaggacuaguaaagugguuguaacuagacacaccugcuagucacuggggaccucgguuucuagacugcauacacugccuuccuacucugaccucguucucaagucuccauuucuccuguuggccugaaugccaccuucacagaccugugccugugugugagcuugcuuagccucacuccccaaguugccuuuuuuucuuuacugaauaugcugagaucagaacugugcugccacuuucuguauuuaguauuuauucacgguugucauuuacuuuguccccugcugacugaucuaagaggcccugauugccucuacauuagucuccaugcagucacaauaguuucagugcacaccgaugaaaaaugagaaauaaaaagaaaaucgugucagcacauaucacagagaaggcguagugucugacucaccuuagcuucagaacccaggcugaguguguguguguguguguguguaaauaacacuagagacugaaggcggagccuugugcaagcuaggcaagcacucugcaccuaaccuacacucaaggccuugccugagccugucuucugguuuguaguuugaaaagcugccuugggacagugcuauaguuggaauggacuucugagagcuuuaugcuuuccgaaagcccauccaugggcaccauuaguuucugguuccuaucacaggaggaaaaccuuuggucagcugcccaguuuucauaguuuuaagugccucuaccagaugauauuugugguguggcugugccucuuuaaaagaacuggguaagagguggguuggugguaauggugauggugugggugcuagggccaaaaagccaggaccuugcauuugcuaaugcuugaugcuaagcuaaauguccaaucccaagucaguggugauuuugcuugcuugcuugauuuuauuuuguuuuguuuuguuuuuaaaucauuggccaagaauagaggcauaauacauacuaauauccacauccacacugacuaccacacuaggcgucuuuggagguacacuggcugagaaguuggucucugaagucuuuggccucggaucuguuagagaacagaaaugagcucacagacugaauugugugugucuacugagaguuuagcaugucugcuuaacuucuugccuuuccaggaugauuucauagguuucuuuaaccuguagucauugcacaauagucuuguagaguuaguguucaugugccagugccaggacaaggaacagacacaggcagguuaauucacccauaauuccagaguugcugauggagccacaguuaagaacaagucuacugaauccuaguugcucuuguuuaagcccaaagcagcgugaaguuuuccagcuuuucauucaacccauagcuauuucucaaaccuacugacagucuagcccaguucacucaugcuuuccuuccgcacagauguuaagaauucguguucugcuuauccagacaagucuaaaaucaugaauuaccaucagaaacggacuaaaucguuaauaaccucucuaauacugaggagcaaggagucagccagcugaccaacacugcugucuccucugcuugucagguagaaggagagcagccaaagcaucguccucggaauucugccugcucugucugguuuuaaauguuucagcaguuuccaguuaaaagguuccuauaauccagugaccccuccuauuaaauaaguauuucauagcuuccugccagguuuaacuacuuggcuauagguuauuauucuguguacaguacaucaucucugagauuaaugaacaauauaugugacuguggcagagcuagcuguuguagaaggguuucgugucuaagaaaauauauagucaucaauuuaacaugaagacuuuuagcuguuuacuauuuuaaguugaaaugcaaagguuauuaucaaacuuugagccccuaaaaaaaaaaucauguuauaaaugcuucuuaacacuaaaugugaaccuaccaguuuccauuucauaaugaaaaaauauuaagcuuaaauauuuaucaauaaaucucaaaucccaguuccuacggu

SEQ ID NO: 441 - RNA, 37444 nt, Mus musculus
aaggcagcagagcccagccaacugugggagagggcguccuguccccucguaggaagcccuccagcaauagcucccuagacgguggggccuccggaggcgugcgugcuucuggcuccugugggccuugacaaucacaauguccuaccuccuggcucuuuucucccaccuacuucgaauucccaaugugaaaacugcgagaaggagcccccuggaacuuuccaggaacaagauaaaucuguaacgacuaugccaacggacuccgcuuccguaggauacgggggccgagagcggccaaacguugccccggcccccucaacgaccucgagugcggccugaggucccgggcggcacucguuuccggacccagcucggaggucuggcucgccgggggaugggaaccgcggagcgcccaccagcaccgggaccccggcucuggcagcucacacgcucgcaggggcggucccgggagucggccccgccucggggcggagccucuuagcuccuccuccuccuccggggcggaggcuguuggugcgcggcaggcuccggauacugacuagucacaaacuugaaggagguggacauucaagccgccuaggaugaggaggugcggccgccucucggggccgccaucgcugcugcuacuacugcugcugcucucgccucugcucuucucggggcccggcgcuuacgcggcccggcucucagugcucuacucguccucugacccgcugacgcugcuggaugcugauucggugcgucccacugugcucggcuccagcagcgccugggcgguggaguucuucgccuccugguguggccacugcaucgccuucgccccgacguggaaggagcuugcuaacgacgugaaaggugagaaguggaggccuuccccgacccaccggcagguccugccaaccgucccgcuagcucguccccucccucgcggcuuccuugguccaucgcagucccuccccucccccaauccauagccuuuaaguucucccuggccgcguccccucaguccucugcuccugcgucuuccucugacaagucuuugucucuauccuucgagaggguuuucuuguucccugugcucuucucugagccuuucuccaauccagcuuuguagcagccuccuuccucauccagggaucccuucuugccaacuucccuaguagucgagguggaacagugcuggauagagaguuggcauucauucuaccgcccccaccacuuuucuccaccccccguggcaaguuacauaguugguauacacauuuccuuucucauccuuaccuaugagguagaugucugucuucaucgggugguuuuccucuuugccuguccaguccaggcuucucuugaccugcuaccucuagcaccuuagcuuccaggccacauucuuauuucucuucuccuugggucuggacucgcuuagaccuuagccuuuaagcccaugagacuaaacuauauguaugccuguggugugugauuggcccgugcuccaugcuccagucacuggucuggcuauuccuccauucuaaaaugccaauuacgggacccacucuucauuuaauuacagccuaagggguagcaggauaagaaaaccaccaaacguauagggauuuuuaaagugugcuguauuauaggaauguuaaaauauugaaaaauuaagacuugcagaugagggaacauaauaaugguaauuauuauagaccaagugcuuaaauaguagacucuguacuguggacacgacagaauuuccucucuacagcuuaaagauucccugcuauacacacaucuuucuaacucaagucaagggugcuggggguggguaaggggagggguggggagcaggaguggcaugguuguggggacugguuccugacuuugucacuucucugaugaguguguuuccuaguuuguggugccaggcaggggacuagcagagcucuuaacccgaaguaauaguuggaugagaaaacugugucuuaguuagggccaggcguucuagagacaggaaaacuagccccucagccccucuccuguguaguugaugguucuccacaagcucagauggguguaaagagcgccuuuguccaaggucaucuuggacuucaucucccccuccccugagcggcuggcaaagugcuuacugaaguggucucauggaaugguguguaguuuucaaaaaaaaaaaaaauuuuuuuuuuucuucaagacaggauuucucuguguagcccuggcugucugggaacucacucuguagaccagguugaccuucaacucacagagauccaccugccucuaccucuugggugccaccacugccugucccccaaaauaaguuuuagccgcaccuagaagcucuuuucccuugcuuccaauuuauacuuaacccacaugccucuccguccccaucauccgugugacggguccuucacacuauuuuaaugaugucagcacauuuggucagggcaagagggagaaagaaugugggcucuggagcugaaacacugagggcaagucaugccagaacagugcaggcccagacaucagaaaagucccccaucuguuucuaaguugagucucuuaagaggucucuaagggcaacauaugggcucgcucuagaauaggugcuugcauuuuaagagggcuaaagggaaagauuagcuuccagcugacucacaugcuuggccucucgcaacccggaguucuccugugagcugcauagccaggcacugacacagccuguuuauauacgaacauuuccaaaaagggucuugcagggagcgacaguccuucuccgaaaagaaaaacaaaagcaaaucuuaacuuguggaaggagaaauggagacaucagaggcuaaaccaggaggaaaugggagguaggggguuucaguggaaacuaggggggucucuuucugacuaugggggugagucuuuccuuuagcaagauuguagagguggagggcaggaucuggaguuggccugaaacagcgagcagugucuuucacaguuccccucuggagaggcuagggcuugucucacuucugagguucccugaggaagcauguggccacgggcuagcagauggcugcccucaaaccacacugagaggcgucauaacagugaacugcccuuaccagcugcuacaagugucuucagcaggagcagagagagugcauggacaaucaugggggcugggaagauguuugggaauccuggccagcuggcuucgggcauuucaucugacuggauagggcucauuucuuagcaagucuagucugaugguagguucuccaggaagucgcugcccuggggcagagcccuuguuucugagagucuauuucucccuuucuguuccagaggagcuccuguuugagaaaauggucggguccaauugggaccuucauuacuauucacuggcuaaucauucagcaaauauuuacugagucacaaagcauugaucgcauagcagcuggggcaaugaacuauacacagcaggagaaugggcagcaguaugaagcuguguuugaaaaagacaggagugguucaccuacuucucaugguaggaauucaaauaaagggacagucauggagggcuaagcgggcagucaagccucugcucggcuggcuguuacacaccucucucaggccagcucuuugccaaggacuuuucaucgcuguucgagaaauggacggugacacuccucuucccccacacccuccauuuauuuaggcucuugauuaugaagguucaaguucaagauaggagagcucauugucuugggucuuuggcaagauuaaauacaucccgguaugagugcgugucagugaggugcucccagcuugagccaggaaacagagcaaaaacauguccuagaaugcugauggacauucuuuuguuuuuuuccuuaaagguuugucugcuuugcuuugcuuugcuuugcuuuucuuuucuuuucuuuucuuuuuuagauuuauuuauuauuauacauaaguucacuguagcugacuucagacauaccaaaagagugugucaucuuauuaugggugguugugagccaccaugugguugcugggauuugaacucaggaccgucagaagagcaaucagugcccuuacccacugagccaucucaccagcccacuuuucuuuuaugugugaauguuuugccuacaugugugucuuugcaccauguggauaacugauaucuggaggccaaaggggacgguggguggguccucugguucauaguuucagaugcuugugagcugccguaucagugcugagaaccaaacccagguccucugcaagggcucuucaccccgguggagguucuuaacuuggcaauuucugacuucccagcauaggcaggauugguaguggcuuaggguuuuccauguagaagagcagcuuacacagagcuguggggcugacaucuguaagacauacgugucugagugucacugggcacugugggcauuuucuuuacuucugggagcacagaugacaucuugaacgugugugccugugaugucuaccacagacuauggucuagggagggagcacacuggugacagccaauggccgaagccucacaggauuccaaaugaugguaugagggagaaaacuugccgccagugcuguaccuccucuugacucaggccuggacuguccaucucgugucaggaguagaggaggcauuuugucugucucaugaccucaccgccuucagcagggagcaaggaagagacauggcggugaugguguagcauugaguagcagcccuuauguaagguaugucugcuuagauggggcaaucagagcugagaacaggccagcacccaguuaccaggucuuccuggcucccggugguugggcaaaguuuguauuccugucuuaauuaaaggaucaggcuugcuuaacauucagagguaacauggucauucuucuugccaagaguuguuugccauccagaaaccuggacagguuuuggagcugcaaggggcaguaggucuagacuauugguccuggcucuccagcccaugaggagcugagucccagagaagagccauguggaucauacgugcguuagucagguguugcucugagucauucuccugucucugggcucaggguucuugaagcaaggaguuugggaggggagccuaccuuguacuucagaacacacccgugcaagggcauagaggaauucccaugagcucucugccucaucaucauuucaaaauuuagggccucucuuggcgucucucuuccuuuccacuguccauuucccagguacuguguucugcccaagucuaauaauaguaggaaguguuucuccccgugagcgaguugggagguguaagaagccaaacgccagaaagacccucucgcuccccaagcacuuggacuguccauacagcugagcugugccaguaggucacucagauaaagagcauuuaguuuaaguaucuuacuugguuuugcuucccacccaccacccccaccccgggaugggcuuacucuguguagcccugacuuccuggaacucaccuggcuggcuuugaacucagagauccaccuucucuguuggacuuaaaggcgugcuccaccacugcccagcuaguuuaaguaucugaacuggcuuuuauuugugauucuggaauccuguaaugucuccaccuauaacauugaaagaguuggggguauggcuuuacagacaaaagggaugaaaacaagaggacccauuagacaaacaaaaaaaguauuggucaugucauaguuacuuucuuuguuuuuuguuuguuuguuuguuuguuugggguuuuuuguuuuuuuguuuuuaagucaggguuucucuguauagcccuggcuauccuggaacucacucugcagaccaggcuggccucgaacucagaaaucugccugccucugccucccaagugcugggauuaaaggcgugcgccaccacgcccggcuguuacuuucuuguaagcuuuagagcugugguucucaaccuuccuaaugcugccacccuuuaaugcaguuccucaugugguggugaccacaaccauaaaacucucucagugcuacuucauaacuaaguuugcuacuguuaugaauuaauuguacuguaaauaucugaugugcaggauaucugauauuugaccccaaaggggucucaacccacaggucgagaaacacugcuuuagagagguaagauuucauuaccauguuggcuaaaacuggccuuuugugaguuugacuguuaucucuccugaucucuuagguggucggguaacuugguuucaacuuagugguauagaacuucauaagcuguuucuguuuuucaucuguugccccuggugcauuugcucaguccaaaccaguggccuccugcaaauuauauuuaaugugcuagaaucaugaauugccaggucuacaguguuuaguacacagugcauacuauagauguaugugucaugauggaucuucaggauacugacuuugagacaccugaaaaaaauccccuggucagaacuuaaccaguaccaaacuggugccagcguucaccuccaccacccuuugagacugaagcaggucagaagagacaauggcuuaaucucauagagcacagguaauggaggaguaaagaaagcaaggcaagcccggucggugacacacaccucuaaccccagcacgugggcagcagaggagcacggaucucuuugaguuagaggucagccuggcccauauauugaguuccaggccagccaaagugacaugaugacaccguguguguguguguguguguguguguguguguguguguguguagggggauggcagacagcaaaagcaagcccaaccaucaucucuccuccugucucccaccucugaccuuauccuuguccucccugcauuccuauuggaagcccaauauugaaacuguuguccugcuccgaauccugggauuagcgccaaggcucgaauccuggguucagaucuuagacucaccaucaauuagcuuaccauaccuugggcuugguuaccugaucucuuuuauaguuaaggaaagcagauauggagauaaaugcuuugguacuuccucauuggguuguugagagcacugaacuagauaaaauugagcacacaauaaacucacuacaagugccgauagcgauagcguaauccuuuaaguaaaccugaaguccagguugcugucagguauagagaaggugcaauuauuucccccauuuucuaagagaaggcuauaauugaagcaagaauguaaguauaaggguaaugcccugacgcucguacaguggggugaggaacaagugaguuggucaagucuauaggccucucaagccgugaggcuccccgucucuauccucacuggcagauaaggguguggaagucaagggggacgguggcaguaaagcaugaugaugcagaacguccuguucuuuccacuuccuccguggugcguccgguaguucuuaaggauagcugggccuuuccuguaagucucuccagaacaaaguucugcuccagaggcagaacaaaagauaccaggcucagagugugccagguggcucuaggagaugaccugugugucucgauagccccgggucuuccuuuggcaggggcacaaaagggacuuuaaauaggcucaccugugauucagugcgaaacucuggacuugggccagggcaaugaccauuggcaagcucuucugugaccuugcucuuucuuuaaagcagugguucucaucuaugugucgugaccccuuugcaagucaaauaacccuuuuacaggggucaccuaaggccaucugaaaacaucaauauuuacauuauaauucauaacaguagcacaauuucaguuaugaaauaaauagcaaugaaaauaauguuaugguugggguaacaggaugacgggcuguauuaaaggccacagcauuagggagguugggaagcacugcucuaagggaugcagcaaucgugaaugaaccuaggcauuaucacaagagacugcuuuaacucccccuacuaccuaaacggaggaaaaacugaugcuggaaccaaagagaacguguucucuagcacuagagcuaccaagaacugagagccagucccuggucuggugugagugccuacugugugcuggguaaggguuguuggucuaaaaggccaaaagacaguaagagaugaacacucuagccauuauguggugccuggaacuuugggcacaugaggcagcucuuccugggagaaaguuguguuccagcugagcuggagcugacaaagggaguuuucaaggaaggcgaacagaacagggugccugcagaaagguccucguguuuggggagagcauggagauaagugagaaccaugcuuucagggaagaaagaaaccuuuggcuuugcuuuggauaaaugcuaagagggaacuaaauauguggacagaggacagauguaaagacauucagaacuaccaaggagucgagaguagagggcagcacccuuagaaccacaggcagaaaggacucguagguagcuggagagacuagcgaggccgaagcacauuagaaccuacauuggagggacgauguaugagguuaucccaggagaccccugugagaagcacuuggaagggaaauaaagaaaccagagcagguagguguccgggccacuaaggauaggacaagaaaguggcggcuuguaggggaggacacucaggagcaaagaagagacagaauauggagucagguuagcaaauugcuguggacaagccacugacuguuccacaagaggagccaggacgagggggaggcuagaaaaguccauguccaauacacagcauugauuuccuuagugccucaaauccugcgaggcucugcuuuauaauuugacacuggccauguuuucccaagguuuauguaacugcggcuuauggcggccugaccugagucagagcucaggagaguuguuuaauacgaacugauuuccuguugguuucuggucugugccauuauuuccucugcuaguuucuuucucagagagaagccucuaggcuggggccugaagagaaaacaggaccaaucuuccugacuucccuaggccugccuucuggaaggguccuggaucuccugcuuucuuccaucccuaggauuugugugucugucugggugaggcaccuaggugcuugugggaagguucacuggggaauacaaguucccaaggcauauugauucucugggagauaaucaacuucuuaggcagcucuucagggacaacagguucuaggggccacacuccucauucuucuuucuuuagcuccuccaaccccucgccacauuccaccaaggcacuagagaaauucaaacgccauugcaaggcugcauaccaugccguuaacugcaucccccuaagugaagacugagggaacugccucagagucauuuucugaagaaaguaugacuguacucaugagagcuuugggguuaauggcugugggguuuuggauagaagacaacagaaguugccaguuucucuuguuuacuggggccaucuuuaucuuuucagacuggaggccagcacucaaucuugcuguccuggacugugcugaggagaccaacagugcugucugcagagaguucaacaucgcuggcuucccgacugugaggguaugcgaagggggagcuacaguugagugguucuggccgagcacacaauccucuguuccgcauuucccuggcaccuuccugggcugcugagcucugaagaaccucugaauuucuggcccucaucugaugaggcaucuguuuuagagacagaggcugaaaagaaaggggugcccgcguucugagaaagucugucuuuauggaggagaggacaugugcuaauguuggcgaggguagaucccaggauugggugaaguaguuguaacauaggcuagugagggcugcuaccucucaagggucuuuuuaauuguucucacuucugacccucuaacucuuggaggucugauuguagucuaaaaccaggauacagacucugaacugugcaugggcaggaucacccucuggggaccugguggcucuucagagacacuggaaugcuucauucucaucaagucuugacccacuggagcuucaaagcgacuuacagggacaaccucacccccacagucaaaauguacagugugucggguggcagggcuuccagcgacagaagucaccaacagccaaggcaugaggguucugcuacccagcucuggcagaaaugacaugaacccgcugaugauccccugucagggaucauaggacaccaacaauuuuuaaaaaucauuuacuuauuuauuuuaauuuuaugugcguuggugcuuugccugcguguaggucuguaugaaggugucaguuccccugaaacuggaguuacagacaucuaugaacuuccgugugggugcugggaauugaacccagguccucuggaagagcagcuuuuaaccagugaaccaucucucuagcaccuccauuuaaaugacugaacaauugccaugguucucaagagcccuacacagcccagaauaauacauuuguagcuguuaagguagggcucagccucucccaccaucuaguaucuagauaagcaguuugucuacagccauuagagcucugaaggcugaaaggccaaguguuaucccuggaacaagauaucucugagcucagggaccuccaguuucagucagauccaugagcuggaacucagccugaccacucagcaguuucaucuccaggaguacuaaccuauggagacccccccccccacacacacacacacacuggacucagaggcuccccaucccagaggggucgcuuccuaaauagucacccaggcccuaagaccagguugguuuggggaacaguguggcacaucauccagggaggcucuuaccagccaccucuuuuuuuuuuuuuuaagauuuauuuauuuuuauauguaaguacacuguagcugucuucagacacuccagaagagggagucagaucucguuacggaugguugugagccaccaugugguugcugggauuugaacucuggaccuucggaagagcaguugggugcucuuacccacugagccaucucuccagcccaucagccaccucuuuaaauagaaaaucucccuggcaaggacacugcuuguccucagccccaagacagguaauaguaauuccgugagagugcucugucuuugugcagagccagagugggcagugcuaagugggaaagcuguggggacgccaggguggcagcaagagccauccuccauaggcucgcaguuuccucucucuugaguccucaacacugucuaacccacagggagagcauucaggacaugcagucagggcuuuguagggcugacacagggagcuuucuguucagccagggaggagccaggcaccugggugugaggaggaagcccagaugguugcaggucuggaggcuccucagcaccugccuaagucacgaaguacacgcagccuggaugccucaagugauuaaucaccuuaccugcccagccuggcaggaaccucacccgguccgucgcgcuggcuuuccccuguuuccagacagguaacaccuggcugggccaguucaguagacaaauguccauuuccuaagcucugucuggucucccuuggcaaggcuucccauggcuuccccgaggggccuacugcuuaguucuaucuguggccaaaugguucaggcugucgguaagccucugcucuuagacucuaaaagacucuaggcaguaccuuugaaaugauuucuuccuguggcuugcaauaagacauauauauauuacauugugaucccgaauuugguguauguuaacuauugcuaaagcaaaaguuaauauuuucuguuaggguaaaaaaaaaaaaaaaaaaaaaaaaaauacuggcugucauuuacuacauugaccacuagguugcuuauagaguguuuuaaaacaguacucacacauauuucaggucuccaaagucuugcucaugaaagccuaaagugccuguagacaccuuggccaggcacccuaaaaagcagagcagauuugaaaagucagccagcuagccagauggccccacuggcuggcugccugcgcccuguagggaccagggccugucuuugcucccuacccgugaggcugggagagagagcccuaggugaggaccaauguuggguagggauccucacauguagagaguuuugcugguaugauggggacauacccacacaaauuuggccaccacaguaagugacaugugucacuguccuuuuucucugccuucagcaccuugccacuaugcgcauguguuaaacuuccacuagcccagccaguuuagaaaauaccuaguccugaagguggggauccugcuccaucagguccccacuaggcuggggcagaaugccuuugggaguugaguugguaguagguuuuggcugaacaaacccuaggccagagcaguccccucaucauguggggaaagccuauuuagugagaauuacauggaaaaguacagcagagagucuucucucugagaugacuauugaugucuauugauaagauugccauguacgaagaaagguccuaccugugggagugcccgggcacuggcauugggguguguguggggggguagauguuaguucuccucuuguucccugaucuaauggcaguuucuguguggaggguacauccuaggaauacucugaaauagcaucuguugaugggucugucaccugggugcacagggcuguguucccaacugggggaaaggcuaggaacaacuggcacaggauacagauggacaucugguugggaggcagggagcaaaugcuggaggaauuggccucucuuccugaagucuucaccugcucaucaaagaggaccuccugugggagggggcuccagauguguguaaggaaggguggagucugacuaggacagaggagcaugggcaggaaggugagagcuagggcuuauugugaguugaacuaugugguguggcgugugguaugguguucagguucauguugaaggcaaggugaggcaagggaguaggagcccaggaauggcagguccuuggaagccaggcacacuuguagagugcagagccugggcugucacucuguaagcuccuacuggaacgcuguagcucgagggugaguucucaggacgagagagacaacuuaggugucuccuuucucugagaaguggacaugggcuccccucuccauugucacccgcuggcuuccagacaccuuuuacacugaucuuuccuagcacggagauuaaguaacuaaggcugucacucuuugugagcucauuaugaaaugcuugaagaccugauuguguuucugagaacuuguccuauacacuuggcuccagggccaccaccagucacuacugggacuugugcuuuugguucccggugucuugccuugugcuaacaguaguccuguuguggaaagaccagagccucacaggagcagcuccacagucaggggaggcagaggcuccuuccugggucuuguuuuauggugacggauuaaaaagacagcagcaggcuggagagaugccucaaugacuuaagagccuuguuagcuccugcagaggacccagguucaguucucagcaccuucaugguggccuaaaaagcauccugaaccccaggggcuccauugcccuccucugaccucugcaagcaccagacacaggcaugguauauaugcacgcauguggguaaaauacauauacacauaaaauaaggagagagagagagagagagagagagagagagagagaaugcuaaugaaugaacugcugccugcucucagagaaaagacucaguccuggaugcuuuguugauuuuucucaaggguaauugaccucagauggcacacaccuccauggcugacuuaacgagaauacauuuuccugaggacagaaaugugcccugacuagauuuccacuugagccuucaagaugaugaaagggcuaucauugcuggauuggacacaggucugcuaagcagcugagugugcuagacaccaucgauaccaggcacaggggggcuugcagcaauguauaagcugugaguacugccuaagucagucaggugggugguugucuuagucacugcucuauugucguaaagagacaccaugacgaaggcagcucuuauaagagaaagcauuuaguugggggcuugcuuacaguuuuaaaggguuagcccauuaucaucacuggggaacauggugccauguagguaggcaugaugcuggaaaguaguugugagcuacauccugaucugcagacagagaaagagaguggggcaggcaagcagacagacagacacugggccugauuugggcuuuugaaacuucaaagcccacccccaguggcauacuuucuccaaaaaaggccauaccuguuccaacaaaaccacaccuccuaauccuucucaaacagugccacucucuggugccuaggcauucaaacauaggagccuauggggccuucuuauucaaaccaccauggugguuacugcauggaaaguccagguugaaguucacuguaguaggaguguguggaaugguggcaggucaguuuggguucagaucuugaaaggaaggccuugaauguauugaguuaggaucuugcucacccuucaugcagagcugaagaagacucccauaguuaugccuuggggaaggaaacauaguggcaagacaguugaagaacagauugagagaauaguauuucuuuuauuuucauuuaguguguguguauguguguauuuguguguguguguauguguauuuguguguguguauguguguguguguauguauuuggaggauagaggaacuuucaagagucaguucucuccaucuaccgucuaggaccucgggauuaaauucgggcuuucacauuggcagcaggcuccuuugccuguugagccaccucccuccccagcugagaacugacauuccugacccaugaagagaaagcaaacaggagcuacuguaauagagcagggccucaguuuucuccuguuggcccugggcuguuggagaguuauccccaaugcagaguugcagaacuugccagguaacuggaugaggguuguagcuaagggcaaugccagugugggcagcagggaggaggacugguugcugggugagguaaggcacaggugcaggcagagguugaaggagggcucacucagcauugguguguaggcacggggccuucacaccuccguggagcuuagcagauggaaccagaagucuaggacagguaaguacgagagacacaaggcucagauaguaaauguguuggacaaagugaaugacuugguaacagagagcaguagguuuauucuugauucauucauucauucauucauucauucauuugaaaguauaaacggagcccuuuccuccugauggugccuguaagggcaccuuaaacacagaaugaucugcucugauguggagcagcaggagagccuaagagcagcagauggaaauuaauggcaguggcacagaaugaagucaggacaagggcuaacaguagcugagaagggcuggucugugcagcaaaguagggaggguggcuacacagaaaagaaaagagaguuucaagaauauguguaugaaaacaagauaaaagccauggagaaagguggaaagcagccagcagcuacugccaagagcaggagaagcaccagagagacaacuugggacagcuagagagaaucgccacucgguucugccggaugauuuuagcugagcggugggcucagaggcagggcagagaugucuggggagcagaagagacauuugucagugcaggggaacaggaagugcagagacugaagaaaggaggucucucuaggccugcccuuccucccuuuugucuuucaguuuacggaucucucuguagccuagaaaaggggcugguagaaaaaacauuuaacgagaaaguuauuaauugguaggaaaaaaacuccaaaguccacgagauaugggagccacauucucagagggugauaccaucccagaaggaagcuggaagcgucugaacaccgagaagguugauaauggcccagaacuccuuuagcugugcagucugugggcggggcucuugagugacucuugaguuucagugauagauuagagcuuugaaauuuaggcucaaggagaugcuuuuuguugggaggagaccagcaccuuuuaagacaaagggcuugggucagcugaugaaggagaggcaccauguuguucuccguagcucugagaaaggcacaccaccaaaggcugguccacggugugagagguguagcagugagcugaagucuguccucccuguacagagugagcacagcagcugucacaugcugagcagaccacccugccucugagcagcagcgucuguccauaaagauucuuagaaacccguguccucauuucaugucacaauucaggaaauuugucaucauuuuacaaguauuagaauaauaauuuuacuagguccggauuuguucaguaacuaucaaggacaugggcacauugugacauauguaaaugagcugcuuuuauucaugaauaaaguauugcauuuguauuuugaaaaaagaguggaguagagagcaggaggaaggcagugaggucauaggaagcagccaaucacaggaagggaugguuggccacuguggucuguuucucaugugaauuuucccuuccugucuacacacauauggaacagaccaguccuagcuggucaguauuucauggugcugaagggguguguauaggagggagugauagugauggaauugacauuuaaugagucaguuuuuauauguacuggcuccuguaccuuaauuacucucaguuuuugauuauugagucguauaacaguucuaggcugguaguaccacuuuauauaugauaucauuauauauauaauuuuauaucucguuuaaaagauuagaauacugagguuuagagaagcagaaagauuucaaagguuacaacaaaaacaucaaagccaggucuugaaaccaguucugccagacccuauagccuugaccuaaucagcugcuugggauaaagcugaggccuugcaguuggagauagaggaguaaacuugcaaaaaaaguguuccugcuagcaaaaagaagaagccuucaggcucuucugcagauagcuugucucccaggacaaccaacauucucucucaggauaggaggccauaaguaagaggccugcagcuaucuugccccuuggccagaagcccagguuguuacccaguguuccuucucaccucucaccccaaugacacacuaggccuaggaugucacacacuugggaaagaguacaucgugaugucgaaagaggcugaugugugcgacaaguccugguuuuguaggcuugagucuaccgcucaguaggaccuguccuggauccuugacccuuggcugagugccaugaugggugggcagcgaguucucacugagaagauaccagucucagaaccucuauccaggaaauagaacaagggcagaucggcacacgggcagccaacacuggccgaggagucacuuccuucuucagauggucugcauggagaccaccagugacuucacuguucgcuuuaacggcuuccaggaacuacgugcagaggccagcuuuuguggaguuggucucuaguuacauuccugagcugcugccuucagguucuaagggugcguuaagcauuggcaaagaauugaaugucaggacacuagagaagcaucgcagaacaaagccucccugaaguccaucacaggggaauaaagugaggcgcaaaagagaagucgucccuaagcagcucaagugccaccucugaccgcucacccuugucuguucucaguuuuuucaggccuuuaccaagaacgguucuggagcgacacugccaggugggugcucuaacuccggcuguuguguuggcauggccagcauccucuccagcucuucugccuuuacccagguucccacagggugaagcagggucuccaagugaagucuguuuggguuuucccauaugucuucucagagagccuggcagaaaagccaggaaagcccauugagcagcccuucagaugugccccauccaaaguccuaggucugagaguggggcaccacauucccagaacagcuguuaugucaaaacgagguugaguucaaagaacaaacccguggccaguucugagggagaccucucugcccucagcauccuugacccuuggcugugugccgugaugggcugggauuucucccugaggacuccagccucagagccccuuuuccaggaagaggagcgagggcauaucagcacauggaaagcuaacauuggccaaggagucacuuucgucuccagagaaugaaagccacgaguggcuuuucacugaugcucacuaaacagcggucaguagcugugugcagggaugggccucccgcuagucuucaagccauggagcccucaccucaccacuucucaggagagggcuggcaugugcuuucucuuggaauuggugugaggacccuuguuugugacugaaacuggcaagggugcuggggucugaucuguccugauacccucuuccuguuuucguuuauaggugcuggcgcuaaugugcagacucugcguaugaggcucaucgaugcucuggagucccaccgugacacauggcccccagccuguccaccucuggaaccugccaaguauuuuggguuggggcaggcuuaguguggcaugaggcucaagcauggagaaggcguugggaaccacagggcagaggacccacauugauucuuccugugggguagauaccccagugugccagacauaccuuagagcagccacaagcgacuccuuucugcuucaggugucgaggagccaugucucuuaggagcuggcugagggucgaagggccugaccuucuggauggaaggaaaguaugugaggggcuucuccagagcgugcuugcugcugcuuccucugacugcccucaggaggguuuguggguguaggagguuuuucucuggccuaguccaggggaggccacugacagaugagagggcagaagagauugauaccaccaggaagaaaaggcuaggauguucagaagaguaaaagcccugcuuggaaacugauucuggacaacuggucaaccuguguuaaucagcuucacagcgacuccuuuauuaucuuuccaaauuccuuaucuuccuagagagccucacagagggagacccugggccaagcauacacuccuaauguaggccaggguucuacaaccgacuuucucucuggugguuauugguuuccuuuuuucucugcuguaacaaauaccugagaaacaauuuagagaaagaaagguuuguuugcucucauuacuuuagagguuucgacccaaauuuggcaggaccaaucaguugggaucugagauuauacagacuaucauggcagccagagcauaugacagaggcugcucacuucaaaaaguagagagaguucaggacaguacagaccccagggacauguaccccauuguauacuuacuccagcuagggcccacccgauuuggccauugacuaggaauccauaagcuggguagucugauuaaaagucagaccccucgugagccagucaucucucaauggcuaaagccuucagcgcaugagccuuuuguggggacaguuccuguccaagcuauaaugucauccaucuaggaugagcuuguaagccuggacccuggugcuuuucucccugcauuuccuccuggcuauguuucucucucucagcucucucucucucucucucucucucucucucucucucucucucucacacacacacacacacacacacacacacacuauagugugucuucagcccuggggaccuuaaaagaaacaaaguggccacauuugucaaccugucucuaagugauccuuuugaugccccuuaggaagaauauaggcagacacacgugcugaaacuuaagcugccucuuccagaaggcugaggacuugcuccucugccagccuaggguagguaugaggauguggccagagagacuggccaccuaaugccacccaagaggcugauguuagguagcuacagaaccucuuuuauccaucaaaggcucgcccuaauccccacuugucugucauaucuacccauacugccaccaggcuggguucuggcauugaccuaaugccacccuuucucuuuggaggcauuugcuacaugucuuggguuaaguguggggaagugagccaccagguugaggauaagaggaagaugcagacuccccaaccugugugccuucucagcuguccuccuuaacauucugggagagacacaguuuucacugaguauuuaaaacaaucuguagguuaguucucugguuaagagauaggauuugccuucuuaaucauuucuaccuaagaaaacugggccucacucucccucaccucgagcuaaaagguuccugcacccaggacucuaguucacuucuucccuuuuuguuccuguucugagaggaacaugcagcucucccacuggucauggcuugccguggaucggggcuugcacuugauagguucuaaucaccagucucuuagggaaccaguaagccugggccuuccccagaacauggagacagcugggcugaaagcaacccuccccaccacuucucuuccccagccugccucccauuuaccccugacucguaaaagggacagaaagaaaaauauaaaacaguaaacccaagguggguugaauaaagcagcgugagguagcaugagucgcauccucugagaccuaaggguuuacuuuccuuccauuggugggcuggcagagggaggccacaggguuaugggagacaugcuacacuggaagugaugcaucgcugggaggagucuuaccucauuuccacaggcuauggagagcaaguggccccauuuaucucuugcaggcugaaugauaucgacggauucuuuacaagaaauaaagcagauuaccuggcccuggucuuugaaagggaagacuccuaccuggguagagaggugagcugccccagcguuccugacucucagaagagaccccgggagagagccugguucagaccagugcaggcaacuaaucccuguacauuuauuagccaggcucugccugaccccuggugggacacaggggaagugggacaaaguggaaguuccuuuccacuuuaaacguugguaucugcucuuaccucucucucucucugaaacuaaaaaguaauaccugcuauuuacugagucuaggacuagauaccaacacauugcugcuaaucucuaaacuuaagagagcaguguaaaaugucuaggaucacacagcuauuaauguagaacagugcugucugacucaaaaccuguguuguuuuuuuacugcccuaacuucauagaauugggguuuaaaaaaaaaaugagggaagcagacacaugagaacuagccuggucccuugugaggaagcuggaucccugaccaacagugaaggcugcacuucuccaucaguuuaaagagcgucuuaggucugagccuuauuucuagcuauuggauagaaguaguuaugcuuauucauauuagaauugucacuaauuuacuuaaaaagcuggaucagggcuggagagauggcucagcgguuaagagcacuggcugcucuuccagggguucugaguucaauucccagcaaccacauggcagcucacuccuaucuauaauggggucugaugcccuuuguagcauguagacauacauguagaaggggcacucauacacaaaaaacacacauaaauacauacaaaacaaaaagaaugaaaacaaaaccacauuuggccauguuuuaccauauucagguggcacucgaauaggacacacaaaguguguggucugaacaguuucaaggccccuugccucaguauuugguaguuguaaccugaggguugugucaacuuugucacagcggucugcucuucgagguuucaagucuagauagaacauagcugcuaccuggugccuacccagccccaggcuaguacucagguuccuucugcccacuggguaagccccauccacacccuacugucuucuacagguaacucuggaccugucccaguaccaugcuguggcagugcgcagggucuugaauacagagagugaccuggugaacaaguuuggcgucacugacuucccaucuuguuaccugcugcuucggaauggcucugucucccgagugccugugugagugugacgucccugcccagucacucuuccugccagagaggucacuagaaagagcaggcagguaggagaagcagaugugugagucaagaccuccgaccuugcagcucaggauuccugccucggccggcccugagcuccgaagccaucuacaccaugccaugaccauguuaucccacaccucugugcacagagccauguguugguggggugcuggccuggcgaggacucagaugugcuggaccuucccucccucugcuuuucuaauugcagaaaaguucauuaggagccagacaauagucugcuccaaaaugucaggagaaaacaaugaagcagccucagcugcugucagcggccugcugcugaauggccuguuaaauggcaccagcuggugccuugguacccucccucccuccucaggcagaugauugaugucagccuggcccugcuggcagaaauuuggggggccaaggaaaucgaggcuaccguagguacccagaaaucuacuucuuggggcuguuaguaccgcccuacacugaggcugggcuaggcagcccccucgcccuuucccuguccugguccaccagugcuccugaggccggccagccagagucaggaaacaugauguucacaaggccuggaaggcaagaccccaggcaagcccagagagugccaguccuagagaaagaagaggcauuguuucccuggcuuggaguugcuggaggggaaaauuguuugugacgaugcugcuccugagccaucugcucacugauagacacugagcccggauggcagagcagggaaaccaugcuuccugacgcuggcucccaugggacguccugucacugaugcuuaucuuggcuagaccuuuuggaggagauagcuccugccuucaagacuccuguauuaggaaagagaaaucaggaguguuugggcaaaccugguucucuguuguuauuaugucuaaaaucauacaucagcucuuugacuuccaugggaaguaaugucaacuugugaugucaccugcugauguuaccuugugaugucuuggaacaagcuugugggaggguggcugucuugagaccagucacacccagccauuccugucaugggcagaagcugguggucuuuguuugguuguuuuucucuguggugcuggggacccugggcuugcacagcuagguagcagcucuuuugaaugcauccccaguucucuguagcaaaauggaugguguucccaguggcuaccugccucagucucuguagaccguggccuugccuggagccagaaggcacacugaguaauucucaggcccaguuguuuuuccagauagggguuccguaucugguggaaaagaggguuucuauaccauggacagugaauggacaagugaggcccaaggagccaaagacaagaugagaccaacuugaaauguuucuuacggcaccuuucugugggaggagccaccuauuuccccugcugacauugguuagcuaugugauuuuuuuuuucuuuguccuuagcacuuccauuuucuuucuuuacaggcugguggaguccaggucuuucuauacauccuaucuucgggggcuaccuggacugaccagggaugcucccccaaccacagccaccccagucacugcugauaagauagcacccacaguguggaaguuugcagaccgguaaggccaccugguucuccucauacauuuccuucaugaauacugccuuacucaucucuguuccugucacaggauagccuaucucuguuccugucauaggauagccuaccugugucccuucaagucuggccuugggguuuguuuguuucauuuuguuaucucuguguugccgggaacccaacccaggacuugaacgcccuaggcagacgcucucggagaccaucucgaugaguagcacacugauacacacugguccuuagggaucccuaacugcugaccgugcucaaaaaucuugaugugggcucucccaucuuugugccaggaccccagugccgaauguguguuuaccaaacagcauuccacguuguccuuuauaauagaaggagugcuggcuagcguccauguuauauaaagcuuaacuuuacucaaaaagcaaguagaagcuagccgugguucugcacacuuguaugccagcacuugggaggccccagcagcaagacugugaauuccaggccagucucggcuucguggugagagagcaagggagaaugagagaaagggaaagagaguugggggaauggcaaguagaguccacguggaggaucacugaggagguucuacacuaacuucugcccuaagcauuguuucuucagugccaggcacguccuaggcaccauggguucagaucugucaaauggggugugagaccugagggcuggcagccgugcacauuagcucugagagcaagacaagcugcugcccuugaugcccccgcgcccucugcugucccaguucccagccuuagagucuuucacucccacagagggccagcuucucuagagcuguguguguguguguguaguguguacacaugcgugugcgcgugcacuguuuucccaccccuagagauuuuugcuuagagcagaaagaagcucaacaccuuugcauaaggguaauguaggcaguugcugagcuaaccgugaugguugccuuagcugauccuacaggacugauguggucucugauuauacccuuuauggucccucgaagcaucccgccuaggaagucacacaguuucaucugaaugccuggucagggagcucacucuguuuuugggugguccuugucacugugcacaguuacagguguggaagaaccacguguuaugaggcucugggcuuugcuuuccuaguaagcauccugaugcccugcauggggauggagcuauagaccucuugcuucaguacccagcuccacacuaagcaaagaugucugaccaggcagcuuaguacugacucucuaagugggggauguucagacagcugggagaaagccacuuuuuaaaaauguacauuuguauuauuuacacauauaucuguacuguggccacaagaggucaucagaucccuuggagcuggaguuacagguuaugaaccaccuggguggugcugggaacugaagccagguccucugaaagaacagcagguguucagcucucucuuuagcccuaggaagccacuuuuugaggcagaacauggggacagugagguaaacugaggcucagggacaccacaguggagacuuggcugagaaugaagaagugcgagugcucacuggucaucuugucaguuggcccuguuggcuuugucccaucaagaggagaaugauuggucagcuuuacaggugaggaacccaggggcuaggaaguaccuaagcucaaaaaaccuagccaggagccagaggggagugaguagcuggcauucagcgcuguucccagcaguaccugagcugcccccguggaagcauggugggcaaggaugggacagcuggcuggagaggugcuagaccucacagggucuagcagcaaggugcauaugagcccugaaagagcuaggcaauguguuuccucacccaucucuccaccaucccagugccuggccucggugggcaacuaaccucuuggccuuccacguucacagagagccuagcuuucccagagccuugugugugggcaccgaugcucugugugucugccccaagggucuuuguucagaacacacugagccugauuggugaguuacaggaggagcuggcucugggccuggagagaaggccccacccaccuguagcaagcugguuucucuguuuucagucaguccuccuagcaaccuaccuauaagcaguauacucugccuguuacacagaggaaggguugaggucuagagaaauuauucacccagggcacucagcaaaccgcuguuagagccacacgccacgcauuacugugacgucagcagugcucccucgcucugucccuuuagugcuugcucucaggcuaaugcuucucuucuuuccacuucuucuuaaaccucagcuccaagaucuacauggccgaccuggaguccgcacuccacuacaucuugcguguagaaguggggaaguucucagugcuggagggacagcgccugguggcccugaaaaaguuuguggcaguauuggccaaggugagcaggccccggcuuccuuugucucuggaguucauaugugauuagugugcaucucuggagaguagacaccaaaccagucccuuccuugagaauucaggucggacuggacaccugggcccauagcugcccgggcccccauaggcgucugccuuccucuuauagccguauucuuuaccagccccacgugaccagagaccaucuguccuguagagcagaggggagagacacacggccagauaucccaauaccugggacucuccucagucauggugacugccugcuuaccuguguucucuaccucacuuaagccccagacuguggugucuuacuccccgccaugaugacugggagauaggaccucggaccgccagagugaagaggggugcuuucugcucugcugucuuucuccucaggcuuacccaguucccuagcguucccugguagugucucagaaagguggcuacuucucagagugaagcuuuugguuauuaaggaccugaugucugacaagaauuuagucuuuuugccugcuuuucagaguugugucgcuaccauuuaaggcccaggggcucacguagcuugcccuaagauagccagcaggagcagacuugaggcauuguccugagcugucauucccuggccucccgacucugccuucccauccaugggcagcccugccugcuuugcugcugagucagggcugucuguccgcugggccugccugcugacucagccucccuccgucccagcuaaucugagccugcucuucccagcggggccugggcaaucuccagaucucacccauuuugccaccauucugacccucuuggcuugguggccuguguaucuguauacaaagaagacccuguaaggaauguugcgggcaaggcagagcuauuuccuugcuucagcggccugcagccuguacuccacaauacugaggaggccuggugcagacacccugcugaacauugagaaggagccaauccagagcaagccuuuguaguguuuuccuaccaccucagugagggacagcucccaugugcuccccagcccugcaggccucaaugaggagaccccgagcccaggucagauuauuucagaggaguccugggaagcaguaguuucuccgugcugcuuggaucuguguccagcuguaagcaggcugguauuuaguuugcuccccagcggggcugugauaugagaggagacagaaaguauccagguuagauaaaggccuggacagcacacucucagcgauacacucagcuagacccucagcaagagcaggagaugaggaucuacuaaggggcucuuuagccagaagccaggucucugagaagaggacugaggaaggcccacagugggugcaccugggacccaaguguagaggcccugucugaccuuugucugcgugacugauagcguccuauaugcuuugcuggggaccuucuuucuucccuggagaagaagaaucaaagcugcuuccuuuccucaagcucuggcaggcugacagagugugcgguacacuguguguuugcuuauuuuccauucuuaaacucugugagugguacucaucauucuagagauggggaacugacagcccggggggcgggcgggggaucgccuuguugaaggugaacuucacauccauggcuccuuuaacauccucccucuccucugacaagaaagccuggaguggagagcccccccaccccccauccccacucagccugccuugucacauuugagccguuacuagggcuggccacuggguggcguuuggucaccgagguuucccugcccuugcuguccagagcccuuuaauucaucgcugcuucugauacguggccuuagaaggcagaaagaaggugccaagucaggguggcaggcagaggucagagagaagugcugacuuucagcuguaaaucugcguguggacccagagcucccgggagcugaccaggaggaagcgcucugaagcacaagucuuuccggccauuugucacucuggggggcuggcuagccccugccguuugauaaggaggguuaaugcccucucggaugcugccucugugacacucucauauuaggauucuucuccuggugucuuccuccuccuccuccucuuggcacaucucucagcucacugucuucuccaccuucaucuuuccucuugugguuuuaucugcucugcuucaccgcugcguccccuucaccccaccccacccccacaggcguuugcacaugcacacaugugcacacaugcacacauccccuccucccuugaguccuugugguuuuaaagugcugauacuaaucagauuugaguugacuuauugucaaaguagcuuuucauguuccucugaggcucuugggaguuaccaucaagauuuggaucuuggcccuaagcccuaggcuagccuguccauacuggcggcccaugagcuaaaaaaugaaaggucuuuugccagccuagccuauuaccaaugaagguuucuccucaguuugguucuugucuuuucaaaagaaagagcugagccaagaaacacagacagcuaaaaacaguuuacuuaucaaaagcaaaaaggagagugcacuccaagcgggaaugggcauuccaaagggagguggguagagucccacugggcccuguguuagggauuuaaagacuuuuuauggugccucccucuggugacaccacugacacccucuucccuagagcaugaucuuucuuccaucuuauggcuugagacgucccugcaguuuuuccuuccuggcuuagcaggauguuugucguggggaggggguccuggugucuguuuccgaagaacccaaccacugcucccaggaggcugggugauaaagggauucugggcaucagagagcagcugccaagauacagcugcaguuuuccucaauuaccugacgcguagccccuugccuacuccacauaaguccggcugggccaucaguugcugcgucagaagacugccugaagagauuugugcccaguguucaaggcaguccuggggagugguguggugcuuggaacuuucucugagugguuucaugugguuaggucagcguuguagccugagccuugauaggagagacccacagggccuaggcuacauagaguuucuucuccucuguccagaauagaguauaugaauucacauuugugucugaugguuuuuguuacaacguaaaacucuauagaauuguuucuuacucuccaaucgccacuugcuccucccuacaguacuucccugggcagccuuugguccagaacuucuugcauuccauaaacgacuggcuucagaagcagcagaagaagaggauccccuacaguuucuucaaagcugcucuggacagcaggaaggaggugaguccagcaggcaagugaaggcccuaucaaugccucgacaugucugggacugggaggacuuaaugccucaacacuuggugacguuauccagagguuugcauuaagugauuccauuuaucacuaauaagcugcuucguuggguccuauggaauaucucaucgaauccucauacaucagaauuuucacuuagcagaugaagaaagcaaguuuaggagauuacauaacgguucuagccuaagacccuguaaggaccugucagugaacagagcuaacaccucugagggaugaggcaguggagacuuauuuuugagauagggccuuacucuguauauaaggcuacugaccuugaaacucagcaauccuccugcaucagcuccccaaaugugaagaugauaggcaugagccaccacauuuaucuaagacaccagaguucuuaacucuugccugcuuccccagcauggcccccagcagagcaccuguucuuucugcugucugcagaaacaagccauacccaguggacauacagacccaugugaguuuauaaggagucaagguuccagggaccucgauagaacuuggucuaugccaugaguucucagaucugcuaaucuucuggccaagaagauggcuguggugcugugggcuccuggaagcuucucuugucauccccguuuccaccccuucucuugucugcuugugcacucaugcucaugugugucccuucuaggaugcuguccuuacugagaaggugaacugggucggcugccagggcagugagccacacuuccggggguuucccugcucacuguggguccucuuccacuuccugacggugcaggcaaaccgauauagugaggcccacccacaggaaccaggugaguccagggccugcucacugcacucugccucaaaucugucugucugucacaucugucugucccccaugggagucagcuagacugauccuguauuagugggaggcagaaagaaaaggaaguguuugcaggaauacaguucuggagaugcugagaagagggaggcagagcugacagagccaugauguggggcaguuagaccuggagugggggugggggagauggagcaggagggggcacagugguacagacacugauguugcaaagcagagacagacacacacacacacagacacacagagagagaugggagagagagagggggggggagggagagagagggagagggagagagagagagagagagagagcacuccuacgagguccugggggauagagggagguuacuuucuacagcguuggagcucugcagaggaaggaauguguagaagcaacaggaagugagccccaagguaucugagguacaggaagagaaaaaaaacauagaaagugugggugggugaccuucaggagagucugguuucaguucaagaaaaagugugggagucgacagagacccuugcuaguaccagccuauaugggggagucagagugagaauaaggagggacauagaggcagacuagaagcuauuuagaccagaggaggauagacuucuaagagggucccagagaggugaggcucgccagagagcaaguugagugggagcugaagcaggcagguggaggaggaggauggaggcugggaugagugaccugcuucugucaccugucuagucaugccacagagccugaacgucccacugaagaggagagggggaacugaaguuuaggaguuugggaggaaaugggaccaucucuguggugacccccgaaaggguagaaguaggcaagggaguauuaggccugugucauaggcuggaacgugaggcacuuugcuggggaccacagcagaguugaggaggguggggcagccuguggggaacccugauggagacagcagaggcuggcagugugaagagccuuucuguggugucuccuuuucccugcagcugauggccaggagguccuccaagccaugaggagcuauguucaguucuucuuuggcugucgugacugugcggaccauuuugagcagauggcugcagcguccaugcaccaagugagaagucccaguaaugcgauucuuuggcucuggacuagccacaacaggguuaacgcucgccucucagguaaggagggcuuacuuccaaggcuggagguggcaaugggggccauacuggcugucauuuucaguggcacucuaugcuucuuacacauaucugccaguccagucucauuggccccaugugcagaggaagcagauggggacacugaaugacccuggugcucagugcuaguguuccuuccccugcuggucccaggaccccucucuccugcuccuccgcucugcggucccucuauaugccucuuaucagacuaacagggaaaagagcauggguuuuccauacccagagaaaguucuuaccagagugggcuggggaguggggagccuccccaauguaaguaguuacuuacauuguuugccuuuccgugcaagugggagcaugguaguuccuacacagagccugggagggagccuucucuagacuggaugcuacacaucuggggaguaguguauaccucccaggcagcccuccuaggguaggaguuggguggagccgcugguacuguaagccagcacuugguucccuguccuggagucuccuaguggcuuuuaaaaagaagacauauaggcuggagagaucgcucagcaguuaagagcacugacugcucuuccgaagguccugaguuuaaaucccagcaaccacacgguggcucacaaccgucuguaaugggaucgaaugcccucuucuggugugucugaagacagcuacaguguacucauaugcauaaaauaaauaaauauuuaaaaaaaaagacauaugccuaccuucucugccagccucuuccccuguccuuaccucaccucugccaccaaaugccgcaguggccaggucacccuguaggccagaacugugccaguuuguccagggcuuguuuggguuuguaguggugcuuggaauggaaccuugggccuagcucaagcuagguagacacucuacuacugagcuauuuccccaaauuuuccucugccuucuuuugagacagaggcauccagacugguccugaacauucaauccuucuaccgcauccugagaggcagggauuacagaccugcaccacugagccuggcuaccugcuccuuuuguuuuuggguuuuuaaucuugguuuauuuuugcuuuuguuuucuuucucuguaucucucaccucccauccuuuuaaaggcuuggugagccuuuuuuugcagaugaaaaagcugguguugugaacaaaagaaaccugagcuccaggcagaguggaugcuauagcucacugaguguacuccaggcagaguggaugcuauagcuaacugaguguacuccaggcagaguggcuguuacaacugaguguccuucccuccccaggugcucugagugaggacccccacuuccccaaggugcaguggccuccccgugagcuguguucugccugccauaaugaacucaacggacaggugccuuugugggaccuuggugccacccucaacuuucucaaggcucacuucuccccagcaaacaucgucauagacucuucugcaucuagacacacaggccggagagggaguccagaagcuacccccgagcugguaauggauacauuaaaacuggagagcagaaauucaguguugggccaugagcaggcugcuucugcagaguccccuggagccacugcccuagauguaccagcugagaagccugaagcaaguggcccccaagaacuauacacaggccucagaauggguggagcuucaccagggcagggcccuccugagcgcauggaagaccaccagagggauaugcaggagaaugcccccgggcagcaacacuugagcaagagagacacugaagccuuauuucugccugaggugaaccaccuccaaggcccuuuagagcucaggcgagggggccgcagccccaagcaacuagcccccauacuugaagaggaaccagaggcccuagcuauacagggccaaggccaguggcugcagguucuaggagggggcauuucccaccuggacauuagccucuguguggggcucuacuccguguccuucaugggcuuacuggccauguacaccuacuuucgggccaggcugagaaccccaaagggccaugcuaguuaccccacagccugaacugccucggcagaggacagacaaggagcugcugaugucuggggcuuuggguuuuuuuuuuuuuuuuuuggcccacuggcccccuugcuuccuuucuaccccuuguucuguugucuagcuuaggagaguggcaaguccaagaaagugaguuguuucagugaacccuggagucuacugugagaggauucccuagacaaaacagaaucagggugccagucucgccugaccagcaugggguaggagcagccugacgcaggggcucaggaggcuucugggaggcucaggcccuggcuucagcaccaaauucuguuuuucagcucuugugaaguccugccccauuccugcugaagucucaauguguccugcuuggucuuggccuuagauugaggcagacaaguccagaguuuccaagguuucucauccagaggaguguaugugggccgggugggcuggaguggaccuccucacugcauucugagacugucuacuccccucccucacgacaugaagaaaaagcaucccuccggccuucucuggccuggccagcuucagcaccucaggaguggguggggcuuagcuucaagaaugggucugggagccucagaaaaugauucuggucacccagguucaaacugggguuucugcugcaagagugugguuuggcaggcugggagggugacaguugcugcacuguaggguguagugcuugcuuggugguaggggcaagggggugggugaugcuggggucuguagugccuuaguccugggcuagcugggagagggcagacuccucucugagcgggggugcuugucucuuacuuuggucucuaaaaucaaugcuaacuuugggguguggaaggugcuggguuuagggcagugggcagagcccucucucucccgcuuggguccacugugggcaggaggggguggagagaccagcccacauuuccuuccccugcuccuguggcuugggagggauguggaauaaaauuauuuuuguuaagucacgcagaacguguuugacuugauccuuggagagguauugaccgugucuacaaauguacagcguccagccucaccugagcagguggagcacuccuggggacaggagcaggcacucacccaaccccccacagagcacucugcgccccagccugaguauacacacacacuggggacaagccuugguaauggcccugccaccuccugcucuccacccucccugagaccuaccccgggugucugagggaccugucuggagcugccaccuucagcucuccuggagaggacuugccaggcuuguccagccagccuggguuggcugcucagccaggagucagccuggauuagacuuugccccuaauccagccugcuggguuuuacagggaucagggcagcugauaaugaaccucauuacggggagcuuugggcuuuucucugacaucuucacucugcucagccggccucagcucugggugcagcagguggaccgccaaggacaccccgugcgcgggggcagcuggggugggggagggugcagcuggcagggcauuugaccucuuuagcagccuggcuccugggaugucugagccucacccugcauccucugcuugagggucugagaggcugacaggccagcacacagucaagcaggguuucugaaagagaugccaagggccuuuguucaaggaagugcccuaccaguccaagaccacaggggguuccuuaccaaccgugccccauagccugacugcucacaaaaugucaaguagagauuccugucagccaauccuagaguaccaguagccauacuuacacaagucaccuggguaucuaagauuuggggcucuccuggaaaugcccuugcaggcuugcuccaugaugcuuagccacgggaccgagcgcaguagcagaguccuacuugagaccugugguaugaguuuccuucugcacagagagccccuuggcccuaucucaggccuucugguugauaggcagggugagcuccugccccacugccuucuaccuuggcuucccagggcucauguccagggcucggauaagccagccugcccaccagcuggcccccuguccugcccaugcagacauccugggacuggggcuuccugugucuuaacgggccuuucuagcuguuucuuugguagaagaggguucaaagaguccuuuugcuggguuggacagagaaacacucauguucuaggaguuaagggucuccuuaaagugacaguccaauaaagaaaaaaaaaaaacuauuacuacaaaacagaacaaaacccuuauauuauuauuaccaccauuaugucaggauuuccugugcuggguuagacuagaaucaggauacaagauaggacagaugugguccuugauguuagcuuacaagggaauccacaaggcuccucccagggaccuagcaauggcuuacaucaucaccugccccuaccgccccaggagcuugugagcuuguguguguuuguguguguguguguuguguguguugugugugugugcucgcuugcacucucccccucgcuuucucucucuuacacacaacacacacuuucuccccuuuccucccucccucuuuuucuauccuucccuacccucacggcuuaagcuucugucugucugacugucuacauguccacucaccugccucuacccucacuccccucccuucccccagugagcccccuuuauaccagaucuguugcaugguguaauuucucaggggcacaccuuggcacaggcccaccagguucccccuugcgccauuauauuucauacccccugguguuacugacugaggggcggugggaucuagugaucagcauacucugcaggagagacaccagcagggacacccucagcaggcucuucugugcccgcuaggagaccaugugugagcugagguuuaugucaugaagacaugguguggggacaccauccaggggagagcucuuuucuaauguccuugcucucccucacauucuggccacagcacucuccugagggguccuggcugaaggcagccacaggccaguuguauccugauggacccucuccucucgggaaaggggaacucccauagcaacaccaggcaggaucuccacagcucugucacaguagugagccaccugccugagccuccugggguguggcuuuccuucugaggguuucauugccuccuagguuu

SEQ ID NO: 442 - RNA, 1996 nt, Mus musculus
uaugcucgaucuccaaacgaagaagggacacuucggagaccaaaggugagagguggcuuaacucuaugcagacaagaggaggggcgagggugcugagggcgacacuggcagguaagcaaagaaaucuugucuuccgugggcaccaguagguccgggagcccaggucucaggaugacccuccaggaaaagucucgggacccaaggaggguccccgggggggacgucaggcagugccaggggggccccgccccgccucucuggccaccucggggaccugggaccgcggacagagacauccgaggcggagcaggcuccgccaggucuccccgcagcucaccugagagugucgccuccgcccucggcucccacggugcaucccgcggggccuggcggagggugcagugacgccgccccgaccggccccagggcugcccggccuggccuccccgcuccggggacgcaccgggugcccgccucgccccggcucccgggauccgccgggcggcaggcaaggaaggagaggcgcagaggcggccuuccucugccccgccgcgagcccccucccgagcugcggcucuccgcaguccucucaggcgcagguccggccccgcucccccgccccgggagucacuucggcagcggcggcccagucgccauuacagcucaacaacugacacggaggaggagcggcgccggcggcaguggcgguggcggcggcgcgaggcagggcgggagcagucagggagggagagggcggggggggggggagagagacucgccaaaccucgcgagaacuguccggagacgguuccgcaggaaugcaacccugggugaaggccagccauguugaguguggccgacggaggagcgcgaucggacccgaggcuagaggaugcggggaagccaucuuugguguggcgcuuugggagcucggcgggacucgggaggagccagagucuauccgcagaggagaccacccccuucccuuugacgcuaauugggccuucuggcugagcgggucacccccgagccaaaacacgcugaggacuugacaagggugacccagggauccgggacccggcagacgauucagaaggaaucgucacucuaggcggaucggaguaaccgcagcuuugcggcugcucgcugcugucacugcggcccucucauuggccagggguuuacaguucuguucagcacgcacacugauggcuuaagcucuuuccaaaacaagcaaaaacuacguuuccuuucccuucgguguugugguuugagaagcccucuggggucaacauauuuucucuuagcuuugucuuugucaccagccuccgcuuggugaauuuuaucgucugucaagacuguaaaggacagcuuuucugcgaauaaugccugacaccuuccgcuaggugcucacugcagcuaagcucuccaccuucugggcuccgauaguuacuuugccucgaaauuauuucucaucuaaaguaccaugggugucuuaaagucuccuuuuucuauguauacccaguagggccuggcacaguaacuacaacacuguagauguucaauaaauguucgcuaccuugaccauaucaauaaaagcagacgacaauaacugauccuccccauaagacagccgcgccucagcaggaacuacgugaauguacaaaaguccugcacauaugucaauguauacacccucccugagaacagcacuucagcaaagaaugagaguuguggagaucccgaguacgcaagcaguagcaagaaaaagauuugaaagguggaacugcggcagggaaauggauuagcagguaaagggaauugccaccacgccuggcgaucuuaguuugauccccggacccagaaugguggaccaagagagcagauuccucuaagguguccucugaucugcauugcgugcaggugcaugagaagacauguaugauuacauacauacauacauacauacauguaauaaaaagaaaagugaaauuua

SEQ ID NO: 443 - RNA, 985 nt, Mus musculus
cacaccuacuccaaggccacaccuccaaauaguggcaaucccugggccaagcauauucaaaccaccacagagaggcacuuacaagaugauuucuuuuaaugcuacuguauuuugauagugggucuacauuugauagugauuauuuuugcagacaguauuucuuucaugugaacuguuuauaagggagaaaugcagagagauggaaagcauauuagugguugaucagugguugauaggugggggaagggauguagccucaauagguuguaugauuugucuauguuuguuuguuuuuccucucaagguuuuggaagcuuagcuuuuugcauggccaugaaacuuuuaagggauaggcuuacuagaaagugaaugggguccuuucaggagauuguggguaguuccuauaagaaagaguugcuggaaaagaaggagcuagaucccucugacuugccaggggauacccucccuugcacaugcaucccugccaugaugucauuuguuaugaacccucaaaagagucagugccaugcuguugaagacuuucagcuuccaaacuguaaauaaaaauaaaacagaccagccacugguaauucgugagaguuaacagaaggcuuuucacuguaacauacaaagcuucuucuugugaagaaugaaaaaauguuuuaaaguuaacuacagcugcccgcauucaacaauacaccgauugcugauuuaucauauuagggcuucagagacauccaccccaaggagaaaggccugggaacuuacgcgccagguuccauguccaugcccucuggaaccgaaucaauaauguucaacagcgcuuccagaugaaacuucauuucauuaaucuuuucaucaauuucaagccacucuucaguggguacuugagaauaaucaaggaaguuuucuaacuugaaaacacacauguccaaagaaaugaccaaguuuggaagaacuuuagagauaccuaggaaaaugggga

SEQ ID NO: 444 - RNA, 525 nt, Mus musculus
cugucuccuguuuuugucucuuuuuuuuuuuuuuuguuuuuuuuuuguuuuuuuuuuuuuuuuuuuuugccagucagucucgcacuuuauugucguugucaucucaggccuugacugcauacuugcgcagaggauacagccgcuccuuccgcugcugcuucuuggucuucagcuucuccucgugcuuggugagccggcggcgcauggcucuagucuucuugggucgcaggucuaggggcuuguauuucuugcccuuguagaauuuccugagguuuucuuuuugagucugguuaauaacagugaggacucgggcgauagacuugcgaacgacucguaucuuggagagcuuggacgcggcaccgccugucacuuuggcgacccgaagcugggacaauuccaccuucagaucguccaguuguuucaacagcuccuccuucuucuugccgcgcaggucccgagccuuaaucuuggccauuucggcguuguucacggcugaagcagccuaguucgagaccuguuuuuguc

SEQ ID NO: 445 - RNA, 22174 nt, Mus musculus
uaaauucaauuuaaaauuuuauuuuaaaguuguacuuacuggaaaaacauuuccuaguggcaaaacuagaguuuuuuuccucuaguuuccugucuguauuuucauaaauaaaaugcacuaauuggcugaacucuugaaauaauuuuuuucagugaaaguuagagcagacuuauauuuuuuaaauaaaucaugaaguaucuugaacauguauuuggauuugauucaaaauaaagcuaagauuuguuuuacauuguggccaauauuuacauuuaccaauauucagucaauauaauuuuuaaaauaacaaggauuugcauaaucuuccuugaaggagaauggaacuguuuucacagauacauuuuuauaguaguaaaauguauuuuaaaaacuguaccuguaaaaauaaguugugcagaguaacguguaauguuuagauuuggggaacuggaagugaaguucugugucauuuacuuggaggugucagucaauaggcuugaucaucaucuguacugcccucaaggaguaggacccgccucuguauucagcccagaaaaugccaucuuggugcuugcuucuguaaugaccaccucuguaccauacuccguugagguuagagugugcacaggcguuguaccaccagccuccuuuauggaagugggcgcaguuuccugcaggagaaauagagacagugaaguaagaguccuucugugccaugacacuugcagacugccacacguaugugcuucuuuuggagccguuugagugacugacuccaggaggagucacuucucauuacucacuuuacuagaauuaccguauucauuucacucugugcugacuuaacauuuaaauaauuucauuuucuucaaaguagaguaaauacaugcaguauuuguguuuaagaaauauauugagggagacaaaggugaaaugggcaggauugacuaagggagauggcagagcuugaaggaaaauugaagucuggaaguagcucagcuaauuaaaugaguguaaacagaaaggcgggcuuucaguccuggcucucuccuuccucuuuugccgguaggaaguaaguuaaaauaguguccaauaugcugcuugguaaggcaauagcugaauacaaaguuaagucaguauucaugguagguaugucuuuuaucaguacagaaacauguuuuuaaaaagacagaaguauaguagauuaaauuucaugaaacuauuucuuucuccuccaccucaagugauuuuaccaccauugugcugcauuucagucucugcuguuuccaucuaagacauacucuuagaccauauagcuaaaugguuuaccucccauaagccuuuguugagaugaugucaucucauaagaaccuuuucuggacaacagcacccacccaagagccugaugcccccagccauauucuguucccugauggauuguuaguguuauugccaacuugacauaaucugggaagggagucucacugggagcuguguagguuagguuggccuacaggcauguucuugggggauuuucuugauuaaguuaauugagguaggaagaucugccugcaguaggugguaucacuccuuaggcggaaguuucucaacugaauaagaaugcagaaagcaagcugagccaccagcauuauaccuuugucgcucugugcuccugauugugggugugaugucaccaaaucccucaagcucuugcugccaugacuuccuugcucugaggaacuauagccuggagcugugagcugaagcaaaccccuuuagccucuccuuaccccuuaaguugcuuuucucauaguuuuaucauagcagcagaaaaaggaacuaaaaacuguuacuugguuucauuuuucuaagaauauuuaucuccaccuaauaaaacauuuugucuccucuugaaaggaacccccaaaggacaaaaauuuaguuccccacugagucuccagcaucuacaguuucugacaugguugguguccagcuauauaccaauguuagucagaguuucauuuucuuuuuauuuauuuauuuauuuauuuauuuauuuauuuauuuauuuauuuauuauuauguauaaguacacuguagcugucuucugacacaccaccagaaggcaucagcucucauuacaggugguugugagccaccaugugguugcugggauuugaacucaggaccuucggaagagcagucacugcucuuacccgcugagccaucucaccagcccagaguuucauuuucaaguggguauagguugguuuuguuuuggcucuccccagaacuuguuuuucccaaagaacauugagguugccuuagaaauccuaaaaaccagauuauauauauucccuuugacuguguccaaaauacccuuugugagauugagggccugguucuguuuaauguguagcacguauugaaugacagccaugcuuguuugcuuuaccuguguacguaucuuuaucucuguccagcguggugaacuguuuaccauuaugccacaucauagaguccccagcauuccccugguacguccccaggcgcagucuguaguagucacuuucgggcuccagacgaaagcugcuguauucugcauagaccuucuucucgcuccagucuucuaguucaaucaucagcuuauaauugucuugauuacuaagcuuguagauauuguccaguccaagccaguacucuccaucaauguuuccaaacccuuucuguuaauaacacagacacaugaacauauugguaaguuuagaugguaaauguugccacaacuacaaaugaaauuuaaauacugagcagagugaggauauuguccacucaaggugaugugccaugguagacagccuuauuuuuguuagugcgcuuugguuccacauugacacuuucuuuuccuuugcuuuauuuuaaugucacuauuaguuuuuguagcuucaaaugcuauaaagaagaguaaagccaaagacaauaaaauucauugauaguuucuaaaaguaucgaacuaccucaauccuucagaaagguuccuggucauccucauccacagauguguguucugagagcauaugauacugugcccauaguaggcagacagagugcaucuaaaaccaugaccauuguucaaacaaaaugauagcguguaugucuuuaauuuuauuauaaguaaaauuagcaugauaguaaucuuuacaguucacccugugaaaguuguaaguuacugucugaaagaaguggacuaaauuauuuuaauaagcauuugacauuggacauuugcagcagaauauauuuaguaaaguucaucuuaucacugaaaguuugacuucaaagagauuucaaggaaguugccccacucccaauuuguggcaguugagguuuagaaauuucuggacauauuacuguuuuauucuuaacugccagaaauuuucaccugagccugaguaagcacgugguugcuucacaguuugaacauggaagucguccucuagaaaugcaggcaaaacagacucauacaagucaacauauagauuuaaaaacuugaaaauggaauugaguuaucuuuguaaaauaugcaugcauguauguauaaguuauccagacucaaaagauacauuuaaaggauaauuuuaguuuucuuuucacauuuuaauucuggcuguucaacuagaaaagagaauaauaaaccuuuugcuagaugaugaauaucaaauggauaguuauguuuuuagcaugccugggagggucacuauuggaaggccugcucaggucuaccuucuccaggucugaacuugcucauuuaccuuauaauuuucccaguuucugaagaaauugacagagccaucuguucuuuucugaauaacaguccaacccccaggauccaaacuguucucacaccauaacugcaucagaccguugcuguuuucagguuuaaucauguaaauuccacuggcugaguguccagcuuccuuugcuugcugacagucuuugaaugguccuguaauuuaaauauugauuuuugagaaauguaaaagauaaguacuaaauaauucuuaaaucaauauucuuaccuucauuuguuucuuuacagauaaccacauuuuaucugcugugugcauaaugcucuauacaaguugaagaaacuaauuaaaauacauacaaagcuaaaggaaagggugacaucaggccaacuccucaaagcauuagcuuguuuuaucucccacucuccucugcucuguauacuguagauacgcacuccuaaaacgcaaugcauuauauugauucuuuuuaacaaauguugccugaagcuauggucuuuauuuauucuagcagcagguuagccccuggugcuucaguugucuuguuaagguuucuucuucugaucugugcuauagcacacacugugcugaaugccuucauucuuacaagcuuuacuuucuucauacauuuuugcaaaaugcugugggauugaccugcuggcauuuacauacguguuuuccuggugccagacuuauagugucugaacuuuuauuucgagggaacauacaaaguugguauguucauuggaaguggagcagcagccugguaaguucugacaguauuaagcauuguguucccuuuugguaacucggucguauucauucacucacucauuaauugcuaagaagcucuagaaauaaagaaaguagagggcuggagagauggcucagaguuuaagagcaccgacugcccuuccaaagguucugaguucaaauucccagcaaccacauguggcucacagccaucuguaaugggauuugguguccucuucuggugugcaggcauacaugcauacagaacauuguauacauaacaaauaaacccuuaaaaaagaaaagaaaguagaaccccccaaauuuaaauaauuugaacuuucccucauauucguaaagaaugcgugucaggccagguguuccaccacacacuuuuaaucccagaacucagaagcuaaggacagaugauuacuacaaguacaaggucagcuugggguacguagugaguuccaggccagccuggcuucaguggagacccugucuuaauacuagaaaaauguaggaauguuggucuaaaugucucccuaagauacuggcugaucucaugcaugauaucauggcucucuuauggcuaagaguaaucuucuuaucagagcugcccagugacccuugacagcuuuucuguugcacagauaauagcuaguuaaggucaugcgacagguaguaguaguuaagguuaugugagguggugguaagcccuccuucaugcucacuucugcucccagguaaauguucugaacuccugcgcacuguuugcucuuuuauuucauaguauucaccaggccauauuuuuuaauuuauuauucugugcaaaaaagucagaagacagccugcaggagcagguucucuccuuccuuccuuccuuccuuccuuccuuccuuccuuccuuccauccauccauccauccauccaucagguaggugcugggauugaucucgggcugucaaguuugguagcaagaucuuaccccugggcauuauauuuuuagccagcuaagauuuuucaacuucuuaaaaaugaaacaaaacgggcuggugagauggcucaguggguaagagcaccugacugcucuuccaaagguccagaguucaaaucccagcaaccacaugguggcucacaaccauccauaaugagaucugacucccucuucuggagugucugaagacagcuauaguguacuuacauauaauaaauaaaucuaaaaaaaaaaaaaaaaugaaacaaaacaaacaaaaaacaaaaaaaaaacaaaaaaaaaaaaaccaugaaguuaaaucauuuguagugucugauugguacauugugggaucuacagaaaauaacugucuaguucuacugaacguccuuaaauuucauaacuauaccagugcuucaaaauuuuuauuuuaaacagcauacaaaaauuauggcucagaaaaaaagaauuaugcuaaauauagauauauuugaacaagggaguuuuaaaggcauucaucaaaaauuuuuacugaauauuuuaaaauucugauguguaauuuuuaaguaucugaaacuaguuuagucagaauucuuaagauuuuuuucugcucuauaauuuuaauaagauugcugaaguuuugagauaacaauacauaguauuguccccauugguucuuacuaagauaaauuaauuucauuauguaaacaccauucauugugucugucauuggaggcaacuuggggaaugugagcucuuccuucuggauugccucuugaggauggagucgccgugcucugcugacuucacgucucucuccauguuucaacugggcaucagccaagguuguuaagucaaugaaucaguccuuuaguuuuaaguccaaggaaauggaaagcaauauguacaaacugagugggucagagucucgaccccauagucuuauauuucauauauagcuuuuucaaaauuuuaaaauuaucaguguccaucuguacuauagauuauuaguaaaaauauaaccuggaaaauggcaucuuuuaaaaauaacauuaggagagcuggagagauagcucagcaaugaaugcucuuccagaggucuugaguucaauucccagcaaccacauggugucucacaaccaucuguaaugggaucugaugcccucuucuggugagucugaagauagcuacaguguacccacauacauuaaauaaauaaauaaauaaauaacaaacaaacaauuuuuuaaaagguaauauuagguauuguggguuuuuuacucucaguuucauuggcucauuuuuuucucuucugggauuuccuugguuuugugucuauuaugaaggccuccagaauaguugcuaaaaaaaaaauuauauauauauauaauucuuguuuuuugcauucccuaguuugcuaaaguuguuuucauuuugagaugggaucucauguuguagcccagguuaaccugggacuggugguguaguacaagcuugucuguaaacacagucacccuguuucagucucccaaaugcuggaaguacagcccucuuugcuguaacugguucagcguuuucuuuucaagucaugaguggauuccagaguucucaaaguauucagagauucuuuuccucuuuccuuucuccuuguuuugagacagacuuuggucuccagaugcucgugccucagcauccaagcgcugggacugugugugaacacugugcuuaacagagccagugucaccagggacugucagucccucuugccucucuugucccuaaccuucaugugcaaaaguacuguacuaaauaucuuuacuuaauacauauaugcucauugagcuguuuaguccggcuaguugaagguuaugauauagucauuucugucacagaaauaaaacauuacugaaugaucauguugugaaaauucauagauuaaaaauaacagcugauuuuagccaguaacauacuuuacauucugcuguguuccaugcaccacaaaauacuauagggaaacaccucagauauugaugucaccccuucucuuucccuuaaucacauaagaauaauuucacauuguagaccauguguugucaggcagagaagaaucauuccauuucggguagggugaacgcugugauguugccuguggaggagcaguggagaggaaaaugaaguggcccccgcucccacccuccggcuucccugcgugucaugugauacaugucaaguaagcagaaugcacaggcaggaccuuuucuuuguuggccgugcacaguuggagcucauugggggacccucagauacuaacuuuucugaugguggucauuuucagaaugucuuuggguuucuauugucauuuaagagccuuuucuggaggguggagcgaaggcucagacuguaacuuuccuucuguacagugugaggacugagucuggaucccagcauucgcacgagccagacacucgagcauacacagugucuguagugucagcacuggguuaggggucagagacaggaaaucccagccaauuuacccaaaucaaggaacuucaaauuuagugaaagacccuccuaucucaaaaaggaggacacccagggucaaccuuuggcuaaauacaaaugaacaauuuuuuuuuuuuaauuuaaaagaaugaucuuuucugaaucuagugcaggguagacucaggucccgagacagaugaagaacccugaaguuaggugggagaugagagaagugguaagaaaagguucccacacagcguggcgaagcacucuaaugagguuugaagcagaacucgugguaagagugugaauugagagcugagauugagcagggccuugcugucuuccugucugagcucagcauacugaauccaaguuaggccguugggagucucgggaccucaucuaagccacaugugggcuacaugcugaaguauguuuagucuuccacagcuguuguacauuuccuaugucugaaauauaaacgacaggaugauguuuauagccucucaggugggccagagacugccucacucaugugcucgaugguuuuacuuaaaaacagucaugguggaaucucuaaaguuagcuacauugugcucccgagucgcuacuuuuagggaaguuagggugucuaaggagcauauuuuacuuuauuguaaauucuuauuuuaagaccugaugcuacuaauggcacacgaggggcucugugagcauugcacccaagggcugcuccugucgaguagcucccaugucugagauuuggaacuaagcuuugcuuguugagaucuuacugccugcucucaaaguuuagauuggaggccauguaaagauucuguuuuagccugguuuuguuaaauaccagagaacuguuuuuauuuuccgcuauuuaacguguguuuagguguuuagauaaauugaagaauacuagcuuaucugaguucaguuuucauuugauaaaacuucuaauacaggcaaauuuaaguuuaucuucagcuucacuaauuuauccacuuuuggacaguggaccuuguauuuacauuucaggaucuuugaggcuuacaaaaccucaggaaauuuuaguucaaauuauuuuguggaagacagauaaacuugacagugccuucucuccucuuuagaaaagacaguaacuaucagagcucaguuacuggguuuuauaauuauaccaucagcucauugaucuuggcagaaacauuuucuuauuguuacuuucauuccuuuuaaauuuuuugcucuagaauuagaugauaguuuuguuuuguuuuguuuuguuuuuuuuuaaacagaaacuaacuucuuucucuggaucauauuuaacaaaaaaauuuuaaaacuacuauuagaaacuuaucagcuuuauuuuugaaaauccaaauuuaccucugguucagaaauuuggugcuucaaagaauguacacaggcaguaucuccucuauaaucauauuuaucuugaaugcagacccucuucuuggaugcaguaaucuugaaauaggauucauucaucucccaugauacacauuuuaauucuucucaaagcagaaaacuagauuccaugggugaauuugacucucccuguaucucaccuaaguggagucauaguuuuugugccggcuuuugacuccagcuuacuaauuuuuagguagaauggauugugugucuucugucaugcauauagagacucuagcauggcuaccuauguguaccacacuacagugagucacuuggugcuagagcauggaugagcgcaguaaccaccuacgucagaguguguguaugcacagcagcagcaucugucagagcguguguaaguacaguagccaccuaugucacacgacauguaagcacaguacccauuuauguuguucuuuccuugaaagucuccagugugagacacuuccccuagaguugcaaaaauuguuuuaagcuacuauguaaagagauaaaacaguaggcuuauuaauuguuuuaggaauuguuuguuaggaaucagcguguuagcacugggaagcagguuacaggcaucggucuguucaaguuucugucaugagggagggcugcuuguuaugauacaacugauuaugucacuuggcuuauagaguaaaauggaagggaaugcuuacuuaaaauaauauuggaaaguuaucucuguggcugaauuuuuuacauuaaaaauugauuuccaauucaucuggaauaacaaaaaaccuaggacugcaaaaagucuucucaaggauaaaagaaccucugguggaaucaccaugccugaccuaaagcuuuacuacagagcaauugugauaaaaacugcaugguacugguauagagacagacaaguagaccaauggaauagaauugaagacccagaaaugaacccacacaccuauggucacuugaucuucgacaagggagcuaaaaccauucaguggaagaaagacagcauuuucaacaauuggugcuggcacaacugguuguuaucauguagaagaaugcgaaucgauccauacuuaucuccuuguacuaaggucaaaucuaaguggaucaaggaacuucacauaaaaccagagacacugaaacuuauagaggagaaaguggggaaaagccuugaagauaugggcacaggggaaaaauuccugaacagaacagcaauggcuugugcuguaagaucgagaauugacaagugggaccuaaugaaacuccaaaguuucugcaaggcaaaagacaccgucaauaagacaaaaagaccaccaacagauugggaaaggaucuuuaccuauccuaaaucagauaggggacuaauauccaacauauauaaagaacucaagaagguugacuucagaaaaucgaauaaccccauuaaaaaaugaggcucagaacugaacaaagaauucucaccugaggaauaccgaauggcagagaagcaccugaaaaaauguucaacauccuuaaucaucagggaaaugcaaaucaaaacaacccugagauuccaccucacaccagucagaauggcuaagaucaaaaauucaggugacagcagaugcuggcguggauguggagaaagcggaacacuccuccauuguuggugggaaugcaggcuuguacaaccacucugaaaaucagucuggcgguuccucagaaaauuggacauaguacuaccggaggauccagcaauaccucuccugggcauauauccagaagaugccccaacugguaagaaggacacaugcuccacuauguucauagcagccuuauuuauaauagccagaagcuggaaagaacccagaugccccucaacagaggaauggauacagaaaaugugguacaucuacacaauggaguacuacucagcuauuaaaaagaaugaauuuaugaaauuccuagccaaauggauggaccuagagggcaucauccugagugagguaacacauucacaaaggaacucacacaauauguacucacugauaaguggauauuagccccuaaccuaggauacccaagauauaagauacaauuugcuaaacucaugaaacucaagaagaaugaagacugaaguguggacacuaugccccuccuuagaauugggaacaaaacacccauggaaggaguuacagagacaaaguuuggaucugagaugaaaggauggaccauguagagacugccauauccagggauccaccccauaaucagcauccaaacguggacaccauugcauacacuagcaagauuuuaucaaaaggacccagauguagcugucucuugugagacuaugccggggccuagcaaacacagaaguggaugcucacagucagcuaauggauggaucacagggcucccaauggaggagcuggagaaaguacccaaggagcuaaagggaucugcaacccuauagguggaacaacauuaugaacuaaccaguaccccggagcucuugacucuagcugcauauguaucaaaagauggccuagucggccaucacuggaaagagaggcccauuggacacauaaacuuuauaugccccaguacaggggaacgccagggccaaaaagggggaguggguggguaggggauuggggguggguggguaugggggacuuuugguauagcauuggaaauguaaaugagcuaaauaccuaauaaaaaauggaaaaaaaauugauuuccuaggacuacucugugcaccguuucuuguaaaagugagauaaacuuuggccuuggguaugccguaucccugcaugcauaauuguauggauguauuuaauuguaugcauuuucuuguacugaugcucagugugugaaaaaacuagagcugauguuuucauucuguaaaguauuuccuuuguuuguuauaaauaaauauguuucuucauuucugcuaaaauugaugaugccacugacuuaaacuuaaaaacucaacagcagcuguuucuacacuucuauaacuauaccuacuguagcuuaauaaaauacauaggaguuaucuuuaucuauaaauauuauaggaacugcuauccugauaaaucauaucaugucuuaaaaacuuaauaaaauguaaguuugaaaugaaugggaaagauuuuuuuccuuucuaaguccaguggacaguuuuguacgugucuuugaaaauuaaagggcuugaguugcugauugaccuaauuuuaugauauucuugcugcucuuaacacuuguuuucaugaaggucuuuagguugaccacgcuaagaggcucuguguuaucaagucauguaauguuucagcaccugcaguugaaaugcaggaaggagcuuauguguuagaaugccucucacuuagauggguugugguuacuuguaaaggugagauaauuuaauaaauguauguguuacagacaguagagguguuugugauuauaaacaacuacuucaggccugugaggucaacuagggcuuacggagggccuucuguuuacaucauguacucauucguucggucucauccuuaucauuugaauggacagaaguccuacuagaguuuuagaaggaaaaaguggauuuguuuuguugaaacaauuuuuuugaaggaagcacgugaaaugaaaaugagacuuucuuguagugagaauuccagaauuuuguuuuuuuaaaaaacacagaaauauuaugagaauguuaucauuuuaaucccaguuguggggauuaugggucugcucuagcagaaucaugguuuggccagcuguagauaguuucugcgauugugacauuuagaauuuagggggagguuauauaaaugcuaggaccccaagagaugggguuccugauugguuguuguugguugcaguuuguuaaguacuugugcacaaagaagaaacaacaacaagaagaaauuagauauccugagagcuaagaucaaacuugcccuaaguaaauugacaucucuaaccagcaggaaauggucuaaugguaacaucacccccuuuccaauuccugguuuuauuccgggaucucuuuccuuuccucuuuauccccuuuucucuguuaucuaguguuaggggguugaaaggguggaagaaagaagaaaccacgaaguagcaaaggacagcuacacuuggguuuuucuugcacaaaauugaugagcagcagcacggugugugcaugcuuuacaaaggaggcugguaccagugcagaguguguugcaagggaauggcuguggggagcagucagcaagcacuuagacaucuggguaggaugugucaggcacugcugcagcacuucuguacuaagcucugagccaggacccagcacuguuacucccacgcccgcucccuccccuccagcuucuggaucuaaaugaccaguuuguuuugccucugaauguuuacaggggacuugaguagaauucaggugacugugcuuaugggacaggugaggaucaaauagauaagucugucaguuuuacucagagaaaugugucuuaagaauauaaucuucagaaaacaaagugguuuuuaaagguuaaacaaauauugauagccauguuuauaagaagauaaaagaaaugaauaaaauguuaacuguuuauuucugcuucuuaggcuguugagcauuuuuuaaaagauaguugguauuuucuagauuuugucaaguaaauauguauuuguuuggagacaauuucucuugguagcccaaaugaccucggaguuaggaacucugcaccgccucucagcccaugcuguaguuagaggaaugcaccacccaagccugcguuauucuugucauuauaauugcuucuguaggaaaguguuggugagaagaugauuguuuuaggacuugcuuacuuauucuucacauacgaugagcacaguaugccaaaccuggucccacaggaaggcaaacaaauggaucucaguaacuccaguguagugugguacagaagacagaaagcagagaaaagagggaaagaaagagccuaggauguggaaaaagagaaguucaguauugucuguuugauucuuggaagucuuagcauuagucuugaaagccuugaggugagccuugaucacuuguuucaguagaggaacccuugccacagucaggcggcuccuacaccagcaggcagguaacccuugccauccugagaugugggggagcucuaaaauacagucuggaagacagcuuguucaugugacuguggaagccaggcgcaaggacacaugugucaguggaugccauugcugcagacagccucaugcgugcgguggcuuccuagugcagcuuuuauguccugccuuuccuuauguaaaugaguuuucaucuuccuugugggcaucugagucccuccucccccauuguagggaagcaguaauguaacagguucaggagaguggcuugugggacagcggaugcacaugugacaguucuaagugaaacacgggacucuguugugcacugggugcucaccccagagucagggccagagcagagcagugagaggaaggcagggugcucaguaucauuuagccuuggaagacaagacuccccuuuucucuugagguagcaaagguagguuuuauauagguguuuugaaguuugaaagaacaagaacccaggaccugaugagacuuagagcaguguaggaagcacacccugaguggagauaaggacagacgacugcaggccugaggacaaggagagcacaagguuaaauacuccuuuugaagacagcaagaaggccagaggaagcagugggaaucugaaggguggggcugcgguggagcuggccgcaaagugggguguagagugaguuccuucagcuauaugucaguggucauucucuuugacagcagccuccauuguaagaauuuggguggcagagugcuuuuuuuucccacagaggggaaaaauuauaaacaccuagaaacuuauagcacggagaaaagagauguuuuauaucaaauccaaacaucacuuuaaaaagugaaaauuuugauuggacauguauaauggcaucagcacauaagaaguaggacuuacuaagauaagaguauuguugcgugaaucauacagcaucagcauaccagcuucguucuuccauuggccaggaagcaguaacucaccuucauugaugaaagucacugcuggaaucuugaaagggcuuuucgugggagcuguuggcagaucaggugguggcauuacgucucugggguaaccugggucccucuguaucucauugccucccagcagaccagggguguacugguggcuguuaggacugugucgcgguaccaccuggacaagagggggagacgcgugggggucuugucgggaaaacauccucaggcacugcucuuccaauacagugaucgucacagacugguuauugacaagauccgucaaggacgcauacuucaccucuagcucccuguaccuuguugccaucuucagcauuucuguggugacauugaggauuuuguuuuccagcugggaaaguucgagugaauugucucuuuuacggaugaucucauguaguagcugcauguagagcugcgugacucuggaguucauguuccggcuuuccuuucucagcagcuucaccucguuuacaauguucccguccacaucuaccaccagcugcaggacaucuaucucccgcuucugccuagacagcacauccuugagguucuccagguccauccuggugaucauguccuuaauagugccugcauccugaccuuugguguugacacagauuggcccuguuauuuuuuguucagguaccaagaauguauaugaacauuucuuugcuuccucuuucccaucaguagcacggggauaucuccuuuggguuauuuuuuuuauuuugaguuguccuccuuugcaaugaccacugcccaguaggaagaguaguacacuuaggguccaaacaaaagccuucauuuugaaaugaaauucuaccacagcgucuuuuaggaagcagugagugaagaagaaacaaaaauaauuaauaugaguuuacauacaaacuaaaauuacauugagauccuaucuugucccuguuagaauagcuauuauuaaaauauauaacaaaugcuggcaaggaugagcauggagacaucuuuucuacacaggcaguaagugggcuauaagcuagaacagccacuaugggaguccauauagggguccucaaacaagaacuacaaccgucauaugggugagauguuuccuucuaucugucuaaaggcucuaagucaacacacuucagagacacuugcucacauuuguuuauugcaacauuaucuacuacagccacguuauggcguagguguccaucaagagaagaaugaaaaaaaauuauauauuacauacauguauauauaauaauuaaaguauauguauuuauauauuauauauguauacagugccucaaccauaaacaacaaaguuaagucuuuuuuuguugucuguuuuuuauuuuucgagacaggguuuuucuauguagcccuggcuguccuggaacucacucuguagaccaggcuggccucgaacucagaaaucugccugcuucugccucccgagugcugggauuaacagaguuaagucuuacugcaaaaaaauagaauugaagucaucuuacuaaggaauuagaccagacccaaaaaggcaaauaucuuguauuuucucuuauuuauagaaccuagguuuuuuguagacaugcaugauacaugacaugaaaacagggaauuaugaaaauagauuauuuuaggaaaggacuagaggagaaaaauggggcaugaauaugaucaaaauacaccauauacuugaacaagaauacuaugcaacccagugaauauaaggcuaaucauuuuuagaguaguuacuguucugcuccugugguaacacacagccagagccaccuacuagagaaagaguacgucuuggcuuacauuuccagagggaugagaaucuauccuaguggagaagcuggugacagagacaggaguugagaagucagaccagcaaagacauggaacuggacgugggugggaucgggcugugaaaucucaagcccagcacagugacucuucccaucaaggccacccacagugccaucagccccggagguggagguggggguggggguaggggcguuuguguaaauacacaagccuacagaggacauuuuucauugagacuacuaagggaauacugagagguuuguauuaguaaauuagauuucacuugaagucucgaguucacuauuagguuuguagguuuguauuuugacauuuguguaaagaugagacccuucucuugaugagcuugcagcugccaccugccaucuuacucagaggagauuuugaugcgugcccgugcuauggaaggcacacugccaggccuggggacccuuuaagagcccuuagaaagcucacugccucgggacugagaacaguacgugaucuuacuacucaggguuuuagauuagaaugcuauaagaucaguuaaguugaucuucugcaauaaauacugcgacauuuuuucaaccuaccaagucagacauuuuagaccaauagaaagugagcauuuuuauaucaucgcuuuggagaccagagacaguuuuaagaaugacgagaugcucccugucgucguguaauuguguuuccugaacugcaguuaugguucugcuuuaagcuuauaggugacucgguggguguguucuguuaagaaagucugguggguuguauuuuaguuuuaaaaaauccuaauugucaacaagcauuaucaaauuggauauaaaaggucuuuuuguaccuauguguguacuaagggccaaagcaacacugauauuagaaacaggucuaaaacuuugguucccuggccccuggucagaaucugucgcagccacagcuacgccaggauguguacuuggacugugcccuguuggcuguggcagaugaggauuaccuguuauuuccagucugacacuggaacucuuuccaagaaccuagauuucuuccuuccucuuuaguucacucccaagugaguagugcaguagacuggggaagaagugggcaaaguguguuugugcucagguucauggccaagcuaccccacagcagcuucaugccaucugcuguuuguaaggcuagcagagggcacccgaggagcagagggcaccucaggaccuuuucuugccaucuuugcuacuaccccagcccuuguuucuugaucuaagaggucgaccccgguuguuuauguguaguccagacagcacagcacuaacacuacugaauaccuagugagugcucucaggaggcauggcugucuucaguuccuuauauaugaacaucacagccuggugaggcagaugauucugauacucauuuguacaggaaguggugcccuaaaggcauaucaguagccacacagcuguuaaaagauagagccagaauuugaacccagguugucuucuaucuggguauauguuuuuaaguuaaccguuucaucauauggcuccucuuucuaaacuacauucugucagaguugcacucucuguagcagaaugaagaaaagaaaugguaucacuuucaaaagagaaguccccgaggaccaaaaccacucauaugggauucagauacuagaccugggaccuguguuuuacagugucuguaguaacagaaggcaucuuggcaugugcugccugcagcuuucucuggccuguucguguguugugcaaaagcaugugcaugccguugucugcagucuggccuggucuacaccccauguugcugucguuccucucugcccaugugugcuccaucaguugcugcuuauguaaucugacuugcaaccccauacguacaugcacgcacaaacacacuuuucuuagugaaaugugggcuuucggcggcugugcagauagauggccgccaccucacuggaaagcaagguccucagaugcuguuuccagaagagaaauaauaaacacagcaaagacugggaagagcuggggaguugcucagugaaaugauaccauuuacucggagcuuucuguggcuggcugauggcaaaggcacacaagugagaaaguuggcuccuguucuguguugugccuucugacaccaggaaauacaaaccugaggaaucacuguuucucacagagcaucucuuacucuccaagaguuaccuguacuaaaacugaugguauauuuggaguuauauuuacaggaaauucuuggaauuuaacuguaguuuuaucaaaacaaagaaacagaacaguaaaauaagguaaaaagccauuagccucugggcaaauauauaucauuucuccuaacucuccuugucuuauuuuaauaauaggacagaaaggaaguaucagggucaccaggauuaauaguaugaacucaggaaaugucaguacugaagacuugacucauaaaauuauuuaaauacuuucuagaaugaaauaagcuaccaaaacaagggaacuuuuaaauuaaaagcuugaggaauauuugggguguuggucuacucugccuugagucacuaugguucguaaaaucaaucauaagauuuaagaugguguucaaagcuccuuccggucgcuguuuguucuuugcuuccuuguuccaucagugaugagcgcauugucucuuuaauuggaguuaagagacaucuuuaaguaguagacuagauauaagcgaagaauugauuuuuaaaauuuguucacucucacauugucuaaaaauacuuucuuauuuaauguuucccacguauguucagugaaagcgccauagauaugucaccucguaacccuuccuauuuauguuggguuucuccuaggucucaggggaauguggaaaauuaguuacagucacucaaguuugaacugcgccuuugccugguggguuuuagaaaagggguaaaaaagcuugugcacuuauauucauauucuuaguaguauuucucuguacuguauugccagcuauaaggaggauaaaagcugccuucccuucccuucccuucccuuuggcuguacccugcacugagagaagccaaaggcauugaaguuagcugaggagcacugacuggccagguggaagaccuuccuaagaauagcccuggaaauguccccaaaauagacagacgugaucauuugugauucguucgcacgcacacagacacacacgugcauucgcucugugaaaugccugcauaggugagugagacuugcuuucaucguggcaggagccacggagaugaugguguuucagauggaguaugauuucgagauuuuacagacucuccuguaaaauacguauuuaacagagcucagaguugagaguuuuaauguuuaagcaaaguugaaaaaacaaaaucugaacauuacuauuauuuguuuguugaaaauuccuaccacuaaagauuaaaagucagggaauccucccaccauaaccgcuugcugucuuugguguuaaagcuugcuguuggugaguagcaauuucauaauucucaugacuaaccaagccccccaauagaauguugagggcaugcuccugccucuuagggacaguuaggaagguuauuuuauuuuuauuuuuuuaaaacaggcuuuuggccuugccaguuuuucuucaguacugacauuuucugaguucauaugcuuaauccuggugacccugacaggucucaauccugaccuugaaggagguuuuaauuauuguuuguaucaauauuacuuuuccaaggaauuuccagcuuuaaucuguugcugaaaugaaauuucuguuguaggaaauuguuuaaaaugauuaaucauaacaagaaauaacauagauuaacaaagacucagaagaguuuuguucaguuguaacugagauucuguugcaagcauucagcugaccagcucuuagcuuuguuuuguagccauacuuugaaaaucgcaguaguuggugcacgucuuuacacacacaccaguguucagaagagaaacucaccgcgcucacaguuguuuccuuuauccuacauccuucgcuguguaagccuuaggcauuuacugaguuacuuguaaaauuuuguaaugucacuagagcauuuguguuuagaacccagcauguaugucucaaucuguagucacauaugaagcacuucaugacuauuuuuacagaaagaugcaaaacaaaaccuucagauacaaauuggcagcaucuucuaaaguucccugagaaaucucuuacuuucuaguacaaaggacaaugaugcauuugacauagaauuuugaauaaaucuaagagaaauauuaaaauaccuuuguugucuguugaaaaaagcgaguccgugaacgugcguccuugcccuugcucucugagaucaguguagaaguuuguucggcuuuacuucagagguaacugcguuuuuugcucugaccggugaauccaaggaguaaggaacuucuuuucacagcacuaauggacugaguuugcugggccaccuauguaacuuggggcuaucuguggacuucucuaaugcagcagagaagguucugugccugugcugucugcugcauggaaaugugcagaaaccagccgcagcugacagacuguccacacaguccgaagagugauucccucucguucu

SEQ ID NO: 446 - RNA, 1404 nt, Mus musculus
aucaauccgggacuaggggaucccaaauauuguuauuugcuccuuaaaccaccggcagccacccugcuuaacaccuagaggccgacccaacacuuccggcaugaugaugugcuagagugcagacuccaucauuuaagaucccacggcuguggggugacucuucacauuugcagucccccuccacuuguccgccacgacuccuaaggacgccgcccucacgggcuggguauuugaucugggggccaagcguuuccagacuuuuguccucuggcccgagcggggagcaacgcccgcgucccaggcgccaacgagacccgugcggggagcagccgcggggccccaccuguccguccugaacccugcggcucguccuugcggccggugcugcgccugcggcuggggcacgcgccucggacaccgguacggggcggcaguuggccucggggggcauagcccggcgcccgcagacugcgccgagaccccggcgacccggcguucccggccgcgcgagcgcgcucgguuggugcgcgcgccgcuccgccccgcccgcccggcgcgcgcccccugcgcggccgggguggauccagcgcacuccccucccccgagcgccggcggcaggcgcugaaugagagacgccgacugcucgguugggcgagcgauugccucggagccgcgggcgaagcggaggcgacggccgcggcugcacaggucggcguggcgugcgggcguguggggaggcgcgggcaauggcggcggcggccgcggugcgcggcgcgggagggcgggcugcgggucgcucgcggucccgcgguggcggaggccccggcgucgccucagccucucaggugagccggggccgggccccgccgcgccagccacacccccucucggccggggcgccugcacccccgucaccgagccgaggcgggugaccuguugcggggccgaaccgcccgcggagcgcggggugagcggcgccgcggcggcggaggccgcgugcggacacggaggggggucccgcaccgccgcgcuagcugcccgcagcgccugggauuccuuugcugugugggcuuaggcgggcucguaaacaccgggcucggggaggcgauggggagcugaccuggaagggagcccggaccugugcgcugccgccgcggcuccccgccccccucgaagcgcuuuuccugccgccgugugcgguguagacgcaggcggguuucagggugcgugggcguguuugggaagaagcugcgagcugauaggagguaccuuagugcgaauguuaauuuguuugagcugggaggggugagggaggaggaagaaaggggccuguugguggccguggaggaggggcguuugcaaccccaaaucccucugcagaaagcgcucuccaccgaaagcauc

SEQ ID NO: 447 - RNA, 2019 nt, Mus musculus
guaaaagucaccuuccuaccccauaccuggcauaccuuuuuaaauuauuauuauuauuauuauuauuauuaauuuaaaggacuuuuuucuuucuuucuuuuuuuuuugguugguuugguuugguuugggggauuuuuuuuuugguuuuuugguuuuuuugagacaggauuucucuguguagcccaggcuguucuagaacuauucuguagaccagguuggccucgaacucaagaguuccaccugccucugccuccagaguccugggauuaaaggugugugcugccacugccugaccauacauguuucuuaaagcaaguaauguuuaggcccauuuucuguuugaauaauuguuaucaguucuucuagaacauucuccugucacugauccaucuaggaaagcacuugagcuuugaaaggacaaggguggugaaauuugcaugagagagaauaaauuucuuucagaaagauccugaggaagacacaugauccaaucgcuuguugcucagaaguucaaggaaacaaguggaguggcguccccuggcucuuucuaggaugagugugugugugugugugugugugugugugugugugugugugugugugugugaaggcagcuccugagacaacauguaacaugccuacagaaauaccacucuuaggacacuccuuuaaaaaaaauguuaaucuacuuuguaaaccaguaacucccagacuuucuugaggcuuuguuuuuguuugguugguuuuuagauuuuaaaacauucuauucacuuugaaauguacuauauguguuauauguauauauaaguuauagugacuugaacucuguuuggcauaggcugagaacuauuguugguagcauagaguguacagagcagccgcugacugucaccaucugagagcaggauacagaagggaguuugguuccucagcagugaaugcccaggugcuugagcaauggcccagccagccucagugaggacggcaagccacccaaggagaggagaagagaaacugacccgcugucccagcacacagguuuaauuuuguacucuuucauuucuuuaucaaaugaccucauuauucccuaaaaagucuuggaacugaaaaccagacugaacugucggugcaguggcauuuccacagcugugcuucggggguucuguccucuguguguggugcaaguauuuagaauuaauagcauggauaugucauguccaaacccucaagggaaaauuaccaauuuccacuuaaccaacagaugaaaugcuaguuaacucaaugcccacuauccugcagaaaagcuacagucaguaguaaagggugggguuggcuggugcugauacuccuuagucguauagaccaacucaagcaacagcagcauuauuuacugggucacaccugggaggaacuuagcuuccaaauuugguuuuugcuuuucaucuccagggccuuaauaagaguguguuaauacacaugacuauuuuacagauaauucaaaauaauuuauuuuuuauuugaagaaagcgaaauccaccuuaaaaaaaaacaaaacccaagauuuuauuuuauuuuuaaagccauauuuuugugcuuuguagcacuuagauuguuccauaugugauccauaucugcauuucauuaccuggguucuaaaaaagauuuauuuuuguucugugaauaauuuuugaugguucuuguacauguacagauauagauacguuugaggucuuuuauugauauuccuacaaaaaauacaaauaaacuuuaacuuuaaacauuucagacuaagaguugcuacuaucuuuuacaaacaucuggguguuuaggcacuuagaacacuccacuauuguucugaagauguauuuuacguugggagcaucaggccuuagccuugauaacuggcacugugcugugcugugcugugcugugcugugcugugcugugcugugcugugcugugcugugcugugcugugcagugcugugugugcugugugugcugugcugggcugugcugg

SEQ ID NO: 448 - RNA, 2165 nt, Mus musculus
cuuuccuucaggaucuuuuauuaacguauagaaaauguguuuaaaaaaggaacuauacagaggcuaaaagcaacugggacuaaaaauacuaguuaacaaugguuaacaagcagauuccagucuuugagcuacagcgccaugaaaggauggggcaaguuggcucucccucuucaauccucuauagccuuuuguuugauuucaucagagugugcaccaccugaugagaauauaccauauaccccuucucuucuucuuccuucuggccuuuuuuuuuuuucuuaaaaaaaaaaaagccuuuucaagaacaguguagcuacaaagucaguaaauucguucgucuuuguuauuuuacccgaaaaggcuauuaaagguuaaaaccacaaauucaaauucggagggaauggaggauuuggugcuuaugauuuguugggacagcaauugagagaccaccaggaugaguguuaucuucuuggagccccaggcaauaaaaccccucagagucacagugacuuuuuuugggcaccuggaaauuucuauaggcuugaggguacuugggguuuguguguguguguguguguguguguguguguguguaaauauaggagggaagagcauuuauguuaaagagaggcaggaaggacuagacucuuacagauucugacccuuguuugugagucccuguagcaucgcuaugccuuaaggaaggaggguagugaagaaaguagguagcauaggauuccucugcugaaagacaguucugcaggaacuguagugcuugauuuaucuaauaagugucugagguguuccagaggaguuaccauuuugagggggaccucaauucacucuugggaagaccuaguccguuuagcauaaauaucuuaagagggaaacagaacucaguguuaggaguuguugucugauagaugaagccaccaaguuucugauaucuuuuuagaucuuccaaaguagcaauucuagucagcauuguagcaaacuguucuccuagacuucucuuucacugggauaagagauggguaaggagagagagaaaggaaaugagaaaauaaacacagagaacuccucucuugacuucuuguaguuccagucuuuacaaauguccugucauguuccuucagggaacucugggaucugggagguggucguguuaauuuucccugcaaucuguugauuuuagccuagacauucacaggauauuugcauuuucugcuguuuguaguuguuugaacacacucauaacucuuccuuugcaaacucuagggucaaacugauacccuaggugcuuacacaguguuauccuguggucucuccuuccuugauacugguucuaucuuuuuuccuaguuuggaaagggguuuguguuagaaaagagaagugucuguacugccuaggcccugggaugggaauuuauguuugugucugacaccaucuucaaaacuuuaaacagaaagaaaaaagaauuguuucugggcuauuucuuacuauuucugacaguaauaguuuggggcugaggguuucucugcagcauagcaugagaaaacaagcaaaauuuuccauuuguuaaaaggaaaaggagagguggauggaguuagaaacaucaugagaaugguagugaguucaagauggcagccgcguggucaaugugacagcagcuuuacaaacuggaagaacuaaggcuguuuguauuagacagagacagugguacuccucagaagcugugugacuucacacaugccauuuaacaaucccaugcuuucacuuucuucuucuagaaaaugauuaaaacuuacucuggauuggggugaggauucaauaaaguaauugaugggaagcccuuugcacagaaugugaccaauagguauacaaauacuguuuuucucaguuucuauuaggagagacagauauuuuuuuuaaauguaccaggcuacccccauuucuaugucuaacuggcugugugaucucaagcaagcugccugccuaugucagccuugcuuuccuugagcauggcauagagagucaucuuaggugauguccagaauguccuuugccucugaaggaguguucuuuaauguuggucuaggagacaggguugaguauauuaguguucaaugacagauugguuaaaggcuacagguuucucugugggu

SEQ ID NO: 449 - RNA, 6958 nt, Mus musculus
aaccuguuuccgguguuguacugcggcggugguuggcuggcugggcagacaacauggcggcguccgugcuaggcucgcugcugcggaccuuccggcaggucaggccccugccuuucucgccagccuaccccuucccugauuuccguguccugugggucccucguaacccugucaccuguaaugcgcacggaggaccgaucccaaggcuccuaucugcuuucccguccuggcuagguuaggagagcccagagcagcagucgagggcuugguauucaggugugauccgucaugugaaagcugcgagaaugacuccggguuauaaggagccgagugugaguggagaagagaggggagagucggaugauugagaccucagaggcuccgauuaugcaaagagacuguagggaacuagcugucagccagugguggcuuggaagcagguggugacaauuucgaauggggagcaggccauuccgcuaaagcagaauuaguuaaaggaagggccgagaauuggcuguagaguuaaggagugggaguguuaugaugcggauagaaacuggaacgagcagcaaaggacguuggagaagucuuggauaguuuuguuggggaggggugucaacuagagggagaccuggguggaccuggguuguuuuuucuuuacugugacauugcgucauaucuguauauuagagugggggaacacugauauaaagaauagggaagaaucgcuggagaucugccuuuuuuuugcaggcaagaggugauauagucuguguaugaauuuugauuuuaggaaugugguuaagucaugaauagcaguuucguccaguagaauuguaaugcaaaccacaaggauaauuuaaauauuuucuaauauuuauauugaaguuuaaaaaggaggugcgguuaauuuugauagauauuuuuagucaggucuauccuuauccuaacaagucaaaauuagaaugacuuaugugacauuugcauucuucuguuggaagcagguuucaaagucuguguaucugacacuuaaaauauauauauaucgcaguugggaugcuaacuuuugcaguuggaccaaaaccaaacuuuuaagcgaguuaauaccaagaauuauguccccacuuguacugcuuacaguuccagugcguauuagcuguauccaugguucauggccacuguaauggacagaggugucauauaaccaaugagagggguguagaguguaguacaaauacugccgagggggcacagguaugguagugggaguuuggaaauucucuccagauugcuucuaauuuuauaacuaaggguacugaagucaucagaaccugagggugugggagaagguaacagugacuuaagaaagaagaaugaauacaccugcaaauuguccccagauuuccaccugaguuguaguaugcaugagguaugcacaugcacacacaaauaaaugccauaaguuacuuccuaaaacuauuaagucuuccccccaugagauggcucaguggguaaaaugcuugccaccaagccugugcaguucaaucuaaggccccauguuguagggggguaacugacucacagaagcguuguccuuguccacccuccacacaugcccguccauacacaagcacacaugugcacucagacaugccaaauagaauuuaacugcucaaagucauuuaacgagugacugaaaguuuguaggauaauccuugucucucuuuuuuaggcaguuccuccaucagcgucaggucaaguucgagguuacuauguagacuggagaauguugcgugauuugaagagacggaaaauggcuuaugaauaugcagaugagaggcuucggaucaauucgcucagaaagaauaccauuuugccaaaggaccuucagguuagccaguugagucccuuucuugcacaaaagcauuaacuauccucauauucuguuuuaugcuguuuuauugcaacuucuuaauguaauuucuggagaauaagaucaaauauucaagucuacauauauagccuuaaaacuggcuuuggucagcuuaggauaaaggacaacuacucagucuuuccugguucuucagccuugucauuauauaaucccuagaaaguacuaguaccaaguacuaguaccaaucgugugccuguuugaccaauugggcuugaccccuacagacaguccuggcagccaccauuuuacucucugcuuccaugaacaacauugucuugagcugagugcccgaggcugucuucuccuauuaaguagaagaagcguaauaccacauugugguaaaagccacaagagagagguccugggaacucaguuuucugcucauuugcuuaaaaacaggcaaaauuuaaaagauauagcagccaccaggacagccagagcuauacagaaacccuguugagugagguaagcagggcuagaaggugaagaaauacugugcugaaaucuagaguagucgucgguggugcagucuucacuugaaauuugcuaagaguagaaagauaauguaccaguauuucauuaaauauauacaaacuuuaguugucaaucaagccagaggguaaaugaguaaauuauuuaugaagaauauuaccccacauacacaccaggagaaaugccucuaguauuaguaccagcaguagccgugaagauaacaaguuauuuaacuaucagggcugucugaggcuuacaaguuaaguuuauguccaguuccagaaggcuuucccagaaugcucuuuugugcuuucuuuucugcugucauuuuccuguucuaaugucaguuuuugaggacaaggaagggcaugcauagcuaagucuacauuucuucuagaauacuuauuauuuguucauugaccucauuguguuuuaugcaauuccccacauauuucuaauaucaacaaaugcauaagcuuuuagacaucaguagauuugcacaugcaaucauuuauuuagugguuuuuuuaaguauugcaauuuuuguccuuuuaaauaguauguacuuuucugugugucucccacauucuaucaaggaucaguggugugcuaacacaucugauaaguguuuacugacaaccugagccuaaucugccauacuuucuccccucaaccacuucccaguuucauagccauuaccuggacaagauucauggcccuugucuggcuaccuuccuuuauuucugcaguagucagaaucuucaucauaaggcuuugaggauccuggugaugaacuuuuuacuagucucaagccauggucuuuccuaagcaucaucagcucagaugcuuaaagcuuuuguccuucaaaaauuaugugucucugcaugggccgauaaaugcaucacauauuuuuucuaaaugacuuaaacauggauguauggagcagcacuauucacaauaacucaaaagagaaccuacucagugauagguuaucucugccggcaaaaugagccaaauucaagcaauauuaaagucuaugacagaaaggggaggugggaggagaaagauagauagaaacaagagugagagauaacgagaacuaaaaugucagaauuauauagugaagagccuccagggaagagggaguccaggcccugagcugggacguucaggugaggauugaaggaugugguagagccuggaggguagaucugcuuugguauguuagucaccucagcugcuggucccaggucugagcccaacacuaucucuaccagcuacagaauacaugaaggaauuccaacauacgcagugaaacuagcaucaaggagacagaggauaucaaugacacuuggaacaguguaggcaaacuagcauauuguagaauaaagaaacaaaaugaauaaagacaaaaaauauuauaugggcauauggcauacaguuugcaacaggauaaauguguacuuaagguuuuagugaacauauuagcuguuagccagugcccuuagaagggaggcaucaucaaucagccuugggugcugauguuauaagucagugauggcuacacagcauaugcuguuuauaaaaauagacugagcuuuguuauuuugauuuguggauuaugguuauuuuaauguuuaaaaucacauugaaaaaacaucaaacauuucuguugucucuaucguaucugcaguugucuggcuaagauucuagcccauuuuucuuuccuuuaggcacugaguuaugaucuguuauaauuuuccccuaggaaauggcuggugaugaaauugcugcccuuccacgggauagcuguccuguuagaaucagaaaucgcuguguuaugacaucucgcccacgugguguuaagcgucgcuggagacuuagucgcauugucuuccgccacuuagcugaccacgggcuacuuucuggaguccagcgagcgauaugguaaaaccauuucagaaccugcccagcugggcagucaauccuggcaggagacuuaagaucaaacccuaggucuuacaagggucuaguauguuuagucuacuuaacccugaguuaaauuacuuuuacauuuuaaauaauguggcuauuugucauugaauugucuuucaacuuuaaagcauaguacaagaguggaauaaacauauuuucugugaaaguauggucuuuccuucaaguuugauguuuaguagcaaaauaauauauauuuuuggagugauuucacaaaauauuucuagaugucagaucuaauugacagguugcuuuucuauguuguauuccuggacuaguuucccuggucugcaguuacaaucacuuuuuggauaacaauagacagaguuaaacaggauauucuaaauuauauuuagggucaacuuuaugugacagugaauaaaagaacugcuaaauaguuguuucaucuuuuaaauuuuuucauuacugcguauggauguuuucaugcaugcaaaccuauguuccacgugggugccuggugcuggaggccagaggaaggcccuggguuccaauuacaaacagcugugagcuaccacauuuaaaccuuaccuguugccuggagacuucgauauuucagugcugaugguugcacgggaucuguuuucauuaaggauuguaggauuuucuaauucuaucuuugcugcauccuuuggguguuuguuauuauuuuuuuaaaaaacuuuccauaucaacaauuacuaaaacauguuucuuugacauaaauguguaauuaauuuucagaguaaacaaguugcuauacuacuaaaaauggaaaccaaucauuguucaucccugugaacuuugaaauguuuauauauuuggugcauuagcccacucugcccauucuuacccaugaucauuguccuauuaccaguggaagucccuugacaucucuauccuguaaguaagguuauucacuauguucuugauugauuacuguuauaacagccaguauaguuccugauuaagacaccugucuuuagggcucuuuuaguaggaaauguuuagagaccacaagauacacuaagguuaacucauagccauuaaguugucauugccuugcuaggaauuuucauuuuguuucaagauuuuuaauuauguguauauguauguguggggcagggggugagugcuuggggggaccagaggugucagauacuagagcuggacuuagucuugugagccacaugggauggguguugggaacagaacugggguucccuuugagagugguauacaucccuucagcccuagaaauguguuuuuauuauaaguaaaacauagugguaccuuuauauuaauucuauauuuauguaucuuacauaaaaauuuuaaaucuugggggcuggagggauggcucagcagagagcaaguacuguucuuccaaaggaucagaguucaguuccuagcacccaugagggacagcucauaaccaacuguaauucaacucccugggaaguccaaaaaaccucuggcagccuccagcaaccacaauggcgauuaacucaagauuuaaaaaaaaaacaaaaaacaaaaaaaacaacuucuaaaaaagcaauugaggggcuggugagauggcucaguggguaagagcacccgacuugcucuuccgaagguccagaguucaaaucccagcaaccacauggugacucacaaccauccgaaacaagaucugacucccucuucuggagugucugaagacagcuacaguguacuuacauauauuaauaaaacaaaucuuaaaaaaaaagcaauugagccgggcagugguggcacacaccuuuaaucccagcacucgggaggcagaggcagguggauuucugaguuugaggccagccuggucuacaaagugaguuacaggacagccagggcuacacagagaaacccugucucggaaaacaacaacaaaaacaaacaaaaaaaagcaauugagugucagcaacuuuacuuuuaucacaauauauaaaaauugcaauauauucauuaauuguugcaaaaaauuagaauucaucuaauagacaaauauucuaaaguucccugaaaauaacuuguacuaaauucaauaugcaaacaaagcaacuauugcuuaguugucuuuguaaaaugcauauugaaauugaaugcccaguuaguucaugguauuaaguggggucauagcuucaccuucaugaaugagcuuaauacacugagagcuccuggaacuuucauugcuugcauccucugccaaagcccuuauuaaccaccaaguaggcccuccgaucuggcuuuucuuuuuuucaauuucagugcuuuuucaauuguuaaaauuccagugguucuaagguccuaauuaucuauuucugccaugauguaccacagucuaguccuguuaauguuuguucuuaacuguguaugucauucccagguuuuuauguucuaugcaucuacuuuuccuaaccuaagcaugaaaauuuaauagcuauguucuuaaauaaaaaccaguggaguuuucccaaugua

SEQ ID NO: 450 - RNA, 6958 nt, Mus musculus
uacauugggaaaacuccacugguuuuuauuuaagaacauagcuauuaaauuuucaugcuuagguuaggaaaaguagaugcauagaacauaaaaaccugggaaugacauacacaguuaagaacaaacauuaacaggacuagacugugguacaucauggcagaaauagauaauuaggaccuuagaaccacuggaauuuuaacaauugaaaaagcacugaaauugaaaaaaagaaaagccagaucggagggccuacuuggugguuaauaagggcuuuggcagaggaugcaagcaaugaaaguuccaggagcucucaguguauuaagcucauucaugaaggugaagcuaugaccccacuuaauaccaugaacuaacugggcauucaauuucaauaugcauuuuacaaagacaacuaagcaauaguugcuuuguuugcauauugaauuuaguacaaguuauuuucagggaacuuuagaauauuugucuauuagaugaauucuaauuuuuugcaacaauuaaugaauauauugcaauuuuuauauauugugauaaaaguaaaguugcugacacucaauugcuuuuuuuuguuuguuuuuguuguuguuuuccgagacaggguuucucuguguagcccuggcuguccuguaacucacuuuguagaccaggcuggccucaaacucagaaauccaccugccucugccucccgagugcugggauuaaaggugugugccaccacugcccggcucaauugcuuuuuuuuuaagauuuguuuuauuaauauauguaaguacacuguagcugucuucagacacuccagaagagggagucagaucuuguuucggaugguugugagucaccaugugguugcugggauuugaacucuggaccuucggaagagcaagucgggugcucuuacccacugagccaucucaccagccccucaauugcuuuuuuagaaguuguuuuuuuuguuuuuuguuuuuuuuuuaaaucuugaguuaaucgccauugugguugcuggaggcugccagagguuuuuuggacuucccagggaguugaauuacaguugguuaugagcugucccucaugggugcuaggaacugaacucugauccuuuggaagaacaguacuugcucucugcugagccaucccuccagcccccaagauuuaaaauuuuuauguaagauacauaaauauagaauuaauauaaagguaccacuauguuuuacuuauaauaaaaacacauuucuagggcugaagggauguauaccacucucaaagggaaccccaguucuguucccaacacccaucccauguggcucacaagacuaaguccagcucuaguaucugacaccucugguccccccaagcacucacccccugccccacacauacauauacacauaauuaaaaaucuugaaacaaaaugaaaauuccuagcaaggcaaugacaacuuaauggcuaugaguuaaccuuaguguaucuuguggucucuaaacauuuccuacuaaaagagcccuaaagacaggugucuuaaucaggaacuauacuggcuguuauaacaguaaucaaucaagaacauagugaauaaccuuacuuacaggauagagaugucaagggacuuccacugguaauaggacaaugaucauggguaagaaugggcagagugggcuaaugcaccaaauauauaaacauuucaaaguucacagggaugaacaaugauugguuuccauuuuuaguaguauagcaacuuguuuacucugaaaauuaauuacacauuuaugucaaagaaacauguuuuaguaauuguugauauggaaaguuuuuuaaaaaaauaauaacaaacacccaaaggaugcagcaaagauagaauuagaaaauccuacaauccuuaaugaaaacagaucccgugcaaccaucagcacugaaauaucgaagucuccaggcaacagguaagguuuaaaugugguagcucacagcuguuuguaauuggaacccagggccuuccucuggccuccagcaccaggcacccacguggaacauagguuugcaugcaugaaaacauccauacgcaguaaugaaaaaauuuaaaagaugaaacaacuauuuagcaguucuuuuauucacugucacauaaaguugacccuaaauauaauuuagaauauccuguuuaacucugucuauuguuauccaaaaagugauuguaacugcagaccagggaaacuaguccaggaauacaacauagaaaagcaaccugucaauuagaucugacaucuagaaauauuuugugaaaucacuccaaaaauauauauuauuuugcuacuaaacaucaaacuugaaggaaagaccauacuuucacagaaaauauguuuauuccacucuuguacuaugcuuuaaaguugaaagacaauucaaugacaaauagccacauuauuuaaaauguaaaaguaauuuaacucaggguuaaguagacuaaacauacuagacccuuguaagaccuaggguuugaucuuaagucuccugccaggauugacugcccagcugggcagguucugaaaugguuuuaccauaucgcucgcuggacuccagaaaguagcccguggucagcuaaguggcggaagacaaugcgacuaagucuccagcgacgcuuaacaccacgugggcgagaugucauaacacagcgauuucugauucuaacaggacagcuaucccguggaagggcagcaauuucaucaccagccauuuccuaggggaaaauuauaacagaucauaacucagugccuaaaggaaagaaaaaugggcuagaaucuuagccagacaacugcagauacgauagagacaacagaaauguuugauguuuuuucaaugugauuuuaaacauuaaaauaaccauaauccacaaaucaaaauaacaaagcucagucuauuuuuauaaacagcauaugcuguguagccaucacugacuuauaacaucagcacccaaggcugauugaugaugccucccuucuaagggcacuggcuaacagcuaauauguucacuaaaaccuuaaguacacauuuauccuguugcaaacuguaugccauaugcccauauaauauuuuuugucuuuauucauuuuguuucuuuauucuacaauaugcuaguuugccuacacuguuccaagugucauugauauccucugucuccuugaugcuaguuucacugcguauguuggaauuccuucauguauucuguagcugguagagauaguguugggcucagaccugggaccagcagcugaggugacuaacauaccaaagcagaucuacccuccaggcucuaccacauccuucaauccucaccugaacgucccagcucagggccuggacucccucuucccuggaggcucuucacuauauaauucugacauuuuaguucucguuaucucucacucuuguuucuaucuaucuuucuccucccaccuccccuuucugucauagacuuuaauauugcuugaauuuggcucauuuugccggcagagauaaccuaucacugaguagguucucuuuugaguuauugugaauagugcugcuccauacauccauguuuaagucauuuagaaaaaauaugugaugcauuuaucggcccaugcagagacacauaauuuuugaaggacaaaagcuuuaagcaucugagcugaugaugcuuaggaaagaccauggcuugagacuaguaaaaaguucaucaccaggauccucaaagccuuaugaugaagauucugacuacugcagaaauaaaggaagguagccagacaagggccaugaaucuuguccagguaauggcuaugaaacugggaagugguugaggggagaaaguauggcagauuaggcucagguugucaguaaacacuuaucagauguguuagcacaccacugauccuugauagaaugugggagacacacagaaaaguacauacuauuuaaaaggacaaaaauugcaauacuuaaaaaaaccacuaaauaaaugauugcaugugcaaaucuacugaugucuaaaagcuuaugcauuuguugauauuagaaauauguggggaauugcauaaaacacaaugaggucaaugaacaaauaauaaguauucuagaagaaauguagacuuagcuaugcaugcccuuccuuguccucaaaaacugacauuagaacaggaaaaugacagcagaaaagaaagcacaaaagagcauucugggaaagccuucuggaacuggacauaaacuuaacuuguaagccucagacagcccugauaguuaaauaacuuguuaucuucacggcuacugcugguacuaauacuagaggcauuucuccugguguguaugugggguaauauucuucauaaauaauuuacucauuuacccucuggcuugauugacaacuaaaguuuguauauauuuaaugaaauacugguacauuaucuuucuacucuuagcaaauuucaagugaagacugcaccaccgacgacuacucuagauuucagcacaguauuucuucaccuucuagcccugcuuaccucacucaacaggguuucuguauagcucuggcuguccugguggcugcuauaucuuuuaaauuuugccuguuuuuaagcaaaugagcagaaaacugaguucccaggaccucucucuuguggcuuuuaccacaaugugguauuacgcuucuucuacuuaauaggagaagacagccucgggcacucagcucaagacaauguuguucauggaagcagagaguaaaaugguggcugccaggacugucuguaggggucaagcccaauuggucaaacaggcacacgauugguacuaguacuugguacuaguacuuucuagggauuauauaaugacaaggcugaagaaccaggaaagacugaguaguuguccuuuauccuaagcugaccaaagccaguuuuaaggcuauauauguagacuugaauauuugaucuuauucuccagaaauuacauuaagaaguugcaauaaaacagcauaaaacagaauaugaggauaguuaaugcuuuugugcaagaaagggacucaacuggcuaaccugaagguccuuuggcaaaaugguauucuuucugagcgaauugauccgaagccucucaucugcauauucauaagccauuuuccgucucuucaaaucacgcaacauucuccagucuacauaguaaccucgaacuugaccugacgcugauggaggaacugccuaaaaaagagagacaaggauuauccuacaaacuuucagucacucguuaaaugacuuugagcaguuaaauucuauuuggcaugucugagugcacaugugugcuuguguauggacgggcauguguggaggguggacaaggacaacgcuucugugagucaguuaccccccuacaacauggggccuuagauugaacugcacaggcuugguggcaagcauuuuacccacugagccaucucauggggggaagacuuaauaguuuuaggaaguaacuuauggcauuuauuugugugugcaugugcauaccucaugcauacuacaacucagguggaaaucuggggacaauuugcagguguauucauucuucuuucuuaagucacuguuaccuucucccacacccucagguucugaugacuucaguacccuuaguuauaaaauuagaagcaaucuggagagaauuuccaaacucccacuaccauaccugugcccccucggcaguauuuguacuacacucuacaccccucucauugguuauaugacaccucuguccauuacaguggccaugaaccauggauacagcuaauacgcacuggaacuguaagcaguacaaguggggacauaauucuugguauuaacucgcuuaaaaguuugguuuugguccaacugcaaaaguuagcaucccaacugcgauauauauauauuuuaagugucagauacacagacuuugaaaccugcuuccaacagaagaaugcaaaugucacauaagucauucuaauuuugacuuguuaggauaaggauagaccugacuaaaaauaucuaucaaaauuaaccgcaccuccuuuuuaaacuucaauauaaauauuagaaaauauuuaaauuauccuugugguuugcauuacaauucuacuggacgaaacugcuauucaugacuuaaccacauuccuaaaaucaaaauucauacacagacuauaucaccucuugccugcaaaaaaaaggcagaucuccagcgauucuucccuauucuuuauaucaguguucccccacucuaauauacagauaugacgcaaugucacaguaaagaaaaaacaacccagguccacccaggucucccucuaguugacaccccuccccaacaaaacuauccaagacuucuccaacguccuuugcugcucguuccaguuucuauccgcaucauaacacucccacuccuuaacucuacagccaauucucggcccuuccuuuaacuaauucugcuuuagcggaauggccugcuccccauucgaaauugucaccaccugcuuccaagccaccacuggcugacagcuaguucccuacagucucuuugcauaaucggagccucugaggucucaaucauccgacucuccccucucuucuccacucacacucggcuccuuauaacccggagucauucucgcagcuuucacaugacggaucacaccugaauaccaagcccucgacugcugcucugggcucuccuaaccuagccaggacgggaaagcagauaggagccuugggaucgguccuccgugcgcauuacaggugacaggguuacgagggacccacaggacacggaaaucagggaagggguaggcuggcgagaaaggcaggggccugaccugccggaagguccgcagcagcgagccuagcacggacgccgccauguugucugcccagccagccaaccaccgccgcaguacaacaccggaaacagguu

SEQ ID NO: 451 - RNA, 10528 nt, Mus musculus
ucuaugaaugauuuauaguuacuggaaaccuuaguaggucauugguuugugcuuauguguauuuuuuugccauguauuuuccuuuuacuuuuuaaaucaagacuucuuccccaguccuaggucauaauggaauuccaucucuuuaaguacuugcauaacuuuauuuuugacagugagaucuuagaugcuguaagugugagcauauggcugucuuauuacacugcuaucauuaaugcuucaucucccuacaaacgccaaaucuccugcaugcaauaaguucauguguuuaccagucugcuuacuucacagcucaauacacuuccagcuacccuuucuauacauuaauuguaaguucugacuuuuaccuaauccuuaaugguaguuguugugaucgacuggcuuuuuuucuaggcaucuaauugcuuucuuuuugauggugagccuaucauuuaacagcuaagccauugcuaagcccuuacggcuuucugaaacuuacucgaguacagugacaaagcuuaacuuugaauacacucaaaacagauugcagaacucaucuuuuaaguaaaacuccaacuuuauugaacaaaggaauaaaugggcguuuucaaguuuucgcgucaugguuauuuuuaagccaucugaaccaugauaguacuuaucaacacgauguuugucuauuuuuguccuuuguauuuuguuuaauuuuauauucauaaguauacuuaaaucaauuagcaguauaugguaacacaugguaauaauggaacagcucuguaguaacuuugcacaaauuugaauuuuaugcaaaaauuuugcuuuauuguuuacauuacugggaucuaaugucaacuacagacaaacacuucuguauucuaucucccagccagaacaaaagucugugacauaacauuuucauuaugcaagacuuccuuuuuacauuuucaguaagagugccauauagccuuuucugaaacgaaaugucuggggugcuaaugaaggaaacaguuuaauaagcuuauuuauuuaaaucaaauccuccaguaagaaauggagaaucugcuaucuuuacuuaaaaggcgguguaaauauuuaucugucaaaacuacauacccacaugaacaaauaugugcaguucaacaacauccccuuacuggaacacgagcauuccacaucacaguucccauacggacuuuuaaaagccucaaaauuccgugucuucucuggcuugcuucucucuggauuccacccacgcuuuauuaaugguucgcuucauaucaucgucuccgucuucauaaauuuucuuuagaacauucauuaaucccucacuagggucugccuccgugucguaggaaggcuuucugugaaaaagaaaacacgcuacaauggaaaaacugaggcauggaaagacauucuuggguuguaagugguaggaaguugagcagagagaagggaugcuagaguauacaacccaaauagcaugcccaggcacauccugauaaaacuaccaugguacacaaaggagggucugccaaauggcaaggacuaacauggcagugagauuuccagagaaaaugaucaauuugaguaguuaaguuuuccagauuguugauuuuuuuuaaaaguauuuuucuucacauuuaaaaauucuacaaaccccugcaaguuaugguauggauacauaaugaaaggagaacauuuuaguuagaaaaaaauuaaauuaguaaacuuuagauucauggaucugggucuagugcuaaggucuuuaauuaaugugguaagcagaucuagucaaggaaugucuaagcagccaaucguccuuacauuuauuucuugaaauaggucuuauuauuuaagcucaggcuuaacucaagucccaagucaucaaaugugcagaacucuggccuacaaauuguaugcggcuaccaagagaggaaugacaaaaaugagugacucacucagugcaggauacucccaacuauaggagaagacuuaacacugauccacaauggaagucaucugguaagauucuuaaaacagccauuaaggauaagaacaaaccuggaugugguaguaaauacaugccucauucguugggagauaaaaaguuuugaggacuuucaaaaaaaaaaaaguauauaaaaccaaugagaguaaaacgaacuacuuaggaaacaucuaacaaaucagugauuuggauaggugagaucuuguagaaguccuagagcagaacuauuugagaacaggccacaguaucuacagacuagauacugugucuagaaauaaaagcaaugccaaagaacaagugauacugucuuaaacuggccccugcccuacccuaacaggcucugacaggcugagcacaguagccagccuauaaucccagcagcacucaagaggcagaggcggguggauccucaugaguucaaagccacuuuggcaaguucuaggacagccagaacuaccuaagaagggagggcggagggcugucuccaagaggugagguuggcucaagaucucagaaaauaaacaauuugcuuguacagcuguuauccauaaaguaaaaccauaacugaagcuaaaauuaguaaaacauuaaacucacucuuucucuuugcauuccuuuuccaccuguguuaaguagucccaucuuguguuuucugcuuucuuucuacauagaauaauuacuguaucagucuugaccuggaagaaaagauagauacaauuuguaacauagaaauaagcacaaauauuuagaaaauaguaauuuacccaagugccuaauauauuaauacucauucuuggugcuagaaauccuuuuauggauuggccagaauaaaccaagcaaaaccugaaugaauaccuuugaugcuaaaaccaccaagaccuaaagauaguguucaggauagggcucaguugauagagugcucgcucaggagucauaaagccuggguugacuccuacuaucacauaagacaggcaccguggcacacaccuguaauuccugcacuugagauaaagguagaauuaucaagaguucaaggucaucuuuagcuacuuagagugagggaauacugccugggcuaccugagacccuauuucaaaagaccccugggcugaaccuaccuuaguuuaguagguaaagcacacuugcauguguuuugguugguuuuguuauugucaaccugguacaagcuagaguaccugggaagagaaccuccacugagaaaguaccuacucaucagacugccugugggaaggaaggucagugaggcauuuucuugaugcaugauugacagggaggcccagcccacuggggguagcauaauucucuggcaguuggccuuggguugcauaagaaaggaggcuaagcaagccaaagaauaagccaguaugguuccuccauggccuuuccuuaauuuuaaaacaacuuucuuagaauaacuuuuccuacaaaugaauuggcaaacuuucuucaaggggccaaacaugaaauuaauuuuacauuucaugggcuauaugaucuacucugccacugcagugcagaaguagacaccaaaaguacuuaagaacaccugcucuaguaacacagcacuuacagaucaggcagggcacuagacucuacugguaccagacacagcagagaauuuuuaguucaucuccagccuaaaucagcuagauucaauuuaaugaggcuuucacaauacuuugaacaaagaaauaaacaacuuacuuuuuuugaacugcuuuccacagagauagguuucaaaagauuguucacaaucauggaguaauucuugccauugagguuuuuuaccagaagaucaaaugaccuauaacauaauagugaaugcauuaucuuccuggcuccacgaugacaggcgcucugugcuccucagacagguaagggguuucagucuggcaguggcucucaaccuuccuaaagugcuuccacccuuuaacaugacucagcaugcuagugaccaccggaccacaacagcauguuguugcuacgucauaaauguaauuugcuacuguuaugaaugauaagugaccccugugaaagaaucaccugaccacuagagcggucaugacccaaagguugagaacagcugguuuaguguguauauuugguugccacacuucuuuaagguuaacuguaaauuuaaacagaaucucaguagccauacagaagacucccaugaauaaggcacugaucacuggacucugaucacgugaccagaacucaccucucugugaagugcaccugcacguucucagugggcaccugauggacgccagucaagguaauguagauuuucacaaacuuaucugacugaucccauccuagcaaaacaaaaaguggaacaggaaugucugaaacugccuauagaacagcaagaggacauggcuuaucauaaaaccuaguuauaggagcucaaaguucagcaguggcuguucccccaaagaaagaguucagguccagcaacauaauaagcaucuguaacucuagucccgggacagcagacauccucuucuggacucugaggcguacacgugguacucaaacauacaugcaaacaaaacaccagcccauacacauaaaauuuaaaaauaaaauuccagaaaaugaaaauccaguaacaagagacauggaaaagaauuaaagguuaaaaauucuuaagauggggagcuggagugauagcucagagauuaagaccauucgcuguucuucuagaggacccugguucaaugccuagcaccuggcuuucaacuguguguaacuccaguuucaggggaucugacacccucucucguauacacauacauacaugcaaaacaccaaugcacauaaaaaaauaaaaaggaaucauuaaaaaaaaaauugucaagaugaagaagcuauggccucaaaacaguacuauuguugaagcuaggcguccagcaagugggagcaugcaaagucagaaucaguucuaugugcacagcccaugaucuuuuuaaucuuuagaauaaaaacaauuauuaaauguaacuuuucuuucuucaaaauaaugaucuucccuaauagggucugaacccuuagccuugugaauaccaggcaaggcccugugccacgaguuucacuccagcacuaaucuuccucuucaauuuugagaaagggccuaaccugccaaagcuggccucaaaccugcaacccuccuagccagcuaagauuacagguaugucccaccaugcccagcaaauacaugaagauuaccucauuuaccuguuuuguuaaguaguuuuguccuucaucuaaaacaugacagacccugcuaugguagcacacauucauacacuugggacguggaagcagaagaaccaggaguucaaagucauuaucacagugagcuuaaggccagccggggcuacuuagucauacccugucucugugaaaagcugaauacaguaacauuggaauucaauagucauuuccauuucucuaaguagugccuccccugcccgccaaacaaccucagcucuuacaggaccaaguacaauauaaauuuaagauuccaauuccuaagcacagcuuggugguacacaacuaggcucccagcuacuugggaucucuugagcccaaguugacuucugaaaacagucuggacaauacacgaagauaccuagccucaaagucaaacugucuggagcacacaaggcaggagcgucucagaguugaaggccagaauggacuacagguuaacugucucacacaaaaaaaaucaaagcccaaauagcuagauaaaagaucuuaauucuucaccagagaucuguuaauuuggccucaauacagugaggcuauuuugguauauacuguuacacuauauaauagcaucuaacccacaccaaaugucaacauuaaaaaaaaaagaaccccacaaacuucacacaaaaaaguguauguaacaugaauauauuauggaguagucauuucugcuugucagaacacuagauauaauggaaugggucauaccauaauuacugauuuucacgguguauccuguuguaagaggagcaaccacagcagcuggcuuuucauuaucaaguucugguuucuucugcgacuucuguugcaucuuguucuugaguuccgucucaaucuuggacuuuucacuuguaagaguaucacguagucuuuuccuaguggacuuuuccagcaauacuuugaccucuucuaggucuuucugcaacuguuaaaguagagguaaauuacuaaaaaucaaguucauuuuaaauuuuuaagaguugcaaacuguuauucuuuucacugaacuguaaguaacucucgcuuccuuuuuguuaaaagaaagcaaucuuaauccauaguaauuaagucuguauuuugccauuugguaggcuguuaccugccuuuguuuuggaauauugaaaaggaaucuugggagauuuaaaaguuaacaccaagucuacuucaaauacuagaaaaauguaaccauuacaguaaaagagaugagaauacaucugacuggaggcacuacagaaacguuaccgaacgaaggcuauacuuucaguucucaucaauuuucuuaacucagaauuucaauuguuaggacaaaaaauaaaaauaagauaagauaaagagagccaucaggauggcucaguggguaaagcugcugccaccaagguugauggccugaguucaauuucaggacccaggugagaggagaagcaaaacucgcaagaccaccucaucuccacaugugccgugguaaauaaauguaaaacauugucugcuuguaagcaaaagucuugguuaguaguuggguugaucuuuugguagaaucugagaccacagaaaggaaagcucaauauccaaucaucucauaugaacacacucuuggaaacuagucuuugcaaauccaguuuucuugucaugccaauauaucagguaguccucugccuuuuagagacagacauguaauguggaacggcacuggagacaaugcuacaaagucaaugggcuggcacugaagacacuguugaaugcuuaaaagcccauaccgaaggacagcuuaguucccagcacccacaucaaguagcucacaagucuuuguaauucuaccucccuuggaucugaggaucucuucuggccuccauaggcacuuauacaugugguauguauaggcagacacaaaaaucaaucagcuuaaauauuuccucugaccuaauggugaguaaaugcuuaaaauuuucugccuugguaaccuaaccauaaaaacaacaaccuuacuuuuauaccuucauacuaaauaaaagguuuaauauuaaaaauccuuaaauguuccauuuacaauugauaggaguccauuacagaaaaccacaauacaaacgcagagguguggaguccagucgcaguguauauagaucugcaguguaacucccucaccuaaggcauacaaggcucagauaauugcaaaagaaaguaacaaauguuaguaugugcaauucuuguggaaaugguaaauuuuaagagcuagaggaucaaggagcuuguuguaagacuuugacuccuagcaagcagagguuacacccacccaaaaacaucucagcgagaaagccuaaacuugaacugaacaaagaugacaauagauaugcuaauguggacaaggaaagccuagggugucacuacucuacacaagaacaggcuccaaagagaggcugagggcaggagaaagucuuccccagaagagcccaguaccaaacggucagcccugagcuuaccuacuaguaacaucacacagacuauguaugcaacaaugaaaaaaaaaugagacagagaaacuaugaaauugaaagagugcaaauggcagggauuggagggaggaagagggaaaugauuuauuauauuuauauuuauuauaauuucaagaaauaaaaaauaauuuuaaaauauuuuaaaugcuagauauuagauaguaaaaaaaaaaaaauagcucaaauagcucauuacucuguggccauuauauuaugauuuccuaacaguuuauaaaaagcacaacagugaaacuccggucuacaaucccaaggaaacuugacucuaagauccaaaacugcaaaacugucacucaucuuuugaauuuagaaucaagauauuucauucaaaguuuuucagugguuucaaaauucauauggauuaucaaguaccacuguuggugaaaguggguuggugggacuuuaccacagauucuaaauaucagcauaauaaaaaaaaauauuaaaagcaaagcaaguacuuauuccuaggacagagcuuuacuuaacaaacggagaaaggaaaagguuuugcuuuaaacuggaaugggaaucuuuuuuuugagcugacucauggcagaauucccaggcccucccaguuuucgcucuaauggacucuuuaguaagauaccaacugaugcgaccuacaggagaaccauugcuugauuuuuguauucacagcccagaaaccacugacaguguagguucugacugggauuagauagaacaguuuccuguccacuuuuucuugccuucuuggcaugcauuuguuuucuauacauaaacauuuaucucccuuugaaucuguuucccaguuguuaaauaggggcucggucuggccugguggcacaugccuuuaguucugccacucuggaggcaaguguaucucaaagaccaagugagggguacucagugagaccuacucccacccaacugcucaaaauggaagaacccaacucuccuccacaaagacauggaauuggacaccagguacacacacaaauagaugcacacagcuaugaagaugcauagccaaugcaugaggugguacuacacccucauguggauguuagcauaugaacaaaaaccacccaauaaaauaacaaauguuagugaauguguggagaaauggcaccuuuugugcaauucuuguggaaacgguagcuuccuaagacuuucccuauuauuuggcaauuacacggacuaaaaacaugcccacaaaacaaaacuuguuuacaagaaaucacaaucggcaagauggagaaacagaagaguaggaauuccaucuguacaaugggacaguauucaaccacccaaaggaaugccauacugauaccacgacugaacuagaaaauccuaaggcuccagccuaaguagauggagcaccuacaauggauuucuauuuaaggaaacgaaaauagucugcaacuagguaacacugaugguuguacgacagaaaaaguugaauuucacaucuuaauaugauugaauaaggugaauuuuaaucucagaagaaaaacaugccccuauaugcauagcuccaagucuaaagucccuucucuuuuggagacaauuaaugcugcacaacuguuaagccacccucuccacucucccagugagcacguggugccugccuaucuugucgcaagauacccagaugaauacuuuaacuuccuaauuuuuauguguuuaaagcccaugauuucuaagugagggagaaguuuccgaaaagcaaaucuuaacagccaauguuucugugaaaacaauaugucaaucacauaaaaccuguauuggccaaaacccggcaauucaauuacucuugcuauggagaccucgaggauccaaaaagucaagucauucacauucauuuuuuacaaaucuaaaaacacacgccaggcaauuuccuagucguaccuacugcucaauucccaguaacuuuuuaaaaauugcuuuuauacauaaagacuggggguauaccggaacgguagagagcuugccuagcguguguaaggccugcagguccgccacuggcacugcuaaauaaaaacugaaaccauaagcacuguccagggcguuuagaaauaauacagagaauguauguauaaccaccuauaaaaugaaagcggugaccaugacuagucaugcgggcaugggaauuccuucccauggcccccggcccggagcucagagcuuugcaggaagguuucugaucccuggccaggaaccgggagccgagaagaccucaggcaauggagagaggggaccgccacccgcgagccuaccacgaaccgcgccaaaaauugggauccagacacacccccgaccuuccagccgcggccgggacacucaggcccaggcaggcggcggcguagaggccgcgggcccgcgacgggggcagagccgaggacaucagccccgggaaagcagccgccgcccggcggcgcgagccgguggguccaggccgaccccuaccucuuccaaaacggaagccaugccgucgcgcgucagacccgaggccggagcugcagcggugcaccgaagcagacaggaaaagccgaacacgccacccacgagcgucgcagcgccggcagcgagcuccacagacccggcgcgacacggcggcccgcccuccgcacgagacggcucuggaaccuucgcaaggcuccaccggagccucccaaggccccgccccuccgagucuagucccgcccccaggcug

SEQ ID NO: 452 - RNA, 4005 nt, Mus musculus
uguugaugcuagaagccguguggauaucugucuaugcugucaccagaauccaugaucccacugacuauaaagggcaaggaagcuacuuuuaaagugguauugaugacuguagacucaaaguugagaaagagugacauagaaggcuucugugacaacacccuacucucaccccuagacaaccuagacagaaaaccaucaaagagaacucuaaaaaauugugauaaggaugcugaaguguagugcuccacaauugauggcuccuggcuggggagcgggugaggaaggacugcauuuucuuuaaggggcuggccacugggaguuugaccguacuccauugaguauauggacaauacaaauugcacuuuuuuuucuuuuuuuuuuuuuuucuuggggcaggguaacaaggauggagggauggaccugggagaacugggaggugagugugguugggguacauaauguuaaauacccaaauaaauaacacaaauauuauuaaaauaaaaaaaauggccuuuauggguugauauauuuugaaugcuuggucuucaguugguggaacuguuugugaaagcuuugaaagauuagaaaguauggccuguuggaaaaggaaugucaaugugcaugagcuuuuagauuucaaaaguuuauauuaccaguuaguucucucucccccaugcuugugguuaagaugugaacucagcuacuguucuagcuccaugccugcuugccccugcuuacagccauguucuccaucaugauagucaugcacucuaaccuuuuuaaacugucaucucucaauaaacucuuccuuuuguaaguuuccuuggucgugauguuuuauacacagaaauccagaaauagaaaaguaagacaggcagcuuaggaagacccuuuaaaaaacaaaacaaaacaaaacaaaacaaaacaaaacaggacaaaacaaaccaguccagaccaccaccaccgccaucauaacaacaacaacaauaacaacaacaaaaaagaaaaaagacaagaaucuuaguucaaaaagagaacuugccuaccaugcauaaggcaaauuuaacuggguuuuauugauaguacuaaaaaaacaaaacagaaaacuaaaacaaccaaaaucaaaacagcauuuacuuaaaauauuuuaauguggaauaaaacauaacaauuaguguguauguguaugugcauacagucaagcucauagcuuauggagaugagagacaacucugaggugaucgcuccugcccccuuguggaucccugcugccaggccugcagggaagugccuccaccagcugcgugaucagacagacccuaacgucaaacugauugcagaguauacucuuuaauguucuuuuauuuauuuuaugaaaccauguaaaaguaauaccuguuuguucucaggaucacaaaaugcuauuuuaaugcucuagcugccuucuguuuugguuuaugggagguuaucucuaggccuuagaauauaguguagcagugguagucaucugcuuucuugaggugaaguugccuagauaacacaaaccccuagucaaaauuggcaagugacuuauuuuaaaaucuauuagguugaaucgcauaagaccguuuucauguauguugccccaagucucuucuacccucuuuccuccccaucuuaccccuccuacugucugccagaccccauacauauucacuucuuccaugauacuggcacauacaugauuuuauguaucuagauauguaaacuguguaagacccauacaugagagagugugguauuucagcaccauccacuguagcuaaguacauuuucacagaggaaaaacaagagauauuuauauuaagugaauuauuuuuuucauaguacacugugaagaaagacguguuuuauuuaacuuaucucugguuuucuuuucuacuuugggaaaauuaguuuuuguuuuuguuuuucuuuugacuccuaauuagaaguuuggaguuugcuuuaguuuuauuuuacaguggcuggucaucuaauuacguauuuauuuuacuuuaguuccuggugcuuagcaugacuucuaauugcagggucuuuggaggagcugucuuaccaaucucaguguauccuuaagcauauaucucuguauaaauuucacuuuuagucuauuuugaaauuagagaagauagaaaaacaugagcacacuguagcugucuucagacacaccagaagagggcaucagcuuccaucacagaugguugugagccaucugugugugguugcugggaauugaacucagggccucuggaaaagcagucagugcucuuaaccacugagccaucucucuagccccugagaagguagaaaaacaugauuuuugcaugacuuugccauaaggauagaugaauguucagugaaauauuuuucuuaacauuuuuuuauauuguuauauaaacauauguguuuugaucaaaucuacuccuuauguguccuucuuuucaguucuucaaucccauucacugcuuuucuuucccaacuuuuugugcuuuuuguuuccuuuuaauugagucuacuuagugcucccuguaugugugaauaggagaaucuaucuauuggaguauagguagcuucucaguggcuacaucccagcaaagcaagaagcaagaagcaagaagcaagaagcaagaagcaagaagcaagaagcaagaagcaagaaacaagaagcagcaagcagcaagcagcagcaagcagcaaaagaagcagcaaaagaagcagcaaaagaagcagcaagcagcagcaagcaagcagcagcaagcaagcagcagcaagcagcaagcaaaaagcaaaaagcaaaaaaagcaaaacuacucuaguucucuuuaguugcccucaguuaucaguagcuccuuagcuacuuaaaaucccuucuccauccgggauguaauuuucgaugguuugauuuuguuuuggaugcuuugauuuaggguuuuuuuuuuuuuuuuuuugcaugccaucauagccuuuguuuguauguugguaugugcaacacuguugucacaucugguaaauacuguuuugcagauguccacuguucaugccugugcaaucaucccuccgaucccuugccuuuugugaugauacaugagaccauggaauauuucuuuaccauccucuaucucuuguauugcucauuauguuuuauuauaaaauguucauuuuuuauaggcugaagaugguaauugucuuaccagcugauaguagugcuagcauuuuauauacugauguguauuuccuaaauaauuaucuucauuugaauagaaauuugacccuuuuacucaucuaaaaauuuucuguuaggguuuguagagguuguuauuauuuacuuuccuuggacagcaagauagaaagauuaacuuucuauauccaaagaugaauaauaagcauagaacuuaguauuuuggauauuauaguauuuuaaguguuauuuuccaguuuacuauuuauuacucuugaucuauauaaauauguaauuaaccuaugucuuaguuuagguuucauugcugugaagagacaccaugaccaagguaacccuuauaaaggaaaacauuuaacugggacuggcuuacaguuugagagguucaguccaccauuaucaugcauggcagcgugcaggcagauaugguguuacaggagccaggagugcuauaucuugaucugaaggccaccaggagaagacucuccugcaggcaaccacauaggagacguauccacacugggcagggccugagcauaggaggagaccucaaaacucaccccuauagugauacacuuuguccuacaaggcuacacauccuaauagugccacuuucauuggccaagcauauucaaaucaccacauucuacuccccaugacauauaucuuaugguucuuuagcaaagucuuauuuuauuuuauuuuaccuuuuuaaaaucuuuuuuuuuuuaguuuaaauuuuuggucuuuuuucugauaguuucuccucc

SEQ ID NO: 453 - RNA, 1299 nt, Mus musculus
gcguuugggucucuuccuccuuuuuauucagucuggaccuucagcccauuggaugaugcuggcgacauucagagugggucuuccuuauuuaguuaaaucuucuuggaaacacuucaguggacgaacaccaagauguauuuccauggugauuggaaagcuaaccagguugaaaaugaaggcugagcauaacaguagguaauacuauacuguccuuguuuuguagauuaggaaguagaaaacugagaccgugucauuucugcaagaucacacagguggagacaggauuugaaacaagguagucacaguccaaagucuguucucucuguccuuagccaccugucaagugaucauugauugcagauguugguagaaauuacacucugcugggucugaaacucagaaaaaaaggcuaacugauguaagcauuaacauaucaaagugggggcuggagagugguuaagagcacugacugcucguacaaagguccugaguucaauucccagcaaccacaugguggcucacaaccauuuguaaugggaucugaugucuucuucuggugucugaagacagcuacaguguacuuauauacauaaaauaaauaagucuuuuuuaaaaaaaaucaaaguggacucuggcugccaaucucccuaggucccuaggauuacaguaucauccuggcuggcauaccccacucccuacccuaaacucuccaguccagagagcagccugggggugggggcuucucuuccccagccucugaucccuacauaaccucaaccauauugaucuuuuuuuuaaccucuuggucucugaguuccaggucucuuugcucucaucucuuccccucuuccucucccccaucacucuccucucaugguccuguuuagucuggaccuuuccagaugccucuggcuguuuucacccucguuucugcaauaaaccuccucagcccauaccuaggagaauacugacuuccagguagcuaggacuagguaggguauuagagcccacacccacaaggccauaccuacucuaacaaggccacaccucccaacagugccacucccugggccaagcauauacaaaccaucacguguacauugguuucuuagauagucucccaaaugucacucacucucccuauuauuuuuugcauucucugagcacuuaccaacuggggaccaagcauucaaauauaugaacccacuggaggccauucucaugcaagccaccacaccaucauaguggggaaaguaugagagugacuucaggcaguucauguagcaugaaccaggaagc

SEQ ID NO: 454 - RNA, 545 nt, Mus musculus
agagcuuuucgccaagauggcgcugaaagcgaagaaggacgcuccugccccucccaaagccgaagccaaagcgaaggccuugaaagcuaagaaggcggugcugaaaggcauccacagccacaaaaagaagaucagaaugucacccaccuuccggcggcccaagacccugcgguuccggaggcagccaaaauauccuuggaagugugcgcccaggagaaacaagcuugaccacuaugcuaucaucaauuucccacugaccacugagucagccaugaagaaaauagaggacaacacucuuguguucauuguggaugucaaggccaacaagcaucagaucaaacaggcuaucaagaaacucugugacauugauguggccaaagucaauacccugauaaggcccgacggagagaagaaggcguauguucgcuuggcuccugauuaugaugcccuagauguugccagcaagauugggaucauuuaaacugaguccagauggcuaauucuaaauauacacuuuuuuuucaccauaaaaaaauaaaaauaga

SEQ ID NO: 455 - RNA, 68633 nt, Mus musculus
cggagucugaggaagaggaaggggacgaggacaacgagcgacgggcggcggaggacgcggaggaggaaggggaggccgaccaacaagauggccccugcugcaggagcagccucagcagcagcagguggggggcuggaggcggcgcuggcgguggcggcuacggccgugguccggcggccugggacagagucagagucgaugguggcagcggcggcggcggcggcugccgcgacgguggcgacggccgcagggacucggagcugagaggagcugcugcucggaccagagcggugagcaaguggcggucggcaguguggggagcggggcggccgcggccgagaacaauaggcagcgacugcggggauggggcuguccucacccgcccugcgcucgggaccggccccagggcuugucaguggccggcguccuuuaggccucaggccuccgcgugccucccggagggccugccgggguagguaggccgaggggcggugcggacgccgcccuggacgccgggaaggcuggggaggcuggggcgggagcgggggguuggggggguccgaggcugacugguuccgaggucccucggaggacagcgggcgggcggugaguuugcucgcaggaaauguuguuuggaccccugucugugcggugggggagggaguaggcgccuguaaacagccgccgcuccugccuagcugccaggcguggcugcucccuccccagcccccuuccucccuuggccaaguggguuuuagggugucgguuucccaggaguuccuggagauaaacccuauuggccaagacgaaaccaugugcaggugccuuuuucaaaaagacuauaaguguacaacaacaaaaacacacaaaaugugguuguugguaaaggauggaguaguaagggguggaccuuuccuaacaagguucuaaacaucaggucucuguaaacaccacgguacucacaucccagguccgagggagcuagccgaaacaagggcucuuuuugaagcagcaauaauguaacucuugacaucccagaauaguccgugaaacuggaaacaaagccacuuauuggcagcacggagacagauuguuaagguuugagcggaacuuuucuaacuagccauuuugaauuguguacagcagaggcgauaucauuaaccucuuugguaucugcuggaagcacuuaggacagagaagugguucaucugucucccuuaggaguucaugugucugucucauauucuaaucauuuuuuuuccaguuugucccaaaauuuggagaagauucuuuuuucucuguuugaaauuucauauuuaaagccuacuuucuaagauuuccaauacuuuuagccugccguuaugcuugccugugaauccuagcacucaggaggcugaggcagaguauccugauuugacaagacuuguaucaaaaaacuaauucagccaacaaaaugccagacaauagaaacuuuuacugauaguuuucaaaaaacaaaaaccaguugugguucuguuuuaaguggcuaggcuuaggaugagacaccucauuuuauguuaguaugcuauacugcaauaauaucuuuauacuuaaaaguuagcuauuucuccuaaauguaauuuuucuaggcauuuaccacauacauuuucaaauggagggggaagagguaaauuuuauuccauuuucuacguggguaugcagaaaaauuauuaaaaagcuugaaagcauucaagaagacugcuuaauauucacuuucaggaucuaucuaggggucuuuguguuucuuccuuuccuuuuauuguuuuggagacguggucuugauguagcccagguugggcaggaauuaacagucuuccugucuuagcauccugaauguugggcugaguuaauauuaaaaggaagguugacuuguacaaagaagauauugcuugauagcuuuugccaauuucuaggguaauuuccuaaugaaaaucuaucucugacuguuaaaaguauuguucaguaauaugaaauuuaauuagcaguacuaguuucuaauucuauugaggaguugauagugaauaauuauauaaaacauaaagugaguauaguaguaucauagauuaauaucugcaaacuuauuuuaugccuaguauaauauuguaucccuaguauaauauugucauggaugcuuugaucuuuugaaucauggagagacaauuuuuauauuauauaucuccugcuaauuugacuuuggggaggggagauggccaagaauuucagaacacuuuguuuuuuguuuuugaagaacucagauugguaaguuuucuuuuccuagugaauuuuauuagauacaaagaaucauguguauuguaaugauacugaaauucauuguguggccuaaacauauuagaaaaaguacaaacuaauuuaugaguuuguaaauuuuaaguuauaaaaaaaaccuucauuacuucaucaaugacuuguuaaucuaauuuuucaaaaaacaaaagccuucaacuaagaaacgagggagaaauggcucaugucaguggguaagagugcuugcuaaguagauauaaagacuuaagcucgaauucccagcacuccuguaaaaaaaaaaaaaaaaggcaaaacaaaacagggggugugucugugccagggcuacauagagaaacccugucucgaaaaaccaaaaaaaauaaaguaaaaauuacaggguuaaggaguauauauauggcuaugguaaagugcuugccuagcauucgugagggccuggguucuaucccuagcacauaaaccauuaucaucaucaacaaaaaaaccaaagcuguggcuagugacucuuaguacuguagaaguaaaagcaggaggaucacugcaaguuugaugcuaauuugggauacagaguaaauuccagaugagucuagacuagaaugaggcccugccucaaggaaacaaacaaacaaaauauguauguaugcaugugugucuguguauagugucugagagcauauucuuaaaacuguuuaucuacuccuucuccuccuguugcauuagugguugcauuguuauccuuacuucacauauacagaauauagaguuagaaacagcuaagucaauagcaaaaagaucacauacuuaguagauaagaguguacucauaccuacaucuucugauacaaaguagcugcuuuacagcuacuacguguaucauuauuaaaccuagaagcaucauucuguauugacaguuuucuuuuccugcugugaauguuuuauagcauuguacuugaccccuauuucuguuacuuguacaaugccaaauacuuauauggucaagaagguauaaaucugaauccuuaaaaaaaugcuuuuuuuguuuguuugcuuuuuaaagcagguucaaaugcaaugacauaugaacauucauacuuuuuaucuucaguuuuuuauuuuauguauaugaguuuauguguguacaccauucugauccugcagaagucagaaaagucugucagauccuccagaugguugugagccaccauaaggguccugggaaccagacuuagguucucugcaagagcaacaggugcuucaaccccuagaaauugauacuuuuagcaagacagauuuuuggcauugcuacaguuugcuaucuaauuacuaaauuguaccuuugaauuacuucaugaaaaauuaaaacuaacuuuuuaauaauauuuaauguuguuaaagcuaggucauaugauacuugagcuucuucaugauaagucuccccaccccccuuuaugcuauagauaauuuagaacucugccaugucuucaagaacuuaggggcuuaauauggaauuugaugggaucuaauuagucuauuuuucauauaucuuuaaaggggucagucucucacaaagugaagaauaaacuguuaagugaucccugucuggugucugucucaggucaggauguuccuuggcaggguuuucugaccugguuuagcuuuggcucuggcuauauuuaugcucagggguuagauauucuucaggauugaguucagaaagacuucucagauuggccuaagccagaagauucggauuuuaaaaucaguaugcuuccuaggaugugguuuaauaccuccuggugaaggcuggaaucucuuauucuguuuggagguuagaguauaagaauagcgcuaccugucucgugucaccagcacguguauguaccacaugccacuguguccucagguucuugggauuugaacucagguucucauguuuguauggcacugagucauuuccucaagcccuuagucucugucugccugccugccuaucuuuuuuaaagauaaaguaucuguguaucucugucucucucccucuccucugugugugugugugugugugugugugugugugugugugaaaugcagagguguucacagaguccagaagagggugucagauccucuggaauuggaguugcccaguauggaugaguauuggugacugaacucagauuaucuagaagaacaaggagcugagccaucucugcagccccuuccauuguuucuuaauucauacagaaaucuugagaugugaacagaggagccagaccuggugguagagucauaauccuagcacuggagagcaugagucagaaggaggacaaguucgaggucagucuaagggauauagauagugcuaggccaguuuggaccaaaggacuuauugagcuucuuugaaaaaugucuuauucauaauuaugugaaauuugacuacuuuuuguguaguucuaaaguagaaaaaaguuguaaauuaaaugugagaguagaagaacuauaauuaagauauuuaacaaggagaguaguaaaauaaauuauccacaaccaccacacauuaucguagagcagcagcuaacugccuaguaccuauagacucuuaagaauaucauuaaacgccacauaucaguccugaugauaaauucacuguguaaauuuuaaaguauauuuguaauuuugaaaaaucauaaaauuguaggaauguauaguagagcagagaguaguaguuggcuuucuuuuguuuuguuugagguagucuccuguagucaaggcugacuucaagucugcuuuguagucuacuccuccuaccuucaucugauccaccucccaaguccugggauugcaggugugcucuaccacaccugguguucuacuaguucuggagucccaggcuuucggcacguggggcaagugugcuagccacagccccaacuuaaguagacagaaacuguuagaacauaaaccuucaaguaaaaacuauccaagugcucuuuuuuuuuuccacuuauuuugaaauuuuuuauguguauguaugccugaguguaugaaugaagacugcauggguccacgugccuguggaguccccaggaagccauuggaucccuuggagcugaaguuaaugaaaacugggguauggguuugggaaacuaaaccuggguuucugcaaacccuuaaccccugaaucacucuagcuccagugcucauccuguaacuuacauuuuaucauuccuguccuuaagcagaaaugauaauaugauuuuuaaagguuauuuagaaguuuagaugacauaaguauaucuuuagaacauaccugacaccaaaucccacuccauaaaugucauauucucuucuucacucugacaacagaauaauuuuagauauacuuaucuagacuauuugagaaaguucuuuaaacauuaauauucaaacuacauuuuaaaaaucauuguacaaggggcuggagagauggcucagugagugguuaagaauacugggaggcagagacaggcagaucugggugaggccagccuggugaaauagcaucaggcccugucucaaaaaucaaacaaauaaaaugcauacuacucuugcaaaggacaugaguucucuagcacccauacugagugaccuacaacuaccuguaauuuaaacuccaggggaucugacacucucuucugaucucuucaggcccugcacucauauguauauacucacacagauacacauauauacacauagucuuuaaaaauuaaguuaaaaaaaaucuuuguauaguuuaggauuaacuacugggugagcaauggucagaaauuugucagaagggguggguggauaugggggacuuuugguauagcauuggaaauguaaaugaguuaaauaccuaauaaaaaauggaaaaaaaaaaaaaaaagaaauuugucagaaauggaguaauuucuaauauugccauugucuuuuuuucccccauuuucaguuuuuuauuuuuguuguugguuaguuggauuuuuguuuuuguuuuugucuugagacagagagucucuuuguagccuuggugguucuggcauucaaucuguagacugggcuggccucgaacuuacagggauccaccugccucugccucugccucuugagugcucggauuaaagguguugaaccaccacugcuggcuuuucuuuuuuguuguuguuuuucauguguaagaacuacuugcuuaguguccuuggaggcuauugagagaaugucagauccuuuggagcuagaguuagagaaaguugugacaucucuccagcucccagucuuugaguuuuauuuugaaauuuauuguuugauaucagcuguuauaugaaauuuggggggugcuggugcaagguaugugaugucugugaugcguguaccguacagaauguguggccagaagaggauguuggguguucuuuggauguucuugcaaaagaaucucucagugaacccaacuggcugcuuugugcuggugagcuggccaacaagcaggcuccuaagagccuccaguuuguacugggaauucugggcuuauaggcaggugcaggcaaugcucaguuuuucuuuuuuguuuuuuuuaauguuggaacuggggauuuaaacucaaguccucagugucacagcaaaauguucauucauacccacuaaaccaucuuuccagcaccuugaacuuaagcucuuuaaguagauuuuaauuauuauuauuauuuuuuugagacagggucucacuguguagcucuggcuguccuagaacucauuauguagaccagacuagccucaaacucagagagauccaccugcuucugccucccuacugcugaauguugugaggugcgccacuacaauagauuuuauuuguaaaaaauauuuuauauuuuuauguaaguucugguuaaauaaaauuuaaaauuuaguuucucaauugcaucagcauauuucagaguauugguagccauagcuagcacauguuuuuagucccagcacuccagagcauaugucacagcagacaugugaguucaagaccagucuagucuacauggaaaguucaggccaacuaggaccacauagugagacucugucuccaaaacugaaaggcuaaggauuuggaaaugcuauuuuauuuuguagcucuccuguugauaaaagucugcucacaggggcuagagagauggcucagugguuaaaaaugaguacugcuuuuucagaggaccccaguuuggaucccaggacccagguuggugcucagaccugccuguaacuacaauuccagaggcucugauauaccuucuagccuccuugagcaccuacacacaugugugauacauacagacaauuuuuaaaaauaaaaauguaucuucuaaaaaaacaacuugcucauaagagcauaaaaaaacaccuuuuaaaucacuuucuaccaguagaaauaaaauuugauacguuuugguguaugaaagucaauaaugcaguguuuaauuaaaucuucuuaaauacauauaagaacaacuuucaaugucauagagccuagaauagguaauccuuugugugugugugcguguauguauguauguguguguguguauauauauauauauauauauauauauauauauaugcacacacacaaauauacauuuauuuauuuuaaauuucauuauaguaacaaauuaaaaaaaaaucacaccaaaauuaacuagacccaaagacuauaaaacucugaauuucuacacagauuggccuuuuagaaaggaaacuggaacuucccauuggauuuuauucuuuaacuagugaauauauuuuaugugcuuauccacuagcaaaacaacaacaaaaaaaauccaugacaaagaacuagaaaaacaguuagcuuuguaucuucuuucauaauucauguucauuaccuacauuaauccuuccucauuacuuaauauuuagccuuucuuguucucuuuucuacauguuguacuguacccacauauauauuuauuuacauauauaauuuaauaauauauauuauguuaauauaauacauacgaaacauauuauuggcuagauucuacauaaggggaacaugaguuauuuuucuuucugagauuauguggucuuguuuaauauuaaauauccuaagucuauccauuuuuccuucaguuuugggggaguuuugagacaggguuucucuguauagcccuggcugucuuggaacucacuuuguagaccagacuggccucaaacucagaagagacccaucuaucucuuagcccuugaagugcuggaauuaaaguugugcuucacugucuggcuuuuccugaaaauuuugugauuacauuuuucuuuagagcugagugguauuccauuguauauuuauaccaaauuuuuauugucuguuuuuguguugguaggcaacuagguucauuccaauucuuuuuuuuuuuuaagauuuauuuacuuaugaguacacaccagaagagggcaucagguuccauuacagaugguugugggaauugugauugcugggaauugaacucagcaccuggaagaguagucaguguucuuaccucucucuccagucaucucuccagcccucauuccaauucuuuacuuuaguaaauagaguaauacacauggggaugcagauauuucuauuauagaauauagaguuuucugaguauguacccaagagugaaauagcagggucauaugguaguccuauuuuuaauuauuugagagauuuccaagcuaauuuccacaagcuguauuaauauauacuuccacuaacagugaauaaucagcccuuccucaccacagccucgccaacugugccaaaagucuaggugacagccauucugauugaggugaggucauaucgcaaaguaguuuuaauuuccuuuucccugauggcuagggauuuugaacauuuuuaaaaauaguuauuggcuauuuauauuucuuuucuuuuuuuuuuuaagugucuauucaguucauuugccccuuuguugguuggcaauuuuguuuccuugguauuuaauuucugcaguucuuuguaaaugcuguauauuuagucccuugucuaaaguauagcugguaaagauuuucucccauaggcugguuugcucugucaguuguuuucuuugcugaacagaaacuuuguuuuugagauugcuuccuucucagcaaagcucugcuguuucagagcuagcucuguagaccaaggcccagugauccuccugccucugcuucccacaugcuggaauuaaaggugugcgccuugaagccuggcaaauuuugaguugaaauuuuuguacaagguaaaagaggagaaucuaauuucauucgugugaaggcagaaaacccaguguugccagccccauuuguugaacaggcucuuuuccagugaaugauuuuuccucuuuugucaaaaauuaagugggcauggcuuuguuguuuuauuucaggguagucugucauauuccauuaaucuuccuguuuuuacacccucgccagguugucuuuuugacugacuacagcccuguagcauuauuugaacuuaguguuaaguuauaaugccucuagcauucuuguuccuucuuuaauuauucauggucuuuuaugguucuauguguauucuuguauuguuuuuugcuaaacuugugaaauacaucagaauuuugauagguauuauaugaacucuaaauuaauuuugguaguauagccuuuccacaauauuaauucugccaaaccaggagcauggaaugucuuucuguugucugcuaucuucuguaauuuucuuuuagugucuugaaguuuguuuugaggguuuuuucaucucuuugguuaaauauauucccaaauucuuaaauuuggcauuuguguuugcguguguuuaguggaacauucgugcaguucauaggacaacuuaaacucuccuuccuguggguucuagguugaacucagguugucagacuugaagauaagugcuuuuaauuugaugagccauugugcuggcucuggaacucauuuggagcucauguuggguagagguaggaggaucacaaguuugaggccagcaccaucuacaaagcaaguaccaggcuaccuuguacuacagagcgagacccugucucagaaaacaagcuugcagcuagagcauuaugggcaguuaaaagaacuggcuguucuagaauaccuggguucaauucccaacauccucuuauaggcucacaacccucuguaacucuaguuucaggaucucugguucuaggcacacacaugguacacauagauacaugcaggcaaaaccuucuuacauauaaaaauaaccaaauccaaucuugaugaguggccauccugcccaccauccuccuacagccaugugggacaccacaguugggcugcaucaacgaguuacacaauauuugaagggaacgguguuggagauucuguccaugggaagcccucagugguggacacauuuuucacauggcuugaacagauuuaucaguccugacuggacaguucuucacaguuaucuaguggguuguggcacugagccugaguuuugucuacaaagaguuuaccuguuacaggauugguacuuuaugaccuaugccuugggaacuuaccaccuaaaccuuuucauaacguucuuuucucgaaaaguguauccuuccuugauggaagacucagauaacagccuuucauuaccaaccaaacaaugaauuuauuaguuccuuuauuugaaagcuuccagaauuaaaauuuugacaugcagcuacaaaaggcauucuuguggcuguggucuguacuuuguuuuacuaucaucaugguuuucugugucacagugaagaggcaaauaaagcacgcgacuaacacagagagcagagguacagagagagggauggccucccuacuuagaagcuggacuacauucgcacauauucaagaacaguuuugagccauuguaacaguaccuuuuucacauagaguaguugugaggaagcugaauuuucuuuuuaagggaagccucaaugauuuguaucugaaauaccagauccuugaagaaacugguauuuaaaccaaguugcagugauuucuuuuuuagugauauacagauguuugaaacagacagaauuguacugacuauagauaggcuugggaggucaagcggguggcagcccaagagagcaggagggaggaugggauacagcccuggggagcugccuuccugaccacuaugaggucacuccucucugcgaaagggacaugccagccugcuuccugcgugugaaaauaauuuaaugcuuugggggugauuuucacauagcucuaugggguucucaugccaguuucugaauuucaucucauuagagauguucuucaacuuggcaucuaucauaaugacucaaaauuuuguucuuaacuaugauaacuuuugagguccuagaauuauauuuuguuugaaaauuuuccuuuuuuuccuaaagguuaaagacgggucaauuaauagguugcuaaauucaggacagagaauuucaguaauguaucaguuccuuggacaugucuggacauaguaaauauucaaguuuugggguuuuuuauggcuaagaguaucaaucaaaagauaguaugaaccugaaccucugagagcucccagaaacugagccaccaaccaaagaacacacagguacuggaaugagaccccagcacauacgcagcaaauguucagcucaaucuccaugugggucucccaauaaggggagcagagccucuuccuaaagcuguagccugacugugguaucaauuuccuaacagggcugccuugucuggccucaaugggagagcauguguguaaacgggcagagacuugaugugccagcguugggagauaaaucagggagaagcacccucucagaggagaagggaaggagggaugagaaaagggucucaaugagggaggaggcucuggaagggggagugcuuggggcuuaauuaauuaauuaauuaaaaaaagaaguaguuaugggaaaggauauuaauauaaaacauaaaguaucuccugccuaacaaggagaaaauguuuuaagugauaggaggagagaaaugaugaccagaucguguacacugauagcguagcguguuaucaccaaagaaugaauuucuuguucaaaaaaaaggaaaauauauacccuguuaucucagcgcuugggagguggagacagaaggacagaaggacagaaggaccaggaauucaaggucagccagggcuacaaaagagacccugucucaaaaagccaaauaaauaaaaguauguauguuuauuugccauggagcuuuuaaauguuaaaaugucauagcauauuaccuuuacuccaguuuccuuaucuguaaaaauaacaauaaugcuuuuagggucauuuugagaauuaaguuacauaguauauguaauacauuuauucucuuucuucuuuuuuguuuuuggugaugguagugguguuuuuuuguuuuguuuucaagacaggguuucucuguguagcccuggauguccugagagaaguuugagcaagaauagcugaguuggaccagccagaguucagaaagaacuaggaagggaugagcuuguucagcaguaagucucagagguuaaaaacauucuuguacagagucuauaaguuuccaggaguaggccuagguuagcagacugaggcaguaagccucaaagacaacaauuacaacaguuggucaauaaaaguuauuuuuacagcucuguauucaauauccaguacuaaaaaaggagaaaugaaaggggcaaguuuugucuuaauguugccauuaggaaauaugaggaaaaaguugucaaagaugauucuuagugcuucugucauaaguagucugcaugcuguugacaacagaagcagaagguagcugggcaguggugguggcacacaccuuuagucccagcacucaggaggcagaggugggcagaucucggaguucaggccagccuggucuacagagagaguuccagggcaacacagagaaacccugccucaaaaaacaaaaacaagacaaaaacaacaacaacaacaacaacaacaacaacaacaacaaaaacaacccagcaacaaaaacccaaacaaaaaaaggaaggagauuuauuggaggugaggugguuuuagguauagaaagguugagacucuagcuggcuuguauauucucacucucucucguucucucucucucauucaaaagggauaucugcacuugaaaugcuauuuucaaaguuagcuggaccuaguuggcaauagaaagcauaaaaauagaccaaaccacuguagaaaacuuaggaaagagaauugaagaauuucugaggaaacaccaccaaucaguccaaugaggagaggagaagcacuuaacagagucaagcauggagugguuuggcauuuaguaacuacuuggacaggauuuugaguaaaagccagaaauggacagcauuuguagaagaacagaaagaguuaaaguaagaauuggaguuguaguaguugaauuucauuuaaacaagaaaaguccuuuucuauauuuaagaguuguuacaugccaggcagugguggcacacaccuuuaaucccagcacuugggaggcagaggcaggcggauuucugaguuccagcuuggucuacagagugaguuccaggacagccauggcuacagggaaacucugucucaaaaaaacaaaaacaaaaaaaaaacaaaaacaaaaagaauuguuacauauuaguggcugaaguagguagaaugauaguuugaacauggacaaugaaaaggcaaauggaaugguagaaccuaaaagacugccagaaauugcagaaaggcuuugucuaguuucacagagucucauuaugcagagcuggcuugucuggaagucaaaggcaucuaucugccugccucuguccucccagcgcgaggaugaaaagccuguggucaaggacauuuuucuuuucuuuuuuaaaauaagaaacaaagguuggagacauuuuaaccccaguuccuccagcguaacuagaaaguuaugcucauguauacauacuguugagacaagaguuaguaaaggggggcaaauugaagaaacacuacagaauuaagaacuauuuaucaaucuaaaacaucaacuguuuaauuagauuuucuuuucauugugaacauucauacauucauuuguuauuauuugccaaucagauuugucauugugauuaaaauuuuggggacuggaugauaaaccaucaaccuaccauuuuacagccagacaugauggcauuaugucaaaaaucuuaccuuaagcuaaggaaaggugugaauuugaggcuagccuaagcuacauaguuagacccuguugcgggaaauauuaaaaaugaacggcauuuucugagcuacaccgggcaccauugggccacauggcuccagcuggguguucucaucucagcagacucucuggcccagagcuccugagaugucuccacccaacuugcucauuucccuugacaggcauugccaggccagccccaugcaacgaccguccacccugcaaccuaguagaaacaaaacucuagaaacuuauaacuaaucagucagauuuauauaucaauaaauucuuaauucacaagauacccauacaauaauuucagggccaauugauaaugguacaagcugccuaccuagauuagacaaguuaccccaauuauuuuaucccuauauggaaaaguugugcaauuaagaaguagcaugguagccgggcagugguggcgcacgccuuuaaucccagcacuugggaggcagaggcaggcggacuucugaguuugaggccagcaugaucuacagagugaguuccaggauagccagggcuacacagagaaacccggugucucaaaaaaaaaaaaaaaaaaaaaaaaaccaaacaaacaaacaaaaaaacaaaacaaaaccaaaaacaaaaaagaaguagcaugguucuggagagaauaguuagcuauuaaaagucaacuaggcaggcagggagaucaaccuggucuacaaagugaguuccaggauagucagggcuacauagaaaaaccuugucuugaaaauagaguugggccuggagagauggcucagcgauuaggagcacugacugcucuuccagagguccugaguucaauucccagcaaccacauggcagcuuacaaccaucuguaaugggauccaaugcccucuucuggugugucugaagacaguuacaguauacucauauaaauaaaauaaaucuuuaaaaaacaaagaaaauaaagaguuuauguugcuuugcaaaggacucaaguuuaguuucuugcaucugugucugguauuucauggccaccuggaguuccagcacccucuucuggccucaguaugcacuagcagcucacguguacauaccccaacagaucacaagacauaauuuaaaaauagauuucuuuaaaaauuaaaaagguggcaacagcuaucacaaagaaaacaauuuuaagaauucauguuuuagggcuggagagauggcucagugguuaagagcacuaaugcuuuuccagagauccugaguucaauucccagcaaccacacgauagcucacaaccaucuguaaugggaucugaugcccucuucuggugugucuaaagagagcaauguguguacuuguauacauaaaauaaauaaauaaaucuuuuaaaaaaagaauucacguuuuauuaaaaaagugaaaagauuauguguaucaaaauauuacucguuuuaguaauuaguucucaacuggcuuaacauuaaauguagagaacauagcuuuuaaguguuugcauaucuaguauagguaaauuuuaauagaguauuaacauagagggcuuaaaaauaaaauaacuuugcaauuuugauauaaguguaaauucuuuuuuuucucccuuuuuuuuuuauuaagauuuauuuauuuauuacauguaaguaacacuguagcugucuucagaaacuccagaagagggagucagaucuuguuacagacgguugugagccaccaugugguugcugggauuugaacuccggaccuuuggaagagcagucgggugcucuuacucacugagccaucucaccagccccguaaauuccuuuuaagaugaugguuuuuagccuggcuguuucauucuaucacuucuguggugacugcuguuaucuuuuucauuguggcacauuuuacauaauauauuacaaauugaaucuauaaaaauauaaauuagaugcugcugcuagacacuuucuuggguaccuuucuucagucucugcuugggcaccuuccuuagguuuuuacccucaucacugcguuucuuucuugugugacacuguguuggaccuaaaaugacuccuccucugaacacaguaaaaguaagccacuuagucagcuggaggcagagacaggcagaucucugaguucgaggcuagccuaguuuacuuagggcagugauuuucaaccuuccuaauguugaaacucuuuaauauaguuccucauguugugguguccccaaacauaaaauuauuuucauuacuacuucauaacuaauuuugcuacuguuaggaaucauacuguaaguauaugauaugcaggauaucuaauauuugaccccugggaaaaagucauuugacacacaccagcaaaggaaucaccacucccagguugagaacuucuggccuagggaguucuggguagccaaggcacauguagagacccuuucucaaagauaaaaacuucagggcugguaagaugauggcucagccacuaagaacacuggcugcucuuccagagguccugaguucaaguccuaggaaccacaugguggcucagggcuaucuauaaagguauugaugcgcucuucuggcacguagguauacaugaagacagcauuccuacauuagaaacaaaaacaaaaacccauuuaaauuagccccuuuagcuuccccccuaaaggggaugauaaaugaagcuccaguuuuuacccucuaacucaguagccuuucucuuuguguaugucuuaggguguguguguguguguguguguguguuguguguuguguguugugugcugugugcuauaagguuagauagaacucaauccaaguauuuuaugaagagauauuuuuacaauuaaaauuguuuuuccucaaaggggugucauuacuauaacuucuagucuucaaaucuuagacuauaauuuccucuguaaauuacugaugccucacugggaauuacaacacuuaaguguaauaauaagccuuuguuuuucuuugugcuauugcuuacuuagcgucaguuuucaggauaguuauaaauuuucucuucucuaauguggucccuuuaugcugguugccauagaaauauuccagagaaguggcaaacuagguuaaggucaagaauaaugauucuuaagaaguuaccaugugggauagaaugagaagugauccaagaauauuuuucuuuacauauaauaaaguuuuguuugauuugauaguuuucucaaaggcagccuaaaccuaaccuaaacuagaaccuuuguuuuaguccaguucaacaguuaauuagccauuggcugaaaaaugcugcuugccaucaaagguuuauuaucuauaaacagguauacuucugucaggagaagaacuugcuuauagcagauacagugaauuguaguuccuguuuucucugaauuagggacaaauaaaauaaaccuguaauuuuaugguaagagaugguugugauauacuuaacauuucacagcaguauaauuuaaugguucaguacagcuauugcugugcucauagaaaaacugaccaguggacauuuuaaaauuauaaauaaacauuugagaaacaaagcuauaaaaagacaggccuuuaaugauuuuagcagauuuauugauugaaauuuuacagaaaauauaguucacuuaaguauagaauucaccuacuuuaauuuauagagcuaugcaacugucagaauuaucugguuuuagauuuccugucacuuaacaaacauuuccuaauaucaaccacuauuaacuacauaauagguuuaaaaguaacagcuuaggaguuuggucuccuugagauauaguccugccauuugcuuugauuaccucuuuguuugaagccuuuuaaauuuuaaaauuggguaauaacuguauuacagcauugaugacauuucaucacaaucccuaauccuuaggggauacuuuucaagaccuccaacagauaccuuagaucauagguagagcagaguacacagucuuuccuaugugguucaugcccugaccccucuuuuacauaacucauuuuguaccuuagugccauuuauugagagguuacucaacacaaaugaguacauaaugaguucuaggccagugagggcuacauaggucagacagacccuguguuuuaacaucaagaguuuauaaucuauacauagcuauaaugaugccucagaagaagaacuaauuuagaacagguauuucaucaauuuuaaguuugaucuuccucugaauuagggaucugacaaccaagguggcuguuaaaguuagcauaugcaguauaaaucagcaguggcucaaaauauauugaacaagaauuccagaaauaagucauaaauuuuaaauuauacucuauucugaguaacaugauaaagucuugugccgucugggagaugagucaucccuuuguccgagaaucaggauguuauuuuaauaauuguuuuucauguguuuacuguugcuuagcccaaguagaagaauguuuaucacauucauuaaaccauauaucccaugguguguguguguguuaaacaugauguaaacuacaauauuugauaaguuugaauauuugaaaaugaaguuagagaaagaaacuuaaaagaaugaaguagaaauucuuggaucaguuucuaccauuaagucaaacuucuccaaagacaugugugcuuuguaguuuaucauuccugaaauacaauauuuaagagugacuuaaagagguuuuuuuuugccgggcgugguggcgcacgccuuuaaucccagcacucaggaggaagaggcaggcggauuucugaguucgaggccagacuggucuacaaagugaguuccaggacagccagggcuauacagagaaaccaugucucgaaaaaccaaaaaaaaaaaaaaaaaaaaaaaagaguuuuuuuuuuuuuuuuaaauuauccuuaaauuuaauuagggagagggaauacaaguggauauagcuuaugaguacggguacaugugcauuugagcuuugaggccacaggaggacuuaagguagccugcucuaucacuugcugccuuauuauuugagguagggucucuuguugagccuggaggguuaccagcaagcacuaucuauucucugucuccacuuuauuuaugugugaguauauauauaagcacacauguguagaguugcccagagaggccagaagaggaugucaggucccuuaaauuggaauuacugguuguugugagccucccuacuugaguacugagaaucaaauucagauccucuggaagagcagcaauagcucuuaacuacugaacuaucuuccaggcacacccucagagcuuuuugauuuauguaauccaguaucuauuuuuauuuuuguuuccugaacguuuuaggguguuuauaaacaacaacaaaaaacaagccuauuucaacauccugacaugucuccucugugcuuuccucuggcaguuucagaucuuacauaaguccagaauacauuuuuacuugguuuuuguaacugaugagaaagagggauauauuuucauucuucauguggauguucaguugucucagcaccauuuguugaaaagauuguccuuucuuccagugguauuuuuaacauguuugucagaagucaauuggcuguagauugaugaaauccuuccacucuuuacaacaugagcaaauacccugaguuuaggucuuguguuauuugaucuuuaauuauuuagagugaccacucucuuuuuaaauuaaaaaaauauuuuuauguauguggauguuuugccuucauuuaugacugugccccaggugcaugucuggugcugguggggaccaaaagaggacguugaauucccuggaucuagaauuacagccuguugugagcucccaugugguuguggucuucuggaagaacagcaggugcucucagcaguuucugcagccccccccccuuuuuuagcauguagagugcaugccauggugcacugaaaaggcaagagaacaacuuguagaaauucucuccuuccacaguguggguuccgggggcugaacucagguucccaaaucuugguagcaagcaccaguacuuacugaacccucucaccagucuuugugucaucuuuuaaccuuucuuguugucuacuauugucacaggauaucugaucacuuugugaacccugagauuguguuauuugcugaaaauaccuguuuguaguuguguggcucugcccuuaagacacaugucuaaucccuuugucuggaauacagauacucccuuaguauacaccuuuaauuucucccccgccccccaaauguaggucaaguuuguuuguagaaggaggcacccauauuugaaagugaugucuaauugaguagcagacaaagugaugaaucugaaagauuugacagaauagguucugcccaagaaaggaaagggaagcuacuuaagagagagcggugcagaggggcagaguggaguuuuaccaggacagcuguacagagacagguuuuagagagaacaagcuagacacaagugaagacagaaugagaaggaaucagaguagaacaaauggccaaaauuacuaugaugccaagcagagcaauccaggugaagcugggagaaaccagagugaaucaaucagcuuggagaggaguuugauccaguauagccgaguugaaccauucagaguucagaaagaacuagggaagggauuuuacaguauuaaaucucagaggcugaaaacauucuaggccuagauaagauuauacagagucuagaaacuuccaggacuaggcccagguuuagcagcuacaguaagccucugagacgacaauacaggaaaauaaaggauacuuucacaccucuguauuuuggucuuuuuuuccccuggccuuucacuaaucuauuuagucucauaaaucacaaaucugugguuaugcauuuucuuuaaccuaaauuuuaggaguuuuuuuuuuaucauauguuuuaacuuucauuauaaauauuaguaguuuaguacauaauaucccacacauccuuuucugaauuuagaauaguuccaucuuauacaugugccauccauguauaaaugugcuacaauuuguagccaucaguuuaacuuugcgauuguuguuuauaucuguagcagaaggagacauauagauauaagauuugcuugccacuguaauccuuagcacuggacauagcaaagaauaaaagagcuaaaauaaaaaugccucuuuuuaaaaaggaaaagaaagacagaccaggucuccuuguauaaucuuggcuggccucaaacuuagaucugccuaccucuugccuguccggugaugagauuaaagauguuagccaccuugccaauaucuuuccauccuauccaccuccaacacuuccuccuacuuuaccacuucuccaacacauauccuuuccuucuuuacauccuguuuucugaaguccaguuagugcuuuccugugugcacauguguguggggccauccacaggagcauggacaaccuaauagaggucaugcuugcagagaaaaaugacgagccccccccccauuccccccccccccccccacacacacacacuuugcagccauuauuugcacuugccaauagugauagaagcacaggagccugucuuccauccaugcuguguuguugacuuacuuguucugcuggucggucuuguacagguaacuacagcugcugugaguuuaugagugcagcacccaugcuuugaccaaaagacaguguuuuacaguacuccucucuacccucuggcucuugguucuuuccacuuacucuuccccaguguaccuuaagccuuaaggaguugauauaaauauuuuacuuagaguugcaccugaaagucauuuauucugucuagcuauacuuucugggggggggggggacugauuuaguuaagagacagaagaauuguaaauaacagcauauaaaauuauuuuucuccaauuaauauauuguauauuuacaugcauaaggaaacaaugggaaaugagguguuuuauagauuuagagugauaaugagaauuggaaagauaaguaauaagguaagagggagauuauuuuacuauaaacauuuuaaaaacauuugacuggcuuguuacuugggaaaaaauuuuaagaguauugauugauggcauacuugccuagcauacacagguccuagguucuaucuccaguaccauacagagaaaacuguuguuuguuguucgggugggacuuguuacugucagaauaguuacuucaagaccauccugaauuacauacgcugguggaggagggaagauuaaaagaguauucauuuccucucuuuaaacuagaauuuaggccugacaguucgauuuguuaacacaaaauagcuaugaggcuuaucacuuucgagaauacagacuggggugcuggaucuccaacuuugucugcuauauagcuuuugaaugaaguuacaagucaagcucccugucucuuuaaucuccuaugugucuguaaugguaaggauaagaugguaagagauuaagauuuuagcuagacuaucuugcuuaaucucuaucuuaauuaauugugugugugucucugugucugucagucugucugucuuuaagagaauggggaucuaauuccaaccuccuacauacagacuuuaaagguuacaccuuuagaaaauuaauucuucugggaaauauguccuccuuuaaaauagaagauggaacugauuauuuuaucaaaacugaguuuauaaaaauguacgaagauauaauuuguaacauuaaaaugauaaggaagguuguagagucaugauugacuucuuuucaacaguuuaauuaaaauuaaaaacagauuauucuaauuuuuuuccuuucucuguuuuccagguuauauuucacacuaugugcugacuguaucuacagaagauauuuaaaaaaaagauaaacuuuuuuccaagauuuugauuccaguggaaucuuugcuuuagauuuuuugugugugugugugcguguuagugaauuguaacuccagaagcaaugccuguacaagcuccacaauggacggauuuccuuuccugcccaauuugcacucagacuuucgacgaaacaauucgaaagcccaucaguuugggcuguggccauacugucugcaaaaugugccugaauaaacuccaccguaaggcuugcccauuugaccagaccacuaucaauacggacauugagcuucuuccugugaacucagcauuacugcagcuagugggugcucagguaacuuaauacugguuauugucuguaauugacugauuuuaguuauaugugucuuugugugggcaugcuuauuuuaauguagauauagaugguugcauacagcaauauuuauaaauauguauauacuuggauuauuagauuuggauauuuucuugccucauuagccucauuagccaagauaaucuuaaggacaccauagucccaauagcagcauacaugccuuuuguuuaaauauugguuucuaauacaauauuuaauaacaggaagcagaacucuugggagggauggucaauucaagggcuaagacagcaaguccuuaaaaugagcauggagugucuugugcaaguauucuaacaaagugggacuaugucaaaagcauaccagagcugguugaaagagcucccgguggccagagcuagaaggguuugagcaaaauaaauggguauguuacugaauuauaacaguaggaaaagaagucaaagacuuuauguagauaaaauggaaauggaaaacacaaagauacagcuauaguuuuuaaguuuucauaguucuauuuuauuucuugcgccucugauuuuauuuuauuuaggaaauuuaaagucauuguccuagagcccauuauguuuaugccagucuuugaacccagguuucuucuaaguuugagucaguuugcauagucuauagagaaagaaaggcaaagagcacuguuuuaccugaggggagucauuacuuacugauuuuuuuccuuucuuagcuuuuaaaagguuuuauuuuuacuggauauugugguaugugccuuuauuaacagcacuggguagaagacaggcagacauuucuugaauucaggccagcaguguuacaauagugagaucuugucuccaaaagaaagaagaaaaaaaagggcauuuuuuuuaaauguaacuguguaccccauguguccagguacccuuggaagccagaagaggguauuggauccccugaaaucacaguuaaaggcaguugugagcuaccugauaugggugcaggggaauugagcuugugucuuccagaagagcagcaagugcucuuaacugcugagcugucucccuaacccuuaagaaguuauuaaauacaucuuaauguauuugggaaguggaugcccauguaaccaccauuuugauauaacuacaacuguuaucuaaagcagagauaaggacugcauagcauguucacaaguacagugguguuugaaaaaaaaaggggaggaagcaggaaauaaaacaugguaagagaugauaaagaagaaggaugaagaagaggaggaagaagaaaagaaggaggagaaggaagaagaggaggaagaggaggaggaagaagaagaagaacaacaacaacaguuuuuucccaacugcaugugcacaauucaggcaugauaaagacuuaaggaacagccauaaccaauagaauucugaaauuaaauuuuaaaucauguauuuuaaauuuaaaaaggaaagaaaacuaaucauacaagaaggaagaauaaauuagagacucuucagguuuucuguaaguguaaaauuacaccccccacgaccaccaccacuaccaccagugugauuuuucaauuaacuacugcuguguuaaauucuggaguugugguuuuuaccugugugauaauguggugaauaauucuuguggguuuuuuguuuuguuuugaguguguuuucuuuuugauuacaccucucuucuuacuauuauauuuuuguuuguuuauugaaugauuguuggggaggggagcacauagaggacagagacaaagaaucacuuucucuuuccaccauguggguccuggaaauugugcucaggucagacuugguggguggcaagcacuuucacccuuuggcccgucucgauggccgucucagauuauaucucuuaacuuuaucacugaaagugauaucaucugaaaaauauuuaaucucuggcuucaccaccugcucauuuaaguaccacgugugcucauuucuaugacugaagagcaguuuugauggauaaccuacaccaaauacacauauuuauguuagagaaauccagcaaaugcuuucgcagucaggugaacuggaucaaugugaccagaaguaagucauauugauagggaaucuuuagcaugcuacgaugaaaaggguauuuuuucucucucuggacuuacugccaaacauaucuaacuccagucuccuugugagaaaaaugagaucccaucaaaagucaguauacaacacguauccccaguagucuuuaaaaccuccaaucaucaaaacccaaaaggaaccuuauaaagagugacacacaaucaaguauucuggaugagcugcuggaacacgggaaggcuguuaggcaaaaguaaggcauucugaguaaaaucagaguuuuuaacuauaaugcgcuaaauuacuauagccagauuggcauauuaauaucaaagagaacguuauaaugagaaugaggugugggauaguaggaguucucugaacugucuuugucauuuucuguaaauuuaaaaugcuucugugaaacugcuuuuguuuuguuuguuuguuugguugguuugguuuguuuuuaaccaggaaaaaaaugauuaauccuaccgcuaaucaggaaaauagagauuuagauaacagcaggguuuguuuuuguuucuguuucuguuuuuuuuguuuuguuuugguuuuguuuguuuguuuuugaucuucccacaaaccagugucugaaugguggucccauguggucaugcagggcucuugcaugugcuagggagggugcaaucugucaggcucuggaaaaugcguacaacccuguagcuauaguggcugcacuuacagguuaucaaaccagauaguuuuaacacauacauacagggggcaccugcagaggaauaucacuacagucucuaaaagcaacaaguuaaaaauagccuaaacaucagaacugauucacuguguugucuauaccagagaguuauuagacauuuacagauaucaccacaaaucuauugcaaaaacaaaguuuuuuuuuuuuuuuuuuuuuuuugguuuuucgagacaggacuuuucuguguagccuuggcuguccuggaacucacucuguagaccagguuggccucgaacucagaaauccgccugccucugccucccaagugcugggauuaaaggcgugcgccaccaccacccggcaaagauuuuuuuucuuaaaacaggaucuuauguauccuaagccggucucaaacucacuguguaacuggccuugaacuccugauccucuugguuauggguuugugccaccaugccuggcuuauguggugcuaaggauuaaaucugugucuuugugcauaugaagaaaauacucuuaucaauugagccaucccagcccucagaucaguuuuaauagccaaugacaguuugggaggcagagucuguauguuugaggucagcguggucuacauaguuccagaacaaccagaauuacauagugaaacuugucucaaaaacaaaacaaacaacuaaaaauuccaguaacaaagucuagcaucccaguaauuucuguaaauuagcacacacgauuggauauucaaggauauguuacuauguguacagaaaauaggaagaauccaggggaacucacaauaucaccuccagaaggcacuuagcaagaaacacagacaaaugacauccuuucuuccaaacugucuuaaguucauacugauaguguuuucauuagcgccucccacagggcauugugguugagaacauuucuuaggcuucaaccuuuuauaaaaauaucuucccagguguaaauguuguaacucaaacuacucaaucuugaguuuaccuuuauauuugaauaauacauuuggcucugaaaacacagguuuuccuuagaaaauacugauuuggaugacaauuugagggucuauuggcuguucuauuucuauguucaagcucccucuaguggcccaaaguaaccccuaccccuuaaauuauuaaauuccuuucuccuacuugguaccgcacacaacacgcacacacaagcuucuugaaaagcaaaggcuugcaagcaguccauuaaguuuuacagauuaggacuggagaguucuugcugcugaacugauuucccagcucccacaccaggcagcucuuuuucacagucaccaguaauuccagcuacaaagggcccagugcccucaucuggcaugcauacucacaugcagucacauacacgaaaggaaaaacaaaauuuaagucuuuaaaaaaauuaacuuauucauuucaguguguaaugcuuguuuguucuuuagcuuuaaauguuuaaauuacauacaguuuaauccaagauacuuagcuuugguauuguguacaauaucaaguguuuuuagcuuugcuuuugccaauugcaugccucaguuugaguagucugcauucuauuucaucggugauucuaaccuauucauccuguaugccaucucugagauuggguuggguugucaaaggauuaagugcaucuaccccuagccuaucuuaaaacauuucucuuuuccuuuuuuggggaaugggguaggguauuguuuugagacaggguuucucugcauagucuuggcuguccuggaacucacucuguagaucaggcuggccuuaaacucagagauucuacugccuuugccucccagcugcuggguuaaaguugugugguaccacuccccaguucaaacauuucuuauauacauacacacuuuuauuauuaguuaaacagggcuggagagauggcuugguggcuaagagaacuugcuacuucugcagaggacccagaguucugagugcucauauaagucacuuaaaaccuucuacagccgggccgugguggagcacgccuuuaaucccagcauuugggaggcagagacaggcagauuucugaguucgaggccugccuggucuacagagugaguuccaggacagccggggcuauacagagaaacccugucucaaaaaacaaaacaaacaaaaaacaaaaacaaaacaaaacaaaaaaaacucuucuacaacuguauuuccuagagauccaacaccagcgucuugcuuccuuggacacuaggcaugcuaauagugcacuuucuaugcauggaggcaaaacacucauacagauaaaauaaaucaguguuggagagauggcucuuuaaauuuuuaagcauauauguaagugccuccaaauucuagaagagggugugcaguaacgugccccccacccccccgugcgcgcacuagccuccugcacacaguuuacaugcuuaguauuagcuguuaauuuuuuuaaacauguauuuuauuuauaugaguacacuguagcugucuucagauacaccagaagauggcaucagaucccaucugaugggaugguugugagccaccaugugguugcugggaauucaggaccucucucuggaagaguagucagugcucuuaacuacuaagccaucgcuucagcccccagcuguuaaauuuuuauucguuaacagucuuucagaagaugggguugggguggggguguauauugaguggaugagaacagaauaaguucuuugcauugacucugaaccagauaggaaguagcaaauuaaauguacaagauauugacaauauuacuauuaauaacacaaaauguaaaaguucuggacuagauaaucacaagucuaauggggaacuguuuaagaacuagaaaauauuuuuuugugacauaaaguugaaaaugcugagccuuugguucuuuagaaucauaguugagugagcggcagguaugacaaauguguggcuccuaccuucaacuagacuuguccugugaccuaaacaggaaagcccagaaauagugcagggagccuuggccaccaagggcagaagcacaucaaacucccacagauagaacagagaaagccuuuccaugaaacaugacucuuuucuaacuccacucgugacuagccuaaaauuugguuucuuguuuauauaccucuggcuguugccacaauuccauaacaacuuuuuucuuaacuauuguuugcuccugccagcuuugguggcacacaugccuuuaguccuagcacuaugugaauuuaugacagaacaaccuuagucuucuaggaaguugaaauauaaaccagagugagguggcaggagggagcaaauggcagaaagagggauguugagggaagggaaagcagauuguuuuguguauguuugagauagggucuauguagccuugguugcccuggaauuuacuauguagacuagacuggccuugaacucagaugucugccuacuucugccuccugagugugcugggauuaaagcuauaugccaccacacugacugagagagaauauaagagaaaauauuuuaaauauuuucaccacaaaguaucugaaaugaaaauuuucuuaauuagccuaguuuaacuauugcaaauuauaagcuuauaucaucagggagucacauuguacuuaauaaacauuuauggccaacacucaaacauuucagugugcucgcaucggcagcacauauacuaaaacauuucauuaauuuugaaaaaucuacauugaggcacuacuuuguacccaaugccaugguucuauaagaaagggaaagcggggcaugguggcauacaccuguaauccaaccacgugaaaggcugaggcucaaggauccuugugaguucccaaguuguuuagacccuaccucaaaauaaaaaagugggugauaugugguaaguauauuaaaugguauguaagcagguuaccuguuggagcccacauaaguaccaugaguuauauucaaauaaugaaaucauaauuagcaauuaaaauaaaugaaauauugaggacuaagaaaguagcucagcuggucaagcauuuuccuuacaugcauggaaucuuuaauccccagaauccagauagaaguggguauggaagcuagagauaugaccccaugauuaaaagcacuaacugaucucccugaaaacccaaguuugagucccagcacccacauggcagcucacaaccuucuguaacuuacaugugugguacacagacaugugcaggcaaaacaccaauucauaucaaauaaauauuacaaagagauauguguuggcacacuuacauugucaaggcugaggaucccugggaucuccaagauccuaggcuagccagccuagccuacuuggcaaguucuaggccagugaaaacccuuucucuagguaugugagaaacaaccacugaaauuuuccucuaguuucuguacauacucaccaaaaagaaaguggguacauaccacacuuuuaaucccuauacuucaaaugggucuggcauaaguuccaagucagccagggcugcacaguugagcgagacccugucucgggguaauaaagggauaagguucuuuuuggggggagggggcagagugaugaagaaaauuuucaauuuaguugcuauaguuauucaacuguaaauuuacuaauacuguagaucauugaauuauauaugcaaucuaguuaauuauauaguauuugaauucuuuuaauaaggcuuuuauggaaauaauaauggauaauauaugcaaguaaaaguuugaaaacauuuagcaaauuuaguaguuuuaauguuguaagcaccuauacuauaaguggguaaguuguacucagcaaaauguuuaauauaaauaaguggaacauucaaauauuucuuuuguucuccagaucccugagcaacagcccauuacuuuguguagugggguugaagauacaaagcauuaugaggaagccaagaaauguguagaagaauuagcauuguaccugaagccacucagcagugcgagagguaaauguaguuauaaaacccaugcuaaacaaguagcuguuugcuaauuuguuuuuugagacaggauuucacuauguagcccugguuggcccagaacucuauguagaccaggcuggccucauucacagagaucuaccugccucuacuuucaagugcuagaauuaaaggugugccccauucauacuuggcugaauaccuguuauagauacuuguaguaccaaaauaauugagcuacaaaugaauacaaauguaugaaaccuuuuucucugucucgucccuuucucucucuucucuuccauuucuacuuuuuccccuacuuaguuuucagugcuaggcaaguguucuacuacuauacaguaguagauuuaggauuuauauaguacuacuaucuaugcagcuuguccuagugaaugcuaauagaauuuauucauuauaagcuguacuggcuagcuuugugucaauuugacacaggcugaguuaucacagagaaaggagcuucaguugaggaaaugccuccaugagauacaacuguaaggcguuuucucaauuagugaucaaggcgggaggucccuuuguggguagugccaucucugggcugguagucuuggguucuuuaagaaagcaagcugagcaagccaguaagaaacaccccuccauggccccugcaucagcuccugcuuccugaucugcuuaaguuccaguccugacuuuuuuuuggugauaacagcuguguggaaauguaagcugaauaagcccuuuccuccccaacuugcuucuuggucgugauguuugugcaggaauagaaacccuaagacauaagccaaaccuacuucaugcuggauaauauaguaaaccacaucauauaaaguaguacuaaguccagagugugugugguguugaaaauauaaauagcuauagaaaugcuuacaugauuuagaagggcuuuccuuuuuuuuuuuuuuuuuuuuuuuggacaguuuugguuugguuugguuugguuuuuuuuccuuugaagacggggucucauuuagcccagguuggcuuuuaaguugcuuuauggccaaggauagcuuugaacuucugaucaucuugucucuacaagguagagacguuugggaaguguugcgaauuaagccagggguuaugcauucuagcagcuguauccccgcucuuauuugauaaacugauucuuugucuaguuuagguuguauuuguagaaaacgguaagaaaauggaaguuguuguuaccguccagaaagagccugcuauuaacuauuuguaagauaaaccaguaauaauaugccagaacuauuagaacaacaguauuugggucuuggauuaauugcuguuuucugucaguuuuucuucuaugauuaaaaugaguaauaguguucugaaugccauaaugagugauauuuaucuauauauguuugcuuuacuuuuuaaauguuauuguuauaugguuuuauuuaccuaauuacuuguuuguuaauuuugauguuuugagacaagguuucucuguguugcucugacugcccuggaacucacucuguagaccaggcuggccuugaacucagagaucuagcuacccuugccucucaagugcuagguguggauauccaaacuguugguuuauuauuuacuuuaaauaugcuaaugagaccgagaacuagcccauaaagaagccacuccagaggaagugcuccuggaucauaaaauugcacuguaaaccuagaaauagcuuccuuguucucuccuccaggugugggucuaaauagcacuacucagaguguucugagucgcccaaugcagaggaaacuugugacucugguucauugccagcuaguggaagaagaaggcaggauccgugcuaugagggcugcucgaucuuuaggugaacgcacaguuacagagcucauucuccagcaccagaauccucagcaacucucuucuaaucucugggcagcagucagagcuaggggcugccaguuccuuggaccagguauguaauuaaaguuuguugcuuuggcugcuuacuuacucuugcuggguauucuaaaaguauagagaaaaauccuuagaaauauacaaacccucaucuuuuguuaaauucuguuucaagcauuguucuacuugacaaccuuggcuucauacuuuuucagagaauucacagucuuuucucuugaugaccaaaguuuauuccuuuuauuagucauuaaaaguguuuuucucuguauuaauuauuuaucgacuuaauauaugacagaauugcccacaaauauggcuuuaaaauguaauuauaaauauguuauauuguuugggguuuuguuguuauuguugguuugguuuugguuuguuugucugucuguuuuugaaacaggguuuuguuguguagcccuggcuauccuggaauucaaucuguacaucaggcuggccucuaguucagagugcugggauuaaagaugugcacuaccaugucugguucaugguauugcuuguuaauggcauaguauuauguugcucuucagacaauguguuuaguucaucuuuguucaccauacauuuugauuguaccauuuuuccuagcgaugcaggaggaagcucugaagcuggucuugcuggccuuagaagaugguucugcauugucucggaaaguguugguucucuucguggugcaaagacuggagccacguuuuccucaagccucuaaaaccagcauugggcauguuguucagcuccucuacagagccuccugcuucaagguaugaaccuaaacucuaguucagcuuaaaacaugucuaguuaaguuugccaugucuccaaacuuaagcauuaaauuuggaccuuaaaaaaaaugccuguaguuuucaggaaauaccagcauuucuuuuuuuuuuuuuuuucuuaaagaaggcaaaguguauaugcucuaguuacauccuggguuugguuuguucgguuuugguuuuguccugucuguuugcacuggagggacugaacccagagccuugcacauguuagacaaguacuauauugcugaaauacagucucacccuuuaaauuuauaugaagagauuacucaucuuguuauucccucugucuuaguuaggauuucuacuuaguuaggguuucuauuacugugauaaaacaccaugaccaaaagcaguuuggggaagaauuuauuuugcaugcccauucaugugccacaguccauuauuggcagaauucaagacaggaaccgaagcacuccauagaagagugcuguugcugggcggugguggcgcacgccuuuaaucccagcacucgggaggcagaggcaggcggauuucugaguucgaggccagccuggucuacagagugaguuccaggacagccagggcuacacagagagagaaacccugucuugaaaaaccaaaaaaaaaaaaaaaaagaagaagagugcugcucacucagacugcugucuuagcaccaugaccaccagcccagggugacacugcccacaaugggcuggccucccauaucaguuauugaucaagagaauguaucacaggcuugcuuguacaccagucuaguggaagcauuuucacacaaaauuagccaacauacucaccaagacuguaagcaaaauuagcccagaaccacugaagcaguaauaagauuuuuaaaaguuucuuccuuaugcaauuguacaguccuagauuucaaauugcuauggaagcuggcuuaaggauugcaccagaccagugguccucuuugcuuuauggggaucagccucacaaaucucauaugcagucuauuauugacaagguagugucuuuauugucccuuacuucauaacugauuuuggagucuugauaauuauuaucgaaguuauuuugugugucuugguuugaugagccaucucucaagcuucuaaccaugugugugugugagugugugugagugugugcgugcgcgcgcacacucacacacacacauaagugcacauccgugccauggcacacauagcagauacaacacaauuuuguagacuugguuuucuccuuccacuuuuauguggguugugggaauugaauuuggguugucaggcuuauguagcauaugccuuuaccugcugagccaucugcuuccugggaguucuccucuguguaugccugcuauauaugguacacaucaaaccaagacacacaaaauaacuuggauuuuuuuaaaucauaauuuuugucuauacguguuuauauaaaguaugaggcuuuugucaguuacuagauuuuuguguguaugugucauuuuaggucaccaaacgugaugaagacucuucuuugaugcaacugaaagaagaauuuaggacuuacgaagcucugaggagagaacaugacucccagauagugcaaauugcuauggaagcuggcuuaaggauugcaccagaccagugguccucuuugcuuuauggggaucagucucacaaaucucauaugcagucuauuauugacaagguagugucuuuauugucccuuacuucauaacugauuuuggagucuugauaauuauuauuuuguaguuauuuuauuuaacaaaugaauauuaucguaaauaguauaugucagaguucuguaaaugagauucaguguguccagaugauaugucauagcuaguccuaucagaaugacaauaguguuacagugcuucaaccagugcucucaugguccuucucaucaccucucuuccuuuauugcccaaagaaucuugagggcuuuguguuuccuggaacuggaguuacagauacuugcaagcuaccaugugggugcugggaaucaaaccguauuuaggagagcagccagugcucugaaccacugaaccaucucuucagccccuaacccugcuuccaaaugcuuuuuuguuuuauauaggagcuuuuaauccaugaucuuccagauguguaccuuguggcuuuaugauucccauucagaauuuuuuuuuuuuuuuuuuuuuuuuuguagauggugacccuuuuauuuuugcuuuggagaauggguuuagacauuuaacauuuuuauguaucacuuuguauauguuucauauaaaauuaauguagcaauauuguauaaaguuacauauguauuuuuauuuuuuauauaguuguuuaaaagaguuuaguuuucauuaaagagaagcaagacaacuccuuuggaguuaaaugagcaggaaaauguaauuccucagugcaaagucguaagaacugauacaagauaauaaagugaucugggcuuguuuccugcaugaucagacuucacauugcaaagagcaaaacuucugauuuaacagauguagacaggguccaagaaugagcuugucauaaacuccugugugaugcucauguucuaaagagacagagugagaacuauuucugucaaagucauuccuucuuaaccauaguaaauacauucaaaagguuucucucuuucuucugcaucuuccucccaagugcugggauuaaaggcaugcacgaccacugucuggcuccaguauauauucuuucaugaugaugaagccuacagaauugugcaaaggcuucaccauauuaaauacacucacaagguuucugucuuaguguuuccauugcuaggaauagacaucaugaccaagacaacucucauaaaagcaaaccuuuaauuggggcuggcuuacaguuucagagguuuaguccauuuucaucauagcaggaagcauggcagcaugcaagcagucauggugcuggagaaaggcuguaaguucugcauuuugauccaaaggcagccaggaagaaacugucuuccggggagggaauaggagggucuguuuugcacuugguggagcuucaaaguccacccucagauauccacuuccuccaacaaggucacacaucugaauagagccacuccuugugacaagcaaauucaaacucccacauuccacuuacuggccccauaagcuuguuggaguacaggaauguauggggaccauacuuaaacauggcauaauggaaaauacaugugguccaacuucaaaaguccccaucaucuauaccagucucaaaaauguuaaaaguccaaaggucaaagucucuucugagauccauccaaucauguaacuguaauccccaugucucaacuucggagcuugcuuaagguucccccacggcacccaacagcaguacucccagaauaauuuuacauagaauaaauauuaccucucaugauaaguuugauaaaauuuucaguaaccauguuuuuauuuuaucaccugucuguuuugguauaaagaccacuauaauaaauaucccaaaacaugacaguuuuugaaaaacugguagauugagaauugagaaauuaguuuuauuuuguuuucugcuuuuuacuguuuauaacucuuccuugaauaccuucauacuagucaugguucucuagaauaacagaacuuauagaaugaacauauauauauauaugggauuuacuagaacaagcuuuuuauugugugaguguaugucucauuccuuuuuuuuauuguuuuauuuuuuguuuuuuuuuaauugguuauuuauuuacauuucaaauauuguccccuuuccuagucuccccucugaaauucucauuaaguuuuagagaaauacuuaaccuucaagaaucccaaacuaaaucagaauauuuuaaaaaauauucuuugacaaguucaucuugaucauaucuauuucagcugcccuuucucauuuuuccuacucagaaugauacauucuuccuaccuucauaaucucuuuguuuuucacaauaaucuuccaaguccaguuagugacaucagcauacacacaagcuuggggccauccacuggaacaugguaccagggguacgaacaucccuaaagacacuuaacacuuucuucucuggaaaccaucaacugccaauaacuucucuagggguggagccucauagucuaucucucauaagcuggaaugauggcuggcuugaucuuguacagguaacuauagcugcuaugaguucaggaggacaacugugucaugucuagaagacaguucacagcacgucuucucauucuccagcuuuuacauuuuuuuuuaaagauuucuuuauuuauuuuauguaaguacacuguagcugucuuuagacacuccagaagagggugucaaaucucauuguggaugguugugagccaccaugugguugcugggauuugaacucaggaccuuuggaagagcagucagugcucuuaacugcugagccaucucuccagccccagcuuuuacauucuuuacaucccuuuuuuuguauucuuugguggugguaguggugaugugauaagauauccuauuuaacucugaauauucaacagucauuuauucucagaacuuuuacaaguuaugagucucuaaacuaacuguuguccacgaggaaagaaauaucuccaagcaggguugagaaaugcauugaucuauaagcauaaacaaaaauauugaggcaguuugaugacauguccaucuaacaaaacaagcagauucacccauagggccuguaaccuacuuggucauuggcuuuuaacaaguuuaaaaugccagauaugaauaccagauguagaacagcccauauuccaguuuuaaaagcuucuugguuaccccaguaacuuucaugccacauuaccuugaugagcaccuuuugccugggcagguuagcugauaggugagaccauuauugacuuaccuccccccagcacccugcauagagccauauagcaccaugaaagcuagucaagagggaggaagauuccacaucuuuuccaguuugaucucucuguguccugcaaucaaaucauaacaggauuuuuuucaacuauacuagacauuugaaauuauuuagacuuuaauauaugaaauuuaguuuguacaguuuauauauuuaguguucugauauuuggucuuaagaacuugaacucauucaguaugacuauucaguggcauuauucuuacuauuaucugacauuaucucucuauuauacuucuaaauuucagguauauggaaagucuaccaagaaucuaacuaauauauggggagaaagaccuccuauuugaagaguuucauaacagacagaaaauaguauuguacacaauguaccaaacuggauagaaagaaacugcuuuagauagcagguguuucagucuggccacagcagagguuaaaaugaagguguaaauaaacugugguuuaaaaggguuaucugaacuuuuggaaaauuaauguuuacuuuucuuuuaaguuacagaccccugccucauuugcacagaguguucaggagcuaacaauugcucuccagcggacuggagacccagcgaauuugaaccgacuaagaccccauuuggaguuacucgcaaacauugacccuaguccagguaaagcuaagagaaguuaguggacuguguaugugucccucaguacugcuugguucuucaguuaucuuuuguuauguuuccucuaaaguuucccaaaguagcuuuuucagcuuuucuuuggcugcauuuccauuaucccaucuucucauaauaccuuguucuauucauuauucucuuucuuagccuuuucuugggcauuucuuucucaccccuucuugaccugaaaauauaccuaaugaccuguuacuugaacaguauuucagcugcuauccucucagaguucgcuccuacuauggaacugaaucuacauacugcuuacuauaguuuccuagucacuccuuccagauaggacuucugaguccucaaacugcuuuguuuuuauuuguaccacucuaccccaccccauccacacagugcugucuguguccuuggaacuguuucuuuugauucuuagucucaaauguuaccuccauauaaaguagauuccccaagagcucugccagugcuccugucacugcagaccauuuccccagugcuuccugacacucagcaucaucugucuguuucaaagugagcucaucuuugaugccugcucuccuagcuauguuucuuuugucuuguuugcauguucuuucaccuguccuacauaccuuuugagacaugggauuuaucuguuuuucuuucguaauuuccugugacccacuuccuguuuauuccuaaaugauagcuuuaguccuuuccucugagacuuaauguuuucaauuuucucuacucugaugcugucaguucagguuacuauugcuucagaguaaaucaaacuucacauaugccuuuuuaguaaggugucauugcuuauagaauggcucugucuuucagagccucuuaaaguuucaccacuccauguuuacagagcugguccccaauggcucaaucaaaucauucauaccuuuucauguguaugugugugggggggguagcaauuauuuuccccauuuuuauuaauuggcauucugaauaauuuaaaaaagugcuugccaccauauuaguauaucuccuacagcuggcugguagauucucuuacacaacaguagauaaacuguugacagacacucugucccuggacgaguucuccaguucuauagcacugucuuaaauucacucugaucagucauuugucuccaccauucuagucaaaccuauuuugucaaguuuaccaguucaccuccccacaaccugugugugugugugugugugugugugugugugugugugcaagcaauuuaagagaaaaggguuauuucagcucauaguacagucuauuauagcaggcaagucaaggcagcaagagcuugaagcagcuuacauaucacaugcacaaucaggaaacagagagggaugaaugcuacagguuaaguuaguuguuucuguaaaagcuaacauaaucuagauuauccgccacaggugcauaccuagagaccugucucucugcugauucuagggccuuuuaagucagcaucacuaaucaucacagaugaaaaagugucugaaagcuaccaaacaauuaacuugauuacacuaguuuaguacuggauaaaacucugcauaagauuauagguuuuguuuaauuuuuaauuuuauagaugcuccuccuccaacaugggaacagcuagaaaaugggcugguugcuguacguacgguagugcauggauugguugauuauauccagaaccacagcaaaaaaggagcagaucaacaacaggugaggggcuacuauuugaaaucuucagauaagcagcuuuggguauaccuagaaacuggcuacuguagguagaguuacaaagcaaaaaaaaaaaguuaugacuauuuuaagacugacuauaguggcuggagaaaggauccacgguuaagagaacuggcugcuuuuuugagauaacccaguucaaguccaagcaccaacauagugguucacaaccuccuauaacuccaguuccgagggaaucagaugcccuguucuggccuaugguaaacacccaucccuauaaaagaauuuuuaaauugcuuugcuuuaaaaaaagauucugacuauagauacuguacguuugcauagcaguuaguguuuuaauuuuucuuagguaauuuuauguuacauuucagcuugauaaugucacuuuuugauaccaaugaugaaucacuaguacuuuucaaauauuuguagauuuuuuuucuguguaguauuuuaaagaauuucacuaauaauauuuauuauacuaugugccaaaccaucuucuaauuuuaaaaaaauauuguuuucuacuuauuuguauauaugcguagagaugagaggacagccuuauagguccuggaggcuugacagcaucacucacuaaaccaucuuguuggcccaaauuuugugguuuuucuuaggagccagcuuuauguuauaugaacacuaaccaaauauuagaagaguauacauuucaaaagucuuuuugguuuuguuuuuugugagagacaaggucucacauaauccucugguaauccuacugaaugagcauaaagaccauuacccaaauucuuugaucaaauuaggcaagcauuauuuucuauccgucaggacuagcuuccuaaagcaugguuugagaaaauaguaucaaacacaggauauuuauuuauuugggguuuauauuagccccaaaauugcaaggcuaagggguuuucaaggauuuugaguuauguaggaacuuggcagaacauagagaucaaggucuaggguacugaacuccugcugagaguuucugaguguaucugucuugucuagaagacacuguugugcucugguccucccugaccucuggcuucuacagucuuucugccagaccucucauccacgaugagagucucuaagccuuggugaaaguguaugugugcauaugacagagauguccuguuuguaacugagcauuccacagucaccugcacugugaccaagacccacuacccugagaaacuucucugauguggucuauguaguguguguggauguuuuaucugcauguauauacauaugcuugguuccuguggaggccagaagaaggugucuuauuuccuggaacuggaguucuagaugguugugagcugccauaugggcccugggaauugaguccagguccuuuggaagagcagccagugcucuuaaccgugagccccuguuagaacuacuuuuaaauuuuaauuuuggaccuggaaaggucgcucaguaggcagaaguuuuuuugcaagcuaggcauccucuguucaauccuagaaccuagguaaaaguguaaggaaagaaccaacuccacaaaauuguccucugacaacccccaaacuaauaaugaauaauuaaaauuuaauuuugaacucugauuuuccccccucaauaguauugcucugaguaguuuagauaaaugugugaauuagcuuaaguucuucugugcuguaagaauccuaaauggaaaacauaaaaacauuuguuacuguuuuguuuuaugucugauguuuugaucuuggccuuagccuccacagcauagcaaauacaaaacauacaugugucgagauaugaagcaaaggggaggaugcccucguggugccagcuguacguuugcacauucacaggaagaacuggaaaaguaaguaugaaaaccaugaaacacagacuugggaauagggaaugauuuguuggcuuuaagaaacacaguaagaggggcuggugauggagagauggcucagugauuaagagcacuggcuguuuuuccagaaauccgaguucaauucccagcaagugcaugguggcucacaaccaucugaauuuggaucugaugcccucuucuggugcgucugaagacagaaauagcaauagcauauacacauacauaaaauaaaucuuuaaaaauauauauaaaaggaauaauugaauucaacacuuaggaaauauuuaugaauuaguacauuucuuaaaaguuuuuuuuuuaguuuucauuauauuguucuuauaaaugggaagcuauauuuuaucaacuagaugacauuaguuauuuccacacucacaaaaaguucuaguucuuuuuaacaauuuuaauugcuucuuaccaauugugugcuguauuuguaguugaaacauuugcuuuucauacagguuucguaaaaugaacaaacgucugguucccagaagacccuugagugccucuuugggucaacuuaaugaggugggccugccuucagcaccuauacuuucugaugaaagugcaguggacuuguccaacagaaaaccuccugcacucccaaauggaauugcaucgucagggagcacagugacacaacugauuccacgugggacagaccccagcuuugauucuucucugaaaccaguaaagcuagaccaccugagcaguagugcuccgggguccccuccugaccuguacgucuucaaguuucuuccuuguaaacugaguagagggaaagaagaguuugguucuaaccccagugguuccuugguguuauuguuuguucuucuguuuugagucaaagucuguccuuuaacuuauuacuucauagcuaaggaugacuuugaacaucugagccgccugccugcaccuccagguacuggaauggcagacuagcagcaccaugcccaguuaugugugcuagggauuaaaaccaccaacugagcuacauccuggcccagaaaauaaaauguuugccuuuguuuuauuggcuuuuacuuacuuuuucugcacugaugauuuuuuuuuuaaagaaagauuaauuccuuuaaauuuguagaagagauugacauucaaauauauugauuuuccaaguacuggcagucuuuuuauaugaaacauuuaauguauauuaaaaguauauuuuagagacuuuaaacuugucuuguauaauuuugcucccuuaggcuggaaucugccccuaagaguauuucugccuuaccugugaauccacauccuguaccuccaaggggaccaacagaucugccucccaugccugucaccaaaccaauucagaugguaccucgagguucucagcuauauccagcacaacaagcagauguuuauuaucaggauccucgaggaagugccccagcuuuugagacagcaccuuaccagcaggguacugaucuuucauuuauauuuauauguauauguauauuuauauuuauauuuauuuccuuauucugugaugaguaaucauuuacacaggggcuuccuuuagauaagagaauauuuuuaauauuuggaaaacagguuuucaugaucaacuaaauuucuuugccugcuuaaaguuguguaauaaauguauuuuagccacucaaauuuaucauauggauaaaaaaggauaaaauuuauuuauuuuauagaaggauuaacauuuacagagcaaauauacuguguaaagcuaaccuaacucuuuucaagaaugaaaaaaaaaagaaaguaguggauguaaacuaaauuuacaguaugauuuccuuccuuuuaauuauugauauuggccuugaaaaggugcugaauacaagucuuuagagcagugauucucgaucuguucguugugaccccucuagaaaagcuauuuccaaaaacauuacaauucgugacaguagcaaauuaaauaguuaugauguagcaacaaaaauaauguuaugguugagucagcacaacaugaggaacuguguuaaagguuugcagcauuaggaagguugagagccacugcuuuagagguucuguagucuagggucagcuuacuaguaaagugugugugcuuguacaugccuuugaucccagcacucagggggcagaggcagaagccugaucuacauaguuccaggauagccaggacaacuuaguaagacucugucuuacaaucaaauaaagcaaaacaaaagauuaaagggaauacugauauuuauuucaaacuaaaguauugaaucucaucaaaauuagaggcuauuuuuguuuuuuuguuguugcuguuuguuuuuaaugguaauagauuaaaguaucuuuuauuuccuucccuccccccccccuuuagguuacauaugucaucucugcauucaaaaguaguucauuuuuauuguuuuguuauugcuuauuuauugguugguuaguugguuuucugagacagaguugcuugcaguauauauaccaggcuugcuuugaacucacuguagcucagacuggccuugaaugaagaugauccuccugccucacccuccugagugcugaaauugcaggcaucuagcauaagaauagauuuugaugacugauagugguuauaaaagaaucugacuugauuuuuuuuuuuaaucucuugaaaaaauauauauguuuuuguucaggcagccaauguguagcuuuaugcucuaugaggaagaguucaguuacaaaagcagaaaucuuuguagcuauauuaagcaugaaaagauuuaguggagaaauggguucuuuccauguugauggaagcauuagagaugcagacuuaaacuaagucuuuaggaaauguguccuagaaaagcacuacuuugcuagauguagagagcagagauaaaaccuucugccuuaacuggagguuucugggaaauguacugcuagaacucuugucucaaggacucuagagccagagaagucacuagauguauagagcaaagugcugagcguuucauacaguauacuugaacacauuucuagcacugccuccccuuacuaccucccaucccuuucuacacaaguuggaggcugaguguuuuuauuucuuuuucucccaucaaguucaguuuauguugcccagcuaaucuugggagugggaccugcucuggucagccuacaagaggucacaucaguaagaaaaauggacucucccucucccaacaguuaucaaaugcuaauaguuucucagcuagugguaggauugcauauuccuauuuccuccucuaugcuaggauuuuuuuuuccuggcuggaacuugugcauacugucauaauugcuaugaaaaguggcucuuuggcauaucauaucuucuagcucauaauaguuuugaaguugaaacucuauaguagcagggccugaaagaggucuguaauuccagcuacugaggaaccugaggcaggaggaucucaaguucuaggcaugccugggcuacagagugaguucaaggauaguggucuucagaagacccuauuucaaaaugaacuauuuaaaagggggcuaagagggggcuggcgagauggcccaguuguuaagagcgccgacugcucuuccaaaggucccgaguucaaaucccagcaaccacaugguggcucacaaccaucuguaaugaaaucugaugcccucuucuggaguaucugaggacagcuacaguguacuuacagauaauaauaaauaaaucuuuaaagggggggggggcuaagaaccuagccgaguaguggagugcuuguuuaguaugcaugcagucuuggauaugaaaauccacagaguuaaaacuaaaguagaaccugaguuucaaggaugcuugugaaauuuaauuuuuaauuuccaguaagugcauuauauuaagacaaacuagaagaaaggaucagucuacuauuuuugacuauauguauauugauccuuuccauuuauuuucaauaauuauuuguuaauugguagaaaaagagguuuucccugggauugaauuucaggaccuugccaauuccagguaaacacuaagccccacuccaggcccuaaggaaaauauuugcuuucuaauugucacaaagcuauuguaacuauacaaguagugcaaaaguuuaucaaaauuaaguagauuauuaauacuuaagugacuuaauguuuuuggguuugaguuuugguuucuuuguguauccuggcuguucuggaacuugcuauguagaccgggcuugccucaaacuuugguauuugccuggcucugccuccugagugcugggauuaaagauguaugccaccaucgcccagcuguguuuuaauguuuuaaaaggaaaaaaaaagcuuauauagaaaaauagaagagcucauuauuguuuuggguucuucuuuuguguugcacagguauguacuauacuccaccaccaugugugucccgcuuuguccgaccuccaccaucugcuccugaaccugguccuccauacuuggaucauuauucacccuaccuccaagaucgugucauaaacucucaguauggcacacagccacaacaguacccaccuauguacccagcucacuacgauggccgccguguauacccugcucagucuuacacaagagaggagauguuccgggaaagcccuauacccauugacauuccaucugcagcagugccguccuauguaccugaguccagagaacgguaccaacagguagaggguuacuacccgguggcuccucauccagcucagaucagaccuucauaccccaggguaagcuguauuuuuuuucuuaccuagauuuaauuuacuuuuuguauauguauguguaauuggugugugagagcgagcacagguacauguacaccacagcacacuuaggucagaggaaaacucuugagcauaaguuuacuuuccacgcugcuagcugggaucuuucuuguugcuacugcucagaauauuccagguuagcuugucuguaagcuuccagcaucuguuuauuccucccaucccauagccauccugggauuacaugugugcccaugguuuccagagaucagccuuggguugucaggcuugcaagccaagacagugcuuuugcccguugugccaucuucuugguccugaaauuugaaguuauuuuaaaaaacaaaauauaaaucuaaacauucuucguuuguguccuaagacuugaugaguuaggaaauuuggaagaucuugggagaguuuagguugaccuuuuuuuuuucucuuuaauauugauauuucuaaauguuaugauggguauauauucugcgccugaauucauucauucuaucuaucuaucuaucuaucuaucuaucuaucuaucuaucuaucuaucuaucuauaaauaauaugguuaauuaaugugcuuugggauucuuugucaauuuuaaauaaucuuccaauuaccaggauccuccuuauagucggcuuccuccuccccaaccccauccuagucuggaugagcuacaucgaaggcggaaggaaauaauggcccagcuagaggaaagaaaagucaucucuccaccuccuuuugcaccgucaccaacauugccuccugcauuccauccagaggaaguaagcauauuauuuuuaauccugcuuauaguuuaccauuaucacuuuuuguagccuguuuaauaaauuaugagagccaagcagagguagcacacaccuuuagucccaggaagcagagacagguagaucucuugaguuugaggccugucuggucuacagagugaguucuagaacagccagggcuacacagcgauacccugauuuggaaaaaaagagagagaacgagagaaaggaaggaaggaaggaaggaaggaaggaagaaagaaagaaagaaagaaagaaagaaagaaagaaagaaagaaagaaagaaagaaagaaagaaggaaaucuguucccaagaagaugguuaucaaauuucaaaauuaugaggcuauuuucugguuuucuccgagggagucauuguuuuauuacacauuuagauucauaagccauuuaaaauugaguuauuaaaugaacuguuagaaucaaaguccauuuuuccucggcagggauagcucauuggccuuauaccaaggacugauuugagcauccuuuuuucagugucccauagucagcuuuccuauaacugguuaauuaggguaggugugguggccuguaguucuaacacaguaggauacugaagcagaagcaagccuucacugcauauagagacccugucucuauaaaagugauagauagccaacugugauucugaaaucucuccuuucauuggucuauuucugucuuuauaccaguacugcauuuauuuauuuauuuauuuauuuauuuauuuauuuauuuuucuuucuuccuuuuugugugucuugggggugagggugggcauauguggaggugagaggauggcuguuaggauaggagucaguuguuugguuucaaggauccaaacuuagguugucagauuugcacauacuucacuugagcugucugacugaucccucauucaauagaauguucuacuuaaguuggacucguugguauagguucuccuaguauucaauucaaaaauaaauaaacauguugggaucugggaguuuaguuccuuaaauuuuuaaauaauugagacauaaauuaagauguauuuuuaaucuagcaauggagaaaccaguagugugguuuuaaaaagguaggaaagauacacaaauacggguggaugguaaaagucacagggaauguuugguuuauguaccauagugcuguaauucugaccauuacauuuauguuuguauaaaauagugcuaauagauuuguuuugguuugggguuuugugaaacagaaucucacauucuagacuagguuuaccuugaauucacucaagcuggccucagauucagugucuccugccuuagccuuccaagugcuuggauuacagauguggacaacuaugcucagcaaaauauugcuuauagcuauugugaauguuaguuguccuaauuuuuuucauuuccggcacuaauauuuuucacugguuaguuuuucgagggauuuaccaguuauauuuaguuuuaauuagacagccugagcugagacuguagaucaguuggaagaguaauuggguaguaugcacaaaucucuaaguucaaucaauaaugcuuucuuuguaaauugagcaaggaggcaggaggaucaaaaguucuaggucaaccuuggcuacauaacaaguuugaggccaaccugggguacaugaaaccuugucucauacuuuauucauuaguuauacauaaugaaucuaauuggaguauagacuuuguuuuuuaaaucaaaugauauguguaagaaaauguguaacagcugggcaaugguggugcaugccuuuaaucacagcacuugggaggcagaggcagguagauggaucucuaugaauucaaggccagucuggucuauaaauggaauucuagaauagccaggcauauacacagaaacccugucuugaggugggggaaagaaaauuaugaguaaacaauguugccaacugacuacauaugauaagcaugaaaacuggaaagugaaagcuagguguggugauacucuugagcuaccauuucaagacaccauuucaaaaauacaauaaaguugcugggcagugguggugcaugcuuuuaaucccagcacuugggaggcagaggcaggcagaucucugaguuugaggccagccuggucuacagagugaguuccgggacagccagggcuauacaaagaagcccugucucgaaaaaaaaaaacaaauuaaaaaaaauacaauaaagugaagauuauuauacacaauaaauaguaacuuguuuaauguaugaagguaaucuaaacagaaguucauagugccucugucucuuagagugcuaggauuaauauuguucaccgccacaccuggaaagcucuauauuuaagcuuccauucugauuauaagcagccuauauauauaguugcccuaaauucauacauuacaggaauacaugacauagaaauaaugcuuucuucaaauucccauuuucuauaacagccaacaguuuuguuguguauuucaacuuuuuuaugugcaugaacacauuugcuggagugggguggaguuguggauugguuuugguuuugggaaaucuauguuaaagugaauuuauucuuuuuuguagcugcauaauauauaauauucagguagaagagccuacuugcuagauauuaauauauucuaaaaguuagcuguucuacaugagcuaagacuuuuaaaguguuuagcauuauaaaaguauauaaauauuacaauuuaauaaaaaauaauuggcguuggaaugaaauauuguuauuggauaaccacagaacuuuagucaagaagauaaaaaugaggccuuuuauucuuuuacuuaauugaaucaaccuugggccagaauguauuuaggacagggaauacugcugcuaaagaagcgucagcagaguugcugcaucauccccuaccucauaagccgcaugagaugcaaagaugcucucagcuacuguagcuguuacuaaagcacauugagggcggccuagcaaauguacauacagcaugauacagauuuaucuaagacaguggaggaaagugugagcaaacuucuuaagauccuagcuugauuugcugaaggaaguugaaacucaaucaaucaauaucucucucucucucucucucucucucucucucucucucucucucccccuccaucucccuccauccaucccuuccuccuucccucccuuccuuccuuccuuuuuuuuuagcugccauuaacaaauaugaaagcuaaaauaaucuucacauuuuucagucuauaaaaauauguucugaaacuuaauaaucaaauaacuaucacuauauuguuuuaaguugguauucuagacauuccacgcuuuuucugcuuuguuaacucauagacccauuuccuauuuucccccucuauaguuuuuggaugaagacuugaagguagccggaaaauacaaagcaaaugauuauagccaguauucuccuuggucaugugauaccaucggcuccuacauuggaaccaaagaugcaaaacccaaagauguuguggcagcggggaguguggaaaugaugguauguguaauggcuaaacauaauuaauagaaaucuagauacagccgggcgugguggcgcaugccuuuaaucccagcacuugggaggcagaagcagguggauuucugaguucgaggccagccuggucuacaagugaguuccaggacagccagggcuauacagagaaacccugucucgaaaaaaaaaaauaaagaagaagaaaaaaaaauuauagggacaacuaauugagcuuugcuuuuguuucauuuaaauauaaaguauacuauuaucuugacaaagaagaauuuuuauuauauaucauuuuagguaacaauuucccaacaauuaguuguucagaaccuaaguuuauuucaggguuggagaaauggcucaguguuuaagagagcauauugcuauugcagaggacuugaguuuuguucccuguuuccauguugggcaguucacaaccaccuauaauucuggcuccagaugauccagugccuuccuggcuuccaugggcaccuacucaguccauauacccacacugauguacaaagacacauaauugaaauaauguguccagcagugguacuucuagacuuuaaucccagcaccuggguaccaaauacauuaaaacucuucuuacaagucauauguuuaaacaaccaacuugguuaauuuauuugguaaagaaaucuaaaauccuuuuuuaauguauauuuuuuauuauuuuaaaugagaauaugauaguuguguagcuugcaagucaagguuuauuaauuuucccccauagcauuaaaauuuugcaaaaguaguuaaccucacuaaucucauuuuucuccuucacuccucccugucaguaaguaaccucuucccugaguuuagauguuauuacuuagauacacacacacacacacacacacacacacacacacacaccuuuuuucuuuuucuuuuuuuuuuuaaacaaaaaacccacuggguuuuccuguauuguccaggaugaccuugcauaaaguauccuucuugucucaccccauggaguagcugagacucuaggcaagugccacuguacucagcuucugcucuuuccuuuuugagacagcaucucacuaaauuuuggguuggcuuugaaaucacucugcaucgcacagcuaaucucaggcuuguggugcucuugucuuagccuuacuaguagcuacagcuauagauucguguuaacugaucuuuugccauuauguauaauuuuucacuucauuuuuuuuaagguuuuuuuuuuagauuugcuuauauuuauaugugaguguuuugcucacguguauauaaguguucuacauaugugucugguguccucagaaguuaaagagcauuagauagauauccuggaauuagaguuagggauggucaugagcuaccaugagggugcugggauucaaaccugguccuuugcaagaacaagcucucuuaacuucugagcuaucucucuaaccccuguguagagucuccuugugcacauccaugaaaguuuugcuuagacauguauuccuggccaaauggaugauaagcuugaacuauauauuuaaaaaaaaaaaaaaaaggcuggauguggugguguauaccuuuaaucucagcagcaccgggguguggagaggggggcacagagaugguaggugacagagugagacucugucucgaaagaaagaaagaaagaaagaaagaaagaaagaaagaaagaaagaaagaaagaagaaagaaagggaaaggagaggagaggagaaaagaaagagagagaaagagggagggagggaggacaguacagacagacagauuuguguagguuuucauaggugauguuuaccuagcuguuucaagacaaaacuaguucaaguagaugacaguucagaguaagaaagaauaauuaaaugaaaaacaaaccugcaaggggacugggaguaugacagagcaagguccugggcucugcucccagcaucaaguaagguaaaauuaaguugaaacaaaauuuuugaugugcuucagugagcaaaugugugcuucuacaucacaggaagucuuuuagcagaaugaguugaaauagaauaguaauguaagaugcuuucaaaagggguaucacaggcuggagagauggcucagcgguuaaaagcaccaacugcucuucugaagguccugaguucaaaucccagcaaccacaugguggcucacaaccauccauaaugagaucugaugcccucuucugggaugucugaagacagcuacaguguacuuacauauacuaaauaaauauaucuuuaaaaaaagggggggggguaucacacugaaguaacauuaccaaaguaaugcuaauuccuuaaauuaggaaaaauaaaauaaaacuacuaaccuaguauagaugccauuaaaaguuuuuccagauacaugaaagaagccuuaacucagugccucucagcauugacuuauagcucagggguaaagugcuugccugacaaguuaauguucauacauaugacuuaggaauggguagauuuaucaucuacuaucaucugucuguaauuguuggucauauaauucuuacugugaucuaaaaccaauguuuuauaugacauccaaagacagcuaaagacuuauucuuacuaauaagaacaucauacucuuauuaacaaccccuuuacagagcugguagaaauuaugcuaaacauacucucauuuuugcuuuuuguuagaauguagaaaguaaaggaacgagagagcagagguuggaccuucagagaagagcaguggagacgagcgaugaugaccucaucccguuuggagaccgaccaacagucucucgauucggugccaucucucgaacauccaaaacacuguaucagggugcuggcccacugcaagcuauagcaccucagggagcacccacaaaaucuauuaacauuuccgguaagaauccuagagugguaauuaugauucucaauguaauucuaucagugcuuuuaagacuuuuuuuuaaagauuuauuuauugguuauauguaaguacacuguagcugucuucagacacuccagaagagggagucagaucucauuacagaugguugugagccaccaugugguugcugggauuugaacuccggaccuuuggaagagcagucgggugcucuuacccacugagccaucucaccagccugcuuuuaagacucuuaaaggcaauuauuaaacuuuucccuauaagaaagcaauugcacuucaggcaauuuuaggaguauaaacuaaaauuaacucuuucuauauuaagacugcuugaggggcuaagguguaaagcucaguugauagaguguaugccuaauauauaugagacccuguauucaauaccccaaaccacauaaaccagcuauggcacaugccaguaauccuaguacuggagagauggagguagggagaucggaauguucaagugcagcuuugggugcauagggauuucaaggcuauucugggcuaaugauccugucucaagggggggggugcugcuugugacuuuuaucuuaaauaacuucauuauuuauuaaaauaagauucuuggagucugaggaggugacuggcuggauaaagaagaucugaguuuggauccccaguacccacauaaaauguaggcgugcgugcgcguaugcguauguguuguguguguaauccuagugcuuugggaagauaaucugacaccaacccucaccccuacauucaaacacucgugcacacagugaaaagaaaguaugcaaaaccugaagguucaauggggaagaaacaaaugcauugucauuuuggcagacagcuuucugcagagacagauaccgugugccgcugccuucuggaugauagugccuuagaugaaucaaacugguaaaugacaucauaaaccacaguaaacuguuccuuuacagauuacagugcauauggagcucaugguggcuggggagauucuccauacucaccucaugcaaacauaccuccucagggacacuucauugagagguacagccauucuuguucacuuguuauaaauaucugaaacauuuagcuuuccuugcuuuguuuucuagucaguagugauuucacaaaauaaaacuuuauacaaaauuuaccuaaugguuucuuucuuuuuuaccaaagggagaaaauguccauggcagaaguggccagucauggaaaaccccuucuaucugcugaaagagaacaauuacggcuagaauugcagcagcugaaccaucagaucagccagcagacccagcuacgaggacuagagguacagaccuacagauacuuuuuucuugugucaggaauuuugauguagaguaccacuguguagcccacauggcuucagacucaggauccuccuguguggccacauugguacuuacaucgagcuuucaguguucagcacugugcccguuuugugcucuaguucugaagagcucccaagaauguuaaguuggauauaauuuucuuucaucguguauauguauuuuguggggugguaugugcacaugaauacagauguuggaggaucugccuggagcuggaauuauagcaguuguuguaggccuccugacauguaugcugagaacaaaacccagggcaucaacaagagcgguaucugauccuaaccaucaaaacaccucuccagucuccuuaaauaguaaguucugagacacaguaaagcagcacguaauuuuaaagccuuugccuaacguuaguauagauaucccuucuucagaggauucagaacuaaauuuaguucuuggcuaauagaaaaagaauauugucugagaauaaacaguaguggaggaaaaaggaaagaaagccugccucaagaacauugaguuuuuauagaaaaaaauauaggauuuacaucauggaaaauagcaaugagaaagaaagauacacauuuauaauugauuucucuuugaaauaggaaaaaagauuaaauuauuuuuggugcuggaaauaugucuuaccauucuugcagaggauacaaguuugguuccugucuuacaacugccuauaacucaagcuccuggggauccagcucuccuucuggcagccauaggcaucugcauuucuguuuaauguguacaucgcaacauucacacacgccaucucugucucugucucugucucucucucucgaaaauaaaacacaucuuuuaaaacucacucucccuuaaaaauaaaauacaucuuuuaaaauuaaaaccauguuucucaagugcuauuaagacaaaauguguuuauaguuggguuauuuuuacugcaaacuuguggcuaguuuagugguaaaauacuuuggguaaaguguuuucuauguggcaugaggugcgcugaauuaugugugugcuuggcuuugugcacuaggcuguuaguaaccggcugguguuacagagggaggugaacacccuggcaagccagccacagcccccucagcugccuccaaaauggccuggaaugaucucaagugagcagcucagcuuggaacugcaucagguggaaagagaaauugggaagaggacccgggaauugaguauggugagugcugaagguggggaagguggaaugaacucugugacucuagagcugauuccagguaccuugaggaauaaguaauauuuagggugauucuaauaaagaugaguugucaucuggugguauuauuauuuuagguuuguccuuugucaaagacuuuggggaaaacaagggaauuaauuagaaauuuuaaaguuucuguuuaauguacucauuagggaagcagaugggaugguugcucuuuuggacucuguaauauuaagauauguuuacacaauaaaauguuacuuuucauggucuuuuauagaagagauauauagucuguacacuguucucuguacugcuuuuucaugcuaguuugcagcauuuucaaaagguagugagaaaagguggguuguacuguauacuuuaguguauacucucucaucuaccuguuuuuuauuguuaauucuuagugaaguaggaaugacuuuuuguuuuuuuaauccguguugugugaauuuggucuaacccauuacaccacagauuacggacuuuauuuccucuucuuuuaaggagaaccaguguucuguagacaugaaaagcaaacuggguacaagcaagcaagcagaaaauggccagcccgagccccaaaacaagauccgcacugaggaccuuacauugacauucagguaaagaaaggaacaggaacacuucuauagacuuuaaccagagagagagauaacuaucauccuaccguacacaaaguaugaauguuuugauucuuaaaagaucuauuuuuuaaaaaaauaagaaaauaugaauauauucauuggguuuuuuucaagacaggauuucucuauucagcccuggcuaucuuggaacucgcucuguagaccuggcuggccuuuaauucaaggcauauaucaccacugcucagcaggagaaaagaauauauuuuuacuaaaucuagaauuaaaauuuuacuuuaggaguuagaguaggauauagcuacgggcacuggagaggcugagguaggaaaagaggaauuugagguuagucugggcuacaaagugagacuaucaaaacacguguauacacaaaacuuagcacuuuacuggggcucaguacauuuucugauuacauuuucuucucauugcuuuaaguguggucuuaugcuuuugacuuauaaaacauaauauauagcucauuuaaucauuuuuuaaaaaugauuaaaagccaaccuacugcccauuuuauugcuacuguuuuuguuucauuuucaugcugacuauugagcucagacccucacaaauuagcacauauuuuuuaccacuaagcuguauuccaggguuauguuccccccuuucaguuauguacaaaacacuuaaauuugcuaguguuguaggguuagauuaggguuuguuggucguuugagacagggugggauuaggccauccacagucaacguuuuuauuugaucucucccauaauacaguauuuaauucauuuguauauccuuauuuauucucuuuggcauauuugaagauuugaauccuuaguccuguguugaucucuugauuaccuagaacaagaauuuauaauauaaccugacauggugguacaugccuuuauucauagcacuuacuguuugaguuugagguuagccuggucuauguugugaguuucaggauagccaggacuauguagaaauauccuaucucaaaaauuaaaaaaaucaaacagaaaagaauucuaauuguccuguugcugucuucuuggguuuuggcuuguuuguuuguuuguuuguuuguuuuuugagacaggguuucucugaguagcccugguuguccuagaacucacucuguagaccaggcuggccucgaacucagaaauucgccugccucugccucccaagugcugggaucaaaggugugcgccaccaugcccagugacuauuuugaaucuauacgcuugccuagguucaaaauaaaguugguaaauaggagguuggcacuuuuucuuaaauuccagccagcaaauauuuuaagcuacgggucuuuugggauguuaggggcuguaggggggaggagucucacuaccugucccuuccucccaagugcuugucucuaccaugccuguuuguuuuaacucuuaguucaguuuucuaauauguauaugcagguuguguucugcuauaaccuauacguauagaguaggaagcuugucaguuuuaguuuaucaucuaugcuacaguguggaugaggaguuagaaucaauauuuggaagcuauuuauguaguuauuuuuauuuuggcuguuugagacagucucauuguguagcuagccuugguuggccuggaaccaaucuaaccuaaaacugauaaagaccagcugcuucugccuucugcuugaacuaaaggcaugugcucuacuccagccucauguuuuucuacagugcuaaauaauaagcccuauugauuggauuuuauuuagaguaauugcuuuucucuuucuauaaauuccaacuauuuuuucauguaauuuacagugauguaccaaauggaucagccuugacacaagagaaucucagccuccuaucaaacaagaccagcucuuugaaucugucagaagacucugagggaggaggagauaacaaugauucccagagaucaggaguuguuuccaauucugcucccuagaauaugggcaccugcuucuaccuucugcuccuaaucaguucauggggcauagggauagaaaaauggauaacuucuaaacuuuuucucugaguggucagugaaguccaggaaaagcaccggaggcaaugugcacaaacaccacuacuaaacaaaccugcacauaguucacauugaugcauuuuuuuaauuuuaagaaaaaaaaauuagcaguaucugcaagcaauucagauuaaauuuguuuuuguucugugaaugaacuuuauuuuaauaacuuuggacgccuuggauccggggcuuuaaaaaaaaagaagauauuauauauacacucuguuugauuaauuguaugaucuuaaugaaguagguuuuucuuguauuuugguauuauuacauacccaguguauaauuccuuuuccccaguccuuuccaacucucacaacccuguaaacuaaaauagacaaaaaugcaccguuuccaagaauucugugguaauagauuggguuauuagaaacugugcagcaaacuaauuuuauuagagcuauucuuuaaccccagcccuguuucuggaucacuagcucuguggauagauacuuguuuuuuacaacauuaaaaguuuauuugaguggauaugguuuuaguuucaacuuuucagagaugucaacaugcaguugauuguuugagccacauuuuggugucaagcauuccuugcauuaucuccuuaaaaucugaaagccuauuuaguguuuacaauguuuaguuagauuuaaaugaagauuauuuuauuuuaagaaugaacucugaauuggauauaauggcucauuccuguaaucccuggccucaagauguugaggcaggaaaaaacagaauaagaagaaaagaaaugaacuucagcuuguuaauagugaaaauaggcauuuccuguucuccuauguggagcucauguuggaaaauucgagcuguguuuacaaauuaaacuugucuugaaacccuagaauagaaaaaccaggacagugaaccauacucuaaagcugggagccggcucagcagaagagcaccggcugcucucccggguucuuggcagcaccugcagggugucucccaguuccacuuucagggacaugacacccuuuucuggcccuuguggacaccagacacaaugaagaaaauuuuuuaauuaaaauaaaacuuaacacucgauaggagcuucaguaaacaaggacauauuauuucaauggaauuuuuguuuuccuuucaaaagcguuaaagauuuggcagauagaaacugacugagucuucaggguaguucaugcuuuggucacuugucaguaaucagaauuacuagaauaacuauaaauaacuugaagugaguuuuuauagaccuggcuuucugacauuaaaaauguuuaugaaaaaguugaagagugaggaagaauuuuuauuuaguucugcugcacauauucuaaugcuaaccacuguuugcuuaauuuacuaagccccucuaaaaugaguucagcaaggcaauguuucguagaaucacuccaucccucugauugccugacgucaguuucccuuucuagaugaugcuacaaaacaagaaagcacugguuauguaauaaguuacugcauugcuuugguuggguaaaagcaaacguuuauauuuuucuuauuucuauuuccugaacccuuaacucugcugaggucugcgucaccucagucuaagcucuguguccaucaucuuguuaauugaaacaagugggugggggugggauaagagugggaggggugggaagggaaaaauaguccugccauugccuaccaguaggaaauccaaacagaacacucauuugaguagcgauuauuuaauuugcccagucaaggcaccguguuuauauacuauuucacauugaauuugauuaugcccuacagaccuggcuggucaaggauuugauauacacauauuggcuugggauucgagcuuucuuuuuuauuuaaauaaaaauuuauauauauauuauauauauacauauauacauggcuauaucuguauauauaucggguauguuuuaaagauuucuucgcaugagcgcagcuguugcaauaagaugacugauugggagguagaggcaccgaaugacggugaggcauuucucaguugaugcauacauuuuccuuuuaauuuuaaauacacauuuguacauuugcuuuuuuuggacuuuuuuuuuuaagauaaaaugacucuuacauuuauacuuuacucauuauuuauugagaugaggagagaaauguuaugccugacaggauuuuuauuuuucugcauaucuauaaaacgccacauuauuggccucuugccuucaguagacagauuugggugggucuuaccuccuuuggacauuucaagauaauuccuaagucuuagaagcagauggguuuuuguuguuguuguuuuuaaaauuggaauaacuagggggaaaucugcauauugguuuucuuggaguuaagaauaaaaguaaauuuucauuguaguguguaugagacccccaaaauguacucugcugcggugcacuaguauccuuuuagguauauuuuuauuuagggagaaaauuagucuuuuaaaugguaguaugaguuccccaagccccucucuauagccagucuggguuggguagaaagugaaagacugugccuacaauuuugcuauuuagucauuuucccuuaccaauuuuuaggugggguuuuuuggggagcaggggguaggcaguauuguuugugcccacuggcagguuuagggauucaauaaaaacucucauaacuuugagggguuuuucuccccuuaacaaagucaauguuaugagacaacaauaaauugaagcauaacuucaugacucuuaacugcuguuuuuauuaaaauaugaaaaccauugauuuuuauuugugucuuuagagacauuaaaaaaaggaagcccaucaaauaggaagcagagcuucugcaccaccagcccugcccuuuuaagacagucuuagcagauagcccauacugguucugacucgagacccugcgccagccuugugagcgagcacuggaagaaugucaagcaugugccgccaugcucagcauacucagcaauggguauggcuuuucacugaaaugguuucuucugaaggugauuacuuuuuacuguauccaagagcaagaaucaucucagaugaaacagacaauucuggaaggguuaugcagcagcauauucauacuuguucagaaacaacgccaguauguuagcugucgugaauaaaaaguacuuaggcucagucuguuuuccgugagucucuggaacaugauggaggaacugagaaugggguaucuagacucaguuuccuguugauaguaggagucugaaugugaccaaagagccauuccuuacuacuuuucuacuuaaacagaacuuguaccauagguuucugguagugauguucaaaugacgucaauguuuaagacacuauuauuaguaauuacaaauauucaccuacucagaauguguaagagcuuguuuggcacguacggcauuaaugugggucauuccuucucucaucuuccuucccuugugguuuucccauguauuuauucuuuugccuaacagcagaagauggauacaauucucacgugcuacuuggauacaugaucccaucagacucccaugagcuugagugugggagcuugaaauuuaguuccuaaguuucccaugauugucuuuuuucuuuucuuccugaccccuugccauucugcaguuuccccuugacuuacccaaucuguaacagugacaguuugcugcuucuaaacagagcauucaaaugaauucgcuuagccaauaacuucugugaaguugccuuuucuaauggcguuauuacucagugaugcacagaugugguauuugcccuacuggcaggcaagcaaaggucuggcaaagaaugauaaccugcuauuucuuuaaggagcgccaaagacuugugcuuuacucuguuuugguuuuaggggaaauaguagccauuuugauuaugaaaucugguaguauuuguaaguugauuguacuguguaaaugucuaaaguuaacuguuaagguuagcuggccuuacaaaauguaaaaguaaugaaaauuuaucaguuucucuaaaccaguaaauaucacccuugacaauauuuguuuaagcaacucacucucccuuugggggcuuaucuugauguacuacucucuucugugcgucucuguacuuucacuugugccuacaggacaauguacuuucacuauggucaaguccugggucugggaauucuucuugaacuugacgcuugugagaaacaguuaacgguaguuacuuaguaccuguucgacuuaaguucagggacaucuuauuuuuacuaaaugggauucauuugcuauuguuuuuauguacaaaugaugguagaaugaaauuucaauauauuuuucauuugggcuuuuaaagaaucaaguaaagaguucaauauguaaaaucuuuguguaaaaaccauccguaacgauuuauuacauccuaauuuguucucaagaggaaguaaugaccuugcaaauuaacugcaguauuacacuauugcccuauaaaagguucaaguguguuaaacucuuaauuguuaauauaugcuuauaguguugcaaagggaugucaucccugaagauagagcucagauacagcgucacugagacaacgggcagucuacacugacaccauuucaucugaaacauaucgaugucuaccuuagacagcuauggcuuuuuuuuuuuuuuuuaacagcucagcuuuuuaaaauuuccugcugaaaugacuggcugggaguuuuugguaaauugugcuaacauucuuuuuaacguucucaaucagcuuuccugagccacucacuucaaagagcugguuuuguuuuguuuuguucaaaagauacaggaaauaacauuugagauuuuaagauucuauuucuguaauugcuagagguguuuucacaaguaacagauuuuaauuaauuaguaauucuagucacacuaauaaagaauaggaaacugcuacccccaggagcaaaugacaccuucuaauaaguguucucaguagguagguuucaauacuacacugaauaaguggguaaagagcccuuggaaucccauugugauaaagggacuucccuuagcacuggaauuguucuuagagccucuggauuucagacaaacacugaauuucccugaacuuaaccuugagcagaauaaccuucauuuucacaagaaaguaaggcauuguaacccaagguggaaaacuuaaacuuuaagacaauacugugucagaaaaauguguauuuagaagagugaaacccuguggagucuguuguccuaguguauauuauauuauauaguagauaagguggcuuuuuuuuuuuuauuuuuuauugaagacucauucugguucuucauuugguuuuguguuuugucuuuuaaugcuacauauguagacagagcucacaagucuuuggcucccauauuagguuguacacucagagucaucuuauaacuggaaacugucagguggucccagcuccagugaacacaggaaaagucaaggaaaggaugcaagacugggugaauagcgcucugggguuuugguuuuguuuugguccuccuuuuaaaaauugucauuuuuauaauuuauugguguagccucucucucuguucauuggcugacauuucacaguaauauccaaaccaccccauaaaauuguauucuuacaagccuuuaaagcuaugauuccuguuuagcuaagacaguccugagagguuuugggguuuguuuuguuuugguuuguuuuugccucacuuuccccuuacccuuuuuuauccuuugucuucccaacuuucuggauauaaaagaaaaaaaaacuucacuggucuuaggccucaguaaugagucugacuuuccaggagugauacaggaagugaacuaagguaaugagcaaacuucucacccaccuaacugcuuuccaguugugagguuccucuucguguguggucuuuucccuuuuaccccugaaacccuucccugccuauggucaguuggucucacggcucacaccagucuccugagacauucugcacucauuaucaccuuuuuggguggauuuuucuuaguuuuuuuguuuuguuuuuaaaaaauaacuuuaacauugauucauauuugcuugggauagagcuuauguaauuuaccaaucguauugauuguaugugauugugcccugcagagguauacuuaacaugaguaaucuuaaguuaguaaaggagcuaugagauuugagucagaauagagauggcuuuauggggagugugaagucccuucucagaaucagugcuacggaagacccccuuugaaagguuuuccuccauuccuguguuuuuccauugccucggcucccuauuguuuucugacauuuucuccccaccugcucacaagguuuuuuaaauugagucuuaaaauaagagauaacuuuuaacugaaugaauuuugugaaauuuuacauuuuccaaauguuuucaauugaggacaaaggaugggcuggacuuggccagccugugaccaucuccuucccaucuggccuggccaacagugagauuugcauuuagaggcauuaucuucugaaaguuguuuuuguauaggaaaaaaaagaaccuugcuugaaauggaacauucccuuucuuuaaucuguuuaauauuuccguuuuuaaacagcuuucaaaacaaaugagguggggaaaaaagaacuaggaguguguuuagggcugccgaccucuggaucugaacgaguacauggaccauguguugcauauucuugagaagauuaaggccuucucucuuaauuuuguauucuuugugugcauguuguuuauauuaaagauggcacauuuuguuaaaaugcuauuuccuuuauuaccuuggaaacugacucagccucuuguugcuccuaauuaggguuuaaggcucuuguaaguugcagauaaaaggauucauuuuaacaauagaaggaggugguucaccuuuuggauuguaaauauaugaaagugucuaaaggucuuuaucugcuuucugucagcauuuauauuaaaugauaaauuaaugaggaggaacaguguguagucuuuuucuugucaaugagucugccaccucguucucgucuugggauuguugaua

SEQ ID NO: 456 - RNA, 778 nt, Mus musculus
ugaaagccuuuaaguaagcaaguuucagggcuacagagaguaauccugucuugaaaaaccauaaacaagaaccacaggcagugguggcacaugcuaaucccagcacuuaggaggcagaggcaggcggauuugaguucaaggccagucuggucuacagagugaguuccaggacagucagggcuacacagaaaaacccugucucgaaaacaggcaaacaaaaaaaaaccauaaaaaagagcccaugccaggaaaacugucuugaaaagccauaagaaagcaaauaauucugugccaggcccagucuuccagcaacagcaggucaggauguagaacucucagcuacuucuauaucaugucuguguuugccaccaugcuuacagcuaaaacuauaaaccagcaccaacuaaaugcuuuauaaagaguugcuuugguuguggugucuccucacagcaauagaacagugguuaggacagcugcauuucaguccuguuuuacaguauuucaaaucacauaucugccacaaauguaaccucaugauucuggcaacaagagaucugugagacagccaggacaagugucauucacauuauauaagcagcuggggcagcuaagagacauuuguagcuugcuuaagguacaacacaauagaauucuguuacuuguaauuuuuuuuuuugauccuacuauacuacuuagaacauuauauugauggcugaaagauuaccacaaaguuuaauuuaugguucuaaugaggcuagaugaacugaaaccuugcugc

SEQ ID NO: 457 - RNA, 4979 nt, Mus musculus
ugauuuugaaaacuguguuaacaauaaagggcugguaauuagaguuugaugaaaauucuuuuaaaucauagacugauuguuccaaagugcagcuugcugucauacuuagcagauguggaggggcucaggagucaggcugcccauguugguugguaucuugcauccaucauuacugguuccuugagccaaguuucuuagcaucucugagaguuuccuuuccuguaagaugaggauuauaauaacucugaugcuagaagguuugcaaaauuuaaugaguuuacuagguagaacacugagugccuggcucuugguaaucauucaguacuugauaguguuucugaucugcugcauaagagagucuggaauaacauacagauguaccuugacuuaugaugaagaggugaccucguagacccauuauaaaguacuguaaguggaagcauacacuuaacauagcuugccugcucaucacagcuuagcaaugcuguaaaggagagagcaguuuauuccugugguuacaggugccugggagcuguugcccauuauugccguucaucaucaugacagaguauuggaacacauauuccuagccuugggaaagacugagcaucaaaguuucaagugcauuuuaaaacuccugucaagccaccccaaggcaguuugaccuggccauuuuuacucuuugucaggguacacgcucuuacacugcgcugcagccuggggccgucuggaaacuuugaaggcccugguggaacuggauguugacauagaggcuuugaacuuccggggagagaaagcucgggauguugcugcucguuauucucagguugaauguguuaauuuucuggacugggcagguaaggaacacacaugguaugaagaugauugaggccauggaaugauaggagugacauuucugccuuccagcuagaugauguauuuucuauugucaauaguauauaaagauugccuucauuuuuucuuuucucuuuuacuuugcuauugaccauaaaacauuccucuucauuguaauucucucucccucccucccucucuuucucuuucucucucuguauguguauauauauauguaucucguugauuuaccaauuucuaacaauuuaagcaacaaauuuccaucggacucuacauacaacauauguucaagguuguuuucugaaagacccaagcaaaguacacuauuccuuacauguuuaaauauuacuauauuucagcaauauauuugaucccccagaaagaaaauuuguuauugaaaauuaaaaauauuuuccuaggagaaauuaaccuaagguauuaauagccugaaucauaauuacccgauagcauggcaggacuucugagccccgucauuuuucucucaguuuggcugcugguugcauggguacuuuguuuaugaaaguucauugaggugaaugaacacuuaaaaguuuuuaugucuuuuaugaauauuguauuucgagaaacauaugugcuaccuugacauuuugcucucguuccccagaucuguagaauauagccugaggagacuuuaggaauauguaacugaguaacuugcugugugugcuuauagaauuuaaaauuaaaccauuuuguauggcuaucugcucauugcugugcuuagcaggcuuuuauggaaugcccacuacugaccaugcuaauauuauuguaggcauggcauccagcaaugguuguuucuuccuucuggacauuuuuuuuaaggagaagcaagcaucuagaaaccaguugguaauuauccaacaguaucagaaagaugugacuauuaagagaaagggugaagguaauaauuggcaggaaagcaguucaugcccugggauagucagagaaaggacgaaagcuuauugggguucaccugggccuugcacaaugaacagcauuugaauacacaguagcagagcaaagagcacaaggaaaacauuaagucugagaaugaaaggaacgugugagggaacagugacaagauccucucacuggaacccaugccagcgcuuccguaaggaaggaaggguaagcacagggucucuggaggaugccuggguuugaauacuauauaagcuugagcagaggacuucaauuauuuguacccugguuuccuuuucugacaaaaggggccaauaauagcuccuuccucuugagacuugugaaaacuaaacgauacaguacaaagcacacggcgacuaccuguuauguggucagauugaaaaaaaaaugcgguugcuauaauuaccacuagauuacacccugaaguuccaguuaagguguucucaguuuauucugggagccacguuagaaagaguggauucguuuucaguugagcggaaacccagagcucgucugagaauuuuucuguaaugauuguggcaaaaaaaaaaaaaaaaaaaaaagcaagcccccaaagaaaccuuuguguccucagacagucccugcaauagauuucuuuuauacuccgcacuugaccaagcuacauuugcacgagcuuuuguccucuccgcacuugaccaagcuacauuugcacgagcuuagggauagcagugaucuucugcuccucuucucccuuacucuucuucuuccuuaauuuacguuguugcuuagcuuucuugacagaagaguggugagacacgugcuucaggaacuuggucaucauugauguuguggccaguagucugcagaggauuuguucaaugucauggauggaugggcucaggucuaggccauuagcguguuucucuaaggaagcuugcuuuuucagcugaaagagcaaaacaaaugauuacgcuuacauucuggagccaaacaccacuaagauguacacaucacauauuuaugcaaaaaagagggagguuacuauagauggcucaaguacagaagagaugcucuuuaauuuacaacacaagacuagacuggaucaccgucaucacggccaaacauugguuagcauugucuaagguuagagagcauuuugccaagagaagcuaggguguaaacaacauguuuuccuuuaggauguggagaaauucagucaggauggacagaugucuucccugcuggcuagcucucacaguauuagagagugccgcccugguccuccugagcugugaacccagugaaccacucaugaacuuaacagcacuugugaucgucuguacacggacuguacaagauccagucaguuuucuguuagcauggagagggaagggguucauaagccuuuaccccuaaaaggaguaguuuugcacaguugaccacuucaggggaaggggaaguuaauuuucuuuaagucuaugguuccuggcagguuaacugaauaaaagcucucagccauaccgggagcacaaaaugggcccuuaagacugaaguuagcgguuggggguagagcucagugaguugcaaagaacuugccuacuauguaggaggcccuggguuugagucccagaaccaaaugcaugaaugaauaaguaaauaaauaaauaaaugaaaaaaaaaauucucuuacuaagcaacaucacuguauaauaaguacauauuaaaaaaaacaaacaagaaaacaucuauauaucugauggucaaggagauguguuugcucacguguuuaguggaguucuuuuuuguuguugguuuuuuuuuuuuuuuuuuuuuuugguuucuugagacaggguuucucuguguagcccuggcuguccuggaacucacuuuguagaccaggcuggccucgaacucagaaauccaccugucucugccuaccaagugcugggauuaaaggugugcgccaccacugcccggcuagcaguucuuaauugucucaaauuauagcacugucuauuggcaaaauuuggaauuaagugcccuguuucccaccaaguccuaacaucuaaaaucaguuuacagccugcuuggaaagcucacgcuaccuuuuguagugagcucucuuugguagacucacagguucucuaggaaaccccuuguuucagaucauuuuaugggaaagcugagaagagcacuuaauuuaccucacuccuauaagccugccuacugcaucuuaauguuuuauugugcuuuguaacuugaaguaggaguugagaugauuuuaaggaccgugugacuaaacauuccucuguggcauucuuagccaugcccacguccuguccugcuagguaaugguggugagguggguggggagcaggggagauggacagcuuuaaggaucuggauaaccuugggcuauccacucuuugagauucuauaaauccuauuugcaucacaaauucaccuuuuuuuggugucuuguccauuucauccauagguaaugcacagauaaagcaaacaggauuaagcagagagcuuguacuaagauguaagugagguguaaggcgcucuguaagagguccauguuagcaaaauugcagcagaguguguccagaggauaagguaggcagcuggaugggggggccuuaacuuucagguagugcacuuccucuggaaaaaucucccauccgaccuuuguccacguugucccgucacaaauggagaaagucucucugaagaagcagaagagcagaaggggagaaagcacagacagucuuuggguagacaucuuuuuuuuuuuuuuuuuuuuuugucuuaacugagaagaaaaucuugugcuaaaaaauuggucagacagagcaaaagaugccucaaucacuaaagaggcacuccugucaaagccuuucagauaguccugccagucagccccucauagccagcaaaauacacaaagauggccauuguuacaucgucagucauagugacucaggugauuucagugacaucauuaaaaaaaugcacugggaugaacagguguacccagcuaaucacccagguuucuugaaaaugaacuauuugcuauuuggccagaguguguuuaacaguagguaugcagucauaauaaugaaaccgcaaug

SEQ ID NO: 458 - RNA, 4979 nt, Mus musculus
cauugcgguuucauuauuaugacugcauaccuacuguuaaacacacucuggccaaauagcaaauaguucauuuucaagaaaccugggugauuagcuggguacaccuguucaucccagugcauuuuuuuaaugaugucacugaaaucaccugagucacuaugacugacgauguaacaauggccaucuuuguguauuuugcuggcuaugaggggcugacuggcaggacuaucugaaaggcuuugacaggagugccucuuuagugauugaggcaucuuuugcucugucugaccaauuuuuuagcacaagauuuucuucucaguuaagacaaaaaaaaaaaaaaaaaaaaaagaugucuacccaaagacugucugugcuuucuccccuucugcucuucugcuucuucagagagacuuucuccauuugugacgggacaacguggacaaaggucggaugggagauuuuuccagaggaagugcacuaccugaaaguuaaggcccccccauccagcugccuaccuuauccucuggacacacucugcugcaauuuugcuaacauggaccucuuacagagcgccuuacaccucacuuacaucuuaguacaagcucucugcuuaauccuguuugcuuuaucugugcauuaccuauggaugaaauggacaagacaccaaaaaaaggugaauuugugaugcaaauaggauuuauagaaucucaaagaguggauagcccaagguuauccagauccuuaaagcuguccaucuccccugcuccccacccaccucaccaccauuaccuagcaggacaggacgugggcauggcuaagaaugccacagaggaauguuuagucacacgguccuuaaaaucaucucaacuccuacuucaaguuacaaagcacaauaaaacauuaagaugcaguaggcaggcuuauaggagugagguaaauuaagugcucuucucagcuuucccauaaaaugaucugaaacaagggguuuccuagagaaccugugagucuaccaaagagagcucacuacaaaagguagcgugagcuuuccaagcaggcuguaaacugauuuuagauguuaggacuuggugggaaacagggcacuuaauuccaaauuuugccaauagacagugcuauaauuugagacaauuaagaacugcuagccgggcagugguggcgcacaccuuuaaucccagcacuugguaggcagagacagguggauuucugaguucgaggccagccuggucuacaaagugaguuccaggacagccagggcuacacagagaaacccugucucaagaaaccaaaaaaaaaaaaaaaaaaaaaaaccaacaacaaaaaagaacuccacuaaacacgugagcaaacacaucuccuugaccaucagauauauagauguuuucuuguuuguuuuuuuuaauauguacuuauuauacagugauguugcuuaguaagagaauuuuuuuuuucauuuauuuauuuauuuacuuauucauucaugcauuugguucugggacucaaacccagggccuccuacauaguaggcaaguucuuugcaacucacugagcucuacccccaaccgcuaacuucagucuuaagggcccauuuugugcucccgguauggcugagagcuuuuauucaguuaaccugccaggaaccauagacuuaaagaaaauuaacuuccccuuccccugaaguggucaacugugcaaaacuacuccuuuuagggguaaaggcuuaugaaccccuucccucuccaugcuaacagaaaacugacuggaucuuguacaguccguguacagacgaucacaagugcuguuaaguucaugagugguucacuggguucacagcucaggaggaccagggcggcacucucuaauacugugagagcuagccagcagggaagacaucuguccauccugacugaauuucuccacauccuaaaggaaaacauguuguuuacacccuagcuucucuuggcaaaaugcucucuaaccuuagacaaugcuaaccaauguuuggccgugaugacggugauccagucuagucuuguguuguaaauuaaagagcaucucuucuguacuugagccaucuauaguaaccucccucuuuuuugcauaaauaugugauguguacaucuuagugguguuuggcuccagaauguaagcguaaucauuuguuuugcucuuucagcugaaaaagcaagcuuccuuagagaaacacgcuaauggccuagaccugagcccauccauccaugacauugaacaaauccucugcagacuacuggccacaacaucaaugaugaccaaguuccugaagcacgugucucaccacucuucugucaagaaagcuaagcaacaacguaaauuaaggaagaagaagaguaagggagaagaggagcagaagaucacugcuaucccuaagcucgugcaaauguagcuuggucaagugcggagaggacaaaagcucgugcaaauguagcuuggucaagugcggaguauaaaagaaaucuauugcagggacugucugaggacacaaagguuucuuugggggcuugcuuuuuuuuuuuuuuuuuuuuuugccacaaucauuacagaaaaauucucagacgagcucuggguuuccgcucaacugaaaacgaauccacucuuucuaacguggcucccagaauaaacugagaacaccuuaacuggaacuucaggguguaaucuagugguaauuauagcaaccgcauuuuuuuuucaaucugaccacauaacagguagucgccgugugcuuuguacuguaucguuuaguuuucacaagucucaagaggaaggagcuauuauuggccccuuuugucagaaaaggaaaccaggguacaaauaauugaaguccucugcucaagcuuauauaguauucaaacccaggcauccuccagagacccugugcuuacccuuccuuccuuacggaagcgcuggcauggguuccagugagaggaucuugucacuguucccucacacguuccuuucauucucagacuuaauguuuuccuugugcucuuugcucugcuacuguguauucaaaugcuguucauugugcaaggcccaggugaaccccaauaagcuuucguccuuucucugacuaucccagggcaugaacugcuuuccugccaauuauuaccuucacccuuucucuuaauagucacaucuuucugauacuguuggauaauuaccaacugguuucuagaugcuugcuucuccuuaaaaaaaauguccagaaggaagaaacaaccauugcuggaugccaugccuacaauaauauuagcauggucaguagugggcauuccauaaaagccugcuaagcacagcaaugagcagauagccauacaaaaugguuuaauuuuaaauucuauaagcacacacagcaaguuacucaguuacauauuccuaaagucuccucaggcuauauucuacagaucuggggaacgagagcaaaaugucaagguagcacauauguuucucgaaauacaauauucauaaaagacauaaaaacuuuuaaguguucauucaccucaaugaacuuucauaaacaaaguacccaugcaaccagcagccaaacugagagaaaaaugacggggcucagaaguccugccaugcuaucggguaauuaugauucaggcuauuaauaccuuagguuaauuucuccuaggaaaauauuuuuaauuuucaauaacaaauuuucuuucugggggaucaaauauauugcugaaauauaguaauauuuaaacauguaaggaauaguguacuuugcuugggucuuucagaaaacaaccuugaacauauguuguauguagaguccgauggaaauuuguugcuuaaauuguuagaaauugguaaaucaacgagauacauauauauauacacauacagagagagaaagagaaagagagggagggagggagagagaauuacaaugaagaggaauguuuuauggucaauagcaaaguaaaagagaaaagaaaaaaugaaggcaaucuuuauauacuauugacaauagaaaauacaucaucuagcuggaaggcagaaaugucacuccuaucauuccauggccucaaucaucuucauaccauguguguuccuuaccugcccaguccagaaaauuaacacauucaaccugagaauaacgagcagcaacaucccgagcuuucucuccccggaaguucaaagccucuaugucaacauccaguuccaccagggccuucaaaguuuccagacggccccaggcugcagcgcaguguaagagcguguacccugacaaagaguaaaaauggccaggucaaacugccuugggguggcuugacaggaguuuuaaaaugcacuugaaacuuugaugcucagucuuucccaaggcuaggaauauguguuccaauacucugucaugaugaugaacggcaauaaugggcaacagcucccaggcaccuguaaccacaggaauaaacugcucucuccuuuacagcauugcuaagcugugaugagcaggcaagcuauguuaaguguaugcuuccacuuacaguacuuuauaaugggucuacgaggucaccucuucaucauaagucaagguacaucuguauguuauuccagacucucuuaugcagcagaucagaaacacuaucaaguacugaaugauuaccaagagccaggcacucaguguucuaccuaguaaacucauuaaauuuugcaaaccuucuagcaucagaguuauuauaauccucaucuuacaggaaaggaaacucucagagaugcuaagaaacuuggcucaaggaaccaguaaugauggaugcaagauaccaaccaacaugggcagccugacuccugagccccuccacaucugcuaaguaugacagcaagcugcacuuuggaacaaucagucuaugauuuaaaagaauuuucaucaaacucuaauuaccagcccuuuauuguuaacacaguuuucaaaauca

SEQ ID NO: 459 - RNA, 2253 nt, Mus musculus
uaugaugaugauagaggacuuuaagaaggacauaaauaacucccuuaaagaaauacaagagagcuuuggcuuccguagacgaggucgggcggaccuucguccgggguuucggcacccccccuuccccuuccccgggguccgggggugacauugcaccgcgccccuccugggguugcguccucgccccacgcggacucccccucggcgcgcagcucccuuucgccuuccuuggccgggguucccucccuuccccagcugcccagucaugggggcugcuguguuuuucggaugcaccuucgucgcguucggcccagccuucucccuuuuccugaucacuguagcuggagacccacuucggguuaucauccugguggcgggagccuuuuucuggcuggucucccugcucuuggcuucuguggucugguucaucuugguccaugugacagaccgaucagaugcacggcuccaguauggccuccugauuuuuggugcugcugucucuguccuucuacaggaaguguuccguuuugcuuacuacaagcuccuuaagaaggcagaugagggcuuagcaucacugagugaggacggaagaucacccaucuccauccgacagauggccuauggagaggcggucuggagggagaguagguaugguagacuuuucccugggcuuggggaguagguacugcuaaugaagcuguggugguccuggucguugacaagacccucccuccccccaguuucuggucuguccuucgguaucaucaguggugucuucucuguuaucaauauuuuggcugaugcacuugggccaggugugguugggauccauggagacucacccuauuacuuccugacuucagccuuucugacagcagccauuauccugcuccacaccuuuuggggaguuguguucuuugaugccugugagaggagacgguacugggcuuugggccugguaguugggagucaccuucugacaucgggacugacauuccugaaccccugguaugaggcuagccugcugcccaucuaugcagucaccguuuccauggggcucugggcguucaucacagccggaggcucccuccgaaguauccagcgcagccuuucguguaaggacugacuaccuggacugaucgcccgacagaucccaucugccuauccacugcccaugacugaacccagccccagcccggguccacugcccucauccuccgucuccucgcugaugugccccgcuuccuuccggguuuggcguuguccauuugugaccuguagucucuaagcuuucucaggagcagccugggugcagccagucagggacugguggguuugaaucugcaucucuccccaccaccuggggacccccuuguuguccaggucuccccaugugucagugcuccacccucacccugcccaugacucaccccgcuuccccucugcaggccgccggcaggaggacagucgggugaugguguacucugcccugcgcaucccacccgaggacugagggaacaugggggggccccugggccuggggugcccucccgaucuccucgucccguauuucuccaucuccaguucuggacagugcagguugccaagaaaagggaccuagcuuagccauggcccuggagaugaaguuacugaggcugaggguagauggguucaguucagugucuccugcccagacuggacaucuuggucuuuuucucaggucugaaaggaaccauuuuuugguaugauaaagaccccaaaaugccuuuuuuuuaaaguggggagagggaggagguacgccgggagccucuuuaaccuccauaggcuguguuugcucccaaaucugcugaugguggcucauuucuauccuguuuucccuuuggucccaggcccugggggaaaggaaggaagugcaugcuuggggacuggucccacuggaucucuauccuaacguccauggccgucagcaccccuccuuuccccaaggugaaauggagggugcuguggggcccugcccacuccauggcagugcccugaaggagucagacuaccauggcaucgcaggcccagagggcagacauuuuuucuaguuuuuaauuggggugugggaggguuuggggagguuuucuaucacuguguuguuuuucugcugaggguggaauauucuguccuuuuaaucaaggugauugugauuuugacuaauaaaaaggacuuuauaaaaaaaaaaaaaaaaaaagaaauacaagagaacac

SEQ ID NO: 460 - RNA, 61041 nt, Mus musculus
aaugacaaagcuagucagucugaaggugagaagugaaaguguaaaacucgagaaccaaacccgcgaguucuacggaggaaaaaaaaaaaaggcggguucgggcaggaggacuacaagccccagauacccgugcgcggaggcggcgcgugccagcgagagugggcaggccauugaaaggcggaagaccgaggguuacaggacuuccuguucgagcgccagcgagugggugggaccugcgcagguugggcggcgguuguggcguuuuggagcuuugucagcggagggggcguggcccgcgcugugacuuguggagcgcgagccgagagggacgugggugacgcgucuccuuccacccagcucaguggagugcgaggugcgcuggcccggccggggauuggcugcugagaggcgaguacgcggcggccguuggucgccggcagcacggagcgagggcccgggcgggcggggcggggauggggaggcaguggcggcgaaggccggaggaggcgggcgcgggcgagcgggcagacagagcggcggcggcggcagucucccgagcgcuccugugaagcgucccuauucccguugccgugggccucucggggaggccauccgggacgcgagccgcugcggaaccgcuccccaagccccacugcucuucggacucucggucccauccucgcguuucugcuccggcuccuccaucuuggccucgacaguggcugcuguggggaggaugugccgccuccuggcagggggaagaaggaggagaagaugaagaaguaccggcgggccuuggcccuggucuccugccucucucucugcucucuagucuggugaguaaggggccggccucuggggacuucccguggggaugaaagagggaguaggucgggucacacccccaaaucaucucggcuuuuuggguugcuuggugcuccugcuccuaagccagggacacagcggccacccagcucuuccucuugugguuuacgaguuguguuuuggaauuugcagaguuccagcagggagagaaggggauauuggggaucacuuuuugccuuuguacucggguaccccaucaccgcaguuagggcaguuuggguaguguucagaaagcuagugagugaguuacucaguuuugcugucaguucauuugcuuucguuaugagguaagggcaggggcgagucaggugugauguguuccggaccugugauuuugaaaacgugagucgucaugaggguaagaguaaugucuaaacuguuguucuucuggucaggucuugcacaaucuugaccaauaguacuuuuggggcugcuccuugaaacccugcggcguggggcgggcgggaucccugaugaagcccuuuuucgguuagccuggugggagaggauuaucacagauguggagucagccauaguuuuggggcauguucuuuggcacuagaaaggaaacgguuuuugcgacccgcucugucccuuucucugaaguucuauggaguucaaguuaauuucaagcacaucucuggauguccaggagcagacauagcuuaugaaccaaaggauugcuaaagguguacuuggaaaagccauucuuucugaaggaauucccaaagagccuugagacuuggugacugaaagugauggccuuuguguuaaagagauuuugcuucuuauacuaaaaucuaaacacacuuucuuauuuaccuuaugucuucaaagcgccaguaauaauucccuuuuuuuuauggguguaauggaauccagaggugcucaaguuguagaguuguugcucacauagaauaauauauuaauaugggcucaagaaaacacuugucugagaaaaucugacuggaaagacuguauuucuugucauucugaauccuuuaaauacuccuuaagagaaacugguaccugaaaccaguguaggauuagguagcaauuucuuagaguuggugagcuucucuuacuagccuuuucuccccucauucagaaauuaucuccagauuuuguuacccacuucucuuuuguagauugaguauucuauguucauauaauaaucaguucuagggucuacccaggacuuacucuauuacuauuacugcaguuuaguuugaucuuauacugucauaguugauagauugugugugauacagccuucugccuuuucucuuuuccugccuagagugcuauagauuuaccuuaacagaaaaccaaaaugcauccuaucuauucauucugguugcuauuuuuuucuuuugcacacugcuaaucacaauucuugguuaaguaguacaguguauucuagguguaauuguaguguagcuacagaagaacagugauagcuaauauuuauuguuaucuguaccaagcauguggcauguguacguuuuagcaucuuugucagcaagguccucuuagguagauauuauuaguugaauucuguauuuuacagaugaauaaauagagaggcuaaaguuaugcuugcaacagaguaacauggcuaagcagcuacugcauucuaaaauuuagauuugaaccuaagcagcuuguaauacaggcuccucacuacagugguccucugacugacuauagguuaaauaaggccuguguuuuuagacagauacaguaccaucacuuacuagauauguguacuuggacaugcuauauaauuccuuugaacuuuaguuuuuagagccucaguaugauaaaauugauccauucauaccaaaguuauuagaagcaaaugagauaacacaugcacuuuguaaaacaguaagagcaugcugucuuucauuauaaaagcauucaaagguguuuuucuuauguuuacuguguauugaauauugugaaucuugaaagcuugagugaguggccucucucguuuuuaguacugaaacuaucucaacuaagaagccuccuuguaagcuccuacugcugcuauaacaaauuaccagaaauccacuggcguacacauaguuguuuuauaguuguaggguguguguacaggaguccaaaaucagucucacuggggcaaguauuaagguggcauggcugcuucauucuggagacccugagggggagacuccaguucuuugacuuuuucagcuucuagguguugcauagauucucucuccugucucucaucacuucaaccucucauuuuggccuucaacaucugcuuaugacggcccuugucuuccuccuucaaggacuuauuauauuguguuuacccuuagucaauauccaugucucuuaguuugcugaagucuucaaaguuuuaugauauaauauacacuauucagaagcugaaggugcagaacucucucagucauugacagaggggaguugaucaucacacugaaguggacgaugugauccaaaccuuugaacaguuauucugaguauguucccuaguaguaaaacuuggugcaugugccuuuaaaaugugucuaauuauuuguaauuuaucuacauguaucaauauggcaucaguauuguacauauaauuaccaaaguuaguuguuuaagaaagauaaaaaauacuuuguuaauauuaccauuuguuuucauuaaaguaauuuucagugagaacuguuuaauuuaagagauuauuuuauaucaaauguagauaaaugguuuauaaugguuacucuucuuagccuuacuauuuuguuacugguuuaugcuuguacuauuaucuuuguuagcuuuucuguuuguuuguuuguuuuaaaauacauguaguaaguuguuuaguuaaagcagagcaaucccuccaucuuagauggacauguauagaaacccagugagucaugguaugccggagguaaaccagagcuuuacucuuccuuuacauaucugccuuuaguucuuaauaugucugcagcuaaccccuaagaaccagaacucuuuacauuaaucuaaaaaaggcuaauuuuuaaaaauaguaacagauuuuuuucugugacucaaaggaugagcuuagaggagcuaauauuuagacuaaaaccuugacguuaaaaaacuuugauauauuuaacauacaauaaagguacuuaaaaggacaugaggugaaucuaaugaaggguuuguauuuuagagucuuuccuguccuccauucaucaaucauaugccuuuggguuguuauuucugugaacauuaguucucaucuauuaaugguuucuagggugaauagaauagucaaggugggagacuuguguuacaagcagagggaacauucuugugggguuuucuggaguguuuaguaaggguggagaagacuugaaaaggauagaguuuugaagaaaauuauugcccaggcgaacucugaguuuagcaggauagaagaugagcgagugaaauagguuaaauaagaaggaaagaggcagccauauugauauuuuaauuagauuacuaucaaagauagaauggacugccugacagauucuggaggugguaggucauggucauaaguggagggaggugcaguaggggagcacugggagcuguguaaaucaagauggugauguuuuuugaccuuagucuaguuuuuauagauggaagagauuuuucccuccuugaguugugauuucuguauucuuuguuuuuuccucugauaauuuuuccagcuuuuuuaaaaauuuuaucuaccuaccuaucuaucuaucuaucuaucuaucuaccuaccuaccuaccuaccuaccuaucuaauauaaguacaucguagcugucaucagaaauaacggaagaaggcaucagaucccauuacagaugguugugagccaccacaugguugcugggaauugaacgcaggaccucuggaagaaaaaagucagugcuuuuaacugcugagccaucucucuagccccuagcuucuuuuguuaauuaauauaugagcagaaaaacaagaagcaaacuauauaagaaacugcuuucuuuuuauauggaauugucgaaaauuccuauucugucuuuuaccuggaaaauguuuguguguguguguguuuacugcuucuguagagacuuuuuaaaaagucucugagucuauuuucugaauaaaaugauauucaaaauaaauaaugaaauaaucaugcucuccacaucauuugaugacuuuuguuguuguuggaacuuaauaugaagagacuggaaagaauucagauuugcugagauauuuauucaaaggauagcaucuggugccuggaaggaguauagauagggucauuaugaauagugccagaucccuucacauaaguugggugaacuaggcugcuuuagugugaagagauccuugaaagaaggugccuucucuuuaugaaaaucugugaugucugucuauacaccaagaggcagaugauucuuuauaauagucuuugaauuauuuuaggaacuggagauguggcucauguugccuuuuaauguuuaauacauuugaagauguuuuagaaugcaaguaaaaauagacuuagcagacaauaaaaaaaagaaucagauauuaacaguuagcucucuuugagcacuauuaucucauaauuuuguuguuugugacuaguacauuuccacuucucucaaucugagcagagaaauaaauauguauaguuaacuuuacacuucuaaugaaaagaaacuuuaaaaaguauuuaauugcuuuuuuugucucucaggucauuuucagcuaugaacauuuuauacacacacacacacacacacacacacacacauacauacacauacauccauauauacacacacaaacacauauacauacauacacacacauaugcuauauacaccccuguuuaauaguuuguguauauaugugaauaaauaaaacacccuacuugagccaggcaugguggcgaaugccuuuaaucccagcacucaggaggcagaggcaggcggauuucugaguucgaggccagccuggucuacaaagugaguuccaggacagccagggcuacacagagaaacccugucuugaaaaaccaaaccaaaccaaaccaaacaaacagacaaaaacacccuaauugaaauaaugauuuauggauuucagauuuuucuuuagugccagcuauaaaacacauuuuuuacuugcauucccuguuuuguuuuucaagaccauauaaaguauuuucacaagguauaauuucauaugucacaagggaaugggaaauugcuuuugaguauuuggauaucccuugggauauacuuauuuuauaaauugagugcuuuugaauuuuuuuuaagauuuguuugcuuuugaaggacuuguuuuccuuccuuuuuugaauauuggauauagaaccuagggcuucccaaaugcuagacaaguauucuacuaugagcuacacucuaaauucagaacauuucuuguuuugagacuggguuucucuguguagcccuggauguccuagcacucuguagaccaggcugcucuagagcucacagaggugcaccugcuucugcuuccugagugcugggauuaaaggcuugugucaccaccacccagcuucaaaacuuuauuuuuauaaugaaguauuaguuaagugauuuuuguacuuuauauaaauguauuuaauguauauaaauauauucagucuuuuauaguguugauauaguucuuagguacuaagcucauaauguauuuaaguacuauuuuauauauauguuuugauucauucacucuggguacuuuaacagcuuauagaguaaaauaggaaagguuauaaggguuuauaauaauauaucauuuauuuuuauaaauuuauuucuaauauuauuugguugcccccaauguauuugguacagagaaggaaacaguaaguguggaacuugagccuuguguacaaguuccuuguccauaauacagauggauaucuuuauuagaaaggacccaauagucacuuuaugaucauuguaacucuucugaaaaauacgccccuuuuaauauauagacuccugugggacuccuucauguaaagacaaagaaggaagacacauagacacuaagcaucuuugccaaguuuuucacaggaaggauccagaacuuagguaguuuuuugagcuuguguucucuuaaucacuguguguucugccuguacgccaguugauguacuuggguagauuucuuauuugaaaaugguggggccugaaugagccaaggaaggauuugacagcaggaguuaacaacaugaagcucuuuuuaaaaggacacuuuucgaagauuccuaucucaaagaaacuauauuuauggauauuuuugguuuuuguauucaauuuaguguuacuggauuagaugaagucaacuauuuuuauacagccaacauucuagaaauaugauuagaaugcuaaugaaucauucagaaaacugaguaucauacuacuuauuaaugaaaaaauuggccuggaguugcuaggaagguuugaaguguaaugugccagcuauaaacucuccagugggaacagguguugcaugagcugaaauaagaugcacuguugcugcuaauaugaaugauggcuauauccguauauaugugucucacugccugcagugagcagauugcacuuaauuaucaagaggaaagaguaugagaaauuaauaaugaauggauagaagugauaauaaguaguuaaacuuaagaaaaaguugcagauaggagauuauggugaauuuuauaagugaagucagagagcuagaugauaaauauccagcaagggaaauuguuuugagaagguuauguugacaucauuguacuagauguauuucugagaagagagagagauuuacagagacaaauacuuggaaacagucagaguaauugaguuugccacaauaagaaugugguuuuagaaauggagaaaguaagagcauuaagcacaaaucuuacggaaguaaaugcucugguuuuauaauagguugugaaguuggccuguagugcagcuguagugcaaagguacagcauugagcuagaacucaaaagagcuguuuaguuugucuccgaccugcucuugucagcauugcuuucucuuacucuucuuaugucaacacaucuagcaaggcucuugugcuguguggugcauuuuuuguagaauucugccaaacaaggaaagguagauacuuucuuagaacauaugcagaugagaccauacauccuuguauauuaaauuaagaauuugggaaauugguucaaagagagagaaaacuguguucuuaucuuguauuaauaguguacaaaaaaugcaagaguuauaaaaaauugaaaaaugaaugaucuucuaguuggagggggauggaauauguaagcccagaauuguauagauuguauacaacuuaaaaaugugggcuugggagauaaaaagacuggaauuuucuccacagagggaauaauuuuugaaggggaauguuugacuuuugaaacagagcacugaguuucugaagauaauaggaaucaagaugacaaagaaaggaagcuuugaaggccugguaugcuacugcauuccuguaaucccagccuuuggcaggaggagggagaagcaggaauucaaggccagccuuugcuacauagagugcagcuuagcuacaugagacccaguaaaaggauagaaaggaggaaacuggaaauaaagauggaaagcuguuuaagauuacuuugucaacaguguagagucugauaggguugaagcauuugaaaacagaaauacuguuuuuuagagggaaguguugauaagucauuguaauugaaauagaaguuuaggagguggcaggcaugcauucuugcaugguugguuggcauccuggaagaaaaagaauacuuauaauaagaaaguuaauggcuacaguagccuuauacuuuuuaauuuuuaaaaagauuuauucucuuaaaaucuauaugucugcaugcccccguguggauauguguauccaaaugcaggugcuuaugcaggccagaagagaacuuuggagccccuggauuuagaggcugucuguuguaagcuaccucacucaaaugcugggaacugaacucuaggacccuugaaaaguaguguauacucuuaaccagugagccaucucuccagcccucuacuuuugauuuuugucagucccuuaaugaaauucuucuaaauaacccugcuugccuaaggauaaacauuugaaggcucagucccuaaccuacuuuugagggauagcuuuucauuguucaauauguggauuucuguuuacccagauuauaugguuagccuacacuaauuuauuugggaacuuuauuuguauuuugaacugaaaauugcuauagaaaaagcaccaugauuuuauuuuuuuuuuaggauaaauacaucuuacacaauuuuuaaaaauaugccauuuuaaguaugauuaguauauaauuauuuccaucagcuuuaaaaacagauuuuauuggcaaaauuaguaaugguagauuaagauacaaaauauuaccuauguugcucagugcuucuucaugauggaucauugaaauuauugaccaguuuuuagugaucagucauugaauauaauuugauauauggaguaugguggcugagaauaucuaagacccagccuauauaagugacuaguaaugaucugaacuacuaaauuuaaagguuugguuaucagcaaucaauagggcuuucucagugagaaugaaagaaaggacacauugugcucuuaccuaguaagagaccaagcagagcaaagcagcuuuuaagagcuccaauuguaagguuaaagguugucuuuguuucuagcugugguguuugacccuccuaucucaguauugcuguaauuguagcuucauauagguuuaauuggucccauauacauuagaaccaucuuuacuaucucuagccuacuuuuccucccucccuuccuuccuuccuucuucccucccuaacuuccuaaauuccuuccucccugcauuuaucuauuuauuuauuuauuuucauuuuucuggauggguuuuucuauguagccuuggcuguccuggaacuuacuauguagaccaggcuggccuuaaacucacagagaucugccugucucugaguucuaggaucaaaggccuguaccaccacuguucagcucugcuuuuauuuuuuaaaaaaccaaaaggugguuuucaggucuuccuuacacaucaguauuuugaaauguguuaaaaugacuuuuuuuuucaagcaaagcaauuggcuaauauuggaagucucaaauaguuugauuugauaguuuucauguuaaguuuggaucuuuuauucauuguaaauaaggaguuauauaacauuuuauaaccagaaauguaauuguugguuuuguuuuguuuuuugagacaugguuucucugugcagcaaaguccuggcuauccuggacucgcuuuauagaucaggcuggccucuaacuuacaaagaucugccugucuccuaaguucugggauuaaaaaggcaugugccaucaugccugguuuaggaaugcaauuuuuauaucuaauuuauaauaguuaauaucuuuguauuuuacacuuacguaagucaucuuuacuauagauaaacucauuauuuguaacauaauuuuacuguuuuacuuuuccacuuugauuuuuuuaauugaaaauaguuuuuuucacauaaaauuucuaauuaugguuuccccuuccucuucuccuucccaauuccccacucaccuuaauccaccccuuuuucucauuucucauuagaauacaaucauucuucuaaaaaacaauaaagauaaaauaaaaaacaagcaaaccagaauaugaugaagcaaacaaauuaacagaagagucaaagagaaagcacaagaugcacauacagagacacacauguucacagacacacacacacacaaagagugugagagagaaaucccagaaaagcguaacaccagaaacuguaauauauaugcagcagaccuguaaggaaauaauagugcccaggcaaagcauuaugagacaaagaaccuccaaaaaugccauugaguuaauuuuguguugauuaucuacugcugggcauagagucugucuuuaaaaguaguuuguacaacuauugagacuccauuggggaaaacaaaguuucccuuuacgagcaguuaucaaacagagguacucucuagauuuggaauggggacuuguguucacuuuucucagugcugggaccccuaucuuggcuuagauccguguaggcccaguauaugcuaccacugucuguuguguucacaugugcuucaguugcacugguguuuagaaggccuuguuuccuuaguauucuucaucccuccucuguuucucagaaucuuccaacuccucuuccaauaguguucccugagcucugaagggauggauuugacggagauaucucauuuaagacugaguaguccaugaucuccuucucugcacauuuuccuguugugggaauccuuuuuugucuuuaaucaucauagcaugugauacuacuuaacacuagacuagugaugcauggguuauuuuuuuuuaauuagguauuuauuucauuuccauuuccaaugcuaucccaaaagucccccacacgcucccccacccacuccuccacccacccacucccacuucuuggcccugguguuccccuguacugaggcauauauacauggguuauuuuuaaagugacauauugacuuuuaaacugaguggcacaugucuauaaucccagcacugagaaagcagaggcagauggaucacugugaguuugaggccagccugguauacaaagugaguuucaguuaaggcuacacugagagaaauccugucucagaacaacaacaacaaaaacaacaacaacgaguuuuaggauuauauaacauauguuccacauauuguguguauguguguguguguguguguguguguguguguguguguguuuuauucauuagaaggaucuuuauagcuauguaauuuauccagauaucuuuuaguaggugugguaaugauuuucuagguuaccauaaaauagauuuaucgauagccugcuuuuuuuauuggauauuuuuuucauuuauauuucaaaugcuaucccaaaaguccccuauacccuccccugcccugcucccuuauccacccacucccacuucuuggcccuggcauuccccuguacuggggcauauaaauuuuacaagaccaaggggccuuucuucccaaugauggcugacuaggccaucuucugguacauaugcagcuagagacacgagcuuuggggguacugauuaguucauauuguuguuccaccuauaggguugcagaccccuucagcuccuuggguaauuucucuagcuucuccauugggggcccuguguuccauccuauagaugacugugagcauccauuucuguauuugccaggcacuggauagccugcuuucuaagacuguuaauuuagaauaaaagacacuugagaaauacuaggcuacaaacuuguggagauuucuguuuuguuauauuaugaggaacuacugagguaauuuugacauuaaaauagcucacagauauuuguauauuuauuuuuguugcuuguuguuuugagccaaacaaucauaaggaauucuauuccucccuuuguuaaacuugcagagagguuuuggccuagaagaguuacauacugguucagaguacugucagccuggaguguuugugcuuguagaguuuguuacuucuagcugucaguguccuuaauaaggcuagcuuacagguuuuacuuccaugauuugaaguagucuaggcggguuuuagaauuaucuuuaaauauuuguaaauggcucuggcaucuggacacuuucucaggaggcuaacucugacaacuuucuguaccuucugugauaauuaccacauacugcuucuguuguuuuuguuguacccuccagaaguguauguauuacuugguguugauaguaauagaaugauuaucaacuuccccuccuacgauaccaauacucuaaaguuguguucuugaguguuuuaggauaagaacggguauuuuauugccugagguuguagcccauaaaaggauauuuacuuaacuuuccuucucuuguucauuguugcugguggugggugucugcaggcuuccgaguuggcauguuugcuguaaagagaguucuucagcuucaacaucauacuauucucaagaugauaauugugcaauaggaagugaagacacacaguuccagaaaaagguaccuuaaauggaauugacagcuugcuuucuaagacuguuuccauuuagaaugaaaguaaccugagaaaugcuaggcuacaguuucuggagauuucuguuuuaauguugagggcugcagagguaauucugauauuaagauagcucagaaauacugguauauuuuuguugcuuauacuucaaauacuauguguuaaguaugaucuauauucaauaaaaauuacucauuuauugcugcaaagaaaucugcuuuuacaaauuaaaaguuaucaguaaugaguauugcauuuuugcuguugggggcuuuguagauauaauuagguacagcaaauagacauaaaaccugauaguuuugaaaucauuuauaguuuugcuacuucaaauuugucuuuugucuccaacuuucuguauuuuaauuuaaacuacagaaauaaacuuuggcugacuauaaaacaauuuucuuugcauauacuuauccuaagcugaguaugguggcacacgccuuugaucccagcacuugggaggcagaggcaggcggauuuucgaguucgaggccagccuggucuacagagugaguuccaggacagccagggcuacacagagaaacccugucucaaaaaacaaaaacaaaaacaaaacaaaaacaaaacaaaaaagcuucuugugaauguucaaauguuucuuguagguaaagguacacuuuuaacuaggaacacaaauuaauauuuugauuucuauuacaauaaaauaaaaauguucuacaagugauuuucuuccuucucuaagggcauaugcacauggccuuuaucauacagauacagcagaauguauuuuucccucaugagauuuuuuuguguuguuccucagcucugugugcaugugcaucaugaccaacuuuuaguuacauguuuggagguuugagauauaauauuuggacuggauuauuuaauauuugaguuguauagaauuuauaucugggauggaagauacaaacuuuggaaaauuaauuucuuuagaaagaaaacuuaaaauguaaugcuuuuauucacaaucagaagaauuugucucuaacuucaucuucgaggagauauuuacauaccaaauguuacaaaaacauuuuaaguaaacauuaaguggggggaauucucagcaaacauuucaauauuuuguaugugcuagauaagcacagguuuaaaaaaggcgaugugaacuuuguuucuaugaaauguguauuuuaggaaacacauuuaaagacacagguauagaaaauauuaaugagugugugucaaaagauagaugaaacaaaaacauauauuccaagcaauuauggaagucucccuuggugucugguauauaauacuucauauaggauguguuuauuaaguuaucagaugaggguuuuaaagucauauauuucuauuuuaaguauggugaaaaggagagggauggaaggagauagaaaauaaacauguaaaugaaguugagaaucaaauguauauaagacugguuuauggcaaagaaggagauaguuuugcuaacugcauuuauuuauuuauuuacuuacuuauuuauacaaaauaauuuuaccagucauuucuuugucaccauguagaaugaaagagaggaaccuaguaaugcugagcuaucaggaaaaucaaauuccuauuuaacuauaucuccagaaggaaacaaaauaaaggaugacuacacuguggauguacaaguaagcuauagucugccuuugcuuuuaauaauauaccuuaugguuuuggguuuuuuguuuuuguuuuuuucuuuuugcacaguaauggauaccuuuguuuagucaacauguuauauaugguuaauuuucuucacuguaaagaaccauauaauagaauguaaaauuauucacauguuaauaguaguauagauuuugugaagauguaaaauuaaagauuuaauaauaaauacagcuauuuucuuagagguaaaauuugagugcaaauauuucuuccuaaguucuauuuuucuuggcucauuauaauauauauuuucugacuuuuagaaacuaaauccuuuuuugaucuuuauuuugcagcagaaguaguuguauguagcacauagaacauucuugaaaccaguauuuaaauuuacauaguauaugaaguuaaaagaaugcauuaaaaugguuucugccauuuuuucauucuaaguauuguuuucaaauuuauguaccugaaauauggcaguuauuaaaaucaugaauaaauacuauaaaccuaguagaaugcugauauauuuagaaaauguuuaaucuaugagguugaaagaacuagggauguuugguauggagacagaaagauuaagaaaaaccaaaacauuuuacagauuaaaaauguucaucuugggacuggagagauggcucagugguucagaucacugacugcucuuccagagguccugaguucaauucccagcaaccacaugguggcucacaaccauuuguaauagaacccagugcccucuucuggugugucugaagacagcugcaauguacuuauacacauaaaauaauucuuuaaaaaauguucaccucagaaugaaagaguuucauuuuauuaaauuuuggaaaauauuugccaaagauuuagguauagacuaaaaagcuacuaucuguugccuuuccaauugcacaacuaucuuaaagcucauguaauugaagucuagaacagugguucucagacuugggugugauucccccauaggggucacauaucagauauuuauuaugauucauaacaguaguaguaaaauaauuuuauaugaaguaguaguaaaauaauuuuaugguuagggggauaccaaaacaugaggaacuguauuaaaggguugcagcauuaggaagguugagaaccacugcucuaguagcuuuuaucucaaauguuuugaaauuuuguggaaucucuuauuccuguguuguuuagcauaguagucauuagguccuuugguuauugagcauuugaaguguggcugauugguaaaauuuacuguuaaguacaaaauacauguugaacuugaaggacuuagguuuuaaaaagaaugcaaaauaccacuguuuuaaaauuuuaaagccuggcaguuuacuguuaaguacaaaauacauguugaacuugaaggacuuagguuuuaaaaagaaugcaaaauaccacuguuuuaaaauuuuaaagccuggcagugguggcgcacaccuuuagucccagcacuugggaggcagaggcagguggauuucugaguuugaggccagccuggucuacaaagugaguuccaggacagccagggcuacacagagaaacccugucucgggaaaagaaaaagaaaaagaaaaaaaaugaauauaugcugaaauaauacaguauuugaugaugucuuuuccugaagauuuucuaucuuuaaaaacaagccauuguuauuuguaaaacuuuuacugcuacuaguucuccaaaugaccauaauuugaucauacuguugacauugucuugugucuucuucuaacccaaacuggcuuaccuacuuuucaaggcccaucucauauagucuguaauaguucauaguuuuuuucuuuccuugaccuuggugugaauuuuucuuacuuguuauccuuuguuacacuuuuaagugcguugugugcuaaauacugggacuuaaaaucgagagaacauucuccuuacuuaauacauuuauauuauaauugaaagcaagaggaagauuuauaauaccaguugacuguuacggaugcugugaugagacugaauagagaauaguggaagcagaaugggaaggagcaggcgaauucuuuuaucacuggagcugauaaagguuuucagaucuaaggggugaaugaccuagaacauuuaggauuggaagaaaagcaaagucuuauauugugcuguaauacuuguacauaucuuauauuguuacuuguugaugcacacuuuuucauaaacucuuuagggauaaaagaacuguaucauaucauuuuauauauuuacauagucuuacuuaguuacuaauaguacaguauuaaauagaaauggaguuaacuuguaggaccugauacagcugugucugcuaauguaugaaaaugugcagguucuguauuagaauaugaaacaaaauucuaaggguaguaaugauggaagaaaggauuuguguguguguguaaaaguauuucguuuaaguaauauucuuucuuuagugcuagagaauuaaaccuaugauagcagucuguguauauuaagcacuuuaccauuggacuaaauacucuuagauuauuaacaucauauagucauuuuucagcuuucuaugaacuuuuucccaucagaaguaacuuauuaaucuuaacauuuaauauaaccuuuuaaaaaacaggauuuggaaacaacgaaguuaagccucccugugguugaagcacucccuacaguugauuugcaugaagagucuuccaguguaguuguaggcagugaaaccauugaaaauaguuccaguucaucuaccucagaaaggacuccagucucagagcuugaguaagucauuaugaaggaggauggaguagggggaggagcaaacacagcaaauuaaaaacauuucuuaauaaaacaccuucguauacucauauuugauauuugggcaguuauaauuuauuguaucaaugucuuauuuguguauguugaauauaaucuuaauagugaacuuauuuauucagcucaguagaugaauagaauagauuauagccuagccaugaauuucuacguugcauagguucuacuuaggagaaauuauacauuuaaaacaaaugauuuguauaguuauucaaaaaucaaaugucaauuuauuuccaucaaguguuacuagcauuccaguaauagucaugcuuuugugugacuagcuaccuuuuuguaacuuaauaacauuugaaauauuuaagcuuauguuauccuuaguucucucaguucugugcuucugaguuacuuaaguuguaacacagagagcaaagucaaacacccucucuuaauacccauuaaguauuuacuuuauugugagaauuaauaauaguaagaagguaacagaguauuugacucaguaagaauaaaugcuacuuuauugccacuuuuaaaaaucuuuuuacugcaacacagucagguuuugaauaucuguauuccugcagaauguaagggacugggcugauggaguuuugcacaaagaugguaucauuugagaauguugcucaguuaaggaaaagggaacagaaagcauguuggaaaaagucuagauaguauuucagaaacuaauuaagaucagaauacuauuuaucuuaacaguauguucuuauucucccauuuuauuaaaaauuauugauuggaaaaaaauuaaauuaaauugaaaaaaaauccugaaaaacugggauuaggggcuguccuaaaagcuguuaccuauacauggaauauguucuacuagcugggcugucuggucuggccucagcaggagaggagaaguaucuagcuaugcagagacuugaagugccaaguuggagggguuacccaagggguaccccugcugcucagaggagaagggaauugggaaggaggaagggggaaagauugugggagggaguggcugagagggggccagugagugggauauaaagugaauaaguagaauuaaaaaaauugauuggaaaauuauaaguaagggaaggaaaauauugaaauauugacacauuuuuaauaguaaaauuguaaaagugcaguaaagcgucacugaaguagcucgaaauaauugguagauuuuugcuaauuucaacaguauugauucaauagcugcagaaaucaaauauuaggaagauacucuuagaaaaaaaguuuuuauuuuuaucaggccaaauauucauuuaauauuuuguuuuauaaaauucuguaguguuuuaggugaaggaacacccauagaucagucaacaguugauuguucaugguuuaaaguaaauagcucagucuggccuugaccucucaguccuccuguuuggccucuuagauacugggauuaaaagcaugugccauugugcccaauuuaauaauaauucuugagccgggcagugguggcgcacgcuuuuaauccuagcacuuggguggcagaggcaggcagauucugaguuccaggccagccuggucuacagagugaguuucaggacagccaaggcuacacagagaaacccugucucgaaaaacaaaaaacaacaacaacaacaacaacaacaacaaaauccuugaaaacauucuguaggucuucaaacauucuuuuuucuugggcuuagguuauguuucaccauuguuauuagaauuuaaauguauauuaaguauuaaaucacuggauuaucaucuuuucuuuccucauuuagugaaguagaaaagucugguacuuuaucuauagccaagccaggugaaguggagcagccugaagcugacugugaugcuggggaggcuccugaugcagaugcuccaguggaacaaccugcuuuugucaguccaccagagagguggguaucgauaguucuuuuaacugugguucuuuuugcuuuuuuaucaugacagugucuuuuuguguagaccacccaggcuaacguggaacuuuauggguaacccaggcugccucaaucauaggcuccucagccuuccaaaugcuggaauuagaggccugcacuaccacaucggauuagugauaagauucuguaauaaccacaaugugauuuuuuuuaaaguuguuuggugcaagcuucauuccaauuuuauuacuggaauuuuaucucuuugugcuuuuguuuagguguuccuugugugugguaaucauauuguaugaaaauuugcuauccagcuaaaauauguuuaauauaucuuuugcuuuuauauagccuuguuggccagcauauagagaaugugucaucuucacacggcaaagaaaaaguaacaaaaucagaauuugaaucaaaaguuucagugagugagcaagacgguggugauccgaagucugcauuaaacacuucagauacuuuaaaaaaugagguuagugugugacuuuggcugacuaguguauguuauguaacuuacuuuaauagugcaaucuugaaaauaaaacgcuaaacauauuucuuauaaaauuagggacuuuagucauaaaacugauguacucugcgucuauguauagcagguagucacuucaugcuauucugacuuguguuuauguauaaaggcguucugggauggauucuccuggguuuuauauauaauuacaugacuuucugcccaccaucagcucuuugggacaauauaaguaaaauccuacuuaagcaguguuauugaucuguauagaugcuacaaccauuaaauugaagaauaguauuuaauucagugagaacaaauauaugcugcucagcuagaauauuuuaagggcacauuuuugguuucuuuacuuacaugcaagguacaacugaaugcuaaacuacuaucuugaaacuauucuuccaauaaagauggacuuuauuauagugaagcaguugucuuuauucuuugugaagagcuugguaaaaaaaaaguucccaaggaaccuuuuauccagcaauuuaggaucccccucugguaagaaauaacuaagugaaagauguuuuucaucaaguugaaagcaaaauaaauagaaugaaagaguaauguaaaacgccaagcacaccuuuuuauucauuccuuuuaguuugagauguuccguucuuuuuaaugaauuuucacuugaccuuccuaacuuaaauugcagagcuuuauauauucauaggacuagcuuuguguguuuguggcuuccuagaaacacaggaacucaguguuuucuagucugguauuauaaaagaacucauuuuaauuuucccaguagaaccagaucaagagcuguuaagguucaauugucagauaucacacccauaaguaaaaguaggcaaacauuaaagcaugucuccuuuggcagccagcugucuuaaauuuacuuguucucaacuguuaaccaacuacaguacccaaggccuucgacugugagccugugauaauagguagaagaaugaaauuuuaauuaaaauguaauuacuuccugaacaaauuaauauccuaaaaagguugucagaaauaacacaugaguauccaguucagaauaauucugccuaguuacguucauguaaaccaguuugcuuucuaauacaauuagaucuuugcagcauccauuauuuaaaagauuuaguuuuguuuuguuuuuguaauguacagauaguugaaccaugaaaugacuaggcaaguaaauuacaacuccucuucagauaaugcuaucaugcauuuggugauuuuaauaauguucauuucaggacagucugugaugacauuccaugccuucauuuaguuuuuuuuuuuaugauaauagauauuuucuuuauuuacauuucaaauguuauccccuuuccuggcuucucuuccaaaaacccccuauccccacccccucccccuguuccucaacccacccacccacuccuacuuccuggcccuggcauuccccuaaacuggggcauagagccuucacaggaccaagggccucuccucccauugaugaccaauuaggccaucuucugcugcauagcuagagccaugagcccuacuuuguguacucugguuggugguucauucagcuuuuuauuugucuuguuagugcuugauauaguuauuuucuuucaauuuuucauuugaaggauauucauuuuucugauuacccuauuagaaguaguggugcacuaugcaauuauacacauuuuugcugacauugcacauggugaggaauuaguagguauguacaucuugcuaauacuuuuugguuuuuugagacaggguuucucuguauagcccuggcuggccuggaacucacucuguagaccaggcuggccucgaacuccucgaacuccugccucugccucucaagugcugggauuaaagaugugugccaccacugcccggcuuuguauuuauuguuuuauguaaguacacuguagcugucuucagacacaccagaagagggcaucagaucucauuacggaugguugugagcaagcauguggucgcugggauuugaacucaggaccuucagaagagcagucagugcucuuaaccgcucagccaucucuccugucccgcuaauacuguauuuuaagacuccuucagcaaucugauagaauccccaugaugcauuagauauguaacacuuugcccagacuaucacacuauaaccgccaucaaauugguauuauuuaugucucugauuuucauagcuucuugugagcauuuuaugacugcaucuucuuuuuguuaauuuauugcuucuacuccuuuugcugcuuauugauuuucaguuaauuuuuauacccacucguuuguucguugaaugcacucaaggauuguuucccccagcucacugucuucauuuuauuuuuacauuuuguauaacaagugcaccccaguuugaaaagugcaguccagacguccauuuuuuuuucuuuuguaaauucuuuugcccgcauguaacacaauuucuguaugcuuuuaaagcguaaggucuuggggcuuuuaaaauaacauuuuaaauaucaacuuuaaagcuuguaugcauaggauacuuguuacuuauuuuguaaaagcaauaugcuacaccugaaauuacuauuuuaauaaguaaguauauuuaaggugguuguacugcaaguguacacacacuuucucucugguugaguagucaguuuaagauacagcauucuguuuguuuuauuuuuaaaauaaguuauguuuauauuacuaacauaauuuuauagugcuuaaaguuaguuuuuauguuaacuugaauuuuaaauaaaucacuauuucauuuuaaauaguauucauuauaaaauuaaauuuuuauuuaguguuaaagaagcaugugugcucaccuucguuauuauuauuauuuuugugcgggggcauuucuuucagagcucugauuauacaaaaccaggagaaacugacccuacaucugucacaagucccaaagauccagaagauauaccaacauuugaugaguggaagaagaaaguuauggaaguagaaaaagaaaaaaguaagaaagcagugggauucuuuuaauuaaaaaaaaauuauuuggggcagggggugguuuaaauauguguuuucucuuucuaauuauaaaacaaccuuucuaaaaacuuguucaaagauauaccacauugcugcugauuacacuaccauuuacuggugguauacaguuuuaauauuaauuaaaaucuauuguuagaaguuaucuacugauaguaaaauaagaaagaguaaaauaucacucccaauauauggagaaaaaacuuggacauggaaaggucaguuagaaagcuuuaaaccgucugcauaauaauucugaaauaagaauucuugauguugggauucaaagaaaaaaagaauaaaacauaaaaccaacaaggcuauauucucaugguaaaucuuuauguucuguuauuagacguaccucaggaaaugugaauuuuuauuccagauguuuuaaaacauuuugaauuucuaguuuguuaguuuugagauagaaucucuguauguaacuuugguuggccuuaauguaacugugacuacaaggcuggcuucaaacucaugccaauccucuuugugcggcaucucaaacgcugggauuaugagcaugugccaccaugucugccuuggauuucucauguauuuuaaagcuguguuuuuaggaauuaaaaccuguuccuuucuggaaagugccuguuacuuuugagaugauuguguugcuggggccaaggauguauuuucgaucauaaucaucuauguguuuauaauaagguuugucuacaggucagucguugcauccgucuucuaauggagguccacaugccacaaaaaagguccagaaaaauagaaauaauuaugccucuguggaguguggugccaaaauuuuggcagcuaauccggaagccaagguacuuuuuuuuuuuuuuuuuuuuuaaagaaaauauaagaaacuagugacuuuauuaaaagcagacagugguugacaguaacuguuacaaugugaauuauuuuuuaacuuuauuaauuaauaugagauuaugcuuuuaaauauuuuauagugucaaauuuuuguuacauuaguugaucacauuacagcuuuaaaaaucauuuaauaaucuaugcagcuuuaaaaauagcuccugaaaaguuauuuuccuuuauaauaaaguuuuaaaaggacaaauugauaauaaggcuaauuuaaugcugcagccuuaacugguaaauuuuaacuauuuaguuuauucccccccucccccccccccacacacacacauaggcucauuuuaaaagucaaaguacaggaauuccacaaaauuuuagaauugaaauauuuuuaaacugcuucucuuuauuuucuuugccucuugaaauagagcacaucugcuauucuuauagaaaauauggaccuuuauaugcugaauccuugcagcacuaaaauuugguaaguaaauaaaacuuuacaaaguauauuuuauauaugaacaucuuuauugggguaacauuaauauaucuguguaauuuaauaagcauuuauguuugaucaauauugauauugccccuaaauuaagaacaagaugccuuuucuuuuaaggagauagaaauguuaauagugacaggucuggucaaaaguacuguuggauggguugucuacaaaaagaauauaaaggagaauucuuagaagagguuguuucugggcuggaucuuaaagggcccaugggaaguagcagaugauggagucaccgcguuuuaauaggagcauaucucuucuggaugacuauguagcagcaguuuaguugugacaagaaggugcaguuagaguagugaggugaugaggcuggagcauuaaucuagcugucuagcuacaauuagaccauuuaguacugcauguacucagcuugacagugugcaugcaucucucucucucucucucucucucucuacuucccucccucccucccucucucccucuacacacacacacacacacacacacacacacacacacacaaacacacacauuugcaugaugugcuuguaugugggaguacauguuuucuugugcagaugaaggccugcugugucuucuuugaucacucuucuccucacuuuccauguugaggcaggucucucaccugagcccagaguuugcugaucccacuagucuaguuagcuggcuugcuccaggaguuuucugggaucacuggcagcuguugcccucacucagcuuuuaccuuugugcuggggaucuaaaccauuguccucaaacuugccuagcaagcacuuucuugcugagcauucuccaguuuuacaguuugcaaguuuuguuuuaaagacagguaggcuaacauuuauaaagacaugacauuaucucauuagcauuucaagaaagcuuaucuucaaagaauggccucuccaagagcauucaguuaaagcagagaaaugaggugggagacuauugucauagcuucaguuugaagucauagccuugagcuaaauaauuucaguuugaguauggaggagaggaaucuaucugaaagagguuuaaacgggaaaaugacagugcucaguaauuacaaauauagaagagaaagacaucuaagaaauacucucuuacuucgguuucacugcuuuauaaaucuuuuaugaauacuauagacaggaacaauuuaugggggaguuaauacacuuuuauuacacuguuuuguguucaaaaguucauguuuaaaagccaguugagggagcuggcaagcuagcucagagguuaggagugcuuacuguauuuucagaaaacccagguuugguuuccacaauucagucuuacagaucuucauaucuaauagggcaaauuuuuguacauuaggacuuguguuuuuuuuuuuuuuuugguaccucugauugauuacuauuauuuuuagacuuuucuuauuucauuccugauuucaauauggagauuuuauuugagauuguuuugaaucuuuaaaugacagauacugaguuucauuaccaguaaaacaagguucauccuuauuguuuaauguacuuaaccuuuuuccguggauccuuucugaaauguguuccucagcagguuuuuuauuacuauuguaagcaccuccuucaaacuguuauauaaagaggugcauuugacuuauacauuuauauguauuuauauauauguaaugcagagagagagacacaucuaccuccuuguauuuuuuauugauaauuuagaaaccaaggggcuucucuaugugggaauucuauauaguguuccuauaaaauaauacuucaaaaauuucuaauucuccuuaucacauuucaccuuuuuaucaacauggugauucauccuugaaaauugucaaauaaaagaaugacauuuccaacucguguauuuuaaaggcggugcuucuaacuuugcaccuuuauuauuauuauuauuacguuuuugacgucuuaguaguguucugccugcauuugugucuuuguaccacauauguacuagguguccuaagugaggccagaagaggcauuagaucuccuggaacuggaguuaaccugaaaguuauaguugacaguugugguuacaacccauuaucuaaaaccauaaaacauaaagucugugauagccauauuguagcuacagcuuaggaaguucuauuauuaaaagaagaaaaaaugugaaaugcucaauuaguaccuguuaagugauuguguagagacaaugucuuuugcaguuuggugugaggacagauggaacugucuaaucugagccagaguaagcauuucauaaauguuacuuggcuuucuucuucaccuuucucugaagccugauuguuuguuuguuuguuuguuuuaccuuuuccuggaacuuaguucuguuuuucuccaaaauuagacaguuacuuuuaugucuuuaauuucauucggcucuggcaguaucacucaacaugucaagaaagcacguaucaagcaugauaaccugaguucagacucaagggccaacauagcgagcgaaaggggagaccuaccucuccuuccugcaaguugccuuugaacugccacacacauaugcacacugaaugaaugaaugagugaaaauuaaauuacauuugaugaaaaaguuauuuaaaacagauuggaauguuauccaugaguuucuuuuuucauaaaugugaugcuauaugcaguuuuuguaacauacuauuauuaugauacuuuuuuccugaguggucauacugugaugacaccuuaccaucaguagggcucgcacauaauuuucuuuuccuuccuuccuuccuuccuuccuuccuuccuuccuuccuuccuuccuucccccccuccuccccuccucccucccucccucccucccuccccccccagaucaucuaucucucucucucuuucuuucuuucuuucuuucuuucuuucuuucuuucuuucuuucuuucuuucuuucuuucuuucuuucuuucuuucuuucuugucuuuaagugauaggaauugaaccaugagccuuaaucuuaaacggcauuaguugcuucauugucuggaaagacaauuuuuaauccuuuuggauaaauauuuaaauugaccuuuuugcuuuuucuuaguaaccuuugcaaaauguuaauacaggguggucauuugggacaguuguugccaucagauaauuuuaaagagauauuuuauaguagcuauguauaaagauucuuauacacaggauacaggauacuuuuaguaaaacuauuucauuaaagaaaagaacaucauaggagcaaacaucaauguucuuucuucucacugggaaaugccugucccaaucaaggcguuuuaucaguggauacauuagauugcaaacacuauuccuguuacauuuugguaauuuuuaaaugccuaauuuauacagauguuuuaauaugaacugcuuugguuagcuuauguaaauaauugucuuauuuucuuuuugaagguuuguuauugaacucugugagccaauucaagugaaacaauuugauauugcaaauuaugaauuauuuucuucuacucccaaagacuuucugguuucuaucagugacagguaaauucuuaaaacuauuuucuauaaagcccaugauagaauuucagaguaaaaauuaagcucacaugccaaucuguugucuucuguuguuuuaguuuuuaauagcaguuugugaugacauuuggauuaugggcuuuuguuaaucacuuagcucuuguaauacuuaaacaucacaaguaugcuauguuauucccuuauaaacugaagacacaggggauuagcuuguauaagucacaugguuuaguauuugggaggaacaagauuccaaucuagaauuauguggcuucacaguuauuuuaaucauuaugcuuguugcuuucugagaguucuuugaaaugcauuaaaaauaugcacauauuauguaagugcuucauuuuauaucacaacguauguuuuuggugaaguguuuuaaaaacuuuuuacuugcaugauuauggaagaaguaaauaucuaaggaagucagaaagagaaccaaccauauucuguucuuggcaacccuaaauuuaucauucuuagcauuuuaauaauauucuuuucagcuuuuccuguuuauuuuuuuauucuacuaaaaaugaguauccuuuuauuucuuauauccugagaauauuuugccuaaagcauagcaguuuuaauuauaauuuaauuuuaucccacaauggagguguuuacuuguauauuaguguguccuagaggaugcugugacuccccugugcugcugucaauugauggcaauuccaguggucuuucaguggucuuccucucccucagagucaucuucauaucuguauggcuuuugaaaccaguucucaaaauguauugagaauuccaucuaguauuuugauacuaaccuuuuuuuccagaauaucccccuaauauuguacauguuagaugguaauaucuggcacugaaaauuaaaguacgcauguuuuuuaaagagaagggauaacucauuaauuugggcucuuuaacuauuacaaacaauaacaggcuuagaguugaauccuagauuuucuuuuaaaggacuuagcuauagaagaugucuauuuaaauaugguaauguguuuucuaaccugcuuucugcuagugcuguauucaugccuuuccucaucaccuuccccucacugcuugcaugcaacagucucccggugucucaugggucacuuuucccccuaaacccuugacacugcuuugcuccugcuucucucuuucccugucuucuguuuguuaaugugauuuuucaaguaauucuuucccagugaaguggaacucaaggccugucuuauuuaaaugagaagaaaaacuacaugauaaauuuauuuuuacauuuuuagauaucccacaaauaaauggauuaagcuggguacuuuccaugguagagaugagcggaauguccaaaguuuuccccuggaugaacagauguaugcaaaauacgugaagguaaucuuuauacauauaggacuauguucuguaaugaaacuauucuaguuaucuacccugcucacuuaggaauuagagaaacuaagaguccuagcauaacacuaauuaaauauuuuuuacugggcuauuuuauuuuauagacaacuuuuauucugacauuuuucuauucuugguaaucuagaccaaacuauuuuaacaagcuccaaguuacaagucuuguuuuugaguuuugcuuuuuuuuucuuuugaggcagagucucauguagcccacccuggccuaacucaccaggugcuggugccucugugugaaguacagucaugcaguaccaugcucagcaugccuuagaccuguaaauugucauccaccugguauuguguucuauuuugaaacuuuaaacauuguugcuguugaaaucuuuuaaguaggugugauuuuuuuuuuuaauuuuuuaaaaaucuuauuccuagauuauugauucauuuuuauuauagcuuucuguuuuuauaauuaaaugaaacaggcccauuuagcaguuucagauaaaacuuuagacacuuuaaauauuuccauugcuuacuuuaccaacuguuacucgaguugaauuuaaauaaucuauggaaguuucugugccucuuuccugaaccuuuuuucuuuaauagaaaauaauggacacaucuuaaaguaccaugcugucaauuauaagaccuuuugaaauugcagaacuucuaauuucugugcuuucuuuaaguuguaagaacuuauaccuacuugauuuugucuucugggauuuuacucucucuuuuuaaagcaugaauuaaauugauuucuacaaauggguaaacuuguaguauuccuaauuucaguaugaaagugcuggauucuauauugaaaaugcaguuggcauucucaguguaaaacugccacguaaagcuccugcucgcuugcuuuguggacagaaaccauaaaauguuuauuaacugcuuuuuuuuuuuuuugaaaaacccucuuucguauagacaugucuaaaagccacuuacuuauaguaaugaaugcuauauaugcauacaauuucuuaccuggguaucuguucaccuaaaguaacuaaauaccaauaauacaaaugacuuuuuaaagcuugcauuuuauaaguaaagcaucuuguaucaguuguauuugaaauacuagaauaccagaacuuaugccuucccugaaacacauuggauacaauauuuuaaaaccaccagaaaaacuuaauuauuuuguuuauuaauauauacauuuaucuguauacacggcaguaauacuuaacaaaagaccugguuucuaaaaaccaucaauuaggaauccuuuuuuauuuaacagauggaaaacaacugcauuuaaagauuauucuacuuuauuagcuuaaagcuaaucuauuacauguauuuagguugugcuuuucaguuguuaugguaaaaauggaaauuagggcuuuuggaccuacaaagaauuaggagugcuacaaucuucccacccgcgcugcuuccacacugcggacugugggugcagauacuuguuaccuaugcaugugauccggacuuugcaacugauuccuuuuucuuuuccuuucuccugcuucagauguucaucaaguacauaaagguuagcaaccuucucuuuugcaauauugaauaacagaccauggcauauuaaugcauuacaaagauaaaaagcaguuccaaugcuuuauaaguauugauuuugggggcagugauuguguuuuuagaaacgcuguacugagaagccugagggugcucaccuuaggguccccgcggccuccggcucacggcuucuguuuuucagguggagcugcuaucacauuuuggaucagagcacuuuuguccuuuaagccuaauaagguaauacaaaacgaauauuuucugcugcuuaucuuacaagggauauagaaaaccuuaauguuuuuaaggugaagagagaauuuucucguaugugaaguuauuguuguggaauguguuuugaaaaaaaugucaagauagucugaaacauaaaccuuuuauuuuuuauguucuuguuagcuuacuuuguuuuauuguguuaauaauacauagaagcacagauugauaggaaaucagacauuauauuucuaaauucuuuaaguuaauuauauuuauggaaguagugaaugaauaaauguaagaaauauuauuuugaagggcaaaagcuaguggcccauaaaacauuacccugauugugacaauuuugcucaugcauugugaagagaugagccuuaguaacuuguacuguaaugaacuguuguuaggguuuuugguacuagcaugguggaagaauaugaagaaauugcugacucccaguaucagucagaacgucaggaacuauuugaugaggacuaugguaagugauguaaacaggugacuaucaggaauuuauuuauuuagguacucuaguaguaaugggugaauuacagaugguuuaaccuguuuuaaaaauguauuuucuagagugagugcuuuguaacuuaaauuguuucccaaaccuaccugugaguucuuuguaacuggaacucuuguaauaccaaugcuauaaauuaugaguauaucucaauucugggcccaaaaucuguucaacucagaagauacuguaacaacagaagaaaauauuuguucaauugauuugccuugagccuuggagcaaguacaugaagaccugagucuuuuaaaagcuccuuuaagucagaagggaggggcaaaguuuuaugcugguuucuuuauuugaucaaaaugguauaaaccauaacuuuaagaauuaaaggugguuuugugugugugugugugugugugugugugugugugugauuuuccuaccaaaaauacaaagauauuugcuaaaguuugggaaaauguuuaguuuaauaauuuugguuagcauuacuauauuguccuugauucacaccuguaaggcuucugacccucuuuauguaaaugucuucuaggcuuauaguuaauauuuacuauacaguguuuuauaugucaauuaccugacaaaacacaggaacuuuuaaauacuguuauuggaaauuguuuuuauuaaaaauuguuuucuucucuuaaaacagauuauccccuggauuauaauacuguggaggauaaaucuucaaaaaaucuucuugguucugcuacaagugaguauuuggggguuuccuauuuaugccgcuaaagucccagucucgcuugcucucuuucugacaggcuauuuguuauaguauaguuuaggaugcuugugcucccaaucuugaccuguguuagcuuugaaaggugcuuauguggaaguggacuacaguugguaaaaaggagggaaaucuaagcaugggauggaaucagauuuguacgguauaaucucuuucaguaaagauaggccuaugaauuucuucaggaaaaaugaaggcagcaucacaaguaaauucguugugaaugaaggcuugguaaucugugucuaugccuaguuuucuguuuaacgguaaaauaucacaucuguuuccagaaugcaccaauaacaguaucaauauauuacgcuguugaaaaugacaaggugacuaagauaccuacuuggugguuuaguuguucucccaaacuagugugaauauagggguagacuggcuaaagauaauucuggaaaaguacuacccaacuggaacauuauuuuucuguuaauacaaaauuaacuaagagcacuuucuuuguauuuagagauuaauaacuagauaacuagaggucauauaagugugugaauacaaacugucucucaccguggauaugcauguuuaguugagucacuuucuuuuuauuguuucuuuucuccaucucuuuucuucuccauggagaagaagguuucccagggaugagaauaaguguguuaagaauaccugcuagaggagaacccgauauauaaugcucacuucuuauuaguuuauuauacuucauuuauagucacugacuuaguuuucuuucauaugucaggaaagcacuguagcacucagcuacaacccaauccccugugcuaauuuuuggcuuuuuaaauaugagcaaugcuuucaguuaggaucuguuguuauuuuuauugcugauauaaaauagugcugugggacaagaugagauuguauguuauguaucuggguuuugcuauuauuaaguauguauuuuuguauguuguauaauaaucauuauucuuaaugauauugagcuaguucuaaggaaacagcuuuuucuuuucuuuuuuuauacauggaauuagauucagacuaaaauaucuuuaacuucugauggcuaccagaaaggaaaggacacaaaagggagguaguuucuuacuauagauuuagauaagaaaaaguccuauuaauauucugcauuuuacuuuuucuuucuaugggauuacuuguuagaugccauuaaaacauaauuacaugccaguguaggacauuucccuacuugcagucucuuuucugaccauauauuuuuauauaauauauacaaaggauuacucuggucccaauauuuuuuugucucucaccuugagaaauauguuucuugcuaacacuuuuuucuucuauuuuucuuuuaugggguuugaugggcauauugaaagaauuugcauaguuaaaugauagggacagggagauguuacuugcucuauaguauggaaaauagauuuugaaaugacauauaccucguuuuuaugauacauuuuuccauuuauuuauuuacuuauuuauugauauaccucauaaggcuucaaaacaauagguggugagaaggaagcauuacuuugcugucaugacguuuacugaucugaucuauauagucuucugaaaaauuaaugguugcuuuugaaccugacuuagccacauuuucuaagauaggauagcuaauaguguaaggagugcauacauguguagaauuagucuaaauaaccaauguuuggacauagaauguccaaguuuggcaguucaaaauggucuugagauugggcuccuuuggaacccagcauuuuaguucuggaaagcagaucuagggcuuuucauaugcuaggcaagcacucugcuacugcacuguucuguucccacuguuuagauguuugaaacaucugugcaggucagguagcuucagacuuauccucuugccucuacuucccaaguguugugauuagaaguguguaccaaaacaaacuuuucccuuuuuaaaauugugugcauagucucuacaaaacagaauuuuguaguuuuaaucuuaauaaaaacuucuuuucccuuuuucuauugggaauguauuuaguaucuccuaauucauauucuuggagccagaaguauuugacaguauguauuucagaauagugcagaugcauaaugaggcaccgugagaaugagauacaaguuuaaacaugaaauucucuuguuucauaauguauauauauagcuugaagguguguuuaaauuuuauuuuauuuuuuacuuauugacuuugcaugcuugaagauaauuauauacuguauuuuuagugugccugaauuuugacuugugauuuauccuaugaagucauauuuacaauuuucuacuuguggaacuguuagugcucaaaaaguauauuuuggagcauuuuggcuuucaugucaggcguuagaguuauguagauuuuuaaaguaguuuuuuuagaguuuuauagcuuaaccuauaguuaguauucacaggaaguuuauaucaccagauauauauacaccagauauauauacaguacauacauacucuguaccuagacaugcuuauuccuguguaauuuaacuaucacugaaggagauauggcugucuuacaacagcagcauaugugcagccuguucagucuucugacuccugcuuagauucuugaacuaaaacauguaaaucucuuuugucaauaggaauucucugucccauuucuauuucacuugaauuuugucuuguggauuuuucagauggcuaucuacuuugauauucuuauaaguuugucuuuucucuuaguuacauguuuaagacaaaaugcaguuuuuaaaucaacauauuuuuagaaaaauaauauauauguaguaugugguccuacaaauagaaagcagaaaagauuauccagggggagccaagagcacauagaagaggugguauuuugguugguuuaucuugguauauugaaacauggccaaaaucuccaucucagcauccuagacaacuuguguuuucuguagccaaagugccauugguguacugaaagacucaacuauaauguaaagauguuuggucccuaggagucuuucauuccagaggaauaaugugagaugaguaacuuucuccacucagaguaaugagggaauauuuaauccaguguggagcugugucugacauuacugcuuuacucauuaggacuuuaguuacugugcugacaagcugacccacguuuagcugugcauguacaacagucagaacagacugccacaaaguugccuugucucaaaacaucaaaagaaauguucuaugaacauaaggaaauuguuucuuuucauuaaaugaacugagaaaauagaaaucuuucaaauuuugccuuuguuaccaaaccaucaccuaaaaugacaacaaacagguuuuuaagagaacauugugucuucuuacuguggagcuaguaauaaaauuaaguuucaaauaacacaaaagacaaauucuuuauacagauuaacauagguuucgguuaauuaaauaacaaugacuuaaauuggaaauccgaagaacagguuuacuuugaauacaagagaauauaaacuauagauuaaaauuuuugauauuuuuaaagcaggcaucuuugccugaacuuuauuugaugguaguguaagcagaagaucauguccaauagggcgguauuguuuggcauucagagcagacuuauaaagaagcaguuuccauuccugacuugggguuugugaauugauggccauuacugucauuaccucagagaaacaccucagccugaguaaaaauccagggcuguacuucucuguucaucagauugucacaucuaagggcaagacguuucaaaguggcagcuuuucuguuauucugaugucucuaaacgaaguacuaaaauuauauucagauaaaaccacaguuacgugcauuccauaauuacuguacuuggaguccucuuuaaaccagugaaauuuuucccuacccuacacacacauuuacagaacugggccugugugaccaugcugaguggcgcagccuucuuuaugugccuucccuuagagcuuuguguuucacaucuuggauuuucauugaaagugucaugcaaagucugugagacacuuuuaucuggagacuaagacagggguaacuugggagccuugcagcacagccucugcacauucuuacugcuuugaugcaaaugugugauaaugaaaauugauaucaaaugacaguucaagguagacugaggaaauuccucugaaauuauguauuagaagacccccucaacucccaucaccaguuucucauagauuucuaccauucugugauucuuauguauucauagaugucuuuauauagaaauggaggcuuguaccuuuauuagcuaaaugucuccacuaggugcaaaaaacaaauaaaaacaaacaacucacaacaaccaaauugcaaguuguucuaccuauuaaccuuaguuuugaccuuuaaaaaaucuuacccacaaaaagauauuggggguuauauaacccacaauauacugcuugccuaguuaguuuuaaacaucaucagggaaauuuaauuaugcauauuaccaguuuauuugacugauauaguacuauaaaauuaauaauagaauuuuucuacuuuucuuuggauacuaaucuucccauuuuauuuuuuaucuauaaccauucauuuagaaaauugcuuuguugauauaaguugauuuuuuuuuuaaacuguagaaccuuuuuagacguuugaaauaggaauuuugaucaucucauguccuccauauuccaguccaggcuauaguugaauuuuguaauguguuaacaacaguacuuaguuauagguaggaugaaguuuuauuuaaaaaaaaaaaaaaaaagaagaagaacuauucaaaauucccucugaaccuuaaaauuucagcuuacuuuggcuaaaaucuauauccuguauuagacuuugauaggaaauaaaagauauauagucaaaagaaaauggcuaaaagaccuuuauaggccuuuuaaaaauuaucuuaagauuguaaugacacucuuuagguauauugguauuauuuucugauugaauuuuguuuuagaugccauucuaaauauggugaauauugcugcuaauauucugggagcaaaaacugaagacuugacagaagguaccuaaucauuuugugggucuuuaaaauaguugguacuucauggauccuuuaaguuagaaaaaggaaguaauaaacuaacaaaguagaauuuucauuuagaaaugaagagaccauuggaaagaacuuagccaucuuguauuagcuuuuguuuauugaauuuuacacuuuuguuuuaaaugaaagaacuucauuucauacauuucauuaauugaucccugccccucuagaagccucuucugcccugguagaauuguuuaacccaggauauccuaugugcuauacaagugcucuuuuuuauuuucaaucaaggucucaugaaguugcuggacuggccuugaacuuaacagugcuccuaucuuagucuuguuaguaucugggugggagcaggugcucccucccugcccaacugaauugauauuugauucuuccuagccaugacaguaaugauucuauacccucaucucuuuauugagaauuccuagugguacuuuauauuagcuuuccuuuuguguagcaaauauauuaauauauuagaccauuuuauuuucuuuuaagaauggcaaauaucaauuaguaaagaguaacaaaugaugccuuuuaguuuuugaagaacacuaagcuaacuguuaacuucaaaguuagccauuuuacuuccucauuuuccaauaacuuuuuggucuagaagcauauuaaucauguaauauuaugcaaaauuuauaauaucaaauaaggaauaauguucauucuuuauaguugugaucaugugcagucaugucuuucaaagaaaacuuagauuuaaaagaaaaaacuccucauuagcaaauguauuugaccuuuuccuucugcccugagagacuacaacucuuuauuuguuacaguaaaauauuuuaugguauaguuuuuaaacauugaacucaaugugggcaucuuucuuaaaauaggaaauaaaaguauaucugagaaugccacugccacaacugaaccuaaaaugacugaaucaacucguguuucaacuccuguuccaucaccugaguaaguuaugcuacgacaguagauuucuguuaaaacaguggaguguauuagaaagagaaagaaaagagcuugucaucuguauacagucaucaucuguaagagagcccaagucacaggacagacauuccuacagcuacuguggacacuuugcaguugcuucuucucuuuuguguauaugcauauuaaaaacacacuauuccagaccacacauuuguugcuuuagaauuaucuauuacuuucacucauugaaucuuuucuaaagaaaaguacuuacuuccuuacugagggugauuacucuaggcuugaggacagauuucaaaggauucuuacugaguuuagguuugaaaguauugcauauguauauaugaagucccuaauaagccacagaggguacccaaaauaccuaaugcaguaguucuugaguuguauuugucacacagcaaacuaacuuguucccugucucaaaaugauuuguauagagguuuuguuuuuguuuuuuuuuuuguuuuugucuuggcacauauugagcaguguuuugcauauagguaaaauaacauaaaauaucuucauuuuguggguauuuucuuaacaaaggcauuuacaucauagauauauguuaucuauaauagaccauaaacucagugauuuggcucauggguuaugguuauuguguaaaauuuuuaaaucuuuuuugucucugaggaacucuaauaggauauaugaaugugaacuauuucacaauaguaggaaaucagaauugcaguaaguaugcuuuaaacuguaauucccaacuagcauacuaauuaaaaaguaauuuugugcuuucaaaaguagagugagauauuuauauucugaaagagacuauaaagauacuuacugagugauuggaugagaaauauggcauauauguuacugauucuuaagaggacuuaaaauauguauuagugaugaagacauucuuagugguucuaauuaucuggauguguaauagcuauuuuugauuucauaacuaggcugcuucuucaguuaacauagguuugguuuuuuuuuuuuuuaaagcaagcuaagcaagcuaauuuuauuuaugcacacagacaaaugugaguauuuugaaagaugacuucauugagacagaaucucccuauagagucuagccuggcccuaaacuugugauccuccugucuuuuucucccaaguacuggacuuacaggcacaugccaccacauuggcaaaaucauugaacaauuuuuacucuaagugucuuuguuuacuuuaaguuuuuaaaauaauuauauagcagucauuugguaaaauaacaaaaauguacuccguauucaaaauuaauacucaauuuauagaaagcuguuacuuucuuuuccuaagucuguuuuaacuagaauagacuagaguauguacaacagcauauaacuucauauuuaccagauuuuuauuuucuccuucuucagacauugcuccuauuuacugucacaguuuauucaguaacuaauaguugacaugccacgugaauauguaagaaagauaauuagguucuaaauggaucuaugugguuauagauaagcuuuuuguuaagagaagcaugacuuaauuguuuuuguuuuguuuuguuuuguugucagcaaaaaugaaaaucugcuuagauacucuuugacuuugcuuuugucauuguggcagacgucucuacuuagaaauauuuucuggugguaacuuuuaaguaggaaauuuugcauauaaagauaauucaauuuugauguucauauuaccugaguuuuucauucagguuuuucuuuguccuuuaagguuguauuuagaaauugucuuuaucucagacagaaccauaggcaucguaauuuguaacccaguuuuuacuacuacacccuaucuaggcccuaucacacagaccuucuguagauccacugaugagacagacagguuuaugaugcaucaguacuuuuuuuaaaguggucaggcauuugucuuuuaguaagagaacuagcucagaugauguuaagauuguauuuccuuaaaaguagauagucugcuguguaggaauuccucacaacauauacagaaauagucuuuagaacuuuagcugccuucugcagaugauacuaggaauccuggguucuaguucuagcucuugguuaucuuuaauuucuaaucugaaagacuuguaaugaguuaguaaauguuauagaaacaaagguacaauguacauauaaggaagagaaguguucggaaauuugauguaaaauacagugguuugagcuauuugguugguugcuugguaaguggacuuugugcugccauuucuggcuuaaguacucuauauaaaauggaaaaaugucuauagggaaaacugaucaaauauauuuguauacagcuuuguacucagcauuucuucauaaucccaaucuuuauguuguuccuaauacauuuuccuuaagcuuauuuuaacauuagauuucuaccuuaagugauauguaaucguguauauguauuucuagauauguaaucaaggaaguccauacacaugauagagaaccaucaaccucagauccuccaaaagagaguccgauuguacaacugguucaggaggaagaagaggaagcgaguccaucuacagugacccuuuugggcaguggugaacaagaggaugagucgucauccugguuugagucugagacacacauacuuuguagugagcugacuucaauuuguuguauuucuaguuuuucggaguacauauauaaauggugcucaguuagaauugcucuuuaucgacaacgcagcaggacugugaguaaaggaaaagauuuugugccaccucagccaucacuacuacuuccuguagaaucaguagagguuucaguaccgcagccucccaguggcgauguggauagcgagaacauggaaagagaagcugaaacuguugaucuggaugauuuaaguagugugcaccaggggcauuugauaaaucacacaguggacacaauugaacuugaaccaagcuacccucaaacucuuucucagucucuucucuuagauguuacuccagaaaugaauucacugucuaaaguagaaggaucugagucuguuaaaucugaaggaggauauauuccaucacaauugaugacccaagagaguucuguugaguuugaugauaaaacagaaaaaaagaccgagagcuuuaguucugcugagaagcucucuguuauuuaugaaacaaguaaaguuaaugaggugauggacaauacugugaaagaagacauacucuccacagaaguugucaccaaguucccugaaacaguaguaccaccaccuaugaacacagccacugugccagagggugaaaguguggaaaccaaaccuaguauagcugauacacuaaagcauacagugacuccaguuauggauccuucauugccugaagugaaagaggaugaacagucuccagaggaugcccuuuuaagaggguuacagaggacagcuacagauuucuaugcugaauuacaaaauucuacugaucugggauaugguaauggaaaucuugugcauggaucaaaucagaaggagucaguauuuaugaggcuuaauaaucguauuaaagccuuagaaguuaacaugucucucaguggucgcuaucuggaggagcuuagucaaagguaaguacaacgcauuuuacaccauaaguuuaguagcugaauaugaucuacaaagacauugugaugauguaagaagcacaauuuucacuggaaaaagggaaagccauuuaaaugauguucaaagcuucccagaauuguuaucuuuguuaucuuuuccguuuuuauaaauauuuauagugacaugcaauuauuauugggcuaauaaauuuucugugucuuauuuucuccuuuauaauuguuguguucuuaccauguugcugagauuagucaugagcucuugugcuuaaugugaccuccuugucagcagcuuaacugguaguguaguucugugcuagcgugcccaacuucauuuccaggauccuugauguccaggaucucucuauuugguuauaccuuuuauguguguuacuggauugcacaguccugaauuggucauuuaagaaaaagcaggauuguucagucucaaaaucagaaugauuuuccaguacauaaugaacgagaaaauggauugaaagcaacucuuacuuuguagguaccgcaaacaaauggaagaaaugcagaaggcuuucaauaagacaauaguuaagcuucagaauacuucacggauagcagaagagcagguugguuucuuccuuauuguauauguacuuuucacccugcaacaugauacucauuucuguggaguauuguaauuaaugugcaucuauaguguguaauagguaguaagucauuucagccauuguuaguauucucugauuucaaguagaucauaauuuuuuuagaugauaauaaaaaucaauuuuaucuuacuuuucuuauuucugauuuuuguuaaucaaugaagacuacaacaaaauucuuuuuuaaugacacuuaguacuuagauaauguaguuuuaaggauauuuuacauuuuuuagacaguacuguagcugaaauguagcuucuccaaugucauguaugcucauuucauacauuuaauauagacuggugguuugcuucaugugaauauuuaauauuuacuuuaugguaacuauauaaauauuuuuaugugugaguacacauguauuuuguggaauacaauuauuucuucucucuuuaguuacucacaaaaguaugucugcaguugcucuuuucuauguaauuauugguaauuuucucuaguuuucucaucggauuucuagagagcuagcccauacauuuccuagugucuugacaacauaacuaacuucucauuucccuggugucacuucuguggccagccuguaucuuccuacuccaacauaauuaaugccucugucagccugaucauccuucuguuuggacacuuuuuuguauaaaauuugauguuacuggaauuuuuuaaaacauacuuuauuuauuacauuucaaccuuugcucuccucuuccaguuccccccucccacaguuccucauccaacuccuccuccuugccuccaagaggguacccucuaccaugccuccucucccucuccucucucccuucuucccucuuucccucccucucccucuccuacuuuucccuccuccuuucccucccucucccucccccaauccucccuccuucccccccuccuagauuaggugcaucuucuuccacugaagccagaccaggcaguccucugcuauguaugugccugggaccuuggaccauccuguauaagcugccugguugguggcucagucucugguagcucccuggggucuggguuaguugagauugcuggucuuccugugagacuggccucuucuucagcuucuuaaauccguucccuuauucaaccauagugguccccaacuucaguucaaugguuggauguaaguaugugcaucugucucagucagcuguuugcugguagagucucucagaggucagccaugcuaggcucuaagucucuucuccauuuuugucccugcaguucuuuuagacagaaacaguucuaggucagaaauuuugacuuaguuaacccaucccuccacuuuaggcccugucuaucugcuggagguggacucuucgauuuccauuguuggccauuuuugcuaaggucacccccauugaguucugagagucucucaccucccggucucugguacuuucuagaugguucccccaucucccacccccuaggcugcauauuuucauucauucuccugucccucugagcuucccuucuguccugccccccauaccuauucugcuuuucccuucccucucccccucuuccauccagguagaauggaucccucccuuugccuccugugauuauuuucuugcuccuccuagugggguugaaacuuccucucuugggccuuucugcuuguuacacuucuucuggucuguggguuuuauccuagguauucuguacuuuuuggcuaauauccacuuaucagugaguauauaccauacauguccucugggaucuggguuaauucacucaggaugauauuuucuaguuccaucuauuugucugcaaaaugcaugauguccuuguucuguauccaugcuucaguugagggacaucuggguuauuuccagcuucugguuauuaugaauaaggcugcugugagcauaguggaacauguguccuuguagugugguggaucaucuuuuggguauaugcccaagagugguauagcugggucuucaaguagaacaauauuuuuugagcaacugccagauugauuuccagagugauuguaccaguuugcaguccuaccagcaauggaggaguuuuaaccguacuagagaagaaauagaaaauguucuugcacucuauuguggugcccuuuauugaacuucuuuucaucuuuucaccuugccguccuucuucauagauugacauaauaguuuucugcaaaugggugagaauauaugguccaugucuuucugugugugguucauuucacuugaaguaauagccuugauauuaauccacauugcuacaaaagcaauaauauuuuauucauuuuuuuauggcaaaauaguauccauuguguaaauguaccacuguuuuugguucuuguccauuccuucacugaaagguauaggaauugaugacauaauuuaucuauugugaauaauuccgccauaaauauuggacauuguuuuaucuccuuugauuauuuacccagcagugaaauugcugggugauaagcaaaguugguuguaacguuuagaguaauuuaauacuguucugcgugauggcucaucugcuuuacauguuacucuggaguuaaauaguuacugauuuuguaaaauguaaguugcaaaaguaaugcuuauucacacuuuucugcaauagcuaaugauggagcuuggauaugaucucaugcuuuggaaguuagcuauuggugucauaucuagaaaaauauuuaacauugcauuguguguagacaaccuuucuacaacucaguaaaacugcaggauguuuugugguuuuucucugaaguacucuuguugauuauagaaaagaauggcuuuauuucuuuuugauccucccacccuuuucuguuuauuuauugcuuguccagauguagguaaugauaaugguaugacuaguaauaaaaguucacuccucugucuuaauaaaaaaaauuccaguauuacacuuuaaauaugauuugugugcucuuacaaucaagaaauauuuugagauuuaaucugauaucuuuuauuuucucuaugcuuuauauauaguuucuguaucuuaugucucaaagaccuauauaaguacuuuucauguucuuauaaucuuaacaaaaauaaauguauugauuaaaaguaucaaccaguuuaagcuugucuuuaguuguuuauaacuaucacaggcaaaucaguauugugucuuggcuuuuaaaaggagugauuuaauaaaucauuaacuuaguauuuuuaaaugguaaacuguauuagaaagagccaaagguuuucaguaaugaaccccacuguuaguuuuauaugcccuucuuuccucacagacaguugaggcuugaagccuuuuuugagcuuagaucuagacuaauaaaggguuauguaguuucugucaagucuuaaguuagaguuuucaaguucuuagacuucuuccugcuuuuuuuuucuuccuuccuuccuuagauuuauuaacucauuugccuaauacccaaugaaagugacuuuguuggccuucuuuucauugguaguaguguaacgucaauuagaugacauagguaugacuuccugcauuccauuguauuuugcuaugaaaggaaagauuauaauuuuuuuauauuaaaauaccuuauauccagaaacuaacuucaaaaaaaauuucagcaugucuuucuacuggcugcuuugcuuuaaaaacacuuggucagaguagcguguauguaucuggugauacacuaguucaauaccaaguugaaaagcaguuuauuagucucuauuaacaugauacucuacauccugcaggaaauggcagaauaguuccuuuugaggggaggauugagcacaaucccagauucuuauguauuuuauuuuuuuaaaaacauuuaaucgaaguuuguguuucucuuuuaagaucguugcaaaaauacauuuugaaagaacuuaguggauuuuccaaauuacauguuucacuuaaauuuauaauuuaauaaacagaugaaauauaaagaaaaacaaucuuuuguuauaggaucagcggcaaacugaagccauccacuugcuccaggcacaacugaccaacaugacacagcuuguuucaaaccuaucagcaacuguagcagaauuaaagcgggagguaauugcuuaguuaccuuguaagacagucuuccuaggaagauuguaggaagggcaagcuuguaacugagcaugaugguucaaagcuuaaaccaaacaaaacugauauuuagguagaacuugcuuuaaacaccaaaaugcauucauuauuuuauuguuugggagcuggguugagaguuugguaaggcauggcugucaugauuuggucuuccuauaaggcagguauuacguuaauucugucaggucuuuugaaaaaagcaguuuaguuugauuuuuauucugaacauugcaaaucauuggaaauuacuaaguaaagaaauuaucuggaucauuucaauaauguuuaccauguugagaaauuccuuguuugcuaccuugcugagaauuagcuguuuaaggacaagagcagaaacaagaaggaaacuucuuaggaggaggcaguugcaguaacuugggugaaguuaacuaagauuuuagaaguagaaaauaguaggauguuaauugaauuaaguauauauuuaaagagguagaaaauaagccuuaaugaaauaccagguaugugaggauaagaaauuuagguugaaucugagggguuugauaauugaguaguugaguuguauauguguuagcauacuaucucuaagggagagagugcagauggaaagacagacuagauaucaacagaauguuaaguggugagcuuaagucuaaggcauaaauguacuuacuguacugcuuuuauauuucaagaaagaguuaaauggggagagaacagaaaaagagcaaaugucuguaguuuguuuucaagcaccaugcucuguauuuaugauuucagagcaccuugacuguuuaaaaauaacuuguuugaauuuuaggucccacgguccauucuuuaaaguaguuuauaauuauguuuaucuuuucagguuucagaucgucagaguuaccuugucaugucuuugguuuuauguguugucuugggacugaugcucuguaugcaacgcugucgaacuacuucucaauuugauggagauuacauuucaaaacuucccaaaaguaaucaguauccaagcccuaaaagguaagguuaacaauauacuccacaauuuucuucuuuuuguuuuucucaaagaaaugcugagcagauaaagggacaugaaacuaaaauacuaaaaauaucauuguagcaagaugguaacuguacauggagauaaugcuauugaauaaucgagagaaacuaauaauauauauauuaagccuuugaauuauuuugguugagaaagauguuaaaauguggcauucaaggguggaagagaaguaagauaagaucuuuggagaagauuuguuuuauauuagcaauaaugguuuugcuaauuuaggcuuguuccauauguuaugcaggucucaaauccuccauuuaaauaggcuacacaguaaguuagaucccguauaaucacucauguguguaauguuuucuuaauauauuagguguuucucuuccuaugaugacaugaauuugaaaagaagaacaucauuuccccucaucagauccaaaucucugcaguuuacuggcaaagaagguagauuuuuauggauaugaucuacauauauaaacuggcuucuggaauaaguauaauguacaugcuguguuuucaucugcauccaaacaaugaaucaguuaucuuuguguuugugcuagucaaagccacuuuaucauuuucaugcuuuaaaacucuuuguuccuuugaaagcccaaaggguggggagggggucuuaguguuaauuagcaaugaguaguuuuguuugcacaugcuccuguuuagaaguauuucuuuuuagaaagggauguuugagaaaguucaacagcuauggaaacccugaaugcucaaugugcucucauagcauccugugcuuuucugccuccucuucuugugcagguaggaccuuuuuuuaucucuaguuuaggacguucaaggcacuuucauagcccagaguuuauuuuccuauuuuaguuccuuuguaauuagugcuuauuaagaaacuuaaaaauuuauucuuauagcaauaguaaaauaauuauaaucauuuaagggugcuuucuaaauaaugagcuguuuucccuuuuuuuuuagaauuuuaguuauuaagccaaguguuucuguuauuauguccuucaaauagucuuuccugaguuuuacuaguguaaguuuucacuccgugugccuuuauuaagcuuagagaauuuuuauaaacgcaauaugccuguguaaccuacauccuaauuaaaaaguagaaugcagucuagcaccucaaaaacugcuuucuuuguucuccucucccaguguaggcagcauuuuaacaucuaauuauugugagucaucaugccauuuacucuaauucuagugcaguauuccacuguacaaaugcugcacauuaacacauuuaccuauggacuauuuucauuuaggcuuuuacaugucuuuaagauaugcaugcaucugccaacaggaauggaaaugggcauucugggucuuagcauguauggcagccuuagugaauacuaacacaggguuugcuguggaugaccccgucagcuuugggugcuuccccuagcuuugucagguguucacauccuaguaaacauguuaguaauugggucuuguagucauucggauugguguauaugcguuucuucuuugagguauauucauauagcugugagauauguugagauuguuuuuguauuuauaaguucuacucuuauuuuaaauuaagugaacuaacauuauuuuuccucuaacucuuuaaaggcaaauagaauaggcuuuuccccccaauaauagaauugcuucuguuuuagacagugauguaaucuugacuuaaccuugcuuuuaaagaaagcugaggacaguagguggggacaguagguaggaagaaacugacaucaguccugauucugucccucccuccucuccucucuucuccucccucccucccucccuccuucccgcucucucucucucucucucuuuuuccucccucccucccucccucccuuccucccucccucccucguuucuuucuuccuucccucuuucucucuuuccuuuaaaauuaaagcucuucuuggaacauuuuuucggucugccuuaaauuuucccaccuuguugguauuuucaguucuuaauuuagaaagaaccaugucagauuguuuucuuuuuuuaagcaacaacuuaaaauuuuaaaaaagguagcaguugccuuuuccccagugagccaucucauuggccuucuguuugucuuuuaaucagauuuaaguagcauccucuuuuuuguuguuguuuuuuuuuucgagacaggguuucucuguguacucuuggcuguccuggaacucacuuuguagaccaggcuggccucaaacucagaaaucugccugccucugucucccaagugcugggauuaaaggugugcgccaccacgccuggcuaaguagcauccucuuauauauaauggaaaaugggauagauaagucaugugacaguauuguuuuacucugaauaaucuccauuguuuccaaauuacuguauugcuuuacaagccuagcaacaguguuccauuguucccauauccacauuuaugguaguuucugcuuuuccuucuaaugauagcuauucuaaugucuguggauuagccuacugugaaauuugcauuucuuuaauucauuguguguguguauguguguguauacauguggguguauauacauacauauauagaugcacacauguacauauaaauaaacauauacacauaugcuaguauauaaaaguaaaaguaaugcaugagucacagagcuuccuuucuucaugugcauuuucacuauccaucuuguuuuguuugcacuuucuguguucuaucuaggcagucuuuaugaaguccagaguccuaaaacuuaguuuuuuucuucuaguuuuauaaguuuagaucuguacuauauuuggaguuaauuuuuauauaugacauaaggguccauuaucucuguacaauuuauugacuagauuaccuauuuuucauugagaguagucuaagcauccuuguaaaagaaaaaaaaaaucacuugaccauaucuccacauaguguaaugcccuauuguuaaauauguuaaauuuguaugaauuuaugaucauuauguuuucuuggaguauuguaguccaauagucauuauguaauuuuguuuaaagucuccucugucucaaaugaauguagcuguucuuucuuuugcauuuaaaugaauuuuuuuaggugauauauaguugaauuucauuaccugauugacugguuagacuacugauuuuaaaaauuguuuugauguaguuagcuuauuaucauaauauuuucuauuuguuaauuuuuguuucuguuuuuguccuccauauuacuuacuuuuacucugacuauaguuauuuuacaugauuuuuguuaguauauccaacauaguucuuuauagaguuaaucuaaugauugcuuguuuaccauauacguucucaagaaccuaccuccacuuucaaacaaagccauaccuuuucacaaguuugguuauagcagcaaaauaauuaauacuacauccugccucucauugcaugcaaaauugcaaucauuuauucugcuuaugcauacacauacauagcuuauacacacauacaaaaucauguggauauuaauuugaauauacuuaucuguuaaccaguuaaggauaagaaaaaaaauuguuuuuuuuucuuauuuuuucuuuuugaauuauuauuuuuuuuuuugcaaggcagaucuguggacaacagcacucccucaauuuugcuuauuuaugaaagucuauucucuuuugaagaauacauaagcaagauaagaauuauaucugguuuuuuccccucaaaaccugaacuuuaagaagaaauuuacaucuuaauguuucagaucucacuccugguuuuuuguuuuuguuuuuucuugucauauucugcucuuaguaaguuuauguuucauccuaucaagauaugccauaguuauggaccauggacuuucuuuuaaauuaguaaaacuacauguguauagcguuuucuuuauaagaguaguuuaagucuuuacuguaaguuguaggaaugaaguuuucugguaauguuuuguuacaauuccaaaaauuacccauuuucccuuaaaugcuagucuguauuaacacacacuucgucggucaucugagcuuugcagggugagcauuuggugucgcagcagccugcugugcucuccuucuucauugucuuguuugaggcuuuuuguuuggaugaaggggauauucauuucccuauuguuacacuuaguugggaguuaugcacagucauuggucuuuauuggucacuuaaggaagguacaauuacuuacuaaccuaaagaagcuuuuuugucucuuucagaaccaauacaaugaucuuaugaaagccuuugcuuauccuguuuaauuuauauauuuuccuuauuauaaucauuuuuauguuguuuuaccucaauuguaguuuuucugcuuaauucuaucucaagguguuauauuuuuuauuuauuguaucuuuaaauuugucugcauauguacugaguucuuugguaugucuuaaaucuuuuuucuaagauuuuucauuugucauauuucuaaaccucugaauuacggguuuuuuuguuuuguuuuuuuuauuguuguuguuguuuuuuuuuuuuuuuuuugcuuuguuuuguuuuguuuuuucuugagacaagaucucucugugguccuggcuguccuggaacucacugugucacuguguagaucaggcuggucucaugacucacagagauccaccugucuuugcugggauuagaggugugugcuaccauaccgguuccuugaacuacuauuuuucuuuuucuuuaauccuguguuagauuuguugggcucuuagaucucuagauagguaucuucuuuuuuuuuaauacauuuaauaaaaauaauccauaguuuuacauauuuuacaucuguagaauauuuauaaguucucuucuauaguauuuaauauuccccauuuuuucuauuauuugccuuuggaucauuucuuucagcaguggaacuguccauuguucacuggaacuaaaaacauagcuucuugggcaauauuccuuguucuaaggccucugucuuuucuguuuuguugccaugguuggauuggacgguuccuuuaaugcuuccacugaacaguuuggucuuggaagcuggcauccagguguuggcccuggacaguuucugaaguccuuggucuucaaugccugugaggcugugauccuaguacacggguuaaagaagaacaagccuuggaugagauccagcaagucguccccagcugcagugaagauguguuguagugggaccccagggaaacucuuaaaugucacagaaucuggaaggcuacacaugucaggccacuguucuucaguugguguacccaaaguuucaaauauucuuguuagcugaucaaggucugacucuccaggcaaaaaaggaacccuuagaagcaauucugcuaauaaacaacaaacagcccacauguccauucccacaucauacauccuaguuccaaacaauaacucccuucauggcuucugcaucagcuccugcuuccugcccugcuugaauuccaguccugacuucccuggugaugaacagcaauguggaaguguaagccgaauaaacccuuuccuccccaacuugcuuucuuggucaugauguuugugcaggaauagaaacccugacuaacacaggggcccaauaccaucuggucacaacuugauguguguaaguccugcuggggcucccaaaugauuugaccaggacaaagucugccaguuucagaacuccauucuuaucuaacaagaaguccuuugguuucagaucccuguguagaauccaaugcugaugcaaauauucuaagcccugaaaagccaucaacauguaggcuugaaugugggauggugucagcacaagacuguuauccuuuauuauaaccucuaggucaguuuccauaacauccaagacaaggcuaauguuagacuuauguccaaaugugucaaggagaccaauuguguucggaugacuuaguuucuguaagagcuuuaucucccuuaaggcuguucuauuuauaccaccuuuagcuucugaccuguguccaaguuugauuuucuuaauggugacgauuugguugguguucuuaucucuggccuuauaggcuguagcaaaaugucccuguccgaagaaguccaguuuuucauagcguuucgcuugagauuuuacguccacagccaugagagugagaaaccagacucuagcaucuuagcaccuaagcuaaguccuccaccccucaggaauuuaaagcaucucuagauagguaucuuuuaaguaauggaaaauuguagcugauaguuuccccuagauauauuaccuaucuugauuccuccaucucuuaaaucucaaauuucauaaauguauuaauccaucuucauguauccucuuuaucuuguaaaguuucugucuucuuuuaaaaucauguguguguggcugugccuuuggaagccaacucacuccugagcugugaucucugagcugccuggcaugggugcuagaacucagcccucugcaugaccaacauaugucguuaauccaauccgccuuugcuuccuuaaauauuuuucaguauuuguuuuucccuaagccacagagucuaaagcuauaucuaaucuguucuuaaauuuguccaucgagucuuuuguuuuacuuaccacauuuuuuuguuccuaggagaucuuuguguuuuuuuuaaaagucucguuuuauauuucuugagguauuuuucugcuuuuuaguauuuaaacacacuuaaacauagugucuuuauuacccauguuugagauuggaauaauaauacaaguuguaauugauggggucauguuauuaauaaguuucugguauguauagcuuuaugauaaauuagugugugucagaauacaaguuguuuuuaacaaguugcauuggggugcaguuuaguagcucuguggagagaucugugcuuaucauuggagcagaaggugcucugaaugugcuuuugaguaacagaauuuuugaaacuuaggggugaaucuauagaugauuuccucaucaugucggaaaguuuuuuucaagagcuuguggucacauguaccguguucaaacucuuucuauauuuuagaguuaauaguuuaaaucagagcuauaaaagauuagagaaaaaggauuccuaaaucucacuuuauguucuucugacaucuaugauuccaacacgucauuaaugugccugucugacucuauccaucuuuuggguuaccuguaugcugcguguagguuuguccaguaaugccauuuuucucgucagguggggaaugaaucuggucccagagaacaacccuuacuguaucauuugauacuuguucauucaaaauguaaaauggaaauagacuuauguaaauguugguugucuucaggguugaugaccaauuuucaaauaucuuugaccaaguucaaauucagagcgcacuacucuggcuuacuaauuuucaguguagaaauaauaguuauccugauaccuuucauccauuucacuaauaaucacuaauguuguuuuggguguauuuugucauagcauaauccacuuuucauuuuauaccccuuuucuuuacuuauaguagauccgaaugauuuguacaucguagaaccccucaaguucucuccagagaaaaagguaauacucuuuuucuuuucaagccuauuuuaagcugugugguaguaaaugaauugaaauuggcauuuuauuuuauuuuauuuuauuuuauuuuauuuuauuuuuuauuuuaguugauuuggguaauuguugauguuuuugcauuuauugugucagugccgaaaggguaacuuguaggaguuacuucuccacccugugaguuuagcaccaagugucuuccugcuaagccauccugcuuuuugauuuacuuauucauucauucauucauucauucauucauucauucauucauuuaaagacaaggucucacauacacuacuguacucugauugguaucaaacucucugaagucuuccugccucaaccuuccaaaggcuaggauaauaggugggagacaucauacccaaccagaauguuggguuucuccccaccccuuguuuuuguuuguuggagauaaagucugacguaugccaggaugccuccugagaauggcuuugagccuguguuuguaccuucugagugcaggggcuaggauugcaggcagacguuccccaugcaguuuuaugcagcacucagggucaagccuggggcuucauaccuaugguacaagcccuuuccuaacugauuugcauucccaguucccauauguucauuuucagcggucauacgguauaaguaaauguuuagaggggucaucaaaccuuugucuaagaaguauauuccuauauuuaaagguuuacaaaauaaaacuaagaauucuuuaaagaaauacuuaugaggccugcaaaaccuuaaauauuauccaacccuuuaaagaaaaaaaaugugcagauacuuggaugauagucauuauuuacugagcugcucaugcaugccaggcacaguucaagcacuguuuauauaauccucuuacaaccuagcagugguaauaaucucuuuuuaaaaaaugaagacucagacagagucuguacuuagaugucccagcagauaguaggcacugcuguguaucuuccuaggauuccccccccccccuuugccuauaaagucugauuuucuuuuuuaccucucaauuuacauaauauuuauuuugacuagcaguaauugucuguaguagaauuucagauuagugcaaaguagcauuggauuuaauccuaacuucaguauuuacuauuuuguaauuuagguaguaagccaaaucucuaaaguuugauuuuuuuuuuuuuucauguaggagccaagggcaaacaaaccucucaggguuaacauauaugaaaguaaccaguauaacaucugacacauagagguauuuagauauuagcugucucuacuuaacucuauaugcacaaguugcuauaacuugaguugaguagcauuuacaaaggggaugucagagauacuaucuauucacagcagaaugugugugugugugugugugagagagagagagagggagagagagagagagagagagagagagagagaaugagagaauacuuguuuuacuuuucauaggcaaugcuacuuuccucuuacaucucuuaucuaauaaggaggaguaauuucuaugcuuuuauuucuguuauagaagaaacguugcaaguacaaaacugaaaaaauugagacaauaaagccugcagauccauugcacccuauagcaaauggagauauaaaaggaagaaagcccuuuacgaaccagagagauuuuucuaacaugggagaaguuuaucacucuucuuacaagggcccuccgucugagggcagcucggaaacuucaucacagucagaagaguccuauuuuuguggcauuucagcuuguacaagucugugcaauggacagacccaaaagacaaaaacugagaagagggcuuuaaaacgaaggcgaucuaaaguccaagaccaaggaaaguuaauaaaagcucuuauacagacuaagucggggucauugccgagccugcaugacauaaucaaaggaaacaaggagaucaccgugggagcauuugggguuacagcagucucgggacauaucuaaaaggagcugaacauuuauacugaaaacuuuuuuguucuuugaagaacagccugugguauuugaaggguucagggggagggauaaaauauuggggaaaguauucagaaauuauggguuuuuuuauuuugccuuuuaaaaaaguagacaggauugugucaaucuuggcugaugagcuacaguuuuacaaggcugaucucuuccuagaaggauggugauaggcauuuuauaaagauguguuuucacagauaauuacugggacaaaaguaauuuggaagcccaguuccuuggguggauaggaacgaaagccuaaaccucuccuucagcuugguucccguuucuugcaccuucccauauuuaugugccuuuugucuauuuauaaugccacuggaagaggagggagaacuuuuucugucauuugauuuguuuuguaacuuuauuagguuuuugaagcugcaaacacuacaaagcuuuaaggugguccaugccugaagcucagcaaugugggucauuugcauaaagauccuaaagacuuccaacuuagaaccgcucaguagucucacugaaauaaacacuuucucaaguuuucuaaaggccuuucagauaaaaaggugaugauuucacccuugguuucauuuaauuuaguuggauuggguuuuuuuucccccugaguuauuauuaacucaguaaaaugguaagauauuuucuuggaaaugacagguauuuggaauaaauuuauuauaaauucaccuuuaaacacacuuaacuauuugugaugauuucucuacauugcucucaauguucacaguaaacacuaauccuccaaauuuucacaucaccaagaccagguuuuccaugguccugucacugccuuuguacauagucacagaaccagccagugagcacgucaggccugauucagucuaauugguaaagucuaaugggauugugauuccuucauguuugcuuucguuggcuacaaugugcagauauguauguaugugaugucagcaucugucuucacuuguuuuuuuguuuuguuuugguuuuuuccuuaaguaauuggcagugucugaguaaauugauuucuugaugugugauuguacagggaugagugaaagugauauguguuuuagagagagaauugaccauuuuguguuguaaaauuuuaaguuauaauuuauugagcacuuuuguuaauaauuguuuauaaauuugucuaaugccuuuuuugguauuguuuguaaugugauuuauuuaaggccuuuuuguuuaaguugcugcuuuagguuaacaguauguuuuaggaaaugaauuuccccucucccagucugcacaauuagccauucagagcaauauggccuggugguacacagcaggcccuugagaaguccagaugugagccgagcuagaguggggagucacugugugcugugaaaggaggguuuuuaauauguaacuacagagcuguaguaccauuagaaacugugaauuuccaaauaaaucugaacacuugucuuuauuaaucacuggcucuucuguccuuuaaaagauugcaaaaauuuauuacuaacuuuugaucauagauuuaaggguguuuugguuuuugguuuuuguuuuguugggguuuuuuuuguuuuguuuaguuuuuuuuuuuuuuacaucuuucaggcuaaauaugacagcauugcucaaauuucaggcaaccacagucuacucuuucaccuaagcauuauguucguuaauaaucauaguuuaccuuugcagacucuaagcagacaguucugauauuuaguaagaugcagaucuaccuagagaacuauagcuuuagucugaguuuuauuucugcagauuauaacuacauguaagagggaagaaaacuaagcggcaaagucucagaccuuuaaugagagaagauucuugccaggagcaaauuuguguuucuaaaagguaacaaucaaacuccaaggguuguaaaauccugaacuucugaauuacugcucagguuuuuuuuuagaggauuuggauuuuuagaggauagcacuuuuggauuuuagauuuuggaacuaaggaugccuacccagcaaauauaauuaacagaauccgaaagucuucaaacacuucucaaguguuucagauaagacauacucaaaccaguauguaaaucugauuuuucaauauuccgugguagccaaccuuauauuauuuguaguguuaagguacuaaaccagaaugaaauaaaacuuacucaacucaagcaaau

SEQ ID NO: 461 - RNA, 7930 nt, Mus musculus
cuuuuccugguccuaaauucauugccaguucccuagucugcugcaaaugugccacgucaagacuggaaaucacagcccuuuagugugucucagucgaugcagcagacaggguucaggggggaagcugaacaagccccuggugcaggaagacaggcucuccccagccccgggacaggauuuuccacacaccgauggaagcuucaggagauccugcuccgucgccccaguguucagacuaccuguucaggacaaugccguuguacaguagucugcacauugguuagacugggcaagggccagcaacgccauggacggcuggggacacaaugugcugcuuccaaggagaggacagcugggugcuccuuuguugaaucucauauccaguguuucucuucacagguuuugcaaacuagggaccaagaagcccucagggacucugccaggggagaggacugcuccagggaagaccagcggguaaggccucugggauugcguaccuggucugugauuggggaacuagauagagaucccaucaccugugugaagacgcuggagacacugagcuaagggacagauaaccgugaacuuaacuuucaaaagagcaaggucguaugguaaauugugauuuucuguguguuuuuuauaagucuaaauguugaucguucaaaugcuuucuuaaauguaagggucuuccgcuucaaaauaaaagguggggaaaaaaaccucacuccagacaaguagcaaaaacugaacgagacuuaguuuugaaugguugaaacugauaauucagagacuuaaacucgagcauggaugagcuauguaugcaaccucuaacacuccaggaaugaaugcauuuugcccuaaaggaaaaaaaugcaauuuucaaaacucuuguaugaacagggagcuuuucuguuuaucuauauaauagaaacaccagaaauaauaguaccuaacgauaagaagcagucuagucuuuuguuuuuugcuuuuuuguuuuguuauuuuacuaucagacaaugcaaacgcacuuagccagagaugagggcccaagugccaaacccacaucuuacugacucagcaacuuagcaggccaggggaauagcgcucugucuuuagugggcucacuagauaacauugaaauuguucuucuaaaauccaagaauggcugauacuugcuggucagcugagccugcuggcccaucuuuuuuuuuuuuuuuuuuuuuuuuuuuaacaaggcucucacuuguccugggccuuugaaaugauaaggcacguugucuaaaaagaugcugauaaaacaggaauuuguaaacgaaggcaaaaguuuucuuuggucaguuuccagcuguccuggaggugaaggagagugggggagguaggcagacuggaagcaagaaaacuuccucuggcugaaugaaauacugaaagagaaaauacuagaagaaucugggucacuaaguaagcugggagguuuguauugagcaucagcgguggcuccguuaaagaaaguucugggagaaaauguugcugcuguacccauaaagucucgccuuucauuuauuuucaccccuggaaaauuucauuccacauucuaugggaugaaauauuaucugcucauugagcuuucugugcaaaacgaauacacugucuuuugucuuuuaaagugugaaucuuugucuaaguuacacauucuccaauaacccaaaggagagugcaaacucuccuuaguaaaauacuauaguauagcugcaucucugaguuuucuucuuacaauuuuuauuuuuaaaaaauuaugcuucauauaaucccaaaacugguaucuuggucauaaaauuuucugaugaauuauggcaauuaaguaagaaauauagcgggggacauuuaacugcuugucacuuaggugaaacaggcgaggcaccauucauuguucugugagaguugaagaaucuuaauuauuuuuaaaagaagaguugagauuauauauauauacacacauacauaucacuuuguuugcacaggaaauuaaaagcacuauuaguucacuuauggaaguugugugucucaggaaacacacuuucuugacuaacgcgucacgaaagaggacagagaagaaucacuuggaucauauuuaagauuucucuaauuuugagggccuauuguauacuagaaauaauugaauuuuauaacuugccuuuauuuaaugauauuuaauuuaaaauuuucucuucauauuaaaugcauuuuuuuuaauuucaagaagaauaaccuuucuucacaggucccuucccuauuucucccaugggacaguuuuuagucugaagauacaaagggcauaagggugauucuccuguaaguucaacaguaaaaaguaacaauuucuuuguaaacccggagucucugccuguucuugguuggaguucuaacacaccauuuucaaggaaaauucuaaaugaaugaaggagugugguacuuaauuuuaaauguaugaguuauauuaaaaguacaaaaaaguuguuugauaacccucugcuguaugaagacaugguguuaagccugugugcugguggauauaucccuuauagacacuuuaggauaaaaauaaagauaucgauuccaaaauaauuagaagaaugucuaauuuuauuccaauauuacuuccaaagaggauauacaaauauuuuagggaugguggaaucuagggcagaagagaguaaccagcagcaaacaucuugcucuggauaguaugguaagucuaaauagaaaagugaaacauuguaggugcucauaaaaaggaaacuguuugcaggguuuguccaaccuuaacguuagugaaaauugcacccuuguuucuuauuucagagaaucaaugauggauaagcuaggcuagguacugaagucaaaaagauuuuuuucaaccaucagagagaaaggaaauucuaagcugcaaccucaacuccaucacuucagagucuaauuucucaaaacaagguuuuuugauuuuuuuuuuuuaaccauagaucucaaaaucaaggaaaguuuguuuguacggagacaaagugugucacagaucgcucucguccaauuaguuaacaugcuagcccuccuuccugcuugcccuugaaccuuuggcuaggagaagguauuuguuuuuaaaagacaaucucccccaccuuuugccuauggaccacccaaguauuucacuccacgggaaagagaaagcuuaggcauaaaagauacuacgaaaauaaugugcccucucccccuuguuggagucuaaagcugauaugggaaaaagaaacugcaaguuguuuaaaaaguuuaaagagucacucauccacaaauguucauuaucacugaaggaagcuuaucauccagugagucuguaagggaacugcucuuuaaaaucaaccuuuucucuuaucucaugacaauagccuacccaccaccaugauguccaaauaguaacuaugagaccaucauauagagaucccagcuuaaaauaagcaagggggaggggggcagacucuagccugaggcaagugaagguugaaacuucccaaaucuuucuuucuuuuuuuuuuuuuaaccuugguguccugcagaugauguccauguaaauauuuagccucuuuucaaaggacuuaauacugaguuuccuuuuuuuuuuuuuuuaagucaucugaguuaaagaaaaucaucaagucuuuacuucauaucuucugacuucuugugaaagccaguuuauuacaguuggugugguucaaguuuccugcuggauguuuaggagagaauuauuuucuuacauuucugucuugggacacgacaccaucaacacauuaucacagacuaugacaacuacauauuaauguuugcaucuuuuaaguagucaccaaauaaguauggcuugggaaugcaagguggcgggagucuuucugacuuuuuuaacgugucuagagcagguuuaaauuauaaauuauaauuauaauauuaaaaauuaugaucaugcuacauauucacuauaaauauuuuuaaucgaucaaaaaauaaauuguccccaaaucucaugaauaaaauaauuauucccccugccaccuuauuuugauuaauuuuucucuucagaaaagccauuaugauaguuuagccucaaacauuuuagauagcaugguauaaauaaaacugcuucuuacugaaggauaacacauggacucacuguuuuuuguauuuuucaggcuguaccguuccuuuacuugagcagaguaaacuggaucagauuacuuaagggagaggggaaagcaauacagaauuauaguaacuuuuaauggcugcuaauauauucuucguaagugaaucacucuauuaugcuuuucuguuguacugaaugaaacaacaaaggaaauaguauuucaagguauuccauuuuuguauacuugacuuuguaacuacuugaauagcagccaagcucuugugcucugaaguguuggacagaagcacacguuuaucuucuugaacuuaaagaaguccagauauaguugcacuuaucaacucgguuaaaaggauaccaucucuaggcacugcacaaaaguucaaaugugcagcaaacuguucuuuuucucauucucaaaaaagauuuuauuguucauaaaacuucugccugcauuuuuuuuucuuuuuagguuuuccaauuaaagguaaauaaggaaguauuuguuuucuuuaaagauaaucucuaauguauaccucuuggauaauaauguauuuuguuuuuaaagaaauuccaauuuuuagacuuucaacucuuuggcuguuuuuguguuuaaaaugacagugaaguuguuaaauaucucugcauaugcaaauugacuaaguauguuaaaaauagcagaauuccugacucagcaggauugcaguuugcuucuguguacuuaacacaauuaauucagauugucauuuuggauaugaagugaacuuuccuuuucuguguuuaagguccuacucuguaaugauauuguauuaacaacaucaaaaacacauucagagcacuagugugggaaagaacauucuagaucaugacuuugauucauggucucacccugcuuguuaaucaagggggauagaagcuuaugaacucuuugguuuucauauggauauuauaaaaagaaaagaaaaauuuaaauacauuucuguugcuuggagagauauauauauccaaaaucuguuagguggauugccagacacuuuaggcucauuaauauuuugagaauggcugcuguuaccauguagauaacaauauauuuuuucaugggcaaggcuauggcacuuaccuacucugaaaaacauguauaaacauagacuuuaauuucacuauuaagagaugcagaggucuugugaaaagaaaaaaacauaugguuugauuacuuugaauucugacugcaugagggccaguaacaacaggaacuggauuuuaaaaguuuauguuguuauuuuuuuuuccuuaaaaucaugugaauuuucuguuuuugacaauuauccuuguuagcaacauuuggaucaaauguaugaguguacuucugaauaaagccaaacgucuaacuucuuuuuaguuccauaauguuuuaauguuuaauucuauuguguguuucucuccuuucccuuuaucccccuguccuuccccccuaaaucaccaaaucuggaaaacaggcugauuguaucugucccugagcaaaggaaaccugaaggacccaagggccuggcuggacagaguugucaugugucugccugucuacacuugcugugcagaacauccgcucaccuguacagcaggcacagacaggcagucacaugacaacccagccugaaugaccaccagccauugaaagaaagcugcccucacaacauagcaucuacaccaagagcuacaaccacagugaggggguuggggggccugggguuugaaacuguuggcuuauuaaaagaaaaacucguauguaauccuuugauuuuuuuugauucgcauauuaaaaccuacccgaaguaaagugaguggugccuaugaagccuaauaaagcccauuucugaaaaugcuccugugucugccaugguccuacugccuccaccacacucucgacauucacugcacacaccuuugcugccuccugacacugacgugaaaaccaauucgacaaaaccauuuggcuucaguuggauguuugucgaagaggaaauuauucugcugggucuugucuauaaaugauuguuuauuuguacuguaacuuuuaaguggggggggggggaggggagagaggggaaguauggagagaagagacagaauaaacaaguaacaauauauucuaaaggaucaaguauuucaaguuaacaaacugccagucuggccuggguaaaagauauuuuaaaauaucccuaguagauuuuucacucauauucaaauaacaguuucucuucuugggauaaacaagaauauugaaccgucaauauuucugagugcuauagcacacacagacuagcuaccauguugcuguuuagcuaagaaagcuuuucuagugcagucacagggauaaaauauagaaaucugauuugcuuacuugggaucuauguuuccagucacguaagcucucaacccaagauuuuucaaacccguugauaauuucaaaaaagcaaagauagcccugcaugacauauuuugcccuaauuucugaggaaauaucaaaguuucuguucugacaugaacuggagaaguggucagggcuggcuuuguauaugagcauuuaaaaaaaaaaaacaacaauaaggauaacaugcagagacagguaaauuuagaaaauuauucuauuuugaccuuguuuauuaacauauuuuaccuuucaauguuucacauuuaacuuuuucuuauauucuaaucaaguuuuaaaauuauaaucugaggcuaccccaaacuauuuuguaaugauugaaauaacaaucucaagcaaacugccuugcccacaggccuuucauuuuuaaaauauaagauuuaaucuuaaggcuaagaguucacaguuuccaaauuuucugaauucuaugguauuuguacuagaugugacacuauacuuucuuuaaaagaaagagucauaggcaaaacugugucaugaaaauaugaauaaaguuaaaugucuugcauguaaacaaucuggacucacagaaacuauaucccaugcaaaaaaugaucuguuuugccuuuaugaaacucgugaggaauuaacagggcuuuuugccuuagaggaaacucccaugaccacccaacagaaugcugaaugauacaucacaaaacgugaaguauaaacaggaaguauaaacuguccauaaggcuauuugcauaguccuacccaacuuuaaaugcuuuacaggaacugcagcagacacuaccagagcgcucaugaugaguuauucuuccagggcaggaauguaccccguucagggugacacagugucccagucagaacacgaaggaacuggggguuaacagggauauccagcauaauguaucaaauaauuuuuccauaaaucauaaaaaauacccuuaaaaacguuucugacucugcucucaaaagccuugacugucuuauaugcaccuuaaauucauaaaauaaggcacacuugagauuuuauccuucugggaaagggguaauauaaagaauguggacuuugcagcauuagauuuggaaacaacaaacaguaguagucgguuuguaguuaaaggauacuuugaguaauuuugaaauggcacuggccauuaccguguauuaaauaacacuuauuuuauuuccuaaaucauaaaucuuuggagaaugccaggauguggaaauaaucaaccucauauuuaaaagcacaauggaaguuacuuucuauaggaauaaaaauuacaaguaugaag

SEQ ID NO: 462 - RNA, 16429 nt, Mus musculus
guugaggagaaaaggguuuauucagcuuaaacuuccacauugcuguucaucaccaaaggaagucaggacaggaacucaaacagggcaggaauuuggaggcagaagcuaacauggagggguguuuacuggcuugcuugaaauggcuugcucggcuugcuuucuuauagaacccaggacaaccaaccuagggauggcaccaccuacaaugggcccuauugaccacuaauugagaaaaugcuuuccagcugaauuucauugaggcauucccucaacaaaggcuccuuucugaugacucuuagcuuaugucaaguugacauacgaccaggcaguaaaaaugcugaccacugauagcaacucguuccugguucccagaguguguccaaucagaguagacuucaaccucaguggccuuuaaaccagcccagauuagcuuccuaggacugcuuguggcaugcuacucugagcuuagaugaacucagacauuaccauacaguccuauaguucaguuggccuguagaagcuaggaaauguuagaaaacgaggcagguggucaccagaaugaggcucucugcucuucggucuccagcacugcuguaugcaacucuguuaacaacucaguuuuagccagugagguccaucuuucgauuucugaauuauaggacucaucauaaaaaccuaggcacacuagggauaccuuucuguggaucuacagggcuccaagaaccacaggggccacugcaugguguuucccuuagcauguguuaugccuaaaucacuucaaaaucuguuaguggucuuaaguucacaacuuuccuuccccagugccuguuaugcccaaaguuaggcacaacucuuacaaagaagggcucacaaggacccaccccucccaagaagcuguaugguuaauguuugugggguuggugguagaaauaaggcuccacagggcugugcccacucuaaguugcuguugcuugaguaaauaaacuccacucauggucauacaagcaacacuaauuaaaugcaguggccuaccaaaaaagaagaaaguuuugguaggaaaaacggguuuguugagaggaaagaugagagaauaaugggguggggaaauauaaucugagaacauuauauguguauguaaagaaucguguucuuuaaauuuugcauagucauuugccugacauuaauacaaaaacaaaucauucuuguuuuauuuguugagacaaacguuucucugugccuuggcuggccucagacucauggagauccaccugccucugccucccaagcacugggacuaaaggcguguggcaccccauacccagcaccaaaccauucuuuagugggaaagaugggacacaggaaguggcucuguguacauaaaaccucugcaaaagcuagugaguguccgaggacucagaggagggacugagcacaaggccagcagcuggggagcauggguccccagugauacaaauguccguugugugggaaaugaagcugaaaacugccucuuucaguuacuauaaaaauacuugagauaaaccaacuuucaagaaagaaaguuuauuuggcuuaguguggagguuccaggcuagcagugaccagacccagucacuguccuugugccugugguaaggcagggcaucaugaaggggaagauaugaggggaugaguucuucacuugacagcagccaaaaggcaaagaggcgggccagugucccaagggcccuucaagggcacaccagugacccaauuuccuucuacaaaguuccucccaaguucuaccaucauccaaaggagccaugggggcuggggagccagcuuucaacauaugaccuuugagaagacauuaaauaucuguguagccuuggcuguccugaacucacuuuguaaguucagacuggccuugaacuuauaaagauccauuugccucugccucucaagugccgggauuaaggccugugcuaccaccacccggcuuucaucaucacccccaugcugccucccaucccaaaaggugggaagcauguagcugauuaugugaccaacaaaagcaugaggucuaaaaguccugugcgucaugcuuuagcucccagcagcccaggaguucaagucaguuuggacagaaagcugaguugccuggccccagggcucacacaaucuucacagucuucagcauaucugacagaacauacgugucaucccaacccugcccaggcuuccgcaggguccgcuccaaaaccugggccauuuccaggagcucugguguagcaaguuucuguucuggaugcagcugacaaaacaggauuucauucaccucgccuucaauccgccggacauagaggagagggaaggcugccuugaguccagccagcacugaguccuuuaaccucacgucccgacacacgagguuaaggaugaagacgccugcagaguaggaagggaagaggaggcugagcagauccagagacaugcaucaaggagaaugcaaagucccgugacagggcagggaggcgggugagugagaaagccaguggaucugacagagauacagcacacagaagcauggggauugugaauacaugaaguguaagaaaacuucagccuugaugguuuccacaguauuaccauauuuuaauauuccccaugccuaagaaaucuuuucauaaaaaaguaauuaauaccuuccauaaaagauaaauuuaucaguuccacgaggauguuauauucuugacacacacaccaccugaguauuuacuauccagugaaaaagccaagguauccugacuucuggcaaccaagguucuauucaaccauaguaguauaccagaggccuuuaaaaugccaauaccuaggggguggaggacacaagugacaaagaacuggagcuccagcucugucaccuuucaagucacuucugaaagugggcuccugugaauacugaguaacacaaagccaaguucagggugucuggagucaccaagcugcuucagugugaacuacaaucaacaugggaacuggcuauggcacaauccacaaaagcugagcauccucaggagcccugcgcagcuccaggccuauguaguauccaagacagcugcaagcacgguuaccaagcagcacauucuagacuauuacuggcaauacuacuuuuaucacccccccaguggugcuggaccaaugaacucuagcauagucacaugauuccaguagcaauaaaaacagacaauauaaacacaaggcuaugguugaaucucacaaaccccaggcugagugaaaggaacagauacuuuuaaaaauauacuaccuaugacucugugucuaucaagggcauaaacuaagcugugaugaaaguuuaagaccaacccuuugagaggacgaguuacugaggagauacggagguagacuaccagaaugcugcaaacgucuguguuuggugcugggggauaguccguuugggaaaacuaagcaaaccauacauuuaaaugcaauuuuuauuaaaggauaauucacauuuuauuuuuuaauuauguguaugcauguguguggggaaagugcacgguguuggugcagacaccgacgugcagaagagagccucaauuccuugcaguccucugagauagcagcaaaugccuuuaacucuguacuagcucuccagcccaagcaauguuuucaaaggacucuuccuucccucccuuccaacccuaccguuucuuaccgucgugacacaggaugcuuuugaccuucugcaggaaaacuugguccacaaaugcugggggaggacagcucauccccagcgucggauccuuacugucuacaucaaacauuaucacaucauagugaggcggcgcuggggaagagaagaaagugagugcuugucuuugagggauaagaugacgucauuuaugcuucuauacacaccugcucugaaaccuaagcagcuaagucugaaagaugacgacgugaguacucugccugcugaagacaugaaugucaugguuuagaccagucuuucucauccaaguucaagcuauccuacaguucagaggacccuuccucugaaucuagacguguguuccaagggcagauauuaacaggcucauuccaacauggacgguauaugcuacgcuugugguuguuaaugcugcaaggagugaguauccccuggggaaguuucuacauacuuagacaaugugggcugcacauccagccaugucaaacccccaggggggaugcgggaagauaugagaggagccgagaagccuguggugguuuuugccagcucacuagguaaaucucaaaguauaaucaaaacugagagccagucaccuagccaaagcagcugucuaggccuuuaagggcuggccaagcauacaguaacugucagcagcaucaugggauccuauagaugaaguuguagaggcccaagagaccuacggaaucucucaccuuacagaaaggcaaugagcacuucauccuuggucuaagaaaacacugcacuggcauuucacgaccucacacgcugacauuuugucccaaguggcaguaaaguucccucccauuugugacaaccaaaaccaucuuggcagaccuugccaaaugccccugaggcuggaagccacugauuugugcaaaugcaguuuuacucuauuucugacuucaccuacagcuaaaugguguauuuaaaaagaaagaaaaucucaacauaugcccagcuauagacucuaaccagcuauagacucuagcuuccuugaacuggcagcaaguggcaagguuacaaggucagacgggaggacuaacggucuguauuauugguugccacagcucggaaaagcuaaauccauagccaaacgagcacacacaugaagcugacaggauguggaugcccgccacccccggcccccuggagaugaauuugagagaccccugcaggccuggcaaccuuggacuaccguuccguagcuaacacuccuccaaaugcucucucaucaguaccuucuccugccaggcugguaauguagucaagaccaucugcaaugugaaccuucauccggucgcucugugagaagccaaaccacugaguggccacuuccaacauuguggggucaaucucaacagcaucgaugcgggacuucgggaaaugaucgugaacgaagagagggaggcuaccuccacccagacccaccaccagcaaugucaguggagucucuguaauagaagaagaaaauuugauuuugugaucugguuaugaaaaaguucuauacagggaaaacaaaacagggaauuaagacuguuguucugcccagugauaaacauaagggucuugccucccugucucauccuagaaacugagaagccuccagacauuugaccuuuccacccuggccucauuuugaccaggucaggacaaugaaacaugugcuauguuguggucccuuacgaaccccaauguaacuggcugacacacuaccaagaguucccugagaguaacuggauagacucgcauccuagaaaacgaggcacaaccuuccacauagucauaaagcaaugugaacacaacaccccucacccagcucuuaacucaaagggccauaacuaaguuuucagacaccccaacaaaguaaaaauuaagccacucuaguucuuuaaagcacagaaaauauacaaccaaauccaagcgagaaccacaguaacacaagagaacuaaagaaagaaaacaaacaagccacuaaaaaaggcuagcccccgaaauuaaaucagcaguuagggaauucaggugaacacgccugugagugaacacaucaagcuuauuaaugauaaaguuaucauuuuaacuauaauuaaaauucauauuuugagccagaugguggugguguaccccuuuaaaacccagugcuugggaggcauaggcagucaggucuuugugaguucaaguccagccuagguguccuagaauagcaugaguuacacucugugggacagguuacacagggaaacccuguugaaagagagaaagaaagaaagaaagaaaaaaagagagagagagagagagagggagagagagagagagagagaaagagagagaaagaaagagaaagagaaaaagaaagaaagagaaagagaaaaaggaagggaaagaaaggggaaggggaaagggaaggggaaggggaaggggaaaagaaaaaaagaaagagagagagagagagagagagagagaaagagaaaagaaaaccugaacaaacaaaagacuuacauuuugugcucaaauauggcacuauuaaggagccauauauuacccaaugccguuggaaaugagaugagauaaauguacuauccaguuaagaugauuaaauuucacacaugugaaaauuuacaaauaacuuaaaauuuuauggauaacuuaaaaucuguaagcuucacauaccuuacuaauuauauuuuauacuuuaauuuuaaagcaaaauaaacagaaaggaaaacaaaaaaacaaaaaacaaaaaggcucauccccaacacgggcagcuaugucaagauggcaagaugucugaggcaaguuauccccaagcucacuaaugggcaugguggccgaggugagggaggcggagccuguggcagcugucagucaucugugacugcugaagcuccggagcagcgagcucaccucugcaggucuccaugcucagacuauggagggcagugguaucuuaccuaagaguagcucgggguuucucagcagggcaaggccagcaaccauggcuuuaugguguucacagcacagguaacucuuaucgauggacugcccuggggcaggcgggaaguccucagaaguaucagcaggucgcuguuuuuuccuguccuuuuuccguuucuucugggcuaaacgagagagucauauuacugaugucccaugcuucuaaggcuaguccuuggaaaucaagggagacuagcaauagggugcugcaacagcuuuaaacagacugaaagagccaauucucaaggaagcagaucgguucagacagccugaacuuggguccugaggaaacauuuaucauagaaacuggcaagcucuacaaaucagagccuccccacaaagacacagcuguuuuaacauucaccauacaccacugcauaccaaguggccggaaaagguacacaggaaaggcacauucaaaccugaaaucauaaauuaaaagaccuucugucugagccuguaagagcagugacaggagcuacagaaauguaaaggcacugcuaccuccacaccaauuccuagacuagcacuuuucacucucagugccucucauaacugcuuccacuucuuugccuguuuagaaacugagaaucucugguauucaauaaaguacccaguuguuagguggugcagguaagacaugaccuuaggacugcuugugucccaagucuaucaccuuccuaucuccuagacagcacacuacaccaucccacggaaaaggaaucaguaaggguuugucuaucuuguugauuucucagagaaccagcucuucguuucuugauucuugguacuauucuguugccaguugauugauuucagcccuggugugauuauuuccucccauccacuacccuuggguguguucgcuuuuuuuucccuagauuucaguguacuuuuaauucauuacuaugagaucucuccaaugucuuuaugaggacacguaguguguuauuaacuuuccucuuagcacugcuuucagugucccaugaguuugggcaugaugugccuuaauuuuucauuuaauucuagaaauuccaggcuagacagggcuacagaaugagaucugucaaaaaaauugcuuucgauugaaaaguaacuguuccuguccuccucuucucaaguguaacuucaucuuggucacagagaaaucugaaauuggaugccuuaauucuuuaauuucuuuauuucuucucugacccagugaucauugaguagagaguuguuguucaaguccagcuuuaauccauggugaucucauaagaugcaagggacuauuucaaucuucuuguaucuuguugaggcuugcuuugugaccaauuauauggucaauuuuggauaagguuccauguggugcugauuaaaagguauauucuuuuguguuuggaugaaauguucuauagauaucuguugauccauuugaaccauaacuguuaguuuuauuauuucucuguuuagauucugucucaaugaccugcccauuggugagagugcuauguugaagucucccacuguuaaugugugggguuugaugugugacagugcuggguagugaagaugcacaccuuuaauuccaacacucaggagguggaggcagaaggauuucugaguucaaggccagccuggucuacauagugaguucuaggaaagccagggcuacauagaagaaagccagccucaaaaaacgaaaacaaaacaaaacaaaacaaaacaucacaaaaacuugacaaugugaaaaaaacaugaaacuaaaacugaaaaaagcgaauguuuucuucagcaaucugacugaggugcggggcaagaucaucacaggcugcagccagaaucaccaaugagagaggagaugcucuaaagaccaauaauucuaccaguacuggacaagggugaauccaggaccucaggagucuaaguccuccuccaacuucuuccagccuugcugagggcacagcauggucaagcaaaagcaaugacugggaauuacggcauccaauuucagauuucucugugaccaagaugaaguuacacuugagaagaggaggacaggaacaguuacuuuucaaucgaaagcaauuuuuuuuugacaaaucucauucuguagcccugucuagccuggaaacugcuuuauaggccaagcuggccuucugaguacugggauuaaugcaauaggccacccaaguccugccuuagcuuacucuaaauguaugauuuuaaacucgucacuagacagagaagguagccagacaggcaagcagacagacaggcagguaacgauaauacaaacagacauagccagggaacggggcagguaaaacagacuagugaugucuccguuggugagauaucuguaacaucuuagacauaccuaagagugcuccucauugguuaagaacacuggcugcucuuauaaaggaacacaguucaggucccgcacccacaccagacgcucauagcugcuugcuaacucuagccccagaggaucaaaugcuuucuuugggcuuccacaggcaccuuuaucacaugcaugcaagugugcacauguguacacacauagagacacacuuuuuuuuuuuuuuuacucaaaaauaaaauaaaccauaaaaaaggaaaugagggcuccugagggaggucuggaucucacuggccaacacuaaaaauauuagacaggcuauggccacauucauuaaaauaugaaugaauucaaauucaagccagcgugguggcucaugccuauaaucccagcuuaggagacagaggcaggacugcugaaaguucaagaacaaccuaaaguguaccacuaucuuaaaaagaaagcacauaagcaaguaaaaaccaaccacauuccaugugcucugcagccauuuauauuuugggguuaccaugcuggaagcucagaaagcaagcaucuuccucacagcacacaguuccacugagcagugcugggcuggauggcagcuacagcacccaccucugaaucccuugaagcagccaagugagggagggcacacuauggaagagggcggggcuucaugcaaccuucauguuucugggucaucuuacagggguacaaagggaugcauguggggcagcuuaugaaacagagucccuuuaaccugaggcacuaaagccauuaucgggcuuacucagcuccaccgucccuacucccuucccuaucauuucggagcuagguguugcucaagacaggaaaaaguacuucuauuugcuuaucuccaaauacccugcccagauggugagaaaggagaccuccagucacauauccaggucugccuuccaucuugguugagcucucaguucuuuugaacacucuaacucgagaggccgccccccuccagcuggguuccaccaccacaccugugagagcucaccucugugagacguauccuucagcagccuggcuuccgacugcaccacguuccuguugcugaggaagaugagccgccgaaaguaccaucugucuuccccuugcacauccucaauaacauagucaccacucaaggcacuguggucuuggugcugcacaguccggaccccaauguccccacccacagacaggaagggcaccuaaaggaggagagugagauguggcaaaaacaucagcucauuuaucaagcaugugaucuuacccacccugcuuuaguaugagcacgaggacuucuccaggccaaggacagcacagcuccaaagacuugccguuccacugcagugcccuucugggccuuuugauagaacucgagaggcuugccccacuuuagaaacugcgaugaacacauagagacccccuaaccacuagagaccggcaccuggcgcugcccguaagcacauggauuccccacaggacaaugaggaaugagagagaaccaccgggaaggagcuguaaugugugagagggaaucuggacaaggacagaaauaacaaaagcccaggggaaacaacaaccccuccuuuccccaacucagucucaucuuuggcccaucugaccacaucucagaagaagaguacauucccucccauccuucugucucuuaaggaccuuaucaguauauuuuccaacugucaguaaucccugcccucgaagacacagugaugagagaaggucuccagagaaccuaggccuccaugagaugaaacucucuaagugauaacaaucccagcgucagagucauggucagcccagaugguaggaccacaggcucgaaacccaaggaaauccauugcuaucacgccgacccuccggagcccuggccuuccuagagcccaguucuuacaacagaccugucaauuucuuguggugacagaugucaacugguaaagccacuucuuaguauaacuuuguuuccuuuccagcaaugcuaacauccugaagugaguugguuggguccccuuucuuuuauauccucccaugauacuucugagacacaaaaugaccaggaaagugcacuucaaauguggaggagaggggcuggaaagauggcucaguggcuggaaagauggcacaagcugcucuucuagaaagccugggcucaguucccaguucccacgugaacaggucacaacugcccauaauuauagucccaugggaucucuucuggugugcagacauacacagaggaaaggcccaucuacauaaaauacauaaaucuuuuuuuuuuaaaaaaauguuaaaaaacaaaaaacaaaaaaacaacaaaccaaaucacagggccccaaccucauauauaaaauacauaaauaaaucuuuuuuuugaaaaauguaaaagcaaaacaaaaaaacaaaaacaaaaacaaaaacagacccccccccccaaccucaacaccuugaguggcucaucuuucucucucugccugggacauuuacucuccaaguacagugacucccuagacuauggucagauucuagucuuaguuuucuucuuuaacuuuuuauaauaauuuauuauuauuuaaugugcacugguguauugcuggcauaugucugugugaggguauaggguccccuggaacuagagcuauaaacaguugugagcugccaugugggugcugggaauugaaccuggguccucuggaagggcagccagugcucauaaccacugagccaucucgccagccucucaauuaauaauguuagcguaugaaguagugguuuuccugauggccucuuuaugugucucugucauaacgcuuugcucucaucuguuccacucccugguccuacccucuaaaggcuuccucuaccuuccuggucgcaguggaagcugcugucagaggucagaggucagaggucagaguuugguaccugcugcuggggaggcaacccagccggggccagcuccaugacucuggcugacaacucugcuugaaugcuuuccaugccagcauaccgcuggccucgguggagagccacugugaccaaccuccugaagcccgcacuggcugccagcugcuuccggcccuccuccaugccaaagagccacucggucucgcgacccugggggacuggaauagacaaaagcggucacagggagugcuggugaaauguucaaggcccacagucgaugucuacaagguagaaccagucgcugcucaggaccagcccccgucccgugacccacagagagguuagcaauucccaaagcaaagcagcccaucaaacacgaagcaggacugagggcaauucgaguguggguaugucugaagggaagaagacaggcaaggagcacgcgugugcgcgcgcgcacacacacgcgcguacacacacacacaaacgcgcgcacacucacacuggauagugcugcuuuuccauauuaaaaaaaaaaaaagcuauaugcaggccaggaaaaaagcucuuuacaaauacaaauaacggaauccucaaaauggcccaagguacacauggcacuauuuccaucuuugaaaaugaggacagagaagcacagaacuuaaacuacuugucuaagaucacacugcagugaaugcaaagcucagcucgcacugacagacgcccauugccaugcuucugauggcuccacuggucacugaggggggguaggcaggaaggauuaucaaauacuuggaaagguggcucaggucucaagaaaccagguuuccagcauaaccccaccuuacuuucaccuagaacguucacauuuucuuuacuuccaaauguucucaccccaccaucccuccggcaccuucucuucuuuauagggcaaacagcugacagucauacagcacuuaccacaaggccagcaucauuucuaagaguuuacacuucccaacuauacaggagagugacaguuccauuucauuuacagggaaaauaaggcagacaggaagcagucacccuugcuguaucaaaucaccaggaaguaucuaaagcugggacuggaucccgagagucugccccagagcuccauccugucugcuaccuccauacugccuccuuaagucugcagagcggcuuuccuucuggaguccaacaguauacacgcuagcuagaacucagccaagauauuccagcuggcaccgagcagcccagccuugcuuccauuuauccaauucacaaaguaacuaacccggcuaugaaauguguaaugggucuaaauuuacacuuacuaucuccugccuauaaccuccauucucaaacuuccuaagaaggaguuugagucuaagacaguuucagagagcuacuacucccucuucauuagaccuugguuaaucuaaccuuaagauaaacacaggcacgauauauauacacccaaucaccaauacccaagcccagcuccagcaagccagcccuucuaggggaaagaggcagagcaagccccagccccuuuaagacagcccuuccagggagaggcggagcaaucccaacucacugaugaaaauggcaaaaugauugucccgcgaugguuucacagcgggguuguccaccacguggaggguguagcguggcucccccguguccccacugcacaaguccagggacacacuccccagcccggcuuugcggcgcagcugacuacacagccaagcauaguacuggcgcucccgcacagccuccgccagcugaucagcacucuccagccuuacgggcuugcccugcuccugaguacacagcucaaagaucugaagggcagagccagggacuggccugaacuuagucaugacgaaggcaaagacgggcagggagaagcggggcucggcuucagacacccgguccuggcugcuggccacuuggugugcccucaccauccaccccucccgagagaaguggcccacugcuuucuucaggaugugagccugagccagggagaugcagagguagcgaccgcccaccugcaggacacggccaaccucagcuagcauccuguccaccugacgcagggucaccuccuccucaucugucaggacagcauccagcgugcccuuguccaacaccaccuggaauguggcgucaggaaacuccagcugggucauguccaucuucaggaaacucauguggggccgucggcugccauugcguuccuucaucugcuugaugacaaccucgcugaugucgauguucacgauauccugauagcccacaucauagaguuguucacugagcucugaguugccacauccgaucacaagcaccuggagggaagaaacaaagacaaaaugaaagugaccaaagucaagaaauccgcuucagauaccucaaagacuagagauuaguagacuuuggcuacuucauauucuccaggggcagagacacuauucugaguagaaagaagcacucaaguuaacucuagacaccaucuugaaacuagcaaugcaggugugcacaauccacggucuagcauagucaugccugcaaaaccaaacuguaaauauucuuaaaauauuguggguuuuuuuuuuuuugggaggggggcauugauaauuuuuuuuucuauuacuugauugcaugguucucaggccuuguagaugacaaccucuucuuacaaugucaaaagcuagacacacgugggagaaaaucacuaauccaaacaguauuaugccacaauaaaggucaugugagaacaggcugugugaugugcgcuauucaaaacuugugugcagccugagggacgguucaguagguuagaacuauugcucuugcaaaggacccaaguucaguucuuagcacagccuauaacuccauuuccagagaauuugguagccucuucuggccuccacaaacuuccuguacucacaugaugcacagaaacucaggcaggcaaacacacaucuacauaauaaaauaaggaaaucuuugucuugaaguuuguaggaaguuacaaaauccaaaacaccaguugcauccucauuuuuguuuuuguuuuuuuaaaccguuaaaaauauaggcugagugacagaacuguuucuaacugcucauacuuccuauuuccucagacaacaaacuaguuugugaggauuuggagccugcucccaucccagagucuaucucaugcuauuuacuacuugaagccaaacuuaaaaauacgaauuguuguuucucuuuguggcacauuccuccauucaucuuucaaaaauucuguugucaccgucucuagagggcaaagcauaguuccaugagaagugauaugcccuggagccagacagaccugcuuuuaaaucucuauuugaccaccuacuacaugcauggccuccaacagucacuugaaaaaaauaagugcacaacuacccgccugaauuuguugagauaaaaggcccgagcauagcagaccuuaagucuccuucccuaccgaagcuccaacucguccacaccuauuuaacuuggaauuuaacuuguguuuguggcuuccugcuccuguagcuugagggcugggcacaaagccugaaauuugaugagcacucggcagugacuuaauaaacauauacaccaauaaagucccacgacgcuaccuauuccacacgugugcacagugacacaacacccuuucagucuacugacgaagccacuauuccaaaacggguuaaggaugaaguuuuaacugaaaaucuuuacuuuuaaauggcuaucuuuaagguugccacuuagccaagaugcugggcagaauccuaaaaugauagaucugagugggguccccacgccugccugccuccugccuccuaaacuuaggauugcuaucuucaguccccacaagggacuggcugcacgccauaccuuuuccuugggcuuuauguauuugugcagcaccucgcacagcuccagauaggucccauaccacucgaaagcugucuucccucgcugcuggaagaacuucucccaguagucggcagagccaaacuccuuggagcuuuuagguaggagauucauguucccaccgugagcggcgucuucgacacugcuccuggugacagaucaccccgggaagcaccgggaggcagcagcggcgggaaucuuagccacuacaggcaccauagauuuguucugcacgcaaaacccaaccgaaccgggcccugugcagcagacgcgcggacgaaccacugagcuggccacgcgccgcugccgccccccuuguuuuucuucacccucgguccgcgccccacgugcagcagccacacacucccgcagcuacacucagaaccuagaaaccauauccggguaagagg

SEQ ID NO: 463 - RNA, 1345 nt, Mus musculus
gaugaacuaaguugaggguggagggcauaaggaggagguggugaaagaaaaggaggucgugaaagaaaagccaucagaagcaacugcggagggaguccaagcaggagaagccagagaccuuccuggcucccuuaagacucagaggaggaaggcccacaaagaacauccaucggagguccugagcaagcuacaccccuugcaguacagguggguucugugguucuucaagaaugaccgaagccgggccuggcaggacaaccugcagcuagucuccaaguuuaacacuguggaggacuucugggugauguacagccauaucaagcuagccagcaagcucucuuccugcugugacuaugcccuauucaaggaaggcauccugcccaugugggaagacaacagaaacaagugggguagccgcuggcugcucagcauugacaaacaacugcgccacuucgaacuggaccgucuguggcuggagacguuggugugucuggucgggaacuguuuugaggaauacagcggugcugucgugaacaucugcacgaagagggacaagauugcccuguggacgaaugaagcagaggacaaagccggagugaugcagaucgggcaaauauacaaagagcgccugggcaucccuacgaagaccauccuuggguaccaggcccaugcagacacugcugccaagagcaacaacuuagcaaacaaguuuguggugugagaccgguuucagccacuacuuggugggcacccuccucuugcuguuugauggacaacgaagacugcacuguggauucuggggcaggccuugggggaggcagacagccugguucuuuaccucucuuggaacacauauaagcaccacuccuuagauaaggucucaccuguugcccagguuggccucauauuugugggcuuaagccacucuccugcuucagccuacagaccugggacugccacagcucaucacugugccugcauccauaauaacuucuucagcauguuuugggcucaggccucauggcagcuggccaaugcuuauaagcuacucucaaucgcuagcccugcacguggccauuugccaagggcaggguaaagcaaaguccuggcucaaccaugccaaccaaggacagcagacuccugaggcaggcucuucugucuugggaggaugguuccaggccacugauauuaaggguuaggaguucaguucuccgugagcuuaaaggcguauuaugggguuacucucaucagaucuguagcuuggguacccauccuaaaaccuguuccuucccuggaccaguugugauuggguccucccucccucccucccuccuccccccacccc

SEQ ID NO: 464 - RNA, 6578 nt, Mus musculus
ucugaggauugauugaccccagauuucucaggguugcucaaaagaugguccuuuguuccuccucccaucaccaucccuuuucaugacagcugucuccuuagcucucaaccgugucuugaaaaaacaaaaguuaaaaaaaaaaaugccaucauguucagauauccauaugucagcuucccuuucugagcaagaacagaagccucggccuuucuauaucaguagacuccaaaguccccaccuuacucuaaauccaucugucuaagggaauggccucccuggaagucacugcagcaagauuugugcuugcacugcagaagcagcauugucuaccugggaacugcagcccagccucugaaaugaaccaugaacaccagaguggaugccagaggugggcugugacagguaccagucacuccuagaacagucugcuuuggacugcuuucugcauauacccucagaggcccuuuagcacagcaacuucccugguauuucuuacagacacaucauguuggcagagugcaucucuauaaagggacacccaacuugguugucagggcucaguugaugggagcagcuuaagaggaguugagacacuggcaagaauucuguccagcagccaucaagguagcagagggcuggaaagaggcaggacuauuccaagcaaccccuucuuuucugguuaguuugaaucuagcggaggaaacaauuguuuauuccuccaacaaguaaacaaagcaaggauaaauagaagcaucuguccaucucaacaaagaagggaauaacuugcugacuuguguauuugucuuguucuccuuugcuuucaucuuucuuccuauauccuuucccucuuuuccuaucugcuguucuuuucaaguuccuagucuguccaauaacuacuugagcucuuuucucucuuuaguguggguaucauuguuuguauuuaaaugucuggcuugcuuuuucaguucacauguuacagugguccauucugaauaauaaugaaaccucaaaggaagauaugggauaugaaaaugccaaggaugggauauacauauaaaaggcuuaaugaggcugagacaaugaaggguccuuuuauuuaaaagggugggggggggggcuaggauugugaaaagaggagguacccagaaguaccuaccuccuccuggggaacuugugcuggaagggauguuacuuccucuaggggggcuaggugggaggaagagguuuaaaaggaaagggagggugugccagacugcaguggggggagggggaauacaagcacuacauugcauaguuguaugaaacaagggggaagcuuuaguuaaaaagauuccguaugaaaccaaaaaugauauccaacccauuugaacaaauuacaaggagacaguacauuuguaaagggaaaaagaaaaggcaaaaaucaucccuccagaaguucaagaucugaaucuaaauauugaaugagugaaaugucaacucaagaauucagccugauuuaggagcugauccaugacuacaacaaggagacaaggagucaguggcuguggccuagagagaugugaaugagaaauaugucagauuuggggggugggggggagauuaaucauggaaauggaaggcucagaaaaucaaguuuaaaagucaguggaucuccuggcugggguaguguaugccuuuaaucccagcauuucugaggcagaggcaaauggaucaaaagucuaaggcuggccuguucuacaaaguuaguucuaggacagccagagguauacacagagaaacccugucucuaaaacaaaaacccucaauggaucaaguaggagaaggacacggguaaagugucauugugcuagcaauaaaggaaaauuauaacugcaacuuucaagaccaugacugagagagaucaagccugagucuuugguauagaagaaaaacguauucagcgaaauaguagcagaaaaucccucaaaucuaggaaaagaugaauacuaagaggcauuaaaaccccaaauagggaccaaugagauggcucaacaguuaacacuggcuacucuuccagagauccugaguucaauucccagcaaccacauggcggcuuacaaacaucuauaaagggauaagaugccuucuucugacauguagauauacaugcagauagagcacucuuacauuuaaaaguauauauagacuagggggcuggagagaugucucaguguuuaagaguacugucugcucuuugagagguccugaguucccagcaaccacaugguggcucacaaccaucuguaaugggaucuucuggcaugcaggcauauaugcagauagagccucauauauaaaauaaaaaaauaaauaaaaucuuuuaaaaauagacuaaagaaauagacucuccuugucacacaauuaaaauucuguuguagcucugauaauagaaugcugcaaagagaagcaauaagcuaaaaaggcaaauucacuagaauuacaugaguggaaacccuaaaagucaaggacauguagaauaauugauuuuaagcucuaagaauaaauagcugacaaacuuauucaacaaagguaucuuggagucuuuagaaaauaaggaaauuccaagagaaagacaaauuaaagcagcccuugacacuaaaacagcauacaggagaggcacuugcuggaaaccuaugcacagaggaggaauucgcgcucagaaaggaaagaucucaugagaagaauagccauaagaauuagaaaauaaucaaacaacaaauugguaaagccaguauuuuagucaggguucuuuaaaugaacagaacuaagaaaaugaauaaguaaauauauauucauguaugugggauuuauuagacuggcucacagggugugucaccaugcaaaggcuaagaauuucauagguguucagccuacaggcaggacaucucagccaucccaaucuggcuuuggaguccuggaggaguucugaagagcuccugucuucaguguguucuggaauccugaagcuggguuuacuacuggcagcacccacauagacgaacuugccagcgaggaugggggcaagcacagucuggauggacuccaugacuuuaacaggaaaacaugaaguugggagguggguugggucugggaggagauggggggaguaguagagaugaauaggauuuuuaaaaaauguacauguguaugaaauucucaaaaaaauaauaaaaauguuuuaaccaagaguugaucuuugaaauggugaacaauauuaguaaacucuuaacuaaauaaauaaaagucaucaauacaauuaagaaauaaacauaaaagacaucaggauaagaggggaggaaaggagacuauuuaaaagagcuucagaaacccacagcaaggaagaaggagaagaaaggaggaggaggaggaggaggaggagaagcugcuguuguugaaaacuugagagaaacaugagagagauguaccagagagaagaaagugaacagaacacagccccagccagcaggcucccagaaugcaggaagggaacagaaaucucauuuaaaggguaagccgcucagccuugugcaguucaccagagaggccauagcucuaaauccuccucaaacacaguugcagagugcucugacuggcagaauaaucaacaguggaaaguucuugcuccaaaggcuguggccaggggucagcuugaaagacagccuauugcuucgaauugagcuauccuaaggacuugagaccagagaacagucugcgugagacagcucgggaaacagcugggggugaggggugcugggcaaugacaaaguggggaaguagaagucauaggaaguuaauccauuucugcaagcgcaaugucuaggucccacccucagugccugggauaagaccucauccacugagaaaacugcagacugaucauccagagccugacguuagcccguggaucagcaacuggcgccagagaacuccgaagcgggucaugugacauccuuaggcacaucccucuagaaggguuaauucgugcuugguggguuuugaaacuacaaagaaaaguguguccauccauauuuugguacuguaauuguuucucacccucccccucacccucccccucccccuccccucccccucuccucccucucccucucccucucccucucccaaacccccaggugaaauguuagcuacugcuugugcccuacagaggaaaucuacaggaggaaagggaggcccagcccagaccauacgcugcaaagcugugugaccagcagaggucaguaguacauaaagaagggaagcuacuaagggcgaagccugucgaggccucuguugauuauguguuuacccaauauaggcgaacgacagcaugaauaccaaauucaacugacccucuuccccgccccaccaccaucaccuugaauacagaaguaaucccgacguuucaucuguuauucuuuuugucccuugaguuuaagauuuauuuuuauuucaugugcauacaagcuugccugcauguauguaugugaauauuguguccgccuggugccccaagagauccuggaacuggaguuacaagcagugugcggcuuuauggguucugggaaccaaacauugauccccuggcaaaagcagcaagagcuuuaaucacugaacaccccucucucugucucugucucucugucugucugucucugucugugucugucugucucucucucucucucucucucucucucuguguguguguguguguguguguguguguguguguguguguguguguguguguguuugaggaaggauuucucuguguagcccuagcuguccuggaacuugcuaaguagacuuguguggcuuccaacucaaagauccaccugccucuaccuccucagagcagggauuaaaagugugcacuaccaaccuggugugaaccgucucuuaagcacccuguuaucaucaucaucaucgccgccaccgccaccauaauauuuuaaagacucuuauguuuucuuucuauucaucuuuauacauuugucuacucguuaguaggcaaacguuuaguuguuguuguuuggggggggggcuuuuuggccuucuguuuucacacuuucccuuuaugcuuuuaguacuauuacagucuugccccacucuaggcuuuuaaaacuuuguggguuuuuccccccuucuuacauucauguaauugggguuauggacuucucucauuauuggggauuuuacauucuuuuuugaugucuugagcuuuuuccucuccuucagagcuuucuguucugucucuucucacauguuugcuucauuucuuuccccucucccugccaggcuccuuuauguuguccaugugugcuuccaugucauguacacuuugacguuguugcuuuugaagccaguugauuccucuauucugcugcgggagguuuaccccucaagaguagagcaggcuacuccguaagaaaaauacacaaagaaaauuggaggggauaaccagaccaacaaggaggaggaagggaaggaggggagagagggagagagaggaggaggaggaggaggaggaggaggaggaggaggaggagaagaagaagaagaagaagaagaagaagaagaacaagaacaagaacaagaacaagaacaagaagaacaagaagaacaagaacaagaagaagaacaagaagaagaacaagaagaacaagaacaagaagaacaagaagaagaagaacaagaagaagaacaagaggaagaagaagaagaacaagaagaacaagaagaagaagaacaagaagaagaacaagaagaacaagaacaagaagaacaagaacaagaagaacaagaagaacaagaacaagaagaagaggaggaggaggaggaggaggaggaggaggaaggaaggaaggaaggaaggauggauagauagauaguguggcuggagagaugauccaaugguuaagagcacugacugcucuuccagaggcccugaguucaauucccaggaaccacagaaugacucacaaccaccuguaaugagaucugaugcccucuuauggagugucugaggacagcuacaguguagucauauauauauauggguacugacaucuccaauacacugggguguuccacucaaacuaggcuucaccaauagccucucauaggcucucuuuauggugacaagccucaaauccuuugcaugaccccuucaguccugggccaucaacuacagcugaggcuauaccuucaccaguggccuuccaugaccucucaaagugccaagccucagcuguucuucaugacaccuucaugccuucaaaaccaguaccaccugggugauucguacacauuaccaaguccagcugcaccacgagguacaaccuuggcuaucucuggaacacagcuucuuugugcucccagaaaacaauucccagaagauuuuaccucggugaugcuggccucuucauaaucacugcuaauuccuuagcuccagcuaaccagcaucaauugucccaguaguuccuuccauucuuaacucuagagccagagccacauggcugaagcugccgaguucugcu

SEQ ID NO: 465 - RNA, 69836 nt, Mus musculus
agaaguaucagugguguuuuauuuuagcacaguguaguaguauguacaugcaugcagagacacacacuguaagcuauacaggcuuuucaucuucuaugaccuaaaacuuaggaacuuaagguuagaauauacaaaacaguugggcgacagugacuuaguaagaaggccaaugugacaaaacccucuuaacagggguucugacccugucaucaccuucuccugauuauucucuagaauaagccacaacauucagaaaaccacagaccuaaaaagcuuagccaauguccuugaauguuuagaaaccacaauauauugacucagugauacauauauuauucagugguuaguucugcuaaaauucucuagaagccuuuauguuccacauauagggauaaacaauuaaaaucucccucagcuuugccaacucaguaauuaacguuaaugacugugaacaugcuaaugaaaauacugagaaauacacauucagguccacuucugguccuuccauuuuuauccaagaaugguaagacauuuuuucuauuuggcaguuuaaaccaagagcaaucuuagauuuuuuuuaucugacucuccaguucuaggcugcccccgaccccgauuucuguguguaggccuggcuguccuggaguucacugaauggccuggaacucaagagagcugccugccucugccucccgagugcugggauuacagagcugccugccccugccucccgagugcugggauuacagccgugcacuaccacacgugucucccuagguuuucuccaagacaaggucucacacacauacagaugggccucaaacuuacuaccuagaugagaauggccuuuaacuccugaucauccugcugccaucuugccaucaaaguuugaucaucccaagaacagaaacuguaacuauuacccucaacaccaccucugacugagugagcuuuaagcuucuugaccucagggcagucccuaacucuuuggauaacggcuaggaccuuugguacacuaacaagccuugcuuccgacuuuggaauagauuagaaguuccaagacucauuauuuagagaauacuuuauuaguuuuuguaaucaaacccacguagauaagaccuuacauauuuaauacagugcguuaccccuguacaaauggaaaaaaaaauuaaguucaacauuucuagaccaauauggcuguuaauuucuguacaaugccaacucaacacaguaaacugggauacguuuuuccaaaguugacagcacagcuaaaguuuccaaaaaauucaaauuauauauauguauauauauuuauauuuauauaaaaagaccaauaauagcaguauguuaugcaucaauagcagcaacagcuuuuccagguucugcagucauuugaacaaaauuguagagacauccagcacacucuuaucaaaaaaaaaaaaaaaaaaaaaaaguaaaaaacaaaaucccagaaaacagcacaguucuguuacucuugugguaccuggcaccauuuuuuguuucuguuuuuuuuuuuaauuagcuucucaaucaucaucuggaaagaaaacauucugagcaacaucauuaaaaaacagcucugauaaagcacggucacuacuacguaucauaaagcagguacaagcuauguuacauucacagagguaugauacaguacuguccuacaucuauaauacuagaggagacaauuuaaaaggcauuauuugagacuugauucuauguuuccagcagagggcccaaaggauggugugacacugcucuguaaagaaacacucuuagacaggauuuccuuucacuagcggcacaguucuaaggauucauucucuccaugaaugucagcuaaaaaccgucauuaaaaaaugaacuaucccuaaaacaaaaccguauacccacuggauucauaugaagaugaccuaguggagacaagcuagaccucaccuuaccaacacguuaucaaauguuauguuuaaauggugagaccuccaaggaaggagacgccaaguagugcuucaaagcuucggaccacaaucaaacccagcaucauuuuaaauagaagcagaagcucuauguugcucaucugaguguguucaaggaugcugacaucaauauucaaucaucugcucacucauccaggaagaggggagaucaguuacuacuguacuuuauuguguucaaccaaaucaccauguuacaaaaauagcaagcugccguaauaaaagauaaggcuccucuauccagcaccaguuagcaucauuuuacuuucaagccuagaagagccauagacacauccaaagaacacaagggagcagaagagccacagcugauggauucaugggaccacccaguguccagcugagcuacucugugguaucuaucgcucuccuccuccuacuucugguguuucaugcuccuuaggacuaaacuguaugcacuuacagacuguuuacguacuuguauacaaaccaacugaagaugcaaauguuacaccggaggugcgagccuguggagccucacugugcagcagcucugucacuguaaaugcucuaugccccuugugucucacaggaugaugucacagaccacuuuaccccuguggcugcuggcuggcauuauuugacuucacuuucccuacccacccauccccaauaaaccacagccuuuacgauuuuguuucuucgguuuugauggccugagguuugauugguccaguucuaacagguuuggugguuauggugggugcaggggguggcuuuucuucuacuuuuuccggacaggugccaggagggucacucagcguuucaggguuacuuguaucacuguccacucucuggguuuugccuccuaucuguuuguucuguugcuguucagagaagaaccgcugcguggacugaagaaccucugcucucugcuuugccuuuaaaaauaagaaaacaaaaacugaaagcacugcaacauuaccuaacauuaccaaagccugucaaaucaaucucaguucaaauuuuuguaccaaucacaaaaaucaguuuucccuaaguuugugccccaucgaucuuucaguuuuuaaugcauagguuucuccuagcucugaaaauauucuaugugauuuaaaaaaaacaaaacaccugaaacaaggccaccccccaccaucuuucuagcgucugcccucuuauaaacaauaaaauacacauugcugccgauucucucucuuuugggaacagcucacuaauaccagacuuuauuggggaggcugcuugcacagucugaaagcauacauguaacguaacacuuaaaacuucuaguuaucaacauguggucuacaauagaaugaaaaggaagcacuuauauuguggcauuaccaacaccuaggaccaaaugucuuguggcugaguccucuucccacagcucucuucugcaggggaagagcaucagaaauuaguaacuacgacuucacuugaucacuaaguucugauagcuccuaccacauucugagcugguaaauaauccguuucaaugacaaugugccccaaagaauauacuuacauuaaccuguaauuauagugcuauacuauauccaauuaaacuuaacuuucuacuccuuuugcauauaauaaaaaacaaaacaaaaccaaaaaccacaagagcuccuucauguucuacugguaaaccuauacuaacuaaaacaguuuauaagaaauuuauacucucccaccccacuaauauuauuauguucuaaugucauuuuuuaacauaagaauguuuaaagaucaaguggcaauuagccgggaguggaaggcuacacaaucugcuaagcuuuuggugcaagcacuuuuuaguaguaacagacagacggaaacccuaggcacacagccuaacaaaacugaguaauggguccuaggcagucuccuagaggguaaccuuuaauuggauuccuaagcuuuagaaacacgaagggacuuuagucaguuaacugacuucuuuagcaguauuaucacaaacaugccucuaacucagagugaagccuuacugugcacacuccugcucauacgcacaaagcucaucucugcucuagccuaaucuacguggugagaaaaccgcucuugaaucuuaaagucagcccuagguaguuagaaaaacaagcucaaauuggcuguauaggaagacgggugagaauuaugcuaaaaacuguccccacacagacuccuaguggccucagcaaacccaugucuguuugugccuuuuaccaugaaggaucccaaagugcuuuucugaguucaucuauaauugcauucuggaauauggccaccacagguggcaugcaaaaaaaggauguggaauguuuaagaugaaaauuacucaaaugauuucugaagggauaagaaucaagguagcuaacaugucuuacccauuccagaguucacaaaaucaugauuauguauuaaguugggauggggagggagggcaggaagguaggaaaaaaaaaaaaaagggaaauaauacagggugacugguaauaacaauccauauuacuuuuuuuuaauauuuaaaauacuguauccaaacucagauuucccucagauacuuauuucacaagcaauccauuugaauauaguuuaaaauguuaauuuguuuucugacuauaguggcaaaggaaggggucauaaaaaggaggaaaagguaaggauggaagggagaaaaaaaacaaaaacaaaaacaaacagggggcugggaugaacaaaaagcaguuagcuugguuaagucugguaaagacaacgaaugccuggauacacggcuaugggccagggcauuuccgacaggguucagagacagacucuugcucugcuggccaucaauacuguacuaaccuucagaucuuguucagccuucaacgcagccugggccugauuaccucugacuccagacagugauccacaaggaccccuggcuacauguggcaaacgagcauggcucaugaggccuguggucagcggaggaggcaucugacuggccagugccauugguggccucuguacaggcgcugggaagguguuaguauguggggcucuuaccaauggagggaccagguuaggcugagagagaaucugagugaaaaaaaacaaaacauacaacauugaacuguuaaaaaaaaaaaaaaaagaaaaaaggaaaaaaaaaaaaaaaaagaaaaaaaaaaagaaagaaaaaaagaaaaaaaaaaaaaggaaaggaaaaaaaaggccaacuagaucaggcuggcuuaucccagaguaaaucugugcccauucugccaguggaaguuuuuggaucgugccauuccauuaauaaggacaaagaauaaaugggccaugcuuaucaaguuuaacagaaaaauuaggcaaagcaugcuauggcacuucagauggaaacucuaagggguagagagaaagggacaauugcagaaaagcccacuucuauacuaaacauaaucugaagguacaguuacaguaacucaacaaauguguuccuugggaaccaauccuaguuugugacuuacuaaucuuaaccagucuccaaugauucagccaggggaggagaaacucaggccugcacauuauuucccgcaaacuuucuucaacugugcagguagcauaaggaccaaagccaccugagggugggucuggaaaccuaagcacggggacccugcacugaaaaucaaacugcuuccaaaaagacaaaagaaacaggauugaaacugucagagccguguggggaucuugagcauuucucaugucugcuauaaaacuaaacuacuacugcaucuauuuuucaguaucauauuuuuaaaaccagacaaguuuucauucccaggugcacaccguaacugcucaccuacauggugacuguaaagccacacccuuagucaaaccagccaucauuacaagcacuguacucacccccuggggucugccuaccuggggugcaaacugugcaggaaacggcugugccaugcgcacuguggcgggggcugacuggaacuguuucugauacacaacacuguucauuuugcuagacuggcuguuuggacuuguugauguagcccuuggaaaagaagucaugguuaguacaguagugccagguaaacaaugcugcugcuacauuuuaaaggcauuuacguuuggauuuccaucacauuuaguggcugaacaugguaagacuauuaaggacagcaaaaguaagagagaguuccuauacuuguaucaacagaauguucuugaaauaugguguucacacacauacaguggaggaaagccaggucuguguucacucagagaugaugcaccuaacccucaagagacuggaggccccaggaaguuuagaggucagguggggugggggugaggacauccacguggagacuggguggggagggcaggggaugugggauguggagcaaaauaaagaaaaaagaaaaaaaaaguaacgguguuaacaucuuagauaaaauuaguaaaauaaauguuuuaauaacuucuguuuaacauaggauuggcaacaccuuaaggauuuuaacaacugaauuuuaaaaauuucaaaauauuauguaguguccuaagcagauuuaaauguccaccuuaccugaauggacuagauguuggcguggugcuucgaccaccaauuggagguguuccugguuugauaucaaugccacucccaaaggcuuuuaguuccauuucagacaucugaagaaaaaaaaggcacaauaaaguuaacauucccucuaauucugugagcaauguguugugcuuaaugaugguuaaacuauaaagugguuaaaacaaaaaccuuacuauagccaaaggaccaagcagccugauaggucugagaaauuuaacgucuaaugcuuccauaaaaaacugaauucuuuguuauuagacaaaacuaagaaguauaagaaaaguaguaaauaauguaggaaaaauaaaagcauacauucauucucuugagguuuucugugggguuguaaaaacugauguuugauuuauauuagaucuuacuuauguacuuggugugugcacacuuaaucacccucaauacggaggccaauuuuugaauuaugaguucucuccuucuauguggcuucguggcauugaacugagucuugguaguggcaacuuuacccaaugagcaaucuuacagcccuuucaacacagauauaacaagcacacagaucuauuaucucugacacccaccaguuauacagccucaugggcacuaaccaagcuucacucacuuuuccuguggucgccaucaugcuaugcuguguuccagcagggauuaauccucggaaaggcuggcuuacuugggcaggacggcucaaacucugagccugugcuuguggggucgugugcuguaacuggggcugaagugucugagguaaagcaaucagagguuguccuguagauccaaaauucgucaaggaaagcugggaugcugguaaagguacuguaaccuagaaaaagaaacaaaaagaaaauguaaccauuugcuuguaauuacugugugccugugucuaaauaaauaccaacaaccaagagaucaucaaauuaaaaauguaaguaaaauacuuucaaauauauauaguauauacaaaucuuuuagguuaaguaacuagcucugcuuucuccccuuuaagacagggucucacuauguaguccugacugguuugaacucacagaaauucgugugccucugucuuccaagugaugggauuaaagguaugaagcagcacacccagcccaucagcccuaacuauaccuguucuuguaugagaggugggacaaucuguugucuuacuagucuggagaaaugugggauuuggugcuuucauuaucacaccaaggucaagauuuacaguuuuguauauguuaacuauagugaaaaaaaccguguauuaacuuugaauauacucagagcacaaaucaaauaccagaaaauauacacuuaaaaucgcucaaguuccuuucaccaauauuucuauauuauuuacagguuucaccaaauugaguguuuauaaguaaaaggucuuuucaguuuauauaaaacaacucuuacuugacaguaaguugauauuacugucauccuuacaaaagcaagcaaaagauuaauggcuugcuuuucuccucuagccuucuaccagaaugucacuucccauugaaaaguccaauuauacuagggcauuuaagaugcugcccuuagugcuacucugcuacauuauauuaagccaguaaagaacaucccuccauggcuucugcaucagcuccugcuuucugaguuccuguccugacuuccuuuggugaugaacagcaguauggaaguguaagcugaauaaacccuuuccuccccaacuugcuucuuggucaugauguuugugcaggauuaaagcacuaucuuagagucuucuuucaccuauaacacugaauguacuauauucuuuaauaaaugauuuucaaaauuccauaugcauggauuccuuucuuauaaacccagcuuaaauaaaccaagugaaccuagaaugcagugaggaggaggaggagcuguuacaggagucaaggaagcgccuuccacuuccaauagaccuaaugggauucccacgacauuccgguguacaucugaaaaccaccuccucuaucuugguucuauauaaaugucaaauuaacaacaaaacaaucaauacaaagaauaauauagaaaagugaggaaauuuaccaugccauaguuuaccugcuggagagcacugggggauugggcaguguuauaaaaauuugucugaccaggcugcuguacuuguccagaguaaagauuugaggcuugaguaagauuugcucuugccuagaaaaauuuaccaaaaaacagaagaaaaacugagaagaagucccaggcaauuuguaucaacauuaucaucuuaagaggaaagaucacagccaggcaugguggugaauaccuuuaaucccagcacucaggagacagaauauuuagcuuguacagauauuuuucuuuguaaguuaaauccaggcccaaaggaucuggguuuaaaggcacagucuuaccugaagaagauguguaucaaucagcugagaacuuccuaguccugaugccuggcccagcugauggucauacaguauagggaugggcugaggauuugaagucugcugaaaggcaagaccugauugugccuuggcaaguuccuggugcuggacagcugggaaguuguggauagcuguaccagagaggaccacggaaggcugggaaagacugcucugcauaaaggcuggcugcgaucuaugaaaaguaucaagcaggagaaggucaugcuauacacuaauuuuauuuagaauugugaaaaucuugugucucaaauaaccaaguacucucaaaucaguaauuaagcagggaagagaaggucuuugacuacuuguuucaagauuaacuccuguuugcaacagaacuccaaauacaaaaguuugagggaaaagacugcucuuggcaacgaacaguuuacauguuaccuuuuaauuauaauaaugauuuacauuuuacauguucuguacaaaacugagagucaaacuuaguuuucucuuuggugacguuacacauagucuugagaccaguaugggagaaaguaaagcagcagccccuucuaacugcaguuuaaucacucuuuaugacccaggcuggcccugaacgauccuuuugcuucugccuccugagaauugggaaucuaagugugagucaccaugacuagauaaaaaaaaaaucacucuaagagaguucacagguuaugaaaauucuauaugaacaaaguacaagaacaaaagaaaccaagacauaguugaaaucaccaggcacaggcuugaaaauauaauguacacaauuauuuaguuuauaaaaauaggguuuggggaaaagaaauuagcacuagauacuucauaaccuucaauuguuuuauuaaaaaugacagaaacaacuuuuaaggcaauuuaccuguaugguugaauugaagaacugaauaauuccugagccugugaaacagcaggcccagcccccaaacucagcugggcuuggugcugcccuugcaguggggcauagauagggauuggaaucugcugaacugaugucggcugcaaugcaauaaaaagaaaaugcacauguaauauauagacacaaccuucauauacacaaaauacaagacugggaaaauaaaacaguacuccagacauaaaaguaagauugaucagcaacuccuuaaaaccaauuuuguuuuuaaccugugacuuacacugguauacuaaacucugguaaugugggaaucaaaaaugucuccaaguuuuguuaauagccuauucaagguaauucaaagccgauuuuaacuuaagugaaucuaacacuaaagcccaagacagaaaagccauaagcaugaagaacuacaggaccaggauguuuaccugcgagagaccagguuggaagcccugcugcugagccagggaugguggagccaaucgcgcaugcugcguauugaauaaaugacuuguauccauauagaaggcugggauuugagcuagaccaucagaaaaaacaaucacuauuaucuaaauuucaggauuuuccaaguaguaaaccaaauuacuuauagcaguuaaaaaaauuuuuuuuucuggccaauuucaaaugugagcauucugaaaagucacugaaaaagcauaaauguaaaaagauaucaaacuucuaguagaaaagugcauguaaauaaaacauuguaaauuuggugcuacuuggccauacaaaauaaaugcucucauuuguucucaauuagcuacguacugguaauauuucacacaagaaacgaaccugaccacugaaccagcaaaucuacuccaauauuaaacuacagaguagaauagggcaauauugaaaacaauuagcauuuagugauuauuaucuuuccauguuuucaacaagcaauugugaugcagguaggaauuaggacuccuaucuauaauacagucaguacaugcuuuaguacaagucuuagcagcuucuuagaagaacuucggcuuuaggugcuuuaugcauuacugguaauacagcaucuucagacaccaggcauuaacagacaguacugauagugcagggugacaacgggaacagucaccauacaguguuauucuuguuugguauacguauguucucucuaccaagaacuucauuauguauuauuuuucaaguaaugaaguuuggugauuguagugaaacugcagaacauggaucaauuauguugcaaauuauaagacacuaacuugucauaaauguagaagacaaaaguggagacagacagaccgacacccccccccccacacccacccacacccacauacacccacaccacuucuaaaaguuccagaauucuugucauggauggaagggacucaaaccuagaaguacaccuggaaaauaaauaaaucuaagcagcaagagucacgagacgaaaagagcauacagcguccauuuucuaaauuucuauaaccaccccuagaaaccuuaccugcugcagacugagacacauaaaccugcgggcucugcugcugcugugcaaugagggaaggcauacagcucaacugugaaaagugacuugcagaagguaggcugcuggucuguaauuguugggguuuuacuuuacaaauauucggaggguccgaagugguuguagauuuuguacucaaugaagagguaguguaaguaccagcuccuguauuugaagaaaggagaaaaauguagcauguucacucuucugauucuaugggucccauggguuuuaucuacaguaagucuucaagcaaccacagaacaaaaauccuugaggggguuggagugucucaggggcuagcagugcacugcagaccaggcagcacaagccugcaauccuagccaugguacuguagucuccauacucaggagguacaggcacaaucuuauucucaccuacagaguucuaggaauacaggugaccuugucuugaaaagggaagaagggggaaaaaucaugucaguaugaaggauggacagccuuuuauccuugucacuguuuguucaacaauauaccagagacaauuagcuugaccugaaaauaggccacuggauuccaaagaaagacugaagaccuuuucaacucauccuaccaaguuccuguuuguuuaauaccaauucccauuaaaguagaggaguucaagguagucuaaaaaaugggcaguggggaaugacuagacaaauuuuaaagaaagaaaaaaaaaaugucauuagggcacuauuuggcaugacauuacaaugcaggaaucaucuccaaggucuuuucuuucauuuucguuuuugagacagugccuucauaguugucuuccugcuucaauccaccaagugcugagaucacaggcguauacuaccacagccacuuugggauugucuaaauauacuuauuacagauauuagaaaaacugcuauaggacagcccagacagaccccaaugguagagugggguggauucuucaaaucaguacaauggcagaauaggcaaaagcaaccaaauaaaaaacaccaaauaaaucaccaaguaaaaaccacagcaagcacacccugugcgggcauacuucucauccacugcuuugggaacaucagggacacuguagaagccugggauaaagucugcuuugaaacagaagcagcauggcuagggaacgggaugaacuucccuacaaauaagcauccgcaaacacuggccauucuuuagaacacaaacuguaaguaaggaacaacaguucauucuaacuccagccugacaaaguuuucccaggcaucaaacaguaguaacacuacccaccuaacuuuucauuagaaaauauaauuuauuccauuaauaccuuuaaaucagauauacuaaaaaaaaaucuuuuaaaagugguaggaauuuuuuuucugaacucuguguuuaauuacuuggguauaguaaaacugaaaacaaaagcaaaauuuggaagacaggauuuuaugcaaugagggagaauuugguaaaaucuuuccuacuaagcaaucaauaaaauagucacauuaaaauucugagacagaaguaaaagggcaaguaagagaagcuguuuucauaaaguauuucgucugcuugggagcagcacaucauuuaggcuaggggugugcuucagugguacagugcuugucuaggaauugccauuaggcaaucaaacaaaaagguauacaggaaaacugugacacauuucuaccugauagugaugcuguaggagugacugacgcaacugggaucugcggcauugaugcacuggaaaaggagcuguaauuagcagugcuugguccacuggcacugcugcugacuccgcucacaaugggaggugcuguagaaguuacuggggaccccuuuucucguagauuuggagaauucucccaugccuuccgugcagacuccaucugcaauaaaauugacgucuauuaaagcaaacaagguaaaaaaacaagaaaaaccaauagacaacacccucuauacccuaguacggagauucuaaauagugucagcacgagaguuuucaaacuuucuacccaaaggguuuuauuuauuuauuuauuuauuuauuuauuuauuuauuuauuuauuuaacagagcuuauugaaagcuuugggagauacacauugaaccauaguuaaagcacuuaucaaaaaacaaauggcccuaccucccaccaguguaauaaagaagaaugggucuuccaugggagagacuuaauauucugccuguugucagaaaaggccuuauauaacacgguccccuguuccuucuuuuuaaaucaacacuuuucaaaggcacauggugauguaacagggcaaguacugucuuggacauauauauuuguggcccugguucacacggauuuucauguuuuaaaggacagaaugagaucuuuaaaauggagcagcagugccuacuaacuuucagauaacaauaaugccugccacauacacgaaacuaaauuuuucuacccacuauguuuuacaagcuaaaaacaaaaaggcaauauuaaauugauuaaaagauaauuugaaacaauguauuuauaacugaaauaguaauugauauaacaacccauguuuccucuuauuugcuuucacuguuucacuguggcauagcauggccaggccuuaaacucacugugcacugaaagaugacuuugaacacuugacuccugaucucugaagcccugagauuuacacaaaugccaccuauuucuuaauuuccccuuuuaauauuaaaauuucagauguagaucucucucauuuucucuucaauuuagaucacaauucaauuuagacuacccauuguucaaauguugaguaauuuuaugugucuagugauuucugaauugaagagcagagcaagauucuaccacauauggaggcaaaaagguucuuuguauuaccagaaaaaauacugugaugaaagguaaacccaagauaaucuuuaagaugauuuguaaggcggugcguuuccuacguagcaucuuuaauaccacuaacaaacaaguuuaacccuuuaaauaccaauuucuaaauuuguuuuuuaaagugguuuuuguguguguguguuaaagauaggguuucucuguauagucuuggcuguccuggaacucacucuguagaccaagcuggccucaaacucagagaucugcccauuaccaucaucgccuguuaauuucuguuuuguuuuuuuuuuuuuuguuuuuguuuuuuuguuuuuuccagacaggguuucucuguguagcccuggcuguccuggcaugaauucuuuuuuuuuuuuuuuuuuuaaagauuuauuuauuuauauguaaguacacuguagcugagggagucagaucucguuacggaugguugugagucaccaugugguugcugggauuugaacuccggaccuucggaagagcagucaggugcucuuacccacugagccaucucaccagccccgccuguuaauuucuaagcuuuuaaccuaccuuaauaaaccuuuuagaaaccuuuuaaaaaucacacaacucaucaauuuaucuaugcagaccaccacaguuaaacacucaaauugcaugacucuucuauguuuaagaacaaauauauuucucacauucacuaugccuuucaaguguauuuuauuuuaaaguaaaagcuguggagaguagggugggacuggaaccccaacuucaucccccauuuuguaagauccuuccuaagucuagacuagcacccacacagagaccucuuucucugcuccugcacugcccucuauuuuuuagcucuuauucaggguauguacucugguauuuuagcugaguuuuucauuagcuguucugaaggauggaacccacagccagagguuugugguaucaccuccauccaguaaggaauagcugauguuucugccuggcuucugauggaagacuggcuuugcucaugugcauccaagucuuacguuauaccuggacucuccauauauaauacaaugaggagaaaagucugaagacaucauuuuugauuaauuaggagauuucuucugagauaaaaguaaauaaucuaccuaucuaggaaauguucacuuuuaaucuucacuaaaaucuguugauaauaacuguaaaucaaaacauuuuguugggaacauaauaaaaguauguuaaguauuuugaaaaguauacuaaaacuaacauuauaugacauauuauugaccauauaauugaccauauuggcuugauuucacuucuuagccagcaaggaaacaguuuguuuuuggaaauucaaguauauuagcuaaguauguauuuuauaugcuggcaauaaugcacauauagaacuuuuccacaacuaaauauuuuuccaagauaaaaggguauguguguauguguagacacaaaaguaaagaaaugacagguuaagcuuauuuaauuuuaauuuuguguauaauaguuuuggaauguuaaaaaugagucaaaaaggcaaacccaauagauauucuaaagaauuaauaacuggcucaacaauaaguauacaagauauuuugugugauauuuugaucaauauaaucaucaaaaucaucugaauuauaaaacaaggccaagacugagacaguccugaguagaaaauuagcagcaaggccaaacaagaauuggugcugaacaguaaggacuggggcccgacauagcucucacaaagagcuagucaugagguuauauagaaagaguuuagaaaugaucauuggccaaaugacuaaaacaacuuagcuucuuccucuaguguauaacaucaaaagguuuacuauaaucuaaucaggaaagccugccuuuauacauuaaauaccaugcugaauaggauuaugaacaaagacauacacacacaaacccaauuccacucccccaccccuuaaccauuaauuuacuaaugccaaggugaaucagagacuuacaauaaucucaaguagcuuuucuauaaagaauuaauauagaucaaaaaucaggacaauaagaugcuagaaaaacaaagcaaauagugccagcuagugauauaggacagacuguaacccuugcuaucuaagguaggcaggaccaucaaguuaaaagccagccugggcuacuuaaaguggcugugucuaaguaaacaaaggacugggauguggugguaaggugcuugccucaaaugugaggucccaaguucaaucuuuaguauuucaaaccaaaaauucucaguuuugcuuauaaaguaugccuauguuauagccuuuucaugacauauuccuauauccauucaauuuacaaaugacuuauaagaaaaaagaacauuauuauaauuagcacuuuguauuugaguacaaaucauaagcuauuaagucuauuuuuuaugacaagauguauaagcacaacaggaccucucauugccaagcaguguuaaaagcuaacaugauuucuuuuuuuuucuuuuuuugagacagggcuucucuguguagcccuggcuguccuggaagucacucuguagaccaggcuggccuccaacucagcaauccaccugccucucccuccacagugcugggauuaaaggcgugcgccacccacugcccagcacuaacaugauuuuuaagguauaauuugaugucauuaaagagagagagagagagagagagagagagagagagagagagagagagagagagagaaagagagagagagagauacuauaauugugaaccugcguucuuugcaugcagcaauuaaggagccuuaaggauggauguuguacauaccuuaaaggugaggcugaaaguagugggaggaacugaaguuaggcuggagcuuuguuguauagucucccucuuagggaggggaaggguguugggcaggggcaccugaaaaggcaggcaacauaucacaaucuaaguaggcuacaaaagccccaucaguccaaaaaggaauaucugauuacuuaaguuacaaugcuuacagagggugauaauuauguuaaacuucuuaagagaaacacuauccacuuggauauauacaaauuaucaggaaaaaauaacuugucaguuguaaaguauauauuacucaagguagcacucuuuauacuagaagugaaaucuuccucagggcggugggguggugauacuacuacugauccaagagccauacucugugcacuaaaguucuaagaaaugcagcuuucagcauauaugaaguauguacacguuccuaucuugaguauuuaacacacagugcaaagcucuucccuagauuaaaaaaccagaguaaccucuggggcaaaguaucgaauauacccuuaccucaucacagcaaacuguucuacucuagaugacgggagcaaacaguuuuagaaacuuggagguggugcacuauucccuggaugucguacccuuacucugugcagugcuuuauguuugcuuuugaugacuuacucaauuauucagaaaauaauggcuggcauucuuucagauacuaagaaggucacucugagauacuuuggacuacauaucaaauagagaucugucaaaacauauucuaccuaagauuuuaaaguaaaucuugacaccagcuauaccaugguaacaaaaauugucgccuguacuuaacuuugugggacauucaaaauacacaauaauuuuagugcuggacaacuguaacuaccacacaaguuaagauauugauuuuaaaagccucuccuggagcuggagaugccucagugguucagaguuccuggugauucaucacauuauaguucaaguguugucuaaaacguuuucuuugucucaugcauacaagcugugcaucauucaagcucauacauauacacauaaacauuuuuuuuuuuaaaaaagaagccuauauggaguuucaacagauaugguuuuguuuguuuugguuuuuuucgagacaggguuucuguguagcccuggcuguccuggaacucacuuuguagaccaggcuggccuugaacucagaaauccaccugccucugccucccaagugcugggauuaaaggagugugccaccaaugcccggccagauguguauuuuuaaagaccaaaguucugcauuuuaaaauggaggccuccaacagacuaaugaaaagacaucuccaaaguccuuacaauuuuuuuccguggaagacuuuauagucaccacagaaucacuaccacaccuggcccaaggaaacaacauuaaugucaucuacacugacuuuacaauacucuuuaaccuaaauuuuuuuuuuuccauucauaggugccuuagauaucuuacuccuaauaagcaaauaaagacuauauuccccuauagaugagacugcaugucuucuuccccguaucugucagugaacaaagucauaugcuaaucagccuuaggagcacacagagaagugcucaucagcauauauauuuuucaaugacaaaaugcuacaagcuuagagaaugaaaaagugacauuuuauauuuuuuaaaugagaaaagauagcacaauuuaagcauauacuuuacuguaacauuacagauaagcuagcaguggaaccagcauuuaaacucaacaaguguccuuucuucuaaguuuccuauuauauaggaaacucuccucauaaagggggugauggugugaguagauuauuacaggcuuagguucaugaagcagucuuauaaauaucaaguacaacugccuccuuuccaccccuuuccuacagcucuguaggagucuuuccauuugacuauaauuugaugaacugaccccuaauguagcucaccuuucuaaaaucccacauacuugaugcuagagggauggacagacagcaugaggaaaaaaauauaaaaugacaaucaggauuuuuauauugaaaaugauaaaguucuuuugaagaacucuuuauagauagauauaaaaauauuuuuggaaaaaacaaucaucauuugaauaugauagcuuuugauuauauuaguuuauauucaaaggggagaucagguaaccaaaauuuuuccuauuuauucucaaaagcaagaacuauacaagaaauuuuaaaugugcugugcaugaggccagagcaacuuacuuuuuagacuaguuuuuuucaucuauacugaaguaggcaaaaugauaaacuguacugacuuaaaacauucaagccuuaaaacuagggcuuuaucucccacacaacuuaacaucaccuaaucuuagauaauuuaagaaauuguggaauacauauuuucauauuacagcucaguuuccacaaaagcaaggccagaucuauguacuucaauuugaaaauacuuguuuuuaaaaaacaaaauaaaaccccaguuucuuuuauucuacugacgagaaacugggguuuuauauuuuauuuucuauuuucuauuuuauuuucuuuuauucuucuaacgaguauggcuccauugaaucauaaagucuuauuuguggacaaaauuacccaaccaaauaaaauuaacuauaguauguaagggugaaaccaaaacuuuuuaccaaacuagguuaauaggaugagugcuaauaaaaaucaagucccagcacaagccuuugaaagcugacaacuucaacagguuguaggaagaagaggacgggaggggaagagaggagagggaggccuaaacuuugauuuuaaaaguagguauacuuauauauugcucaaaauacaaaaugaccaucaacucauuucucaagucaaacauuguucacaacagugugcuuaagauacagugauggaugaguuagguuccuauccaaaccugcuaaaucuuaugguuuacuuacauuauuaacuaaaguauccuccaucuuugcauuauuaguagccacaguguuaggcagagaagaggaaggugugguguagucuguuacagacuccuguggaggaguaaaagaaaacaaagcugaauuuaucggccauuuuugacagucuaauagaaguaaagcuauuuuagaaggagagagauaauaaaccacuaugcccuaaaacuugaauccaccaacuaacaguaggcugaaagagcaucaacccgccugccuucaagagacaacaucucaguugcugcuagacuuuuacacauauuuaaaaucuauuuucauagcaugagguagaaggcuaucagcaaaacuaaauauuucuuucuaugaguuauguccccuaaugacuacaagugucuaucuaccucuagucaccuaacagaacgugccuucgaggcgcaccuuguuacauaccgggccugcagagaugcagaugcuuagguuuauggcauuuucucuaaauaacuaauaaccuggaauacagugaaauguucugccacuggauguuauaguuuaaugaagacaaacccaaaacaaaacaccuccaauuuuugagagagaauauuuuuuauccagauuugaauucauggauccugaacucacagauauaagggagcugacuguauuuuaaaagauacauaucuuucguucaauguagcaaccaaaaacaagucaauacuuuuaguguucaaccucagaaacagugauguguuccaagugugucucaccuuaaguuugaauuauaguagaaggcaaaauaaaguucuaccagacaaagacaacuuugaaugcuuacaaacuuaagggagacaauucugaucuuuuacaguuuucuauuuaagccauucagcaaaauacagauauacuucuguaaaaauguaaccuuuugcagagacauuuacauuguaugauagaacaucacaaaguaaguuugcuguaugccagguggugguaaccccagcccucaggaggcggaggcagguggaucugaguuagagaccagccuggucuacagagagagagguccacggcagccagccagcuggggcuacaucuuggcucaaaaacccaaaaccaaacaacaacaaaagucaccaaaaagggcucgauacaaccaccauuauaaucaaaugcuccgcauaagaaguccaugauuaauguuccugucacucauaaauaagcagucaguguguacuuaccuuugcaucagagccauacucugcagaggagacugagaucaucgccccaauuucagcagacauuucggagacugcuuugguuucuuuugcuguuucaggaucagugcuucugaccacagcugggcuggguuucucuuguccuucuggcucgaccugcugggcaucuuucacuuuucuauuuuuuaaugaucguuccuuuccaaugggaccagguuuauguucuuuguuuucuaccagacucaagucuggaagcuaaagccaauguuauaacaaaauauaaugaaagauuuauuaaaaacgaaguuaaauuuuagaacaguauguccauucuagaaucacaucacccuaacgaacagcaccuaccuucugagcuuuaaugggcccugcccgaggcugcuucugccgcugcucuuuagguucaggaacuuuaucaguugcuuucucugaaagcacaggaaccaccucauuuucauucccguuugaggccggagcaccaaacugaauugugucaauuccaauuucaacaccacucucuugaccauuucuuguucccuaauaaaauaauguuuuaacacuugguauaucacaguaaacaaauucagacuugacugaaaaaaaaaauguaugcagugccacaaauaaaaagcacaacagaagcauguuuaaugcaauucgacauaguaacggagacuucggcuuaaguaagucugcucugauaguaacguaaauaaaaaccucaacaaagcagcacugugugacugggaagguaauauacauacagguagagucaagucaccaauuaaaaagcgaauuuucugaacacauucuuugugcuaggcaaucucacuuugguuuuauuagauaaagugaaagaacgaaaaaguuccuuagggaauguaagaaaagcuaagauagaagaauucuagauggaggaaauuccugagcaaaacauacuggaaaggaauaaauacuaauagaaaguaaugccagaaauaaaaggaaauagcaacuuguuagaccauagcaaaucuggauuuuguguccagcuuucuuuuucauuaacugcuccaugcaccuagccucuuccaugcugccuuccaucacugcucaggaacugcugugcucuggccucaguggccauuugugcuguuaacuucuacaauaaauagcuuucugauuuuucugugaauuccaaagaaugacagauacucagaaugaccacuaaucucuacgugcacacaugugugauacauguacacauguguacucacagaaaaggaaaugggaaaucauuagagaauucuugccauugucugaaaugucaauuuugcaaacuuaaaaagcuggaaauugcaaagaacaugaggaugaugaacaaauuaugacagauaauuaagacacuaccaaaacauaugguuuuagaaugccuacaggacaacuacugcagccaagaaacaaaacaaaauuucuacacuaucuccuucaaaucagcaugaaucaucugacuuugcaagaaaugcacucuaugaugaaucuuuaaaaaaugccaauaucagggguuggagagauggcucagugcuuaagagcacugacuacucugaguucaauuucuagcaaccacaugguggcucacaaccaucuguaaugggauccaaugcccacuucugucgcgucugaaagcagugacaguguauucauacacaaaauuaacagcaacaacaacaacaacaaagccaauaucaacaauaaauaucaaauaaaggcucucaaacaggaagcacagugacucugaguuccccagagaacuuuuaauaacaaaauaaaugaugaagccuauuccagaccugcuaugugagaauacugggaugguagauuaauaaggaagacuucuaaaaugagaaauacaucacaagggaauuauuuuguucugcacauauuacagcauacuaaaacuaagacgacuacgaugucaccagaugauacuuuauguguacaccauggcauuuguggccuccgagugacauuccaaccaaaauuccacauagugaacaacuguacccugaagcucucuuuauucgccucauauuuucucaauuuuaugcuaauguguuuucaugucaguaaugggccuacagcauuaauuuuuacugccaauucaguagauguaccacuugcucuaucagcacuacuggauauaacgauccauccccuuucuuuucucucagauacuucuuuuagcagcuggcacccaacaucucccacauuucucugagcuggaaagccucaauacuuaguuuagauuucccacuuuugcaucuuuauaauucaucuuaccuugguaauuucauccaaccccaugauauauugaugacuuagcaaguaaaaucuucaaaucagacauucuuugauuuacacacucugauagcuaacuacuaauugacauguccacuuaaguuuugguuguguuagcauguguaggaaggaauguauacccgagaguaccaguaccaaugggugccagagacaucagaccccuuagguaucuugauccaccugcugugagugcugggaccaaacuuggguccuuugcaaaagcaguaagcacuugaacccaggcauagcaucuuaaauguaacucuauggccuuuuuauccucacaccuaaucacgauccauucggaucuacucauuuuaaacuaacgaaaaacuuuuucuuucuugcuguucacaccaagucaguuguggguuuauggcccaccuucucaugacaucccacauuaaucauuugacuaaugucauccuuacucccucauccauaagacaaacaaccuauauauucacacccugccacuccuuugcaucacacccuccaaugguucuccaugucuccaugucuccaagccccuaaaaccuccccacacucuguuguuucuuucucuuaguucauuccacucaccuggacuucccugaacuacuucgaacacaccagaccugucuuugcuaaaaauuuuuuuuuagauuuauucauuuuauauacaugacuacacuauaguugucuucagaccuaugagggcaucagauuccauuauagaugguugugagccacugugugguugcugggaauugaacucaguaacucuuuuaccagcugagucaacucuccagcucccaucaggcuugcucuugccucacggcuuugauaacuacuauucccugaacugggaauugacuuuuucucagguaucugaauaaacuacuuucuuuauauucuccaaaucuucaaucaaaugacacacaaguaggaucuccuggccuuaaauuaucuuggucauuuaagcuuaccuccauauacuuugggaaaauucuuugcugucaucuugacuaaacaaguauacugcugauuucucccaugaggccuuuugcuucuauuaucugugccagcuuuguaaacucaaaaaggagacuaaacuggcacaucaaaacuacuucauaaauguucauucacuucauaaauguucauucaccaauauugcagaugguuaagaaaugauagaauaguaagcugugaaauuuuguaauuauccuauuagauaggaauaugagguaggccuggaaaauagugacuguauugguuucuaccagguccuuucuggacauuagaaugaaacaaauguuuaaccuuuagcagccuauaaaauauggaggacuagcaguauuagcauuaucuggguaccugauagaaauguacucaaaacccaacccacacccaauagggcagaaauucugggcaugaauuuaaucuguuuuaguggccccaagguaauaauuagguacaaugaaguuuuggaaauuauuuuaaaaacuaugucauuaacuucccaucuaugccaguaagucuauucuuaccucugaugaaguugcugauccaaaugauguuaagggcuuauuccacgcacugacugaagguggcugugguggacuaauaggaccuacuaaaaagaagccagaggaaaugugaccauuaaaauuuagaugcugaagucuaguacauucaacccuuuuacaauggugggcacacaauaaaacaauucagcauaucacaaauuauuuuuuuuuucucaagauaggguuucuuuaugcaucccuagcuguccuggaacuugcucuguagaccugucugccccugccuccuggauuaagggugugcgccacuacugccuaagagauucuuaaaugcccgcaccccaaaaggcagcccaaaugaaagguguuuuacacaucccuauuauuacuuuuuaguccacaaaacacacgcucuacacuuauugcaguacguugcccuucuuucuaguuauguuaaaugguuccuucccuauccuuauacaaauuagauuccauuugagaaaaccacacuuuuaaccuaaguuccccccauucaccuuuauuuucaccuguacaugaacccuacccagacucaaccuaaagcucacaggaagaaaaauacaaaauucuugugaaucuacuuuguuuggcuuaacaugcugauuuccacuuccauucauuucccuauagaugacagaaucauucuuccuggcugaguaggaccccacuguguucuacuagaucaugauuacuuaucuuggucacuguccccacuguuaucaucaauguacaaguuucucugcuaaucuaaaucccuuuggauauacauccagaaagggacuagguagauucuaugguaauucuagggguuuuuguuguuguugaaaaacuuccuugcugauuuucacauuggcugagcuaauuuaccaguuguauauaaggguuucuuucucuuuccccccccaauuggcauuuguugguguucccgauaacuauccuaguuagggugauaugaaaccucaauggagaaaaguauccuguuaacuguuuuagagaaauaaaaaggaaaggaaacuaagcuacuaaaauaaaggaagcuaagacuuccuaauuaagauauaaaagaaauuuuaguacuucugucuuuucccaccgcacacgucccuguugcauacuuacguuuuuuagaaaugucauucagcacagcuggagcagccacuuugcugucccauaacucagcuguuagagagccaugggacugugaagugggcauggacuucccagcggcuacgaagucugugccauuagacgucugagcugaggguaaucuaaucgagggugguggcugcuuugaagauggcgcugaagguggaaguggacucuggacugguuugugggucugggucugggucugggucugcacugucgaggccgggggugggacaguggaugcagcugaggcuggggcaaggggaacugaggcuguuggggcugaggcugggacggcugguguugaaauggauggcacagcuguagcugagaccacugggguuggagaagaaacaguagcuggugcuagggcugaagcaaggauaggaauggaagccgaggugagaauagggacagagacuguaguugaggcugaggccaagacaggagucggagcuggaacugaugguugggaugaggaagaggcugugacuggagaugaaguggaugcuggaacaggagccgaggcugagguuggaacuggagcugggcaugaaguuagaaccggagcugggguugacacuggaacuagagcgguggcugaugccaaaaugggaacuggagcugggguggaggcaggagcugcagcugcuggggcuguuaggccuggagcugaggaagacacuggaacuggcgcggaggguggagcuuggauuugcugagucccaguagcuuguuuuuuggcaaaccuuggaggaagcuuagaagucugacuucuuccuuuuucaccuauauuuuuuuugcuccauaccuuaaacaaacagaucauuuugucacuaauuuacccaaagaaacaguguauacauguaauuuguacuuccuagugauuuuagaacuuccuacugcuaacuuagcuauuucauuuuucuaaguuggacacccuuaggguaguaaugaguuuacaaaguauuagaagucaagauaguuuggagaauauagacaaaauauaauuuuauauauuagguuacucuucccucuaaaauaugaaauaaacuaacaaaauuugaaguacauuugacaccuucaccaaacaaacaaacaaacaaacaaaugagaaagacaaaaguuacuucuggaucagggcacuuguguucauucaauuuccaacauaauuuaaaacaaauugaauucuaccauagaacaaauuaguaaaaauauauguugaauuaacuauggucuguuauaaggacaauagcaagcuauagucguagcucauuuuaaaauuaauugcuuaaggucaggugugaagcuacucagccaucuucuaagacugagcagaccugaguaaccugaccauuuguuaacaaguucuggauaucaacagacaaagcuagcaauaaaaugcugagcucaaaccuguacgacuugcucuuccuucuuucggcguuccucauccuguaaccgcuuuugcuguuuuuuagauacaacuucaguaaagccaucaucauucagauuugacugggggucuucaauuacaguuacuucaggaugaucaucaaugauaacaacaccugcagauguggaaaagauuuuuuuguuuuguuuuguuuuguuuuucccucuguauagcccuggcuguccuggaacucacaccauagaccaggcuggccuugaacucagaaauccaccugccucugcuucccaagugcuggaguuaaagacugugcccgacagaaaaauauuuuuuaauuugagaguauaacuuauuuccuacccuguaagaaaguauuuuaucuuucugaaaaaguuucauagauuagaaaaccuaaaauggcaugguuugauugauagacccuuuugguuuugaaacagggucucaaguagcaaauaccagccucaaacuuguguagccgaggcuggccuugaacucuauccagauccugccccuaccugucaagugucaggauuauacacaugugguaccaguuccaguagaauuauuuuucccuuaugauguguaacacauagaggugugugagcuucccccccccccccccgcaacacaguuucuuuugaaaauaaaaauaaaccaaaaguauuuuaugucuucccaaccucagauaugagugaugcucaccaaacaguaguacuuuacuucauacacacaugaucauucuaagaagugggaauuauuacugccauguauuuucaaaccaugacaauuuugccuaaaguuacuauacuguagacagaagaccaaaucuaaaccuguuaaauaaugcuugaaagucagaagagacgugacuuuuggcuacagauauaaaauacugaaggaauuugcagagaaccuaaaauucuauuuuuuuuaauuacaauuuuauguacagaccaaggaaaaauguaaaauaaacacuaaaacgggcuuucggggauguccuauuauuucagauugaugaaguaaacuuaucacaauucuaucauuuauuguuguuuugagauaacuuuuuauuuuguaagccaggcugacauagaacucacuaugcaaccuggaacucuugauuuucaugucuccaccuuaaaguuagcauuauagguaugugcuaacacaugacuaacaucauaauccuaaauucacuucagccuuucacuuaacagggccugaacuacuucagcuaugggccaaaaauauuaaguggaaaaguguaaaaaucuauacugcuuaauuuuaaauuccaugacaucaaucauccagugaaaauaugucauccugccugaagcauuucuuuguucggcuuacugauaacagcugcccaggaacugccugguagcuguuuaccagaucaacuagggcuaccacuacuaguaacucuuguauaguaacuaauguugugucuccaugggacccccaggagagcucuaagaacugcugggcccaaugcaaagauacaaaaagagucucuuuuuaacaccagucagacucggauuguaaaccuucccacuugcaggacaggagugugacccagcacagucagagauucuuuggguuuuauggcgaugggggaggcaacaagucaguuuucaaacaugauaucguuugcuuaggcagcaagguguaaucucucaacugggaggaggggaacucuuuugaccuggggaguaacuuuauggugcuaucaggaacuaguguguuuuaugacuagccacugucauaguccccugugaccccugauuauuuuccuuucaugaucuaaaugugagacccuaaucuucccaaggauguuuguuuuuugugcuucuuucccaaggacaggugccagcuguaccugggaagaagggcuuagccauuuaucagugagagugcuagccucagcaacuuggaggcuuuuuguuuauucucaagauggcaucuauggcuccuuggggguggggguaggggugagucgguaaggcgggccucuaugaaaacgggauagugauauucuggugucagacagggcccucucugagcggccuggaaggagcaggagggacaggaacuucugcgagagagugcagaagcaggcugccugugucauuucacuaacagcauacccacucuacuucaucacucauccaucucauaucggcacaaaaggguaaagaaaacacaagguauucugagaaaagagguaacauccuuguaacuucacacuauggucugguuguuuuauacacagaauuuuaguggcaucucuguuccucuauuuuacuagauauaaucaguacuucaccccaguucugacaacugacugucaaauaucucagaguggauaaucacuuauauuucuaaauaauccagcuaaaaauuccuaaacaugcaauuaagaucaguuauuucuuuuucauuuccccccauuugaauuacaaaaguucucaaaaucauauucaauauguuugguagauaagaauuugcauuucaauuuccaacugagacaaaucaucgagaaccacacuuuugagaaccacuggccuagaaacaaugucugagaucugaguccaaacaaguaaggguuuaauaaaaacaaauaccaauaaaaccacacaaaauuagaagcaaggaaaagacaccuacaucucauauugggauaacuguuaccucaccuaaccuuccauuaucacuaccucauuaagaaaucucagauaugcuuugguuucaucugaaugaaugacaaauacacuauuacaaguaaaaucaucuaacuugagauaauuuguacuaauuucuucaccaaauauuuccuuauugcuuauuauccauauuugaugucuucauuuguagcuuccuuaguuuacccacaaucacagucagucucccguuguuauucucugcuuguauugacuauuacuuuuuuccuuuuaagaagaaauguucagaauugcuuuaguucuaacuuaaaaucuucacuuuauguuuguuuuucugugcuuucucaaacauguuuugcaauuuuacugguuuaauccauuucaagccucuuccaaugagaacagugaaaucuuccugaguaucauuaacaaaaauuauacccaauguucauaacaugcuaaaggcuaauaauguucuuuuagucuaagucaaguuauuuugucuaacauaaaugcacaacuuguccuuccuuauguuuucacaguauuugcuucaauuuaccaagaaguaaaacaaaagaaucugaaacauacuugcguaauuauugaggucaaacugugacagagcaucuacuuucuccuuuggcuucuuaggacccgguuugguaucuucccucuuuuuuccagcagcauccuuggaauucuucuguccugcaccauuaggcacaccuucuugguggugugcagaguuaccacugacagggucagcaccagcugugccugaggccuggucaucaaauggccuaaagaaaauaacuuuagaugauuuugacauacucuaacaaaacaaagcuguguuuccuggcaguuugcaaagucauaccuaagaaacaacagcacugaaaaagacccagucacucucagcagcuucugaccuucauuaaacuaaagcuccaauacagcaggccaguucuuugaaguucuccccaacaauuuaagucuagaauucuaauuaucuccaggagguaacugggucuguuugucauuuuauaaaugaguuauaauauggauauaucaaaaagaacuucuguaaucaagucaguacuagaucggcuccuaaagugggcagcguacaaaauaggauuuaaaacagcauugcaaauguuuacauuguuuagcauauauacacguuaaguuuuauccgauuuauguccugauggaaccauauuaaaaacaccuuuaacaugaaaacucacuucaaaggcaaauaaauauauccuuaguuuuugucccuuaauauaacaacauagcaauuccaggucuauuuuaauaaauucccagaugaaaauauaacauaaaaauggguuuacuguuuaauuuuuguaucagucuauacgauuucucaagauugccuugugucugacaugacuccuaacagucugaaaugacuucauucuuuccauaugggcccuuccaaagucuguuguaacuacaaccauucacuggaguuucuacaaauuuauagaguuguugcuaucuacacaacacaaaaaucaaaucaagauuuuuuuaguaguacuugaaauucuaauaauuuggucuggcuaaauacuuauuguguugcuuuuauuguuacccugacucuugaacauucaaagugaaaucuauauugagcauguauucagaaaaaaaaacuugguccauuacucuaaaauuuuguuugaaaauacuaauuuuauacaacuaagaaauugagauuacgugcaauauuauuauuauuccuaaacaaugcuuuuaagauuuauguuuauguguacagguguuuugccugcauuuaugucuguacucguguguacacugcccagggaagcaagaggagagaguuggaugcccagaacuggaguuagcuaccauguggguacagggaaucaaacccagaugcucuggaagagcuaucagugcucuuagccucauaagccaucaacccacgaaugcuuaugguauacuaugugcuauaauagcccauacucuuguuucucuucauauuauauaaagcuuccaucuuuuauaauaaacgucaaagaucugaauggacccaaucaauacugaaaccaauauuaacgcuauaaucaacauuuuaguauuaaaagagcaaccuuagcacacacuuucucucccagguugucuuugaaccaucuagucaaggauaaacccugaacuucugauugcccugcccgcuaucuucccacaugcugagaugacacguaagcaccaugccuaguuuuaugcagugcuacguaaacacuucuaccaacuaagaagcuacuacacccucagacaugaaguuuuaaaaauuaauuaauacccauugccagaggacucauguuggccacuagagcauaguagacaugcagggauugucuuucugggacuauuauaacuccagaagggaauacaauuuaugacaauucaccaaggauuucugagauaacagcacagagugccagaguaaugugguuuuaacacaucaagucuuaaaacacaccuggagaaacuaaggacagagagcuacucauuagcacaaagcaacuacagaaacuguacguucauuucuggauguacaaguacuucuaaagcucuauacauaauuuccaagaaaacccuuuuagaagaagugucuuagcauaacagauuaacagcagucagcaauacagggucuuuuaucuagccuggcauccuguguaccuucuuuccaggcauguucuaaauuacaguacucacccucucuucccaccuuuugauggugggccauuucuucuuucauuccuaggaccugaaaaauuccuuccugauuugggugggccauuguugccacgacgauucuggcgaucaacuccaggucucugacuagaaaaacuucucuucgcuauuucccuuuuuggaggcaaaacacuuucaccagccuuuacaacugcuugugaacucuuaucagcauuuuucuucucgucccucucucgccucucauuaaaaucacugcuuucagaggcuguuucccacucuucauuugccugaucugaagaauucugauuagacaaaucuggugucuuauuuccagaaauguccgcagguggauuaacugguucuugaacaacauuauuagcugugccauuugaggguaccaacaccucacuugucuuggaagcggccucucucucucucagccgucuaaaucgagguggcuuaucuugccuugguggucggguaggucgcugccuucggggccucucucuagccgggucaaauuuucgcucaaauuuuggaggucguuuaucugccgguauaggcauaaacugcucaugucuucuugguggcucuccaucuucagguuuaggagguucugccugccuuguguuccacugauugucucgauaagcaggucuucuuaagguggcaggacgugauggccggccuccaggaucccuuccaccucgucugaauguuccuccucugccacgccuuguaggcuccccuuugggaaggaaaccagguuuagauuuauccuccucucuuauguaagguuucucuaaaggccgauuaucuauucggacgugguuuucagguuuaaaagaagacugaggcuugacagguuuuuuguucucaggccguuccucucuuuugggaaguuucccuuugcuuacacugucuuugucacucgcacuuucaugaaccucacuguccguguccgucucagaaccccucugucgccuucuuuugggaacaaccucaaaaucagaacucucacuucguguuucgcuuucuucucguugucugagagguccugaaggcacauguucuguucuuggcuuauugucucuauacugaggauacucacgagugugcccucuaccaccucugccacgacccccauaagagccucuauagcuccgaccucuggaguaauacucgccucugccucggccucuguauccuuggucuggaaaccaaucccuaucucuagcuucuuuccaauagguccuaguggguaaagaugagucuuucuuaacugcuagucuagaaucugggcgagaucuuucuauuccaacaucuuuguuaaugacuuucucagguggcuuuucuucuuugacugucggugcugcaacgcuuugcugguuuacaguuuuaacuacagguucuaccuggacacuaccaacagguuccaaagguuucucaucuugagauggcuucugagucaaaguugauguuucuguugauggugguuucucugguucuggcuguacugguggugaaaccaauggcuguggcugagguugagcuggugcuggaggggggagaggaagaggaagaucuuucuuuucuggcuuuucugcuuuaacaacuuuuucagugaccuucucaagcuucucaccuucuuucuccuuccucugcucucgcuccucuuucauaucucuaaguacagguuuuuuaaugggacccgaccuucucacaggccuaucauuaccuucuucucuucuguuggagcuuggucuuggaccccaccgaguuucugauuuagauuuauagacuuucucugguuuaggcccuucagaagaucgcagaaagccaucuuuucuuggcuucuccucuggcuuuucuacaguuucuuuggaauccauacaucuguugauaaccuuagguaugcuaacagacggcucauuucuuuguuccucugcauucugagcaugguuagauccaugagaaacacuucuuuuucgggcagguugacuuucuagcgcugagauccgcucuucugcagaaguagguaagcucuucugaucaauuacaucaaaacaagcagacugaguauuuguaucaacauggcgagguuuuacaucuuccagugaucugcuuaaaaacuuuuguucuucgguuucaguugagucucuagcaacguccguuuuugaaugaguuuccaacugacuauguucuacaggauaagcagcagucauaugcucaugguccauugcaguuucaggccugugaugaugagaauucaaagguauuaccaacauaacaaccuuacccauguguacauauaccccuucacugcagcauuaccccuacaaccccaccccugaauacaaaauaaugaauccuaaguauaaagaacauugacauuccccaauuaaaaauaucuuaacaaagagaagaacacagaguaucuauaucauugagugaaugaagaaauuaugacgauguuacucagggaaaauaagaaaagauaacugugaaacacuaaugcagauaagaguuuugcugguagcaagggcaccaauuguaucagggugcaaauauaacaaccaaccucauucaagcagaauauagaaugaagauuacuagagggcuuagggcagucagaaacguggagaugcuguuauaaaugaugggguaaacuuucagucacacaauaugaagcucuguaucuguaacugcagauaguaauauggacuuguauacugaaguucuaauacaccaauuaguuaguauaacuaauauacuagagcaagucuaucaauuugccaaucacaaauaacuauacaacauaaucacuaaaauacauccccauaaaagaaacacuagccaucuggcuaucgaugagaguuuacaccacugcccauuauaaacuaucacuuugcuuuaaagugugguuuacauaguuucucuaaggauugaaaguaucauuucucaucacuacuagauucuuaucagcccauuggcuagacuauaaaaaaaaaaaaaggcaaauuccuguuuuuacuaauuugcccucguugauuuaaaauuauuauacaagaaaaagaaaaaauaugcacaaagauaaaaugaagcacauuuauggcuugguauuaaaucagaaucuaauccuuuaaaaauguuaauguguguguguguguugauagagugggaagagcuuuuguuauuaucaaccaucuguggagaucagaggacaacuuuugggaguuaguucucuccuuccaccauauggguuccaaacaucaaauucuggccaucuggcuuaauggcaaacaccuuuguccaugagugauacuguuggcacccagaaugaucuuuagggaugcaauauucuacuuaucuuucaaugauguaaguaauuuauuaccuugcauccccaguuucuucagcagacuugggaguagcugccugcugaggcucagcaugauagggaucugacccccacaucauucgagguucagaaagugaaauuccaugaucucuugcagaucuagcuauaugcucaaaugacucagagcuauuaggugacccuuccaucuggucucuucugauuaacggcuuaggaggaaucauuccuguaagaaaaagaaaaguucacacacacaagagaauuagguaaagugaaagaaacaaaaccaagauaaacauauacaaaaaugagugcuaagaaauuaagaggggacauacaauaggaguucacuuuauuuuaaaagaaaaaaaaaugugcauagaaaaaacagcuaacagaaaaacugagauuagaaucauaccaacaaggcuaaguuuugggaaaaauuauuucuuacagcaaauuuuauucaucuuugcuguuaaaauaguuaacucugcauucaaauagugagauuuacaaaccaaccaaccaaccaaccuucaagauggcucuaaacuucugagccuccuggguccugggauuaugagcacaugccacugcuuugaaugagcuauaauuugugaauagcuuuuuaaucauuccuaaaucuuccauaguaucauucugaugacagauuaucuggcuuaauucuaaauggauucccaaaagaacuggcuuauuuacuuuuuggcuaacuuaugaagaaucaaguuauuaugauaauaauaaauaauaggaaaacuauaaaaaaagaauaaauauaugaagauaaaauuuaaauguugaaauauuuggcaaagugagaauacuaguaacagauuuuaacuagaauaauugccauuucaaaaauuuaaaguucuaaagcaaaaaagagcuaguacuuuggucgaguuaaauagcugccacaaaugucuacacuaaaagcuuuuaacuuccugauaaagaccuaggggucguauuuuaaguucuuacuagauuaaugcugagggaauuaugacaaaaaggagggacaggacaaggcaacauuaaaaacugcaaguaguaacagucacucccaacucaccaggaugaauggguggaauguccauagcaggccuuccugauaucauucgaggauccauauaggacugcaucaugagccaccuugggucaaaacccauagaagccagauguugagggugggguugcauuggcugguaaaggggucugugugguggaggagggacugaaccauuagacggcugugagggcacagucuguggaagcacaccuugcugcugcugcugcugcugcugcugccacuguugcuguuucaucugcuccuggaaaaccaaaaucacacuuacugacauuucuauucuauaauuaauuaguguaaccguauuugaaaacaaagguguuugggaaauuuaaagauaaaaacaaucagcacagaguuggcaaaagaccaaauaaguuacaguaauuucuuauaauucacauaagcaucucaucauuuccuagaaguagaagaugugucuaugaguaaagcuuaagacaaaaaagacaugauagagaaagucaacuaacuucucaacaaccaauucucaacaaguguacuacaaagaaaaaaggaacuaagguaaguuccuaugcuuuauguauuuuguuuuauauuauauuaucagauccugaaagauaagauaucuauuuccaaucccauauaugagguaaaguauuuuugguuuuaguaguauuaccugcugacgcugaaaucgugguggcaaugauuucugaaacuguuugaaauagccaggucgagguugagcccccgauucagguucugcuucuuguaccacuuguguggucuccuuuucacugcgauugcuguccugccuagugaaaauugguucuucuucugcucaaagaaacaguaaaaaauaauccuaucaaacaugcuguuaaagaggaaaaaggaucuccauaauacuccaaaucaucacuuuguaacccaauaugaaaaacaucaauaacauaucacuaaacuaucaacagauucuuauaaaccuggacucuaaggagaacacagauccaaauccuucacuuacacacauauguauuuacuugacaaaaacccaagguccuaauacuucucauuuauuucaauaaauauuuauguuaacacucaguauuuacaugauaugaucuauaccugggaagaggacaaucaaguguagcugcacacgccuuuaaccccagcaccucgggaggcagaggcagucagauuucugaguuugaggccggccugcucuacagugcaauuucaggccagucagggcuaugucaaggaccuguuuacuguuuuuauccugaggaaaacuuguuccaucuguccaucuguccuagaggaugaugcaucacaaguauacaugcaaggcccugccuucaccucuccaccauuaacaacuaaggagaaugcauaauuaacuaugaaauguggguggggcaccauaccuuucuugcaguuguuuucacuuucuugguuuucugucgcaggcucuacaacaggcucuugggguucaacuuuuuccucuuuuuccuguuccuuuggcucgcccuccuuuuccuguucucucagccuuuguaguuccugcuccuuuucucucuguuguucuaacucuuucucuugcugucuugcccucuccauuucccucugcuuuuccugcucuuucucaagcucccgcucuuucucuuuuucaaguucucucucccgcuccuucucucucucccuuucucuaaguuccucuggagauggcugcuuuucuaugaucccgagcuucucauccagcugcuucaauuucucugcgcacgcugccuuccucuguuccuccauccuucgcucuuccuccucacggcguuuacgagcacgcucuacugcugcagauauuucagacuguuguuuucgucuuugcuuccauauuucaucguuaucagguacuggaggcuuggagggaaaggggccuugucuuccagguauuugucgaucuggaggugggggaugcugaaggaguaagagaccagaugaagauaagaacuugguauucgaaauaauuuguuuuuaugucuaugugugugugcaugugugcacaugugaaaaucagagaacaaccuguaggagucagcucucuuaucauuccauuauauggaaucucauuagagugaacucagguugucaagcuuggcagcaagcaccccuaacaccugagccaucaucacccugaucacuuucugggacugauauugugugccauaaauauggagagaugggaagggucaaaaagaaggaaaaagaaagaaggaagagauucuguuaaagcauaaacaagacaaugaaaagaaaaagggccagcaagauggugauggaggauagaaguaaucuguugacaauuuagacagccugaguuuaaccccaggucccacacuguagaaguagagaacugacuucccaaacuugaacuuugaccucugguaugugcauaaagacucuuaaauaguaagucuagacaauauacuaaauuaggaagggaaaaauuaauuggaacgucaaacaccaagugaagaaauacccauucacuguguuaggcauuauugcucacucaguuauacuaagauaaaagaucaguuuagagauaauagaaauuuaagugcauguuuuaguaguaguagcuugcagacagaaugccuuagaaggggaauuccucagggagaaaaaucaaggcccaaauauguaaaaugacagcucauggguaccaaggagacgaacaaggaagcugcagaguaagaagcaagggacaagauggcugcuagagaaacggccuugaaggaaauuucaaaacuacgucuggaaagagagauuuacacuguauccagaacacaaugaagauuuuaguucauguaacugauauuauuuucauuaacauuuucaaacgaugacagaguuuaacaacacugcuaaaaacaccaaaaauaagagagaaaguacacaaagugcuaaaucauaaagaaacaaaacacaagauuuucaacauagagaagugaaaagucaccaggauaaagaaggauggagauuccuauauugcccaguuagaauuccaaaaaaagaaaaauagcagcauagugaaaucaaauaccaguaaguaaauguauaccauggcaacggauagaaagacuucccaugaggaugggauacacaccaagcucagcugcaucacaucacuccugcucuuuuuaccuucacauaucucaacccuaacacuguuuuuccugugcuagaauugugcugaugcagacgaaucucuugugcuauucucucuggcucacuacaauacuguggaggcuauuuugugguggcuuacaccauuucacugccguuuaguaguccaagguacaagaacaaugacagauauguauccugugguauaaaggcacacaucugcauauuuucauuccucuugaauaaacaggugauagugacccucucaauuauguuuccuuaacaggaaacugccaagcugccuuccuauacuguucaagcaugcacgcuauccuauauguuauuacuauagggcaaugauggaugcaaagaaagaguauuaccgcgauuuaaauuugcauuaccaugguuauuagauagcacaugugcuuacuggccacucauauuuuucuuugugaauguguguauauaugguuuuuauauaaaugaauguguucauuacauauauaagcguacagagguuaaaaaaugucaggcaauacuguuuaaguuaaagugucauuguuguucauuauugugcacaccacaaacaugugugauucucgucuauguggauauucuuaugcucauguuuguaucgcagguucuuacugggcuaucucccuagaccacagucacagauuuucuuugugaagcuaaaaauccuuuuuacugaguuaggugccauacuauuauuauuaucauuguuuuuuuuuuucuuggcauagucuaguacaaguucucuguuagauuaauacuuggaaaucaaauuuauuagaagaggcaauagauguguacguguguucaugcagcacuccugggagugaugguaaauuuaugagucauccagcuaagcucaacuuacuaaaagaauuuugcuaugauggagaacaaagacauagagcagaugaugaaaaagaaugaagagcaggguauugcacucuauagacaguaaguggcaggacugccugccgucagggaacaaggaaggaagacuacaagugugaaagugcccgacaucagcucugugcuuccuuccuuagugagguacucagugcgcuuguuagguaagaaggaugaacuagaagaaaaacaugcaaaagccacacugaacaauguacaacugguuaaugaaaguuauaaacauaaaagcaucauuccaacagaagaaaacuucacaaagccaaauacagaguauacaucaacacuuauuuaaaauuuaccuguugugcaagcaacuugggaggugguggcaagugugaagaugggccacguuccuaugaagaccaagagauuuaaaaauuuaccccacacauuuaugaccacagucaguguacuaauuuucucaacgagaacacaaaccuguucaaagucaaccuauugggccugucuucauuuuagaaguuaaucagugacuguaaaaucacuuuuuacagaaccacacagccauaucaguaugguaacaagcaaaccuacuacaaagaguggaaaauuuccuuucccuuucaaagacugccaguuugcucccuauagcuuacuaacaguuauguucuuccaucuguuuuguacaaacgcaaaaaccaccuagauaauuacagccucuuucaguuuguaauguagcuacugcuauaccaucucaacucaugagaucaaaauauaugcuccccauauauuucucuccuuuugcuaucuuuuccacaauaaccagguauuguaagucuccauuuucuucauguuaagauuucucuacaguguauucuuucccaugcaaguagcacgauguagaagacauucaguagaugguaaagcgccuuguuuauuuugagaaaauauuccucuacuuugaccugauuuaaucuucaguuuuggcuugacaauuaauuuuaguagccauaucaguaauuucauuuaacaggcaauaaaagcagcaaaaaaauacacagccucagucaaguacuauacaucacaugccugacaguucagcacccagaggagaggcaggaggaucuuaugugugaauccagcucaaaacuacaaccagcacccacugccugccugcaaaucacacaaaaaccccuuucucaagucacuccaauuuugguucuaagaucaacucauccaaacuauugguaaugauaaggaccuguacaggcccaacaaaccugauuaaaugguggucccuucccauaaggacuuuuugugacuggaggcugagcagguaucugagaagaugauuuagugcuggaagcuucaucuacuucuuuucgguuuucugugcuuucagguguuuuugcaguuugauccucacugaagaaccaaaauggagaagaggaaaggaacaaagaaacagaaauuaugugaacaagugaaugacuuuuccucugggggggggggguaguuuuccauauaauuucaagggaagaaaauguauaaagcaaucacugacagguuugugacucagugauguuaauacugagauguuucuguaguguuuuggggaguauuuaguucacacugucaaaguguaauaacuaaaauagcaguauagcagcugcucaaauuggauacucaucugugauguaaaugaaucuaauacacuuuuuuuucuugccuguccucucaagaugucaccuaaauauaaauaagugauacugaaaauauuauuccagcacucgggaggcagaggcagguggauuucugaguucgaggccagccuggucuacaaagugaguuccaggacagccagggcuacauagagaaacccugucaugaaaaacaaaaaaaaaagaaaauauuauugacuauauucuaauuuacucugguucaaaagauauauuaguguauguauauauguauguauguauguauauagauagacagauauaaaauaaccucaacauaucagguaucucagagaugaccgaccaaucaugaaacuauagcauacuauaaugccaugccugagaaaacuacaaauugggcacguaaaagcccaauguuucuuacacauuagcccauauauuccuuacuuggaugcccuucaauaaguaacagagauuaaaaagcuccauuucccaaaucucuaaugcuguuugccaauaagcuuuuagggaauaacaaauaaugaauaaauaaauaaaacaagauccugaagcaauuaaguaagcuaagaaaaauaaagaaaaucuguaguaaaaaaaaaaaacaaaacaaaaaaaacaaaaaccguaugaaugaagcaucuuuguaccaacagcucauguucuaucaacaaagucacgcuaucaauagcaagacugucacaaauuuaccugcugcucucuuuaggacuaguacuuccuugcucaucaucaucacugaaguucagcuguucuguguaaucuacuuccaucugagcaccugguaaaugaaggaaagcauagauggagugaguucauaaacacaccacuaacugugucaaacuaaaccccaggcaguuucaaguguuucaugaacuguuccucaccugcccaaccuucaucugcuucagcaucuagguuaucaaauuuaucgagcuccuucaguucggaugcacuaaggauggaugggcguucagguucagaagcccaagaaggaggagggccucuuccucgaaggcuucuaaucaacgggagagcagaggaaaaaaugcacagguuuuaguuauauugacuugagaguauuaaaacauuggaauuuaguucauuucaauuugauauuaauuuuuucuauagcaaaauauacccuggaaugacaugaguauaaagaaaucauuaaaauauacuuaguagcuuaaauaguucaauucuuuucauuucaaaauaaguaauuagaaccauuaaaaaggauccuaaaauuucuacaguaagaggagaguaagaaaaagaauuaucacuaguuuuagaaucaugauuuccuguuuucaaaaauuuaugccaauuacauuuuuaaaauacucaacuauuucggguuuuguuuuugauuucugagacagaaucgaucucucucucucucucucucucucucucucucucccucccucccucccucccucucgccuagcuacuauuuuaguuuuagcuuacaagagguaaauaauuauacuuuugagagcgaacccucaauguuaaaaaaaaaaucuuaaagcacauauccccuguaggcuuugucuaagucuuacuuguuugcuucugauaaugaaggugggaaccucaugggaccauguagaggaggauaugccauccuuggguacugcugaaacaucuggaugauaaaaaaaguaacuuaugauacacaaguucaguuugaguagcucuuaaaauguaaugagguaugaaugguugaugcaaauaauaugaauauucaacuuugucugcuaguauagaccaccacucauccucacuaaaaaaccauuuacagaaaagugauuccaggaagucuuuuuuuuguuuuuaaggcagggaucucacuauguagccuuggcuggccuacaguuugcucuaaaacagcuaguugugaacucaggggaucugccugucuuaaagacauauguuuucacacccccaccucuagaaauacuaacaaaaaccuaacuaagacacugaagaaccuccauaucacauuaauauaauuaacuuauguaaugacacaaacuguaaaaaccacaaauccguaaaccaacuagaaaaacaaugauaaagaggaaaucacuucagauaacagacagauguuaagaauggcauagaaaaugugcucuuagucaaguuucucuagagaugacaugaauuaaguacuaaaaaaaauccagucaaggaaaaagguaagccuaaaagugggugggggcagauuaugcaaacccugguaacugaaggacucagcuaugaucuggauggagacagucucaacacauuuauucauuuacagacacauaagccugaaauaauuuugcuucugcugaaaaaggucuuacaaaaacaaaaaaauaaaaaacaacaaaaaaaucuuuuuagguaaggaaaucacacuuagaaaggacuuuuugugugacuguaaugucuaaaggggccauuccuaccacacagggcugaaacuagguugaauuaaacaccagcucaaggucaacuaucaaguauugaggaaaucugugggcauuggcuacagcacuauagcgaaaggaguaaaaauggaugcagucuuuaguuuacguuagcucccccuuuaaauuauucagacauguuaauucuaugagguguauagcuuaaaauucggaguuugccauaacauuaacugcagaaacuaucucuaaccacucaguaucuacuugugguguagacugggugacuggcuugauagaagcagcugguacugaagccuucucugcccuuugcuuugaugcgccuuccaauauccacaccuggaagcucaaaaaucuacaagcacaauuugaaaauuaggcccaaacugaccgggucaguuuauaaaguuuuccuuacuuuuuuuaaaaaaagucaugcucucauacuucuuaggauaucauccuucagcacugugggggaguuaaggucauggccucaaacacaaugaacuauaaccucccaccuuuaaaaaauacuuaauuuccuuugcuuuucuggcacaguuaagacauggcagagagaaggaacaaagcacaagcaacuugacacaaauaagugaaagaaagaaaagaacugcacagaggcgucuacacacagggaaggaaugagaccccuaagaaauaucagucauuaccucgauccuaacaaugaccuaccauuuaagaauucauuuuuuuuuaauuuuagccaccuuaauggagcuauguauuuucccauguuuucuccuuuuaaaacacaaccaaaaauauccacaaaugaaauacuguauccaggacuggagaauggcauuuaccacuacucuucuguaaaacuuaauugagguaggcauaauagagcaugcaugucccuaacuucagcacucaauagccugggacaggacuaaucuugaagccuacuugaacuacucacgagaccuugucucacaaaaaagcaaaauguagauuuaaaaacauaauuagaauucaaacaauucuuaaccuuuaggcucuuuguuauuggccaugaacuaucaguugggcaauuuagcaaacccaaugaacuuaucuuaaaaaaaauuuuaaaucuguaauauaaaauacucauuaacacaaagaacugguaaacuaaaauuuuauuuccacaauaauuaaaaguugugauacugcaauuaacauuugugcuuauguuuacuuuugagacaaggucucacacacuacguaguccugcuggccucaaacucauaguguucaaccugcuuuuggcuccuaagagcagggacuuaauaugcuguaaaaauauguggucuaacaugauaaagcuacuugugcuacugaggcaugugacuuguuuaccucacuauucucacaaucagacuuuaguuagaugcuauugagaccaaagaucuacaucuuccccauuucuugagucccagaguagaauauucuuuugacugauugccauguuuagcaauacucacauauggaggcaucauagcucuauacugagaagcaagugcagguugcuguccauucaguuuggccuguggaggaccacaagcuauucucuuuucuaccacuuugagaauaucauuuuguucugauguuauagccgugcuuucauccuggccaaguugcuuuucauccugaucagaggaaggugacccagcagacuuaccaccaucucuccagcaagcaacaucugggauggaggacaaaaaggauuaagaaaauauuaguaacauaacagcaacagcaagcuuagcauauuuuaagaaaaugccaccaaguacaguaagaguggggauuugcugucuuguaaugcagacuagagucauagauugugaagcagaaaggcucuaugucaggcagccaugacaacccaugaaaggaggguuaucagcgcuuguauaaagcuuugucaguguuucuguagugguucaaaaaccacuauucucacuuggacugucagguaggcaucuagagggaaggaaggaagauaagugaaauucuauacaacucagaaaagcugaugggggauguucacauccauuuacuuuagucaacucuuacuaauuacaugggaccagaggagcagauucagugacauuaucuuguuuacaucuuuaaucaaguaaaaccacucugguuuuaaggaaauccugaacagacuauuaagagacaaauaucccccuucuagaaaacaguccacucuuucauauuagccucuccccaucacguauuuuggggaaggcacgucaugaacaguaacagcaaagggggcuuugagagaauccuuuagucacaacguuuaaccaggccucuuuuggauuccuucagaaauggugggaggucauguguuggguucaguuuguugacucaagcugccacauuuauuaggagacaauagauaacuuuugggucaaaauguaacuaacugaagaaauaguggagcugauccaauuuuaaugaguaauugauuauguuauaaagguuaaacaaaaauuuaugauauauguaaguuugacaaggaauauugacaagaaauagguuaaaauguaaaaugcaauguauauaacauuaaaauauaaaccuauaaaauuuugcuagaggaaucucauagauauagucuguugaaauguuucaugaugacaacaugaagcuaaaacauuuacaugugucucaaaaauuuauuucuuuuuuuauuuuaugcuuuauaaugcacauaaaguaaccuucauuauccaaaauauuucauuuugaguccagaaagcaaagaaucauggaauacaaacaaaaguauauuaaaaaaauaaaaauaaaaauggguagaucuuacacaauggggaaaauauguuaaaaccaaaacaaaccaaucucucuagauagauaguauguguguauauggauauggacagcuaggcacaguagcauaugccuauaaucccaagccaugggaggcugaggcagauacaugcauauggagaagagggaagggaauagggaaugaacagggcaaagauaaggacaaaaggaucaccuauuauuuacaaagaagauaccuggauaccuuacaaauuuugacuuacagauuaaaucagauguaauuauacauuuccaacaagcucuacaguuacagcaguacuauuguuggcacaaaaaaaaaaaucuguuuuaagugaauacaacacuagucucuacaaagcaggcaaauacacaggaacacacaugaggugacauuguaagacaaaacauguagaaagcauucuuacuuggagggcguaaacuggguccagguccauaguuuucaucauuugcuuccuuuucuuuuuuuuccugaucuccagcugccugcagacugggaaauuccugcugaaauugacuauucacuuggauuccuaaacauuuuuucaaaaacacauuaaguuaacuuuuauaaugaagauaauucaaguaacccucccaggauagaguucuugcuuuuuucugaugaauuaauuauucuacauuauaauaauuguuuauaucaauaaaucguauaaacuguaccuaagcccuugaaaaguuauugaacagccaugaggacacaaaacccugagagaaaccuuucagacauguugcaggaguguuuguuucucuuucauuaugacuccuacuacugaagaccaacuucucugcuaaaaucuuuuaacaacuaguuuagauuggauuacugaaauauacuuugacuaaacaccaagucccgaacaaggcuaagauguuuucauuucauuuacuacuuugauuuaccacuaaauagcaacucacuauacaugaaauauguguccauuuuuuagaaguauuauagcuacugugcuuuaugaucauucucuaauuuucacuacccagaaauccuaggaggauuucuguaaaagacauuugggauaauuagggaaaggaauccaguaucaauauacaauguuuuuguauucauugaaauguuaaggguacaggccaugucuguuguuccuuaauucauagauguucuuuaaaaugcagaagauaacucagagauucuccuuagauuagaucacauaugacuuuugucagugaaauuuaacuagccuaauagaguucaaggaugcgaccauauccucucgcaaugcucucuuccuuuccuuccugcacggcuguucaguaaccacugacccucaccagaccccccagcucauguccacuuaccaucuccuugcccaccuugcuuguuacuggcccaugauuugggagcaggugcuacuucugggggagcugcaaccccagguuugggcugugcuggugacacuucuggugcucuuuaaaaaaauauuaauccauuauuucagauauuacacacuaaaaaaauguuuaaauguauguaaauuaagucugcuaaguuuggcuacaaauggauuaauacgaauaaaucacagaggcaucucuuauaagugguuugccuuuguaucauuaccuuuaaaguuaugucuguuuucucccaaucaucucucccuuuaaauaacugagaugacagcugccuguuuuccauuuuguuuaaaaagaaaccaaaacaacgugauacugaaaguaacuaccaauaauguuuuaaagaacuacauuaucaacagaacuguaaguauaugcagacauucaguuuacacugggauaauuaggggcaaaggcuaugcaaacuccaaaugucagaugauagauucaucauugcauuacauuucaaacauguaacagcaaucugucuaauccauucucaugaauaaaacaggauuaaaaagucuauaguuuuauacaauccuugcaauauagcaauacuuaaaaaugaaaagguuauucaagaaacuaaagaaugccgguauuauuuuuuuguacacacagcccuagcucccuuucuacuauaaaauaauucuccagcaaacuaaaauuucuacaaaggagaucgaauauacuauagaaauuaagcaggaacauggagauuugauaagauccaugcaaacaauguaaauccuaccaacugaccaauaacuacuuaguauuuagcccagcuaauaaucugguacaaaccuugacagacagaagacaaaauauuuacugaaugaauaaggauuggggcagacagugcuaauucuuguuuuccacuuacuuuauaaauaaugcccaaacacccaugauacaccaagcaguuucaaagcuggagucagaauucuuaggcaucuuggaauuuaggcaacagaaccaauuccuuauuuuuguuucauuuuuuaauauuauuucuuucugacucaauuucuuccucccauuagaaagugaaggccugguuugaacagggugggagaggaggcaguaugguacaggcuaugcaguguaaguaaaccuguuuauuagccacucugucaucugugcuuauggcuaaugcuacugaacucaaagagccuaacgacuaaaaguguguauacacaguuauuauauauuuacacuaaaugugucuauucacacuuuaaauauaacaccacaaaagaguuauaauaucuauauuaucuuuuuaacucuucauuuaucaaggacuuauuaaagcagaaugcuggguuccacacucagauaauaguuugcaguaaauauugguuggcuuguagauuuguucuuagaauguuaaguucauuuuucauguuuuugcuaaguaauaguguuaagagaaguccaagacucuauucuuggaguuaguaggcaucaaagaguaagcugacuuguguuuucaucugaggaagaacucucugaauuauaagugucauagaguguuucuauuggcugaacagugcacagcgguggcaguuuccuacaaugagagaaguguuuuauucuuaacagauucugacucacuuuucuucuucauguugcucuuguuucgaugcccauccugucccaucuuugggcacaauauucacauuaggaucauugccuuuguucucugcuuugagacuuggaagguuagcaggugggggcauucgccgugaaauaccaacuuuuccaagacuuuguaacccaugucgagcugcaacuaaaagaucaguaacaucaauuuccuuagaacaucuacuguucaucacucuauuauacauuuuauucaacaaauaauauacaugaacaggaguuaacaaucucugacuaguccccaauguuaaaguagagcucuauaaacucaguuuauaaccuacaacauuaauugaagguaaaaaguaaacaauccacucaaaauauuaagccaucuugggaccccagcaaaauuugucucaaaaaacaaaacaaacccacccaccagaaccccuuaacuucuaaauauggaacacuauauacugggaauaugggaaggggaaaugcuaguuuugaaauguuuucaggcaaucuauuuuaaguaaaaaacuuaaaauguuaagagaagaaaguucaaacuacacaacuuggaaggugaaagugggaaaauagcuucauguuggaggcuggccugauccacuguuaaguucuaagcccuuuaggguuacacagugugauggcuuguauaugcuuggccccagggaguggcacuauuaagagguguggcccuguuggaggaaguguuaucauuguggauacaggcuuuaauacccuuguccuagcugccuggaagccagucuucuccugucugccuucagaauaagauauaagaauucucagcucuuuccugcaccaugccugccuggaugcugccaugaucccacccuguugacaauggacugaaccucugaaccuguaagccagccccaauuaaauguuuuccuuagaagaguugccuugccuuggucauggugucucuucauagcaguaaauaaaacccuaacuaaaauacacagcaacaaguccuugucucaucacccccuaaccccacaaacaaagcccacaauguucacaauacugcagcaaaugcucuacuuuucacuguauguacugguggugcaagggacccaggucaaaaagacaggacuuuuuucccccuguagcacgaacacacccacccacuccccucuucgucucuuauaugguuucuuuccuauagacacaaguguauagagaaguguauauauacaaaguucugugagguuaagaacaguagcuguuaaguucuaagucacaccuaucucuauguaacuucagcuccaaagggauauaucauagcucugaccucugcaggcaccugcacucacuuccccauauccacacacaaacacacacaucuacaacaucuaaguaucauuaaaaaauuaaaacaaauuuucaaagguaaaauauuuaauucuuauucccuggaaagaaugugaauacauacaaaaaggcuaaaauaaacggguucacccuagcuucuaaucauacacauuagacacagugucuuugcaucaacaaacccacaaaccagauaacgugggcuacugcaucuacucaccuguagucuucuguguuuccaaggacuuuccuuuguaaguguuaaacaaacugaguguugcauacuucuucccauccuuggcuuuugugcucuggccugacuucuccgacauuucgguggaaacucaucuaguccaaaaccuccugacacaccccuuaaaaguagucuuuguaaugcauacaagaaaaaagaaaaagaaaauuuuaguauuagcuacauccaacaguaacugaucauccuaaacuacuuaagauugcaccccacugccuaacuauauuucucuucugagcacauuuucaacuuacauagaauauaggcauauuuuugguuguaagcauagccuuuaguggcugagccccuaagccugaauaaaggaauauuuaagaagggccuccauauauaauauauauuauauauggaggcccuucuuuaaauauauauauauauuuuuaagaaagcccccuccgccucucucuauauauauauauacauauguauauauagagaguauaugugugcgugugugaggcuaacacugaaaucucagagauccuccugccucugcccaggauaaaggauaaagguauguaccaccaugccuggccuuauacauagauaauuucuaaaagcauagaauuugcaccaauuggcacuccaaugagaaggaaugcugguaagagcuccaggcuauuagcagcugccaagagaaggagaaaucaguccucuccagggacaaagacccucauagguuauccaaucccaaggagucaaaugcuaaacacauguccaugggagcaacacuauuuauaauuauauauguguaacaauaauaauuaaagaacaacacucuugcauaugccagaaagauuuugcugaagggacccuguuauagcugucucguaugaggcuaugccagugccuggcaaauacagaaguagaugcugacagucaucuauaagauggaacaaggggccccaauggaggaguuaaagaaaguacccaaggagcugaaggggucugcaacucucuagguggaacaacaauaugaacuaaccaguacccaaagagcuuguaucucuagcugcauauguagcagaagauggccuaguuggccaucacugagaagacaggccccuuggucuugcaaacuuuauaugccccaguacaggggaaugccagggccaagaagcaggagugggugggggaggaauagggaacuuucaggauagaauuugaaauguauauaaagaaaauaucuaauaaaaaauaauuaaagaacaagaggcuaugaauuuguaagggaauggaggaaaguaagaauuggagggagaggaaauuauguaaauauaguacuuacauaugaaauuuaaaaaaauuaauaaaaagagccucuggacuggagagguggcucaaugguuaagggcauugacugcucuucuagaggaccuggguuaaauuccuagcacccacauggcaccucacaaccguuucuaacuccagcuucaugggauccaacacccucacacacauacacacuagcaaaacaccaauucacauaaaauaauuuuuuuuuuuuuggcuuuucgagauaggguuucucuguauagcccuggcuguccuggaacucauuuuguagaccaggcuggccucgaacucagaaaucugccuaccucugccucccaagugcugggauuaaagacaugcgccaucacugccuggcaauacaaauauuuuuaagaaggccucuauaguuguauaauauuaagaauaauacacgaucauucacacuaaggucccuaaauaccugaagaacucaauuguaaaaacauuuuuaaaauaacugccgcccaccccaacccugcuuuuagcauuaagaaauaaucauucugucugaaaaaugagagauucugacugagaaaacccaguaaaaauggcauuuuccacugaaauuagauauggugcauauguauuuucuagauuuuguacaacuguauauuauuuucuaacagauuuuggccaaaaauaaacaaacauuuugcauaaaauuuuauaaggcaaaagaugggguauauagggggaacggauguuuuuaaagaaaguagcugguuuccaaaagauauaaaugaaauuuggggagcaguuugucaaaauauaaauuaaaaaaacaaaaaacccaaauuccuucaaacuacaaucuuugagacaguuuuuaauugcugauauacuaaaauaucauauaaguuucuagacagagcuucaauagcaaauguuuuaacccuacagucguacacuuacucagugcuuaccauauaccaaagaaauugugaccaggaaauauauuguccucaugcacuaagcagagauaagagcuuagaaauuugagauugcaaagguauaaaaagcaaaugugaagucagaaagcuaacuaaccagugaccaucuuuugucuuucuaccauuacuucaagugaagacaguguucaaguggcauuugaaugcagaaccucugguucuuagcagccacuacaacugggagguugucucaggcauguuacaacagcacuaacagaaaggaaugagagaggaaagcgaaggagacuggugacuucagcaaccacccccagagugucugucagcaacaauacugaguuauguacaaagaaucaagcuuuuuacuaaaucaaauucaagaacuacucucagaaaauuauugacauaagaauaugauuuucagagacuacaguguuuagaccuagauauuaaaaaccaaacacauaaaaacugugucagugugugcagaaguaaauguuuacacagaagacaaagaaaauaagguaaaacaguuaaaggcaggacaccuggauaaagaaauauggacauucucuaccaucuuuuaacuuucuagaaaaauaaguguugguggacaccaucuggaggagcaguggugagcaagugagggaccuggaaauaguccaguuuugcaaaacugugauggguguaccuuagagaggcaaagcagcacccccccccgggggggggguaucaccaaauugcuucuugcuucugcugugccuucuccugcuuaucauugcuauaaucauccuguaccuagcaugguauuaaugggcacggggagacccucacugccuguggucugaugugaccacuucaggaagauagcccaaucuacugagcaaauuuucugcagaucaauaugaagaugaacgucuauaaaauaaugguguuuaaaugaacugauuuuacagaauuccugacuugauuuaaaucguuuuaggaauuuggugugguugauaaagacucaggagaugguuucaguugcuuugccaggaagaugaaucaaagaaccaacaguagacagacugugcccuucucugcagagcagugagggcugucuaggcuagaaagggagccccgugaccucucaagcccugcgagcgcagagugggacuugagaaaggaacagagguuugagacaaguuaauacgcaaagaaaacauucacuuguucuagguugaguucguuaaucuugugaucuaaggauguggucacagguuuuagugugcaccaugggaagguagaacagaugauagucuagcuauguaaggcuucaaaaaaaauauguaaaaaaaauugguuucuugguaaaugaaacuguugucagcuaacagaaaaauuagcuacaauagagcuggcauguuuaaaauuguuaaucaacgacaaaagaauuauugcuuuggguuaagaugaauuugugcaaagauagauggaaaauguucaguaagguuuggguuucaaaagaauauauagucagucaucaugcaauuccccucaguguaaugauuuuaaucuguuuuugaagaauacguuuuucuggugauuuuuuuuuuuuuuuugagaauauguaacuuguagcuauaaggugaucuuauguugagaauuuuugucuuaggugauauauaaaggaguaagagaaaaagcaaaguuguuagagccuugcuucauccaccaaguguguguauguuucccccucuucauuggccacagagaauuaagucuugcucccccagagaaaagacugaguugcagaguacacacccagccucagcaccugagauguugaagcuggccuuuggaaaagcuuauuccucucuuaaaaaauuguaaggacuuaaaaaaggugacaccuucuccacaaauaaguucuucucccccaauuucuaagaguauuuucucuuaucucuagucuuaaacaccacuaaacuuugguauuagauucucacacuuauaaacauuauugaacuauauucuaauuuagcaauguauuuugggacccaccuuucaaaaagcuaagguuuuggcaugcaaaauauaaaauuaccagacugggucucagaaguacuuaaaagucuaaaucauuaaaauuuauaaauuaagaaaauugcccaaaaaaaaacccuauaaagcuugaaaacaaugguaucaauauuaauucaggugugccucaaaagaaguguccaagauaauuuuauuacaacaauuuucauuaaggagauaaacauuuaaaaugagguaacacguuauuuaaaguuaaagagacuguacauggcugaugcuuucuuccucacaauguacuacaaucuagaacaccaaaucauuaugagcacugagugagccuccauuaaauaaacaugcgcaccuacacagaaaaugucauuuucaagugaaauaacauaaaaagcaccacagauuauaagaggaauuuguguaaccugaaauuaugaagcccuaacccagaggugaugguauuuagaaacgcagaugaugacauaaaagucaugaacaggucagcauuucaagggacaagagagcucacucuguugugggagaacaauggaaagcgcucauguguaagaagggaagcaagacaaagacaaaccaugcuagcaacuuaggcuuccagucuccauugcuuugagaaauacauuucugcuguuuaagccaccuaguuauauugggggcagggaaugacugguguauuaagucuagaagacaguauuuuauuacuacaauuuuaauuaaaaugucaaauuuaauuaugaccaaacauucagcaccccaagccauccuaguuucaagguauucacaaaauauaaaccuucuagaaaguuauuuaauucuucaaucuucuguuugugaagcauuacucaagugccaggcuuaauacccccuaaauacaaaaaaguggaaacccacuuuaugauaugaaugaaguacagaacccacaaaccaauuuuuugauaggaaauauuaaaaaaaaaaacuauaaauaccuuucuuaaaaagccacaaaaaacaucaauacaguguaacuauuuaugcagcauuuacauaguuuagaugugguaagucaucuaaugauauaugagagccguguacugguuauaugugacaucaugcuaauuuauuugaaacugggucuaaugcaguuuaaguuggucucaccuucacauuauguaggugauguuucugaccuuccaauccuccuguuucuauuucccaaguguugggacuacaggcacguuauguacaccagccacuuuauuauguuagaggacuuggccauuuauggaguuugcuuugagcaggaguuaucugaaucuccuggguccuaaucuuauucuuuucugucucuuguuuaaaacuuggauaaagcuggaaagcagacacaacaaacgaaaucauaaacacaucugaaagagcaacaguauauuaaugcuuccauaagauaagaucucagccuuuuaaaguauuuaagaauaacuauauagccacaauuuaaaaacacaauuucuucucauguggcaggagucuauaaucguaguagcuacucagguggcuauggcaggaggauugccuauggccaagagaaggguaaccaaacuggguuucacaggcagagagccuccaaaacuaucuccccacaaacaugaauuucuuuauacauuguugcauuaauaaaaaucuaaugcgcuguuguggcacaugucuuuaaucccaacacuuagggaggcacaggcagguggauuuuuuaguucaaggccagccuggucuacagagugaguuccaggacagccaggacagagaaacccugucucgaaaaaccaaaauaaaacaaacaaacaaacaaacaaaaaccuaauguacagaucugggacuuuaacuauucuacugaacuuaucauacuaaauucaaaguuuggcuaguucuacugcagguuccacccuggccagcuuauaaccuaggccaaucauaaacuuuguaaaugcucaacucugaaaguaaguuauuauaaaauaaaaucaugccauucuccauuuucagaauuaaccagauaacccaagaacugugaaaugacuuugccaaagcacagcauuugcuauugugcuuguuucuacgaaggugaaucuaggaaacaagcaaaaugaauucucccuaccuaugccuauaugcugggcaccuuuuccuuuuccccugacuuucuucauugugugucugugggggugaggggugggggguauccaggagugacauauauaacucacauaaaaagaaucuaucagcuucuuagaauaaagagcucugaaaagaaaugauggaaguagaauaaaguuuuaauguuauuaugguacuugcaguuugggauaugguaguaccuuaccauauacaucuuauuuaaagauugacuauggugaccuucaaucaccaccucucaaccacagguggcuuccaaguagaaaagcaagcuauuauauugcccaccuucuaaggucuuacucccauugcacccaauaguaauuugaaugucuaaaaugauauccuacaauuuuacacauuuuaauuaacacaaguauauacuugaggcaugaugucgcaacucaaugugugagagacauauaaaauauacacacauagugugcagugaucaggucagagcaacugcccugucuaccaucucaaguguucauuucucuguauagaaaacaucaaaugguuuuaaauuacauuuuuucuauaauugcaaagcaaauauguugaaggccucuaaaauaugaaaaacuaucauuucuuaaaaaccaagguguaauacaaauaacugucaggucauaacuggaaacaacauugcuggguauggugguacaugccuauaauccuagcacuuauaagauggaagcagggguaucaagcguugaaacccaaccuggauuaugagaacaagagaauuauguuuccaggacagagaaaacccuuuauaauuagaaaaacaaucuagcuaguaaaucuuuuguacaaaaaaaccccaaacaaaccaacaaacaaaccacugcuguauuaaucagcuucuuaugugggucaugaccuaaaauguagcuaacaguaaagggcuucugaauuugcaauccuacaaugaauccaaagcauuucuggaagcacucaaccaugcugucuggacaacuucaccggguauaaccucaugccgugcaacaaugcagccuguaacaccucgguuaauacuggugaagccugugugcuaugaauuucaguguuuuacuguauauauagcguuuuuugcuuguauagaaauguaaaaugguuuaauuauggaaaacaauauuccucaggauguaucuaauuaguuuacuuucagacuguauuaugcuauacugcuugauuuuaaaauugcuucucaaguugauggcuuugucaagcucauuccagucuacaauacaauuccuacaaauuucuaagacgguccuuaacauacuucugauaugcaaaaugucauucucugcacuguaccagucagucuuugaaaaauguuuaagauuuuuacauucagcaaaucaaacacuuaaacaaaacuuauuuaugcaaaaaaccaaacaaucaccuguaaaguuuuuaucuuuaaaaaguaaaauaccaaaagaacuguauuaaaauaaauucauaaucaccacuaaauauuuaauuuguauauuucauauaccuggaccacagacaaagagagagagagacagacagacauguggaaagguuaaaaagcccuguccuagagcuggagagagagagcgcguggugggaaaauggacuuugcaaaccugaaugagaauaugaggacugggaugcaguggaggugagguggagcaccucaaaugccagaguugaggagacagacaggaggcucccuggggcuuucgggccagucaaacauugaacugaugagaucugugagagaugaccgcaguaaagggagggccaaaauguuaaaagcuaugaggaaaagaauuauuuuacaaugcgcaucuuccuucuccaucuuccacauaaccaaaggguuacaguaggggcuggaauuuuaaggauagcauccuuccaauaucacugaaacguuggucuucaaaccuuaaaagagcgugugcaucccucccuuacacguucuaacuuucauucuuuccauguucaaauuugccauacauauuacacgacaccuuccuuuuucaucuucaaagugucagaauacuccuccugccuuggaagauguuuugucuuuguacaaccugaccagaaauacucuuugauuuuuguuuuaagagaaagucacuuauuaaguagcccaggaugaccugaagccagcagugacucacucucucccgggcaugaagaagcauucagcuuucuuuucccacuuuuaaacuaauauuuguaugauccacuuuccuaacuuucaacagcuauucuagaccucccauacuaugcuucuuugauuugaucuaaaaaauuuaaauucucaaagcagacucgaauuagacuaccauacaauagccauauuuugaaaaaaaaucaaaacuugaauucaaacaaaauguuugaagauaaaauuguauuaaauaaggacucuuucugcuuuuguuuuucagacaagguuucucaguauuguccuggaacucacuaagaaagacaaggcuggcuucaaacagaaauuugccuaccucugccucuugagugccgagauuaaagaugugccaugacugcuuagcuaaauaauaacucuuaaaaugcucuuacauaguauuuaacacaucauuuuuuuuuguuguuguuuguuuuuuuugagacaggguuucucuguguagcccuggcuguccuggaacucacucuguagaccaggcuggccucgaacucagaaauccgccugccucugccauuuuucauuuauacuaaaaguauuuaguaaguuauaauauccaucuuuuuuuuuuuuggagugggggauguuuugguuucuuagagacaagguuucucugugcccugguuguccucaaauucauaggccagccucugccuggccuuaauauacaucuuuaauaugcauuaaaaauggaacuggagguauagacaguugugagccaccauguggaugcugagaaccaaaccuggcgccuugguaaaagcacaaguguucuuagccacugauccacuuuuccagccuguuucugguguuccaaaggccucuacaaagccucugaauaaauaggaaaauguaucuuucuggaaauaacuagaguucuaucagcaagaagcugguaucuuuaaaagagcacauaacuggaagaugggcuacacuuaaguucuuguuaucuuuuucauccuaguaccuuuguguagugcacugaccacagaaccacaacagcaguccuguacuuacacauuaccagcuggaaagaggaaggaagacugaauuacuaucucuuuucuucagacucaaaauuuagugacuuguuugagaugggaucucaauauguaugccauaccugaacuggaacucucugaagaccugucuggccuuaaacucacagaauaccacccgccugucugccagagugauguuuuuuaaucuaaucucccaugauuguacuuuaaauauggcuaaagcuagacacaguagccccuaccuuugaucccagcagacaagaggcaugcugaucucugugagacugagaccagccuggucaacacagugaauuccaggacagccauggcuacagagagacccaccuccaaaucccaaaaauaaauaggcaaauaaauaaaggcaagauugaugacaugugguaccacagaauauuaaguucaaaggauacagaacacauuuaauggucucuuuguaaagucaagagaccagaccugaacuugacagcugauacgaacugaaaagaacuaaaccuaaguucaaauacaguuaguucagcguucaaguauugaaacaccugaaacucaagguuucauuacuuuuucuaaccaccuugccucuuaaccuuccaccccccaguacuugacuuaaaagucuuuuggggucaccaaggauaugucaccucagucagaggcuguuuaccacagauuuaagaaauguuucuuacacugaacuuuaguacucauacuauguuauauuauggccuucucgcauaucuguaguagcuuugcuuaaucacucucguaauucucuuguugacauccuaguacaauugucaaguaccuauuuaggacuaguuggcauccuuuucugcaccgcugucucuuccuguuucaugaaucuauuccauucuaagcuuuuaaccacuuuuggucuucauuaccucaacuguugcuugaucuuauccaccacucauuuuuuauagcaguuauguuccaacggauggaaagacagacugguggaaugcuaauuugaaguggcccacagauuagaauuuaagaguuuacauguuuauuuuuaaagauauuagaugguuaaaaaaaaacuuaucaccaaauaauaaucauguacauuuuaauuucaaauuuacuuaauuaaaaguaaauucaccuguaauuccaguagucugaagccugagguuuaaaagggugacaaaucugaauacacaaagagacacagguggggucagggcguggaaauggggaaauaaaguauuaacacauggguugaagacaaagucaaaacuuacuagccagguaaucauaacuaucaacguaagagaaaaaguuuucuaguguuguaauguaagaauccuccuguaaaguuuaccguagugccccaccuccccaaacagucuuacccuagggcuggguagaguccucggcaaauauuaaaaaggaauaggaauuaggcuauagcuuggagguagaauaguugucaagcaugugcaagaccgaccaacccuaauucuggaacacaccuguaaccccaguacuuggaaagcugaggcaggaggauguggauuauaaugaaccucugccucaaacacaacacucaaaaaccucagccgaggaugacuguuaaugccuguaauguuagcaccaaggaggcugagguaggaguuugaggccaagcucugagcuauggcgugaaacuuaggaacacacacaaacacacacacaguaagaaaauuacaauuauugauauuuguguggaugugccuauauucagagaccagaaacugucaggagucuucuaagacucucuaccuuguuuuugagagucucucacugaacugggcguguacuacucuugguuacaggcccguguagcaauggauguucaugagugcuggagauuugaacccagguucucuugcuuucacagcaagcacucuaacccacugaaucacuuuuucugccccacaauuuuuaucuccuagccauaaugucuuccuuuaucguaauuaaccagacaugauauauuuuucugaguggauuuuuuuuucuacaccaacuuuucucuaguuuaaucacaugacuuuaauuucauccucagguauuaauccuaaaauuauaagggagcuuucuguggugugaagggcaguauuagggacuaaaccuaagccucaugggugccacacaaaagcucucuccgguucuaugguaaccccccacuaacacacaccuuauuaaugcaguccagggaagccuggaacucaagagaguucugccuccugcucuugguaacucuaaccauucuucuuuaagacuaaguaucuugguaauaagaaacaaagccacacuccucugaaaauuaagccagcuauggggccacaagccuuuauuuaauuccagcucuggggaggcagagguaguaggccaauaugugaguucaagggcagccuagucuacacaaugacuucuaagccaguuagaaccagucucaaauaaaaccagaaaaaugugaugcaaaucagccucacaaugaguauuggcucacuuaaccuuauuugaggaugcaaucuuugguauuucuaacuauucaauguaaauaaacuaugacacccaccauauaagcuaagugagagaaccaugggaaaggcccaggaaaggaagacuaacugggaaaaauuccuagauagcaguuuugugagacagggcuucuuugugucuguagcccuggccguccuucaacucauacaguucagccugccucugccucaguguuaggauuaaagauagcuaccaugacauggcuuccuggauaaguuuuaaaaaauacuaguaaugcuuucucuauaugcuaguugggccuuccuuuaauauucagcauccaguagugccucuaagggugaauccaauacacuggcaguaauacuuuuaguauccuagguaauauaugccaauaucugccaaugaaacaaaaguugcuuguugaacuucaguaauaaccucauuugacuggcucuucuagcaaagacacaggcuccuaaacaugacuguccugcuacuaaacucuagaauaaaaugguaagugguacaaagacaaguuuauaguuagcucuaaaaggaaaacacaacacaagugacucuaaagaauucuuaaagccacaaagaaacucugauugauacaucuaugguaucacugaccuaaaaaugcugugacucaggaaacuaacauuaacucagaauucuuagcaacaauuaacacauacugugucacuccacucuaaggcaacaaauaaauccugcuuuucugaagucaaaguguuuuggucagaacuuggguauuaacugcaggcugcuuuccuugugggaugcuuucugcugggcacgguagcacucaccuuuaaucucagcacccaggagucugagacaggaggaucucuugaguuugaggccagagccugauauacagaacuccagaacagccagggcucuguaagagagccuuugccucaaaacaaacaucccccaaaacaagaggauucaguuuccuaaacauguauguaauugacuucuuuugcauuuuaucaaugaugaacucuuagaaacacuaguuucuucuuccaggacucuccugcuuucccuucaucuuuagcuguccuuuuacuuacuaucagauaucagaaugacagaaauuacauaaaaagcuaccaccuagcuaacuaauaacuggaaguggggguuuggggguagcacauagacucaaggaaacaguauuauauucaaagacauugaagaaauucugcacuucauucugagcuagaacugaugccaggguuauuuacuauacagagcacaaaggagaaagucuuaugaaauaaagugcaguauguaaauguaaagaggaguggaagaggaaaaagaaacuacuuacggauccaaagacuuaggcuauucugagaacagauuuuacugcuugaacacuaguuucuucuuccaggacucuccugcuuucccuucaucuuuagcuguccuuuuacuuacuaugcacuaaccacaguaacaagagcauuacucagucuuaaauucuacagcaagccugagagguacugauaucaucuuuaguuuauaaugaagggaugggcucacaaucacuucucaaaaacaaaacaaaacugaacauucacaagcucucacuacgcagccuaggcuggccucaagcccauuucugucuuccccuagucuuccuaugacaccaaacagacacuacguuuacaucuggcagcauuuuaaccuucacauguaacaauguucaaacacccaagcaagcuaaagaaaaaguaccaguuaaaaaugugccuuauuuuagcaacaauuauaaauguacaagaccaaaugaacacuuugauaguucagagcauccccucuggguuuagaaaguauggcuuugacuacagcaccacuacaaauuugugaccuugaucaaauuacuucgaucucucaaauaucuuguccucaucuguaaaccaaguauaagagcuccuuccucaaagacuaggaucaaaaaggauaauguauauaaaggucuugagagcauacaguuagagguuaaguaaugagagaucagccagcauucuauguucuucacacacaccuacagacaccccccccaaaaaaacccaaaagcuuauuaugacaaauucaucccagaaaaaucauauaaaaacuucuuuucuauaugcaaacucaaucuauuucuaauuuuuggagaaucaaugcauuuggagccagccagaaaagaugcugcagugcaucugugacacacaccuaaaaauggcuccagccaaagcagcaucuuaaugaccaacauggaagcuuaaaucuacuuuuaaaaaaugcuagaggucagacgugguggccgcuucauaccacccucucuguaacgucuauuagcgggaauugacuccugagcacucgaugaagcaagcaucuuccgauucuucuggugcauucccaaagagaaacccuaacaggagggccgccuacuguacaauucuaaguauccugcugggguaugaauuuaugaaccgagguugaagaccagccaaugcggaaauccggguaguuuuaagagucaggaauuacuaggcaaguuggauccccccaccccaaagaucuugaacacacuucaaacaaauauacauccccuuuaaagagaucagagcgguccuuauaugcaaaaucaagcaagaguccucacuggcucccaugcuauuuuucuucggucuuaacuagggucucuacucuagcaaccaguaauacuaaacgcucucucugaaaaucaggcagcagccgagccguauucccacaaaugccgggcuggagcggccuagagggaggaaaagacuacucaaauccuccaagaaguuguucagcuuguccccagcggaagugggguucguugguccuggguccugguagagccucuacgaccgcccuggacuacacaccgcuggcugcaaacgccagccaucaccacaggagcauccgcaggcacuaagagcgcucggagccgccacgggcaccguccuccacgccguggaaaaacggcgcgcgcaggccccgcgcgggcggaggcucccucggccaucgcagggccgccccgccgcagcacacgccgcgcacaugggcgacgagcccugcuccggaucuccgcggacagcacgacgccgggagcccagggagagacgccgcgggcccccaggccuggcuccagcgcccgugccuucccucccuccuccaucgggccucuucacgguccggacgcccucgcucuccuuacccgccaggguugagaaccaagucugcgcgcuuccaaggggcucgccccggacggaucagggucaggggaggggagauugccucgagagaccguccgcagggccgcucggucccgaaagcccgagccaccgccguacaaaccgccaaagcacuuucgcuaccuccugagagggugagagcgagcgagaaaaagaagcaagauggcggcuagccagccccuacgugcuacgucau

SEQ ID NO: 466 - RNA, 1052 nt, Mus musculus
guuaaucuuuuuuuucagcuuuuagcgccuuuauuuuccuuccaucuuuuuuucccuuugcucaggcgucugcacagcagcucaggaccacucagugguggcuccaacccacucaguggccugcacugugggagcugcugaccaauccucagugacuggcugugcacuccagucuuccguggggaacugcuggaugggcacagagggaaccugcacacccccagaccagucggccaccucaggcugagcagcagugaacucaggagcuggugcgguccauucacccuggaauuccuccuuggucacagccuucucagcagccgccugcuccuccuucucauucuccucugggucucuguagagauaaagaucaggcaugaccucccaggggugcucacgggagauaguaccucgcaugcggaguacuucccuggccagcauccaccacaucagacccacugagugagcucccuuguuguugcaugggauggcaauguccacauagcgcaggggagaaucuguguuacacagagcaauggugggcagguugacauaagaggccucugugaggggccugguggucagcccugggauuggucaccacuagaagccguggcucccugaaggcugcuuggaucuggucagugaaggucccaggugugaagaggccagcgauuggaguggcucccguggcagcagcaaacuucagcacagcucgcuggccuguguucuuggaggagaugacgcugacgucagcaggauucucgauggcaacaauagcuugagcugugagcagcagcuucucccagguccucuucagguuuauaaugaagauaccauuacuuuuccuuuuguagauacacugcuccauuugaaagucaagguuggugccaccuaaguggguucccgcagcaaggaauuugaggacauccuccuccuucaucugcagggcgucaagagcuccgaacauuguguuaaguuuccauuuaaguuacgaugggaaucaagaacaacgccuuauggacuggucccuggguagugcggaaaaagca

SEQ ID NO: 467 - RNA, 26029 nt, Mus musculus
aaaagaaaggcacaaaauaaauugaucaagacaauccuggucucauucugacuugccuuacaggacgugguagcugauguuacuuuaucuacauucuuuaccaggaaggcagaggcuggcugcgaccucccacacgcaaauggguugaucauuuagucuucgguuauuguaacgaaggugaacuuucgaagagaacaagaagucagcggauauuggagcugguaauucuaucacagguguagucuucucuuccuccguuccuuucccacacaccccccccccauccuuauuuccccucuccucccuuccccuuuucuccucuucacuuucuucccuccuguccgguccucuccggucuugcgugacauuccuucuaauuguacuauuucgcugaauuaugauuccagguuuuccaucugaaaccuuaagccuuaauuaagucucaagcguuaaucgccaugauuucugacuucacuaaauacauacauacauacauacauacauacauacauacauacauacauacauacauacauacauaucuucucugacagcaggccaauccugguggccaggaugcugagggggcagucacaaccggaaaaguucuggcucagccccaaacuccucuccuccuccuccccgcccccuuacuugucugaagccagagguggccauuuuggauucgggcggaaaugaacucaaaagcggcugguuaaaaacccaaacaugaaaaccgggaugccccugcagucgggcugaagacacacgcagagaggcuucccugccgccagagccggcugccgggaacaggcgugcggcgcaggcuccccuggcgcccacaccuacccgggcccgcgcccucgcagcaccugugcggccgcucuagcucgguuccggguucgcgccucggugguggcgucggaggaacugaaggcccggcuguugagccgcuuccgggcccucggagagccgccggagccggguccucgggggugucuguggguggaggagccggggucugagcgucggagccagccgcgggccaagagggagcggagccgccagccuccucccgccgcccgcagguaaccgggagccgugcggccuggacggcggggcgggaagcgagccggggcggccgguugagcgcugccccggggaguucggggugccccugugccuggcgucucgggugagccccgccggccgaggccgguggagggccgagagaccgggccuggaguccagcgggaaggccgcgcggugcaggguccccgacgagcguccacacucagcccccgggcuucacguguagaaaagacaacaacaucucccaaggucgcuuuugcugaguucugggaucgcugcugcugcuggguugggggacaugugugugcucugagcugaugucacaccucggaguacuuuuaguccacagagacuacauguuuugcuugucagcuagcacaaugcgguugaguuccugacagggaacauacguggccgagacagggccgcugguaagauuugucacccaguaucuaagugccaacgaguacauauccuuaggacucucgggcaagucauaaccuuuggcucuuugaagcgaagggaacuagaaccgaagagagucucuacugucgggagaacuaagggacauacuucccccagagcacacgugguaugugguugaauaccuaggcaaggugcugcucccaaaccaaauggaacccuucagaagcuucgccugaagccaaagaaaugagaaggauggaagacauagauagauuaaaguguacagucacauccuagacugucaacucgacguuucauuauagaaaguauaagugguauagucaguaaaaaugccauauuagaauauccuuuucuaccuucgugugacuuucaaagcuaccuggcacuauuucauaguccccuucuuacuucccaaaccaagaaaaaauccguggaguugggaguguuccuuaugucuugcauuuccauaagcuccuuucagcuccguccugaggguuguaaaacacugcuggugccagcgguccugccucuuagauacaggcguggggagaaccagagugaccgccuuguguguucucaaauccaguccucggcgcccuuucccugcuguguugggcgcggggcucuguacagggcauccuauucgcuucgguagaaacugagccuugccuuuuuaaaggugcucuuccuuagggucauaggcgacuuaucacugugaaaaaugacugguuuugguagcuuccuaguauuuuugcaaaucuaaagguauuauguucguauuuauaacauugaguuaggguuaauagauaaucuaagggccaauauuccaacaaggauuuggccugcuauuggaaaucaguaagcuaaaugcccauugccccugccuuuugccagcguggcucaugaaucucagugaccgcaguaucccuucaggacuaacgaaauuaaacugguuuuucugccaagaagauacucaccugcugugguuuuccuuuauuguuuaauuuugaaaacuuuuauuuuguagugaaccaaaaaugcaggcuagguccacauacuuuucaaaugaacccuucccuaacucauaccucucuucucacugguguuugaagcaggggucagaguagaaguguccguuggucucagggaguguaggcccacucaagccacaccagggaagccgcaagcaccuagaggcuuagucagugaggcaguggaaaaacuggauuggaagccagcugcucguccugcaggcacuaggcagggccaagauggaggaugccugugugucucuauaaagcagccauucccccagcuugugccuaccauuaucucacugaccacucacuuccuuggugccuaccacguguuugcuuccauggggccccagcuccaccuccuggugaccccagcuucagaugugcuacuagugauaaagaaaaacaucagauccauagaggagacagugguccgccccuucauucugguuguggauacuaaagauccggcugugacucgacugcucuuuggccaggaggcaggaagaaggcccucgccgcccagggaccacugcauccaugaucagagcuucuuucucuggcugcaugcauugcuuuucucuugucccaguaaaauauggcugguccuugucauuccuuuuuuuauaugauuuuuuuuuuuggaauuaaacuuaaucauaucauuuuccccccuuucucugucaucccuccagcccuucccgugcauccuccuugccauuguucucucaaauucaucgucuuuuucuuguugcaugugugugugcuccuaaauacagaaguacaucuugcucugugugugugugugcaagcaagcaagcaagugugaucuuaauguugagcacaugguauugacuaaccagcugggagcccuucccucuggaggaaaacaucucugauucucagcauucccugggucccuguaguucuuuggcuaugagugagguugugugagauuucacucuuucaaguuagcuuguccauugguguccuuguuguuugggucuuacuuaggcgaccguguuaacaagauggucugaaucucugacuuuauuagcacaagaaaagucucuuacuuuuccuaggaaauagagucucacaacaaacguccugucccucuggcuuuugcaagcugaucccagagucucaagugcagaaaucgcgcuccaggucuguguguugggacugaacgccgcagucuccuguucucugcauuuuggccugucacagugggucuugagagacaaacugagcucagugcauuugauaaucuuccgagauuuugaaaaagccaguauucuauagcuucucgcccucacaucuucucauucucucgauaguaacguguaugcaucuauacacacuuuaaacucagugauaggcauggauuuuagcagcauuacauagauuauaucuguggcuuuucuuccaaguacaaggaaaauuaaaguugagagauuugugucauaauuauggcguuuguauuuaucuaaaggcuacuuaccuuuaacugaagaaguuuauaaacuuuauagauauuuguguacgauuggguuugggggaggaacugcacgugacuguuugguaaaauacaguuucucugaaguuguuagcuguuaaguaacacgcauuccugauaacuugcugcucguugcccauuuguacucucagaugcaguugugggcacugcaggagugaguggguaccuguuaguggucacauugaggaaaccuggauuagccagccuggcuaauauugcagaucgagauuuaaugucucaguuccuuuucuucuuuguuuguagagcuguuuggauuugaggaggagcugcagaacugccucacggcaacagggaugggaucagagaacagcgcuuuaaagagcuacacacugagggagucuccuuuuaccuuaccaucuggacuugcuguuuaucccgccauauugcaagaugggaaaugugcuuccguguuuguauauaagcgagaaaaugaagacaagguuaacaaggcugccaagguacugugcugcaguugucuuaauagcaucuuuauuacagccacaugcagaaguauuuuaugauuugguguuauaaaaacaguuguccugucuccagcauacuuucacuauagccaaagacccucauagaacucaguguaauggauuuuaaucaugagaaagguaggcaggugauuucauaugucuacucuaagaauguuuauccugccucugauucuugaugagagaccuuacaggaucauugacuucugggggcgggggggucgagcuccauuuuggcuccacuaagaaaguccuuggccccuuaaagucacugcugcauuugguugagauuauuagugcagucaguuugcuauuugguuccaugucaggggauauugacagcuuagaagaaaaugacuugagcugaugauaugucucagucauaguauucaaguaacacgguuaagcacgcgauccauccucagcauacacacaucaaaaaacaaacaaacaaaaaaagccacagaaaacauaugaccccaucuuguaauaguauucaguaaaugagccaauuuuuuuuaaagcaaggccaugucuugguaguuccuuggauaaccuacuuugcauauuaucuaaaucacaucuucaaaaaguuucuagagagaaaacuauaguugagugcaugaaugaauucuucgguguuuacuguagugggaacaggaaguuuucaguguuagcuaauggcuguuuugauugaaucauggucugcaucacuaugagcuccuuuagaaaagucaguagguguagaccauaucuuguucuugaagucugggggaacacagggagguugaacagacccucagggaaagcguggcuuucaucacagugugugugaagcuguaauuaauccgguuugagacauuaacuucaucaacucuucuauuuguguuuuaaagcacuuaaagacacuccgucacccuugcuugcuaagauuuuuaucuuguacuguggaagcagauggcauucaccucgucacugagagagugcagccucuggaaguggccuuggaaacccugucuccugcagaagucugugcuggaaucuaugacauacugcuggcucuuaucuuccuucaugacagagugagugaugugugucucccuucauugauggggacugaggccaccaucugggugguggcacuuggguaacacugagaggaauagaaagcaagcagaaggaacaagagaugccacagauaguuugugggaucagcaacuaguucucugucccugagcaguuccuuacauaauuuuauuucagcuagcugucauauacuucuuguuuuagguaagccuuugucuaacuacagcuacagccaauauuuguuaagagaaagcuuuggcaguaauguugcuauaaaccaaaguuccugcuuguuuucagagguucuacuccauuuuagcuuucaaaggaagaaauaaccauuccuuaggaagaaacgguguuugcauuugagugggugaagcccauggagagacagcccauaacaaggacgugcagcuuuugugcuuggcucuggugauuucugggguugguccugcuucucuuuacuuaguuuguugucgguguuucugagcuguuguuuucuggugcuuacaucggaagcauuaggucuucagcagucacuguuauacacacuggcaccaggcucaucuuaacaucuuacagcuguuucuacaaugggagauuggcuuucuuuggaaagaaauuuagaauuucuuagaauuucaaaguuuauugacguuugcauggcaacuagaauuauuaguaaugcuucauuggggaggauaacucuaauauauauaauagaaaagcaacaagaugagaggagcagguuaaauaggucccauccuugggucugacucuucuucuagaggcaacugugggguacucaguggaucauuccacugcauaucaagcaaauguuuguauguuuauucucucucauucuccugaauggacacaucuuauacauacucugagaguuuucuguauaaaauugcaagcccauuggaucacgugaguagcauaguuaguguacuuuuuauuuacugaaugauuccugguuugaaacggaaacguagcuagucaccugugcccguucucucccgucuucauacuuacuuggcuguacuaugguuugcuuuaugauuuuagacuugauuguucugugggaaguuucuggagguucuuaucauuccaucuuucucuucugacggguuuucguuauugccuccugacuagcaaacuuuccauugaaguggaucugggugccugauagaaucuaggccagagggacuuuaggagagagcguggcaucgucuucgggagccgagauauuuugguguaagguauuggaagcuagucguccaggcuuugaagacuuguguguguuuaaggacacguguggcuccugaucccuaagaaacgggacugaccgcaucuaugcauuggcucccaugucuuccuugaccugccugcuguucgaagcucccuguugucugccuuucccguuuuaaccacaucugguuuguucuuuuaagcacaguucuauuugcuuugcugcaggugccaggaucacauugcucugucugcaguaacuaguauuuaauuguuuaaaaccuucaacuauuggggugccaaucuucuuccuguuuuuauuucccccuccccccgcagggacauuugacacacaacaaugucugccugucgucuguuuuugugagugaggaugggcacuggaagcuuggaggcauggagacuguuugccaaguuccucaggccacgccagaggugagccaggugcagcucccuuccucauggagaggugguggugacucggcauggguucuuccuggguccuuuccugcuaccguggcuaccgugauuuuagacuugaaguugugaacuguuuguuaaugcccgaguucagaaaguuaaauuguaauaguuaauccucaaagaagugugaggcucauguauucccgucucacguagucggucaggaauguaaggcugggagguagccgucuacucagacuuguaagccaguugccugccucucuguuucgucuaaguucgugugccgcacauggcuuaugcuuacuacugagaucagcuccaugugucucucuuccauuccagcaguugagugccuuauuuuuauaucucuaccuggaauaguaccugucuauuaugagaccagagguauucauugaacaaugucuaaggugcugugucaguacacuguguucuauuggaauugugggcugaguuguugcuaucacgguacuucuauaauuuugucugacaugucuauacauuuuccuccuagugcacaagcugcacuauucucuaguuuauuaucuuucacuauuuguacucuuuuuaaaagaaaaagcuacucccuucuuaaugucucugugaaaguggugacucacugucucuuuaaaaagguguguguguguguguguauauauaugugugugugugugucuguguaugugugugcauauauauauauagagagagagagagagagugagugagagugugugugugugugugugugugcauauauauauauagagagagugagugagaguguguguguaugugugugugugugugugugugugugugcauauauauauauauauauagagagagagagagagagagagugagagugugugugugugugugugugugucauucuacaucugggcaggugccuagggaggcuagaagaggguugucagauccccugcagcuggagucaggcaauuaugagucaccuuaugugagugcuugggggucucuggaagaugaggaagagcucuuaacuggccucucugugauguauuggcucagucugucuuccuggaacauuucuacacuuaggcuugguaauggacaccugcaugaacugguacuccagucugaugcugccaguucuguauucuccucugaacucaccucagaucuaauuagcgugcaguucauagcauaaaugcuuugccauggcacaugcgcagugccccucacaggccugcccaugcuaccucaguuccugagccgcugccuauguggagcagcucugaggcuccccucuucucugaggcggcuuucugcuguacuggcuucuucuuuaccauuguccccuagaaaauggaaacgcaugucaaguggagccuaagucccgucucugaacccuucccacucugaaaggauuaaucacuccuccuaggcucccguggcuggcacucagcaguuuauuagaaucgucagcuucucucuggcuucugagcacugccuggggacaggagagcuacugcauucacugcguuuucuauuuuccucaugcuuaaaugccguuuggcauguaagcucuucagaaguaaucuugacuaggagaauagguggacuuagucccugguguagcuaucugcacaacccacaggagccucagauuuuaugacuugacagcaaaacuuaagauucccaugauuuagugguaaguuguaugauaaauuuuuguucugugaugaacaguuagcuugcuugcuuuuuaaaagcaggaucucccuguguuguccaggcuggucuggaacuuacaggcucaaguaaccaucuuccuucagcuugcuuccuagugcgcacuacaggcaugugccgcgucugaccacagcaccuuauagucauuauuaucugugcgggaaaaugaauagcuucaggagccucugacaacaaaggugucucucagacccucugaugggaagaggagcugauguuuauucuuucccucagccuugugcugugcugggaacuauauucacaaugaaucaggaagguuuuaacuuuuuauacugaauguguagcuucgauugaaagguuucauuuauggcucugcuucuacugcuguugcuuuuauagauugagcuaagagauuaauuuaccaaauaugcauaugaguuauuuugaauugucuuuucugucuaguuucucaggaauauccagucaguaagagacccagcauccauuccuccugaggagaugguaaguaaaggccuguaggucaggcucugggugcaguggaguacaacccuacaaagaccuaaaaagugcagcccuucccauuuccucuguccguuccucacuacauuauaaacuauacaugccucaugaugccucugacauugaaaaugcccgagguuaauuuuacuauuccaguuaaggaacagcuuacaguuuuguuuguaucaagauggagaugucccaguguggccagagaugguguuuauuucacgagacaccauugcugcuuuucuguacgcuguaauuauugggaagcaguaaccucauccaucccgucugucuuccuagccagucucuagcuggaauucugugacguguggcagagugcuuguuacugucaugaugaggaaagaccauuuagcaguuaauuuaagaacauugucagucccuuacaaguccuaaaauaagugccaaccuccugauuguuaauauucuacaggaaaugcaggcccagcuagaaacuuaagguuuacaaucucaggcucagccaaaucuguuuuauacacauagacuuugaaaaaguugaaaaaaagaaaguagcacugggcauggcagauuauaagaaaaaacauugcuuuaugaccuuuguuuucauuguguaaauauauacguauguauguguauuagccuauguauuauuuauauacuuaauauauauaauauauguauagcauauaccuaugugugcauauuagacuauguauaauauauuuuauucugagcuauggucaacauguuucagaaagccacagauauguauuauauuaugauuuuuucuuuuuguucauauacagauauuuuuaagucuuugauaagcccaucaacuaguaguuccaggucucuccauuuuggagagagaccugcaauuucauuggcauacagugcacaccuauuuuucaugcacuuugaacuaauaauuccuaaagcccguggagugugguuaaagccaugaaguuagguuugagaauaguaaaugcaacaagggggauguuggaggcagcuucuaaagcaggccccucguucuaauagucuuuaacgcauucagucuccagaauuuucaggccuucccgagucccacggccacgcccgggaugccuaugccuuuggagcuuugguggacagcuugcuccccaucuucaaugagcagggugaguuggagggcagcugcugcaugcacagacuaaggcgcagacgcauuccugacccgcucgcucugcauggggauccacggacugcaggcuucaggacagagggaaaacggcugccuaccacacagcuauuuagacagauagcagcagcagaaguaugaacaacagaaaagaacuucaaguaggaagcccuuugcccagggcugucccugcuguaugugguuaucuccuggcuuuguuacugagcugucucgcugugaggacagccccagugacugagcucugcuggccugaguaguaguguuuuuauuaaauuaauuucaaaaucaggcuuaaaguuucuuuaugcuuucaaagccauuaauuuuuuccuauuauaauuuacuuaguguuuuuucuuacgugcccuuuuaaggccaggcuaccuaaagacaguucucuacucccuucagucuccucuaauugcaugcugggcagccugugucagucuccugggaugggcucuaggacauaacucugcaccugugacaguuacugugcuggcugccacauucaguccuuuaguggccugucucauucugcugacaccuccuacaguaccaguauagcuuuuaccaguaugugcagugucugguguuagacgugccugguugcugucaacuugaacugucccuccuaaaugugaauuaagcccuaaaguuuuaaggcauuguugguuuuuuuuuuuuugaacuaacuacucuccaucacaccucuaaugguggaaaaugugaagaugaacugaaaauacagacauucagucaacucucuugaagagccuacccaaaaagacccuuccaaccuuccaccuuuugagccauccuuuuggaucagagguguauuaacaaucaggaaaugggagcauggagaaggaaggccccugggguagugcgggcugugccgacaagacagcuuuggagaccuuccaaggcgucuggccugaacgagcagaagucgugcagcaacagccagggcucuguuugcuugggcuuuuucagguugguuuuugcucucaucagucuccagcuagagagguccgaaaagagggagaaggccuggaacuaacuguagcucuggauuucaguuucagcggacguucucuccagcuuccuacagauccugcacucagcucugcugaaccccaugcccgagugucggccagcacucagcaccuuacugucccaugauuucuucaggugagggcaucaugugacacacuacagagagggaaagagaggaagagagagagauugguuugccuuucagguuuuuaucacagaaaguuugaaaacuucucagcugucaugaaggaauuauauccagauucaguaggaaguuugauuagaaagaacuaguccgugucaaauaguuuucaguuggaaacuaauugagaaaguagauaaaguugauaagcauggccccgccuugugcugccacugcauuaugggugccuguucucugaaucugucuuguugagagggggcagguuuguguuucgucuggcaguagaugguucccuuagucucaguguauaggcguuggucagagggaaggacacagaauaaacaccccggguucacagaugguuuugaacuucaagguuaguuuuaauuacguuuuuuuuuuuauuucuguaaccacagagcuugugcccagguuaguuccauguuugugaguuuuauuaacaaaccuaacccauguuucuuaaacaaaguauguuuauguguuuguacuuagagcuuggaagggaucagaacagaaggaaggauacagccuccccaaggaagaugaggccucuagagaggcaccguguggugggguguuacuaaguuaguccuguagucaccacaaguacaguugacauuuauguuugugagaaaauguuuuggacuuuucccaauauagcagguucccuccuccauuucuuaaauugggaaauacaauuguauauauuuguguuuauaagucugucaacaguuauuauuuucuuguauuuguagaugaauuuuagaaauacuuuauuucucaugcuaucauagucucuauaaagauaauucauuauaguaaauuguuaccacuauauguaacucaaguucuuuaagaacuguguaauagugcagagggaagaaaaucaucaaagcgcauuccaggccacaucagacauccguguguggcaggaggagcaaacugccggaagcagcaggguggagcaggccagcucccucccugaggcaguugcuucuguuaaagcgcuugugcauuagcuccgccucuuugggauacacagguccacuucgauuggacaggagucuuuaaagguucuuuguuuuuuagacuuaaaaaaauugaaacucugugacaaauguuacagccuagaaauaccaaaggaggaaaggaugugguggacacauaaaauaaauguagauggucugcuuaucgccuagggccaugaaagguaaacaacuugucucuuaggagaaguuuacgauuaugagcacauacauuuauaguccacauacgcuaccauuugcgugagaaauguaaacagacauaaagaugugguauuaaauuauaaaugcaaaaaauucauuggagcgcauauuacugguaugcuaagcauuucaagcaucacccucaagcagcacaugacacaaaucaucucaacaaacgcagaaaaauggcucacgucgcacaaagugguuucuugaguuucugguguauuuccacugucuuuuaauuuacccaccauagaaaaguuuguguuuagacuguuuucaguaaaacuacuggucaacaggcuaaugaaaauuaagucuugguaaaaguuaaaaguaacacgaauuuuuauguggaggaaaucauggaagauagggccuuaauaaugaauuguucaagaaucacauauaggugucagcgugagaaugaaggcaguaccugugcaugccaagcugugugcuuaaguguugggcaauaugguagggauaugcuaggacgguaugguagggauaugcuaggacgguaugauaggauaugcuaggaugauaagguagggauaugguaggaugguaugguagggauaugcuaggacgguaugguagggauaugcuaggacaguaugguaggauaugcuaggaugauaagguagggauaugguaggaugguaugguagggaugugguaggaugggagccaugcugucuuggaacagaauaguuuacagguuuggaacuaucuguagacucuucagaaacuggccuugccuagguccaaaagucagaaaaaugagaaaacacuggugacuucuauaaaaguuccauuuccuagauccucuuugguguuuucacuucaccacaggggacuuggggaucagcagcuucuuugauagugccacuucuuccaggguaguccacuuaaucagugucugugacagugagagcauuggaaagguguggucacugcugaagccuaaggacagcagcaagugcccuuccauuauauccucucacaguaggcuccucuauuacauccucucacaguaggcuccucuauuacauccucucacaguaggcuccucuauuacauccucucacaguaggcuccucuauuacauccucucacaguaggcuccucuaggcuugcuguuuguuucucucauaagcacuuugaaucugucguaugguguacguagagagcuagagaucguuucuucauugcaaguccuggucugcucuguacugauggcuucaacaccuaacauuaacaugccuuuuaccuuguuguccugcuguuuccucacauuuagaaaugauuuucuagaaguugugaacuucuugaaaagcuugacauuaaagagugaagaugaaaagacugaauuuuucaaguaaguucagaaaaaaaaaacucuuaaauucccucccuugaauuaaaccuuugucaccaugacagcgcugccgggcugaguuagacuucugacuucccagugguuaucgaaccucccuccaugucauacuuuguaccgugccccgggacucacuguccucguaaugcagacacauccacacugguaacuuaaacggaaagaugugccagcuuugcuuugcuuggaguggagagagaauagcucuucuagauagacaaacagcagagugagugccccaaggugagacccacugggauggcagcaccugaucccugcuggccagacuucagagcaaagguaaguggucccuguauaacaggcaggcuauugaugggauuuguagacagugagcugcuugccuugaagccacugagagagugaauggaacugagauggcuagaagucucugugcugaucacuguguuugugggggcagaguuagaucucaugaagcuuggcuugguuaguaugucguaguucuguagccagagaggagcugauguaagagcgaugauggaggagauaggggagauagacaugguggaacuaggacagggaaaggaacacuuggaguuacaguaaggcuggagacugagccaggaggcgggagagggagaggauguuagagcaguggccaaggaaggcuguauguuaacgcuaagacuguagcaagccaaaggaaaagaaaaacaaaaaaccaaauagcaaggaacggaggaagcagaugcacagcuaacaccgucagcucgggugcugaccgcaucggcgaggcugugggggagccagagggagaaagcaagcagggagcaucaccaggugggaggcuaacgacaucggugccucauuuguccucagauuucugcuggaccgagugagcugccugucagaagaauuaauagcuucaagauuggugccucuucugcuuaaccagcugguguuugcugagccaguagcuguuaagagcuuucuucccuaucuacuugguccuaaaaaaggugauuuuuuuuuuccuaguguuacuaguuauuaaggaguuuggcaauuauuaauccauuuucuugguugggguaacauuacaguauccuaaaguuaauguuuggcucuaaagcacagaacaguaacuccucccuaauaugauagcuuuaacucagguaccaaaacccacagguaaauauggcacaucuuccaucuuccuggagagccauauuuacugcaguaagugguuucacacauacacacacacacacacacacacacacacacacacacacgaguguggagcaugcaugaccuguaauaggugaaggcacacaucaucagguuauccuugcagugagucuguagccugugcuuccuaaguuacugagagcaaaccauguugugcuuugaauaaaaaguuugaaaaucuccaagaucgcuguauuucuuggagcgauggguugcuuuuuguuuuuuccugacugugaaaugaagcaguugcuuuggaaguuugucuuuugaugguaacacacuggguuagagaauguuuuacuaauauacuaaagaauuuagaguuagguuggauccuacuuugagaauucauuuucuuaaauaaaaaaaaauguaaggaaagacuuaauuuuaugugcaugaguguuacacuuucauguaugcaugugcccuacaugcaugccugguuuccauggaagucacaggagggcacuaauccccugcaacuaagaguuagggaugguagagucacuaugagaacuggaccugaaccuggguccucugcagucgucaguacagggcucuuaacuagugagccaccuccccugccuugcaggguugauuuucguagauuaugucacuccugccgaaauuauggguaguuacuucaguuucgaauugcauuuuaucucuagguugaauauuuuuauuuuaguaaugaauguuccuuauagcuuuccauccucccacuguggauuuuagagggagaagccaugaaucaccucagcgcucauuaaagaucugccuugugccaggaaaggagcaggauguagagaacgcuugagacggaaaagccuugauguuauugaacccacagcagaaacaccuuaagauugcagcuuaaaauuuagacaaauagauaaaacauguguaaaguucuggacucaguuggugaauugugcgcuucacucuuuucacugaaugacucugucuguacccucugauuugggguagagaacgcaccaggagaaaccccuugcuugcucucgccagcgcuguuccagucccgagugaucccugugcuucuccggcuguucgaggugcacgaggagcacgugcggaugguguuacugucccacaucgaggccuacguggagcacuucacucaggaacagcuaaagaaagucauccugccacaggucagagccagguuggcagugggagugugucaaaccuugucagagcaggccgaggagacugcgcacaggugcugccacugcagggaaggaaagggggagguugucagauaacaacucacaaagacucagccagcagcugagauccagagucacuagagggucaagggcugagguggcacuuucagucgugucucagucugugaacaguuaggauuccuuaugcuaauucuuggaggcaaaugaaugauaagacaaaaacagaccuaagugaagucauggccauucacuagcauuucugggaugcuuagugaacauaacauaugauuguccauaauuacauuaugguuuuugccauagagauuuauugucagugacuuccaaccuguuugucugccauggggagcgcuaguauucacucauccagagguuccaggcuugcauucauuuuuuaugcuauauaaaauuaucagaggcaugaaucaaaacaacagaaauuuaugugaaaaucugaagaacuagugugaaaucaaggcauagacagauguaaccacuucugagggccugcguguuauaagccuugaugcucccggcagcaguauuuaguaucucuuguugagcagcuguaucaggcaguccacacucauuuucauggagcauuuugcucuaggacuggcuuuuggggaucaggggaaguggggugagaucauggucuugaguguauagcagaggcuggcuucaaacugcuaggauuucagauguaugucaccuuacugacuucaccuauguauucaaggaacuugugaaugacagaugguuccuuuaggugacaccuuaggaugccaaaaaguuccuuaacucucaugagucuuuguauuaacaguuuaggacuuuuggcacuucguauguuagcuaaagcuucaguccucagggccucaggccuuauccaaacugacuuccugauaccuugaauagcugauaggcuagacuucgcagggaccucaggauacccaaguuuuucucaucacucucgaggagagucuagguucuucuccuaccccacuaagucacuuaacucaguuacuguaguaugggcugacaguguuguagaagcaugucauuggggagcuggcucuuugcacuuagguaugcaggaaugaguguuagccugcaugaugucaauuuagcagagaaaugcggugcucuaacucugaaacaggugcuacaggcugaguccagagacugaguugggugcucagcaugugaaacugucauaauuuagaaaacugaauuauuaauaaguuguuaagguaaacaacuacuaacuucaguagcuauuuuuugguaacuguaguuauaggguaacugggucaaauuuugugugccauaaguagccauguggaagacagggcaaaagcuguugauuagcucaauuaagagaagacaaagugcggggagaggaugcucggacuggcuuucucacucuagaaaaagguguugagaacagauugggcuuagguggacuaucugugaguaguauauuaaaugauagaagcaggcucugguuuaaagcuuuacguccaggaaguggcugcuaaguuaucacuggacugucaccaagucuuauuagaauaccuugaucuuacauaaaugagaauuagccacaaauccaugauuuauugguccaguuauacugagaaugacucguaaaacuaugucaacgcaauauucuagauaagauuaggagccagguacucagacccugcuaauccaccuucccuucuaacauagaacaaaaccugccccacuaucuuauccaugguucuccuuguuuaaggugcuuuugguugcauauaacuaaaauccacauaaagccagcuaaacacaaaagaauaguaacuaaauauuauaguguacuaaaaggaugucagacuaccuagccuggcauaaggcugcugggcuuggcuucuuucacuuugucuuuacaucugucuuaccuuuacccugaacacaaguuccucaugguuuugguguuacaaaaugaugucccguaacuugccauaaguaagguuuccugucccuuauuuuaagcaaacuggauagcucuuugaauaugcagcuagaugacuggugggagaccauaauuaacucagccagugggugcauguuaaauauauacaaagcucuugugggcuccucccaucugaguaugcauaaaguuaagaauuauagaguuuagaccagcaacauagcuugucagucccuagaaugaucugagugugcucugcagagcagugucgcuccuacgcuguuaauguuccauaaugaagaaaguuugaauauuuauauguaaaauugccauuuguagcaguugggaguuuuuaguuuccauuguauuucaucagggcucuaucuuaaaaaauacauauauuuguauguaugugccuucauuuaugugcaugcauaccuuccacagcucauguguggaggacaacccaugggaggcaguucucuuuccaccauguggggggaucuucauggucgucaggauucaaagcaagagccuuuagccacugagcuggcuugccaguccugguguuuuguuuucuuaaguagcaauccaagcuggacugggagggauggauauuguuuucuuccuuuagaagguuagagagccaccaaccuuagaaauuaaaugucguucauuugaacaagcuuuaugacugcaggccaguugguccuuuccaggauacaaagauaaugguugucuacccuuauccccaauuuugcuccuagguacuacugggccuucgugauaccagcaauuccauuguggcaauuacucuccguagccuggcagugcuggugucuuuacuuggaccagaagugguugugggaggagaacgaaccaagaucuuuaagcgcaccgcuccaagcuucaccaaaacuagugaccuuuccccugaagguaagacuaaaaauuauuuuauuagguuuuuuaguauuauagaauacagguucauguugaaguuaauagacagaaagcaugagaaaaaguugaauuucucuuuucaaacucauaguggguacagaguaaccuuuaauggcuuaagugagaauccuuuuuugcaaacccaugagacagauaacuguuuacauacgauuauuuuaaugaugcuauguacaaauuuauuauuuucauguacuauauauuaaagauguguucccacgucauugcauaaacgcuaccucacuuuucuaccugccucauauuucacugaauccaauucagugaguuagugauggcugcuguuucugcugcuggauuuuagucaguauguacuaguauuguuagaauacuuacacaugcaucuuuauauguguggucccacucccauagcagucucagaagcagacuuuguagguuagaggauauauuugaauuuuaguagggacuaaagacuuguuuuuuuaacacuagaugcuuaaguuacuuuguuagacuacuuggauaaaagauauuuuugaguacuucaggaaaucguucuuugguuuguuuuguauuaacaaaauuagccuuuuugcuacuuuguaugaccuugaauaggaccaugauuucuuuacaaaauccugggucucuaaugcaguuccuuggauuggagugcuagacacugagcgcugagggugaaggagagagacaggugcucuagagagcugaagccuuagagugacacuucacuccccuuagccuagcuuuaaaguaggggaaauauucagcuguaauuagaaaucuuucugacugacaucuaaucuuaaguguaaguuuccugguaauuguuaagccugcuuuccucacucacugucaaauaccacaacagaaaaguuauuuucaguguauaguucuguggugcuaagucauuauuuugggcuuguacucuuacuagccuuuuauucuuaaaaggaaauuagaaucauggucuuacauugcuaccagaacaauuuuaaggacugaaauuuuaucuaugcauugccucauaguucugucccaucaccaaguggcaacagaaccugucuuuaaccucaggagacaggaaacccauuuaauaauguuuuuuucaccaaauauuuaaugauguucuuuuaucugugcuacaugcaccauuuccccugacuguugcucaccaaucauguccaagguguaagcacaccccucucccuucagguucucccaugcauguugucugcagccagcagagucgggucucaaaagucuuggaggaccccucgucuaacguauucccuaaaugguugucuggcaacgugcccagcagcagcaggaagcgcauacaggaagaauguuacagcucucucucacagacagguaagaaccucagcuguguccuacugcucugagcuguuccugagaaugguaaguacacuuuggacuagcugucuugucugaccucuccaaacaguuguuaugcaucuaauccucccacauuguacauuaacaguacuugaauucauuuuuguaucagaugcuuugguauucugauaccuucugcaucauaauauaccaaaagugaagaguucuauaagauguuaauaaagacacguagccaaaaauguucacuaggauaggaaacuggaguaaaccuagaucccucaauaccugaugacauuugagaaaaucuguuuuaaacuuauuugugggccagacagauugaugguucagcaguucguuaaaagaacaaauuacucuugcaggggacacaaguuugguccccagcacuggccucuaacuaacuccagcucuagggcauccuguccucugacgucugugggcacuucacccacaugcacguguacacacacaguuaaagaugagucucggaacagugaaaugggcuggacagauggcucaggagguaaaagcucuuguggcgaaaggcuagcaacccaaguucaaugaaaaaguagaaccaacugcacucuguccuuuaccuauacacuaucuggcauguaugcacccagauccccuccuugccaaccccaguaaauaaauaaaaaacaaacaaacaaaaaacuuacuugagcacacauuucuagguguaauuacuaccaaaggauaagacugauucuguauuuaucuguauuugaaagacuuaugccaacagguauuuggacauuuagucaaugaucuaaaaagaucaguuaauuaugacaugguaugccuuugaguuaagugccauguggauuuggagaauuuauuuggcaucuuuuuuuuuaaaagauuuauuuauuacuuauuauauguaaguacacuguagcugucuucagacacuccagaagagggcgucagaucucauuauggaugguugugagccaccaugugguugcugggauuugaacuccggaccuucggaagagcagucgggugcucuuaccugcugagccaucucaccagccccuauuuggcaucuuuauguucuacugccuaacuuuugcuaguguucauggauauuuccaauuagaccuacuuauugcuugcuuuaagauuucaugagacuaauucucgcauauacccauaggugaucaguuuucucacaccauuaaauucccuaugaauggacucucagaugugaaaaacacuucagaggacaauggaagcuucccugcagguucuaauaagcccgaggaguggccugacuggagcgagccugaggagccugagcagcagccugccaguauucacagauggccccgagaacccugugauguagcagagucccagcacacaaaccugaccgcagaggaggugaccugggaugauggugaggcuagcuuuggcacugaaauaaacucaacagcuacagccucugcuccugugccuguuaccucagggggacagucaaccucugcagcuuugguuccucucacugaagagucaaagccuuugcaauccaguccuuccucaaagaccagucauagacagcaugaggaagucaaaccaccccaagugucacaagaaagaccccugaaggcuccgucaggacuugguuugggagaagaguuuaccauucaaguaaaaaagaagccaguacaagacccggaguuggacugguuugcagauaugaucccagaaauuaagccuucagguacuuuucuuauucugccugaacuaaggacagaagugauggucccugacaaggauaacgucucaucacugaugcaguuuuccucaaaguuugcugcaacagaaaugaccgaggugaguucuuucuuuguaauaagcgugcuacugucaggguuucucucagaaguccuagcuagcaauaaacaagcauuuuuaucaacgaaagaacagagugcacagcugacuaaaaauguucaaaguaaacccagaaauaauacaaccaguuccuagaaaauuauuucagagugcuacaaaaaggaacuaguccuucagacaugcccaaccuguuaacaugacacaaugcuaucaucuacaguguucaugguucagaauuuuaaagaaaucaaacuaccaagauggcucuaugguuaacaauacgggcuauucuggaggccuggguuugauugcuggcuuucucaggaugcgucacaugaaaugaucuguuaacucgaguuccaggagauucaaucccuccgaccuguacaggcaccagacacaguggggcauagauauaugcaugcacaucaauguuuuuuaaaaauacaaacccauuuuauaucuucuguuuugugccuuguguauaacuguccuuggccacaucuggguccaccugcuaaaugaguaacuccucgauguggggaaagaugucacuguguugcacacuuacuuuccaaugggugugguuuuuaacaucagaacuaaucuugcuuuuaacuuuugguaacagcuuuaucguuucuuaucauaaggcauucucucugggucauuuuuaaaugcuuggcuuuucagauguguacacaauuugccgcagacagcuagugucaguguguucuguugcagggagaggcagaaggcugggaaggagaagagcuagccugggaagauaacaacuggugacgauaaugaaaagcuucaggaagaauucucaaagaauuaauaccucaaagcaagcugcauggaugcaaaaccccaaagcagcuuguguuccccacaccaggagcucuuuuuugcagucugugccaagucaagcagagaccaaccucagguugcugacuaaguccugguggcaaaaggcuucggugccagaguccaggagaaagugcugugugcacuugacugaggccaguuuccauacaaagcaaacagcuaaagaagugcuuuuuuccaggacaauucuggaagaaauaaaaaauucaagcugguaagcuuaauuuugugccauuucuuuaaaagaguaaauucuauuaugaaauaacuuaguggaaaaagaaaacaaacaaaccuagcuguaaauuauaacuucagacugcuaaggcuccuuaggcaguuugucuguuuacagucugucccucuccuucggaccugggcaguuacuguuucaccuguauuacacuggaccaaagcucucaaugagaaauacccacccucaucucccaucuuguucuuuaugucaaauaaagauuauuuucacauuuacaaaagcucuuuuaugugcuaugaaaauauacaaacauaauuuacauucacaauuucauuuacaaaacacccaggcaggcaucugaagagucagcccaguucugucgauacacaggccauucauauuuuacccuguaagcacacagcguuuuagcuucucgauccuuccuugcagcgccuccaguucuggcagcagccaugcuggagcaagagaguguuugaguaaaaacucaguugucuccaaagcccuugcugcagcuuuaaauacugaucuguauucuucuucaaagggcaacacccgacgggcucucuuugugugaggcuggaaaauaaggaaaucaugaaacaaguaauacauaauacucauucuaaaaauaauauaagagaaacuagucauaggaucacgaagaaggcagccuucccauuuguauuaacaauaaccuaaaugugcuacuacucuccacguccuaacuuguauguggcagacaagaagucgcacugugcaacgguucccaaugauaaaugcugucuuguccaacaacuauccacgaguagucuuuaaaaacaucauuaaggaaauaaaacaugaauuuccuaauaaguuuguaaaugcugagagccauaauaccuuucaacauacuuuuggagccaauuaaggaaaacuaaggcuccagacaucuugcauagaaggggaagaggaacugaggugaaacuaaaacauaucuuaacaacuaguuuuucaaagggaagucacaguuuaaauucauagggcuuucgaacacaacugacuuaaauugaacuuuauauauauucaggccuacagcuacauccaagaaaacaaguuacuauugcacuauaaaccuagaacauuguuuuccuuaggacccuauucuaucaccuguguucaaaacacaauuuugaauguauguagucgugucaaauuucugccaauuaauagguacaugugauauuugagaaaagugauuauuauugaugagaugaauugaacaaacugacaucuaagugucagaaaaugcauuuaugucaucauugguacaauaugcaauuaccaauaauaaagaguauauuugguacaaugguuacaauuau

SEQ ID NO: 468 - RNA, 2359 nt, Mus musculus
aaauucugggguauucuuuuuauuucauuacgccauucggugcauauuaacuggggugcuuaaaagucaucuccauuagaaaucucuuuagaccuucaucaauuacuucaaguguucgagucucaaauacacccuuuucuucuacaaacuucuggaagagaugaacgccaccaccaacaccaaaauaaugugcuuugcuggccagaagcacccggccacuccuacuuaauagccugaggaauguuucaugcaaagugcuguaauaauccggauuauaaaugguuucugaagugagaaugaggucauauuucacaaacaguuuuucacguaauacaagcuugcaaaacucagcccacuccccagagaacaagcgacauuuacagauuucucggccuacuucugacuuccuuugucuuuucccaucuggcucauuuuugccauugcugucaucuugcaaagggacauuagcaacuacauuagguaaggucaccucaucgaucaccaaaccguuguaaucuugaaaaugaacuucccuagccccuccuuuggaugcaguuaucccaagcagcccagacccacagccaaggucuaacacuuucugcccagcaaauuucacuuuggcuuuugugaaguaagucaagaggucaaaggugcauucccagauuuucaagccuccuucauaaacaccugggaucagaucagaaugagaagaaaagcucuuugaaacgauguuuucuccagggaauuucucuuucaaagagacgguuuucacuacugcuguguuagcaugcuggggaccuggcaacauuuccaaaaccguauuuucuaagacgugauucacaucuuuaggcaucacauguucuuuagcagguuuccaggagggcugguguuuacaagcuucugggucaucugaccugucagcaauagggggugggcugccagugucuucagaggaagcugcauuucccagugaggagcauuuccaagagugaucccgaggcaagcccggacguucuguagauugccuuuuguccugcuuuccuuucugacuuucuaagacacaaguuccaucaucgagggauguuaauuuauuuuccagaucuucuucuaugcugaaauugaauugaaaggccauccucuuuuucuaugcacaccguuuuuuuaccaaaggaugaugcuucagcuucuagaaagaauuuaauggcauaaccgaucacacagucgauuaguucuguugcgcccaaugucuguuagcugcguauacaccaucagauguauucagagggggcuccaaagacguuuuagacgccuuugauccuuuuucaguucagcccuggaaagggaagggggaaaagaaaauguuuaaaaacaaaaacaaaaaaaggcuguguguaugcgauuuagcaaaaugcacagaugccuuaaguauucaaaaguagaagauaaaacauaaagacaaacaaaagaauagcuauagcagcuaccaccuucaccagaacaauaaaccccaagauuuguagacaggacagccuagcuaccugcugccuggucuuuuuuuuuuuuuuuuuuuuuuugguuuuucgagacaggguuucucuauagcccuggcuguucuggaacucacuuuguagaccaggcuggccucgaacucagaaauccaccugccucugucucccgagugcugggauuaaaggcgugcgccaccaugcccagcuuccugccuggucuuuuaguugccuugugcucaggcaucuucaccuucaucuuccuaaauuucugacgcaucuacaguaauuauuuucucuuuguucacaguggcauccagguuuguuccuucaucucugccucgcaaaaacaguuuaagguuuuauuuggguaaguaggguauccauuuucaaacacacacaggugugugugaucuggugugugcaaacucauccaaacgguacauuuauguguacguaguucuacaccuuaugugacuggagggaugaauaaagacuaggacuguggaaaguauaaucgauuguauagaaacauuuccggcaauaugccagaccauaacacccguuuuaauuugcacauuucuggacggugggaucuccguucacuuggcaggagccguaggaacggaagcacgcacgccaguaaaaucauuccuauucucgaacgcaccucacaggggaguagagucauuccuggccucagcccaggucacccuugaaacuacgcgucgucucaaaguccccccggacugaggauagcaaaccugaggacuucuggucucagcauuggaaagucagacgccagggcgaacaaacuaccggagaaacucgccuucagccuacggcgaacacca

SEQ ID NO: 469 - RNA, 2933 nt, Mus musculus
uucuucuggaacugguuaagugagugcacuuucauggagggauucuucauaacuguuuggcacaucucacccuucagcaagaaaucacccauugcuaccaccaggagauugugcacaggaguauugaagaaacacacucagugcaaugguggcuuuguguggagaucgauaagaggagggcacaggacauugccagcugugagcaggugagauuagguauugucugccucagugggaugggaggucuggggucauuuagcacagcccugucuaguuaucuggguuugggcaucagcugguucuccaugcccuacuuauuuucuacaaggaaggacaguaagagccucauuagcuaauagagaaauguuugugaagccaggaagcuccuggggaggcuacaagucacagcagauugagaaaggauguuuguaagucuaagagccaggcuuuccuuuccuuucaucccaguccuaaacucucuuucugacagcggcugcuaaaauucccuccuguuuggucauucucauguugaaagcuucaccagccccucaaguuugcaggagagaacuauuaaguguguuuucagaacuccacugaagcagcuucuccuccagacuggucugugagucccgcggguucagacacucucugcuguuaaacacacacacacacucucucucucucucucucucucucucucucucucucucucucucucccucucucucucucccucucccucucucucucucccucucccucucucccucucucccucucucccucccuccucucagcugagcugcagauggcuaucucacgaggggaguaaggaaaaggaacauggcauguuuacaguuaacuugggugguuccagaagcccucagauucuccaacagaauuuuaagagauggcuuugggaaaauuauauaaugguuggugccauagcacuggcuuaguaugcaaaacacacacacauacauaugcacacauacauacauauacacacauacauacacacauacauaugcacacauacauacauacacacacacauacauaugcacacauacauaugcacacauacauacauauacacacauacacacacauauacguccccucaacccgacccacccacauacacgaauagacaaagagacagaaaaaucuagaauuuccguauuuucacaaauuccuacaggugauuuugauggacagucagggcucaaaaucacaaaccuccaccuuauuuucuuuaacaaacuguuuccaaacagcaacuacugacuuuaucauuucacuccaacauuaugagcaauaaagaagguuccuucgcauuuauuuaccuuucuuucugagacgcuuucuuagcagagccaggagugucccgcccacugccaggccuguuguagaagccacugcaccacccaaguacgucagagcuuccuggauugucagugucccugcuaaaagaauaaacacacgcgcaaggugugaguguagcaugcccagaucagucguccuuccugaggaaucccaaggacugggacaaggcugcaggcaggauccucaaaggccccaccggugccaagacccuggcaggaaagaucucgaagucagaaauccacuguagcagaacaggaagcagggacugucugcauccuaaguacuuugguuacuuuaggucaaaaaucgugauucuaaaguagacaagguaaacaucccauggaaggaguucgucagcagauucaaaaagccugugcaugguaguggguaaacgaaauaaauguuugggucauuucgcuuucucaauugaagauuuggauauguaacaaaaacagucuuaccggcuaaggaccgugagaaguggggcugagaagugaggguaaagggauggaguaugacugaaagucgagguguucucagaggcagguguuaaguaaaggucugagaucgcaaacuaggacucugugagaaggaagggucaacgugugcuaagcagagguuuuaggaagugggagcauuagugucacaaaucuaaacaaugacaaggaacggcagggauccacgcaggcaccagcuucaucccuagggcuccauauacagugaagggacccuuuguggcaaggggagccagcaaagggaagacauucuaccaugagaagugugugguaaagaaacagggauucuguuuuccaaaucaagcugguguucuaaaccaugggguuuuuuuuuguuuguuuguuuguuuuuuguuuuuuguuuuuuuuuuaaguuguaccuuggcagguuggcauggcaucugaccagugaccguccucucggcagguugcucucacagagccguucagugacugccccucugggcacuggaaggugcagguugauccauagcuaaaguuuccccagggauuggaacaguucauugcuacugcuguguccaugugcaauucggagcauuugaccgcugugagggagaaugaagaaugugugagaagcaggugugcugaagggagcauugugguuugcuuugaacccgacuggaauugucaaucgauggacuggaugcaaaaugucacgauggaggucagucauacccaagagucacacacagcagcuccuaaaauaacaccuugcugaagccuccacuggaauaauacuagccugagaacaaggauggcccauggaaucacauaacaaugcacucgucuuguuuccaaaaagucuccuuacaaaauuugcccuucgcaaacacuaucgaaucuguauguaucuauguguuauuauugauguguugugaguaauagcgaugccagcaugugauugacaaaauacuuauuuagcguuccccacagcuggacacuagaaguuuggaagaaggagaagccacgauucucuuuaaaccauuaaaaaaaaaauaacuucagagu

SEQ ID NO: 470 - RNA, 3644 nt, Mus musculus
ggugaaaaggcaagaauaccagucuugaauuuucuuuauaucauauguauggaauuuuaagcauguauuagaauauuaagcucugauauuggcaacaaguaugugugacugaguggagacaauagaauuuauccuuggauuuccauucccgcccagaugagagguucuagcaguacauaaccuguuccaggauguuugagaucccacugaugccaaggaagugacguugacagugugggcuugccucaaaauccccugugcuaccugagcagaaaccaccugaagucaucuuuucaaacaguacagggaaaaguccccuuuccugcugguagacagugcagaaccuagaaagaggcaaaugucucagacaucagaggggcccacggugaaagacuucuuuaucuuguaaggaagcaguccuuuaauuaguuuguuucuuuuucagaaacccggucugccaaugucucauucgauuucucaggauuccacaugcaagugucaaguuuccugucacacuugacuguaacuccauggcauuugggcauuugcugagguucucuguaguuuaaaacaaaaaacaaaacaaaacaaaaaaaaggacaggaaccuagaaaaagaacuaugcacuuucccaccucuccacccaccccuuccugcuccgccccucaccuuccuccagcuccgccccuuccugcuccgccccucaccuuccuccagcuccgccccuuccugcuccgccccucaccuuccuccagcucagccacagacccaggagcaaauguuucugcucuggucuguggcuuguuguuacuuugcuguugcugaaaacgggagaguccaaggcccuggagcaucuuccucaccaggugaccaggcucuggaaaaccgaaggucuuucucuugggauugcagaguagcaauguuggugggcaggcagaccucuaguuuaaggggaugccugcuuuaagaucuccugggucuuccauguuucauaucaaugagguuguuuacaccucugcugcugagacuuucacagaaaccuccagaugguacuaggggacacagaagaucuggaacagagccaagacgucacaucugacugcagacuuucccuccaccaaagcacccaaagaucauuguuuggauguauaaauaacucaacuuccccaaaugucaagcucuuuguguuuuguucaauaaguucuguguauagcacuuugucuaccaccaauguggucacaguuacaacccucuaaaugacagcuggaccuuccagugaaagcacaaauguaugucguauauccccugaccacagaggaaaaaaacaaaaacaaaagucagaggagcagaaaaagguccucuuugcaauuacuguucugcaggaaagaacagauauuguuuuauauguaauuuaaugcacauauuuaauaaauaagucacugaaaauuacauauggcuugucuguaauugaugcaaacauuaaggagucaaaaacugcaguugcuuugcugagcuguaaugagauccauuggucaccauguagccuggacacauaagcagacaagcaagcaagggcaguaaagcuguccuuggaaaaguugcaaugauuugggggaaaagggaagaaaguaauuuagagaccugcugcuuuuuuuuucuuacauugucaauagcaucuaauuuggugugugugugugugugugugugugugucuguguguguguguguguguguguguguguguguguguguguguggagagagacagagacaaacagagagacagacagauagacagauacuaggcuagauauuauaggaccauagaucucaaccaugucucuuguguccgaauuugcauuuuggaaacuccuggaacuguggaucaggaguauaagacaucaucccugcucuugaauagaucauaaucuagccacagauacaagggcaucuugaaaaccuaaugaaagguuagcaaaaggaguauauaaucugagcagauuaaguucaugaaacggaaaagucaacuggaacccagaaucagagacaauggcagaaauucugacuuuaaagagcagggaagcagaaagggaaggaaauccgugugagcauucuuccuaguguaguuaugugugcacacaucugcuaauuaauuacuuuucaguacauggucucacugcguagcuuaggcugaucucaggccucaaacucacauuccccugcuucuagcccucgugugcugggauuacaggcaugugccaucaugccugacucaagaaggggcauuauaaacugacugaagaauaucagugaugugaucagcaaagaaacagaagcaggaguuggggggaggggagaaggaagggaagggggagggguggggcagggggagggagagggagaggcugcugcggaaccuggaugguaccagaucacaauuuacuggaugugcuggaagcagaaagucugagcagagacaaaguucuggagaauucagggcaggccauccugcugauucaggcauaauucucagcuuugccaccaacagaaaaauaaaaucuaaaacaccaugccaaggauacaggagaacgagcaaagacaagaucauagacuguagcuaccuaggcccuggggacuguccaguuuacaacaguuuguccccucccaauaauaagaucaaggaaaacuagaauugccauucuuauuuuacagaugucaaaaguauuucuaaagacauaguuggccccagaccacacagcuacugacuaucucaaaugaguucucuaaacccuggucucggcuacacuugagcuggugacaagcccuuaccaagcggucuguccuaagagauucagacugcuaaccuguugguggaccuguccugaggcuguuuucugguuacugugcagugccauuuuccugggaucugaggauggguguugggucuuacuaaggcuugcagaaaucagcugacaagccuaaacuuugaaccccuaccccauccccccaccuccacccgcgcagguuaagugggauugcugcucccaccuacguugaagugggggaaaugcugcuuugugauggggcggagacccuugggcacugcuccagagccauaaccuccagcaggcuugcccuuccuuucccucuacauuccuugucuggcauucucucuaguaaaugccuguggccacaggggggagugaccucaacaagccccugccuacacuaggcauagagggagguaggguuagacagccaccacaggggacagggacacucacugugcccugcagcuucuuaguccuccagggagacagaucagcgcgcaacagggacagagcacugagcacugucggugguggcagcgcgcggcaggacaagggccaugcuccuagucugcccgugcuucuuccuccuggugguucugggaacccgcugggcgggcuggggcagccaccaggcagaggccgcgcaacuaaggcaguucuauguggcagcucaggggauccucuggaacuaucauccugagcccacagauccaagguaacugggggugaaauccaggugggcuucuucaaggaagaaaaucuauuauaguugcaaggggugggggugggcugggaggaggaggaaaaggaaaa

SEQ ID NO: 471 - RNA, 68554 nt, Mus musculus
acauuccuugucuggcauucucucuaguaaaugccuguggccacaggggggagugaccucaacaagccccugccuacacuaggcauagagggagguaggguuagacagccaccacaggggacagggacacucacugugcccugcagcuucuuaguccuccagggagacagaucagcgcgcaacagggacagagcacugagcacugucggugguggcagcgcgcggcaggacaagggccaugcuccuagucugcccgugcuucuuccuccuggugguucugggaacccgcugggcgggcuggggcagccaccaggcagaggccgcgcaacuaaggcaguucuauguggcagcucaggggauccucuggaacuaucauccugagcccacagauccaagguaacugggggugaaauccaggugggcuucuucaaggaagaaaaucuauuauaguugcaaggggugggggugggcugggaggaggaggaaaaggaaaaggaagaggaggaggaggagagagagagagagagagagagagagagagagagagagagacuaauguuguguggguguaauuuugucucuauggacauaauuuaucauuuugaggauguggaaauuucaaugugaaugguuagcuguggcuuucuuuccaggugcaaucccuaaucuguuuuccccccacguuuguuaguuuaguguauugauggguugaaaggacacaccuccacagcccucuuagcccuuccugugcauucggcuuaagccuuuugacagucugcuuaaaaaaaagaaaaaggaccuucuaguuauauaauauuuauuccuguuaaacacaaguucaucuucuaaagaaaaagaugucaaagcugucaccauguacuucauuauaaggagauuuuguugccuuccuauaaacgauuuucacuguggguucagagggaagggaaggcacacuuguauuuucacuuuuccuagacuuaccccuggcuaccuaauguggcuucauuuuuuccucucauuuugaguuacuuccuggaauaugacuuauccuggguauuuuggucugcccugauuauuacccauguuagugagcacauaagguagucauucaaaggcaugucuaacuaagaggaggcuuaaauaauaucaaaccuaacuuugaguugcagaauauauuuugcuaaccugccugcaguuacccaagucauagauucuacguagcacuugcgaccacgaguguuuuuauuuuaaaugcuaagccucgcuuacugguugacgcauuuuuuucccuuuuaguugacaucaaaguuuaagugauugugaaagauguguuccucuuuuacaauugcaaaaccaaagcaaucagccaaagaaaauaauguaauaucuugaaagcaauguguaauguuuuaguauaaaugaauaaucagccuuugaguuugcuguuguugguucuggguuguuugggaaggcauuguauucagucuugguaucaugcuagugagaaauaucacaucuaaaugacuuaaagauugcauuuucagaguaauaaucuagaccacacccauacucuuaggaaaguaccacuaacugaacaccuccaccccaccccaaucccaaaagaaaauaacauuauuuccaacaucaauuuugcugcuuaggggcagagaacacagacuuguguucaagugacugcauucagccugggguaaggcaaagguagguuugaguuaacacaagguuagagaugaacaaauuccgaucaaaugcacagcaugaggacucuagcuaacaacauugcacaggucuuccccugguaaggaaagagaaguggguaaguuaccaguagggaaaacugcuaaaggaaguuucccagggucuucaucccuccugugaaagauguaguuaucaagacaccugaccuuguugacucuagacauagagacuggagcggacaccuacugggucagcuaaagcugaggaaaugguuuaacccuccaggaucuuuaucaggaggguguuuauccucugcaucuucuaaggaagcgccuuuaucuucccaaugcaggauuuuuucuaauacaaauccuagaguuuugcccuacugcugucuuugcuuucccaacuagaggcaggcuccaucagauggacaccaauucaccacaccuucuagucauucaaaaccacggaaugaaaguggaaaacguuucuaaaugaugucugauucaucgacugagaaaugguucacauacacuucucagugacuuauauuuuuaauuuagaccugaaguucgaguuugugugacgagcuuaccauccuuuauagaaaaaacuugacucugaagagcagacuuagagaagcacugggcuuguguucaugggagcaugcacacugaggcagaaugucuuugaaaagaccaaugauuaucccauugacuucacuugugauccaaauuuauaaaacccugggcuuuggaaauacaauaaauuacugucacuuugcucuucaacaaaaauagucacauagacaccuuucuuucuggaauagaaauagauagauauuauaugacuuucaaguucguuucuguacuuuauuuccaguuugaauucuauaccuuccuucaagaaaauugucuacagagaguaugaacaguauuuuaagaaagaaaagccacgaucuagcaacucagguaagccuacaaaauauauuuuuuaaauuacuauuauauugguguuuggaccuaaaaucuaauaaacgcuaaggaaaaagaaaaaaaaaaaaaaccucuaccacugaucuauaucccuggucuacaucuaaauuuuuauucugagacaaggucucuggggaagacuaugaauugugauuuuucugucucggauucucaacuagauggcauuauaggccugugccaccagacacagccuguaguuuuuauuuuaaauauaauuuuucguggaaaauauuguauucuuuauacuuaaaguaucuacauugugaacuggucagauggcucaguggcuaaagguaauugcugcuaagccugaagaccugaguuccauccccaguuccaugguagaaggaaagaauuuaaucuuucaaguuggccucugaucuccacacaugcaccaugauacaagcacacaaacacaccccaaaauaaguaacuaaauauucauuuaguuaucuuccauuauaggauaugugauguuuuugucaaacaccagcaguauaauauguaugcucagacccagugagaauauggggcucuucaaauuauugagaauuuuguagauggugaaaucuaaaccaaacugcaguuuuucugagcaugggguaauguggaauugaacaggucacauguuacacagccagccaugccuuuagccucggucaauaaagccaaacaaaaaguuucaguguuucacuuuguguuuauucaucuagcaaaccacaggugagcaccuucugcgggcuugacggugaauuaggcacuaugagcaagcacaagaguagacaaaguaaacuuagacuuuccuuaguuggcuaggcacuggugugcccuaacagaaugaauuugcuauuguuucuauccagcuuccuguacccauucaaaggagcuacauagauuugauccucugcuuuuccaauagcuauggcauuugaaggaaaccucucuucuuucuuucuuucuuuuuuuuuucuuuugugcuuccuuaaucaaacacuaacuuauugagggcucugagaucuuaacuauacgaaccuauuucacaggaaugacagaggucaucuccagggagagcaucuuccaguugcauucuuuaccauuaguuugcucaccuucucccagccuggugaugaucuguuauccauccuaggcucaucuccugccucuucuccucccccaccccuuccaccuccugcucucaccuuuguccucuggucucuuucacucuucaguucuuccucaaaucaaaucuuuuccuucugaaaaaaaaaaucaccaacagaauauuuuucagguaaaucuuaucuagaaaaaugaaaauaucuuucuguuccuuuaccacucucucucaaugccuccacucuucccuugcucuccaaagucagccacaacugugguuuuuacagcuacuuacccaggagccauguccuuuaggacagagcuuggauucccacccuagccuggcucaaguaccuuuucucucuucuguauacucccagcacccugaacuugcgcuugccuguuagagaugcugugagguuuaacgaauacaaaguacuuauccuaugcucaaacaugacaagagcuuagcagaaguuagcuacauuauuguuauugcugcuauuccaguuaugaauuaggucuccaugagagcaggccuaucauaauaucguugauaugucgacacaauauuuuugcucauuuuuaucuucuugugccuuauaauuuguauauuuauuuacuuuuaaauaaagacaguuaaguauucuguuaaugaucgcaaccuaggaacgccaccucugaggcuccguaaaggugaauucugacuuuccgucaucugucagcugguagagaugacugcgaauggaacauuauagcacaguguuaaggaagaacaauacagaacagucuccacuuuaguggugaggagagagagaaaaccgggauugggaggccagacguggguguggguuggguauaaagaugcauuuuagaacagaaguggagaacaugaggguuuagaucaaagguucccagccucuggguugaaacccuuuagggauuaaaugacccugucacgggggagacuaucaaaaaacacaaauauuuacauuaugauucauaggaguagcaaaauuacaguuaugaggucgcaaugaaaauaauuuuaugguugggggggucauuacaacaugcugaacuacauuaaaaggugaaagcuuugucuugagggaaauagagggacacugagaucauuuaaaugggagagaguaggauccagguuagcauuuuagguucugcuuucaauauugcucuaugagugugaaccaacugcaaugccacacguguaggaaaaugccaucauaaaugccauuguuccccaugcuaacugaaaauuaauuaaaagcuuuguucucuccaaaucuggaagcuggauucgcgggcagagaaaaugguaauguggcuuuggucccaauccaggaaacaagacagcagggaagcugggguggagaacauuaaauggauuccaaagauacuuaggagcuaaaaucagccaaacagguaguuaauuggauggagacaagagaagggaauuaugacugacaucaaaguuucuggauugaguaguaaaauguagaauguacuguguacaauguagaaugugccauucaaugagaaagagaacugaaaaaaaaaaaaagaagaaggaugcuuguuugggaagauaaugaggucagauuuggagucugggguagaauguagaaugucuaccuaguguuaucaaaggagcagguggguauaggaguuuugcuuuuagguaggagaacugagcuagauagauacaaauauucaggagacaucauaaccagguuacaaaggaagcucugagggggacacacaagaucacucaagggaaauauaaugagaagaggaggcuauaaacagagcucaaaggagcaacagaguccaagggauaagccaagaaagcaauggucaccaaaaagcuuaagaaagucuuccuagagaggguggaggagagguggaggcugagauucccuggaagcagagacaaauggcacaaacagcaaucagugcucauggagagggccauaaagccugcuuucugcagcaguagugggcugagaaaugaggacagggcucuggggagugaauggcaggugaagaaauggaaacagacagaaagaauaauucuuccugaaaguucuggagaucaaugagagauucaaggguaucuggguacagcccagggaugcgauguuuacugacucaguagaaaagcuaccuggggggauggauaacugauggaucuagauacagaagaagcaggaagugcugccauuaaaagcuguuccuuaaguggaaaggccguuguccucgcugggagucccaggguggggcauuacguuuauacuccagcucagaguugagcguguucaauagauucauaagaaccaugcaacuuguaaguaaaugagaacagauucgccaggccgagaagagaaggcagguagguauucaaagcugaaugcucuguggcuuucgccagguucaccaaauauugaugucauugccaggcaauguauugugcuggaugcacagugacagaaagggccacggccaggguggagacuuuugaacugacagaagaaggcaccgguagguuuucugagagagagaccacuguggcagauguccugucagaugucuuuuguagcgaguuccugagacgcagccuuguuagucagaagaccuugaaggcuggugagaacagccuggaccuuguguaaacccuuucgcuuuaaacguuaguuuccugucagagccugugcauugaaguauauguuuaauguggggcaacuggggaacugaaacaccucuuuuuaugcagucccuucuuaaacucccaaggaugcagagcuggugagaaaggaaaggugcagaggaucuggcugaggucugauugagugcuaguuaguacugccuagcucuagcccuguguuauuuuaccuucccuguguguuuccuuuuccaaacacuuggggugugguucuagcugagcucaaacaagucauggcucuucagcccugcaguaacaggaguccagacuuaguuuacuaaauugaaagcagaggcaguuguuugggguagucugaaggugacagacauccuaauuagguuuguggacagcuagacaguugggagaggccagacgcaguuucaggaauccaacuugggcuucaaagcauugaaucuccacguuuuuucuaacggagguugugaaauccauguccccagaugagcuuuaauugauaacugcagcugucuugugugauauaacaauuuguucagcugagagcaaaggauccgauuaacucaucuacugugcucuugccaguucuucaacuaaaugagacuggcuacuggcuauacagucuucucagcccuaagguacaucacuccuuccccuaaccuuccuucccucccaucaaaccaucaguggaaagggcuuagacuuuguggcugggguaggagaagauucucagccuugggucugcugugugcacuaagguauuugagucacaguuaugaaaacauccuuuaguugagccuuaauuauaaagaagcaggaagggaguuaaauaaauaccccaaacugucaaaaugcccauugaaguaagaggucuuacugggucaaauaaccuaggaagguuuuucuuggcagcuggcauuuguugccaugugauagcaacaaacaaauaaccaugcaagagaggcaggacaacaaaauaccgugacagugcugccgguaaguacuggccugugggcagucuggacacguugagcuuccaugguaagccgggaugaaagguaacauucagaagacagggucagccugugacccugaagaagaagagaaggucagaagucaaaagaggagcccaccuggacuauucuaggaaggccggggucuuaauuugccccuaaagaauuagagagacguuuuucuugggaguuccaagaccuggauucuagucucagcaaugccagggagccacugaccaacccugggugagccaauccccacucuccauccuuuucuccacauacauagccaagcuuuguuaacuaucucuaacugaggcaugaagaauguggccuccaugaucuugcccagagucaacagaaaaacaaacaaaaaagcuccuggcauaaaaacaauauaaaauuuaagauggaugcuuccacaaaaggaacaggacaagaguggccaggaagauaggagcagagaaggcagggacaggaugacaguugcuagaaagauaggaauggagaaggcaggaacaggauggcaauggcaggaaagauaggcagagaaugaagagacagcaccagaauagagagaugggagcggaccagggaaggccagacuucugcugagcugugacaaauugccacacauuuagugcuuuggaaaaaaaugaaucagccagauguccuggcacauagcuauaauuccugcauugggaagcccgaacaauaagaucaugaguaugacaggacagcuugggcuacaugacaagacucugccucaaaacaugaguaacuuauucuucuguuaacaguuacauuucuggauguggaggaucagagcaggauucacuggguuuaaauagagguguuggcagagcucugucccuugggaaacccccagagaagucacucucuugcuuuuuccuuucuuagagcugccuguguuuguugacauguuuucuccuucugccauuuucacagucagcagaguggcgucuucuaauuuccuucuuaagcuucucuugugacccuuuaguguguauccuugugacuauguaaaacuuaccuggugacccaggaaaaucucagacucccguaauuaaccauuaauuuaaucacacguacagucccuuuuaucacucaagacauugcggcauggaaaggaggaccauuguucugcacaccacacacaccuaacagaaucaucacaugcuaucuuccauccuauagcaugucaccauugucuacacagcucccaggcagauccuugcuagcacuauaacaccuuguuggccccaccccuauuccauagccaauacauucuaaaacucaaagguuucauuucuagcauauauaucugguauuuucuuuguggaagacuuccacuaugcccuucaucuuaccagugucuccuucagagccuucuauuaguuucuaccccaguuucuccauugaaaagcaacagaaaaguuaaacaaaaacuucuuaaaagucugagucaugcuguauccugcugaaaaaacuuaacagccucacuauuaucagaugaaaaacaaaauuccaaauguucuaccugacccucaguugggccgaagaugauggugccuaugguguuucuuucaaugccuugcucucuuagcuacuaagugcuucaguggccaucaauuuuucccucaguggccaagauuucuguugucucagagccuuugcacuugcugaucucacucacccaucucuguguuccucugucuuugcaccucauagaaagcaucacuuucucagaaaaguguuuggcagcccugacccacuuccuagucacaagccuggaacagacuucucucugcagugcuugacagcagcaguguucccaucagcuagagcugcccguguuuuuugauacacgacccuuccaucuucacucuucugagaagcaucuuccuugauguuauuccaguuuaaaauuaaaaaccugugugauuguuagaauguuucucuugauauuucucaucuuguauugucuacuucucaucuaugcaucaaccacagucugaugauaucuaagacaguaugaguacuuaguaugugauagauggauggauggauggauggauggauggauggauggauggaugcaaggcgugaggugcuguauaaaaagauggcuuaaaacucaguaccuagagucugguagacuaaaguuuaaaucauagcuuugccuuuuguugcuuaugugauuuggaaucuggggcaaacuaucucucaacucuuuggguuaaggccaaggauuugccuuucaguucuuauaugauaagucauaauggaguugaugacaaagauuacaaauaacaaagauuugagagaagcaaaccaacaucaggaccaggaggagugacaacaaucgucucaggaccuuucuacauguuccucuugcuuaguagcugugucuuucaugaucuugaauauaagcgauuucaaacuucucccuuaggacuucuuggaccuacuuuauacgcugaaguuggggacgucauuaaaguucacuuuagaaacaaagcagacaaaccacuaagcauccauccucaagggauuaaauacaguaaauuuucagaagguaagaugaacuuauuaacccucugacaggagaagaagaucacuuuaauaucauugcuaaauauuaagacugguguuguuaaccauacacucuuagagaaaauucuuuuccugaaaauuguaauuauaaaaauugaacugcuuucaguuucagagaggaaaacaaaugguuuuagagucaucuaaacacugugauuguguuagguuccuguuccugguaagguggguuggaaaauuaccucaugucaaugaaucucuccauuccauauguucaucuuaaaguggaaauaacaauacauucuaggaugguuuaagacagauucgauguuuccaugguaaguacaagcaagacucaucaccaggcggauaagugcagggcaaauggauugugcuugaacuccauggccacugugcuucccuucccugcuccuguggcuucucaugggcauaaacaaaccccaugguaaggcagggugagcaaacauuuuuuuaaagccagcuacuaaauaaauuaauacacucggcuuugcaggcaauaagaucuaugcuguccuggaaagaggaguuuccaguugaggaguuaccuucauucaauuuguuugugagccuauuuguggagcauuuucuugacuguuaacugauaugggagauucuagcucacuauguaugguacuaucccugggcagugagccccggcuguauaaagaaaggaagcugagcaagccagggcaacauauucaugagcagaguucuaaguggucucugcuccggcuucugccuugaguuccugccuuggcuucccuccauaauggaugguagccuguaauugaggcaaacuuuuggucaguguuuuaucacagcaacagaggaagaaaucgggacaguuggcaaguuccuggaugagacggggugcccaggggucucuucuagguuccccagauucauacagugaugagccuacuuacuggguuucuaaacuagagcucagccauacagaguaggauagagcaacaugcccacacagucucuuucaaguuccacucccagcgugggagaagguaagaguuguggacucugccccucagcucagcuguuugcagagggaauggacuuugugacaucguucauccuccuccaauguuuauuugaucccccauuacucagucagcaaucacuagugagauaaaauuaucgaaaauguacccacacaucugugcuagcacauauagcauugcauaugcaugccuguaguccuagaaguucaaaauaaaaaugguaaauacagauaugugcgaaacauaaaaaaaaaaaaaacuucccuagaaaacaauauguaaucuuaguucagaguuucuuucaugaagagagaagucuauugugucacgccccucuguguuaaaauacagucucuccgcaucugugucagcacugaccguugccuauugucuaccucuauaguuagaccuacuuuugugaggauaaacuagcuacauggugagccagcucuaugagaguccaaauucuuucucccaggaguaaauguucaccaggcagacagugggggacagagauaacagacauagguuugagagucuaugguugcagguagcuuaaaaaugggcucccuccccuguuugucagaacacacaaacugacuuauagaaauacaauuccuuucuaaugguauuuuaagcuuuguaucgagucugggaagacagcucagcagguacaguugcuuacucaacaagcaugaggacaugaaugcaaauuuccagaacucccauagaaagcaccuauaacauccagugcuuggggaaggggaacaugggggguggagagagaaggccugugaggcuugcuggucaccaccugagcuucauguuuacuaagaaucuuugucucaagggacuaagggcaagaguggccaggucuucagguguucucuggcuucuacccaugcacaggcaaguguaccugcucaugugcauauucaacacacacacacacacacacacacacacacacacacacacacacacacacuacuuuaaaaccccaauuuucugucacuaauuuuaaucugaaugaaauuaauuugauuuccaaaaagucuauaaauagcauacauuacacuaagguuaaggucaugaaagauuuuugugauccaaagacuuugaaauuuugagugauuguuuuaagaaagccuguuucaugauaaaucuuaauauugcuguuguucuuucuucucucuaucuuucugucucucucccucuccuucccucuaugucuucaugugucucugucucugugugucuguguguguguguaugugugugugugugugugugucugucugucugugugcaugugcacacuaaggaugagacccaguaucucaaaacugcuaggcaagcaccgucccacugaacuccauucccagauccuugauauuauucuuucauuugauuuauauucuugaucuaucuguggaguugcuuuguacuauacuacaaaauuauuuuuagacuuauauaaaaugcauuaaauuauauuuaauauuaaaauucuauuacauuuagucaccuacuaguaagcuagaguccuaaacuuaaaaaaaaaaauccaauagagcuuuuauuuugcaucuaaguacuacaaaauucuguauaugaaaaguuaguucucggcuccaacaugcccaggaucagagaaucagagguuaggaggacacaacaucugacccaacaccaggaguaacugggaccggugggacccaggcacgcaggaacuccacuagaccagugauggagguuccuuccagucugucugggcugguacccugagcagaccuugggcgcaaacucugcagccagccccacaacaccccgaggcagcuccacucccaggcacucuaacauacccaggaucagaggaucacaaggucccaugaacuuagucacaccagaaucucaaggucccaaaggcagcuugacucccaggaacuuggacacacccaggaucucaggaucacaggaucccagaaucacaguaucacagagacagcucgacucagaggagugcugacacaaccaggaucacaggauggacggcuccagucagauauagccagagcagguagcacuagagauaaccagacggugggagguaagcguaagaacauaagcaacggagccgggcgugguggcgcacaccuuuaaucccagcacuugggaggcagagacagguggauuucugaguucgaggccagccuggucuacaaaguagguuccaggacaacaacggcuauacagagaaacccugucucaaaaaacaaaacaaaacaaaacaaaaagaacauaagcaacggaaaccaagguuacuugggaucaucagaacccaauucucccaccacagcaaguccugaauaccccaacacacuggaaaaucaagauucagaucuaaaaucacuucucaugaugaugaugauagaggacauuaagaaagacauaaauaacucccuuaaagaaauacaggagaacacagauaaacagcuagaagcccuaaaagaggaagcacaaaaaccccuuaaagaguuacaggaaaacacaaucaaacaggcaaaggaauggaacaaaaccauccaggaucuaaaaauggaacuagaaacaauaaagaaaucacaaagggagacaacccuggaguuagaaaaccuaggaaagagaucaggaguuauagaugcaagagauaaaaggugcagaggauaucauagaaaacauugaaacacaacagugaaagaaaacacaaaaagcaaaaaucuccuaacccaaagcauccaggaauuccacgacacaaugagaagaccaaaccuaaggauaauagguauagaagagagugagaauucccaacuuaaagggccaguaaauaucuucaacaaaauuauagaagaacacuucccuaaccuaaagaaagaguugcccaugaacauacaaaaagccuacagaacuccaaauagacuggaccagaaaagaaauuccuccugucacauaauagucaaaacaccaaaugcacuaaacaaagaaagaauuuuaaaagcaguaaagggaaaaaggucagguaacauauaaaggcagaccuaucagaauuacaccugacuucucagcagaaacuaugaaagcuagaagauccuggguagaugucauacagaccauaagagaacacgaaugccagcccagacuacuauacccagcaaaacucucaaucaccauagacagaaaaaccaagauauuccaugacaaaacuaaauuuacacaauaucuuuccacaaaucuaucccuacaaaggauaauauauggaaaacaccaacacaaggaggaaaacuacacccuagaagaagcaagaaagcaaucuuucaacaaacucacacaaacauaauuccaccucuaacaagaaaaguaacaggaaauaacaaucacuuuucuuuaauaucuuuuaauaugaaaauuaacauuuccagcauauccuauucgauugaaauucaaaaacaugaggaauuagaaauuugucagcugucauacuguggucucuuuaauuugguaaugggagaaauauguccaauauuauacaauccauauacacuuucugccuguuggcacaugacagggucuugcugugugccacauaauggucuugaaaucaugcuucuccuaucucagccuauuguuuauuugauguuuuuacacuauacuaugguuuucagaacagcuuacaaauuucaaaauuauuuauacagccaaaagaaauguagacaauuaauuugggagguggcuuauaagagaacagcaaagagugagacugaaggcuuugcuugauauuuauaauuauuguaucaauuuugaagaagaggacuuuauaaauaacucuuaucugagaugaaugcuuuucaaaaucaucacagccaaugaaccagaaccuuacccucaccuaacaucugugccacccuccaagcagaaccauuguucauugaaauaguugaugaaugacuucauggauagaucaucuuaauacacacaccauuucuuaaaugaauguaaccuguucccugugggcugagaaugaugacaaucacucaagucaaauagcuuugacuguagcgggaaaucuguauccaaaaaucgugccuacaauucauuccuugguguagcagaacugucaacucuuagcuuaucuacuauggagguaaaauccuuuggugaugugagggacauucaaauacagacuuauuacaaugcacuccaauguccaaaaacuguucuuauuuuguguguguaccacaguaagagccaagauuuuaagcucuacuaaaaacaaagcaaacaaaaagacuuuauuuauuuaugcucauuucagaaacuaauagugauauauuauuuuaaaauaucauacaguuaauauauuuggagugauuugaaauuuauauugagaaaaacguguguauuuucaguauugcuguagacaagcaucuacauaagacuguucaauugauuguuguuuuauaucaaacuacuuuuauaauauuuuuauuguuacaauauuuuauaaauuuuaaagaauaugauacaaaaugaaagguauuacagguuuugaaggggggcucuccgggaggaguugggguacaaaaaggaaaaaagaaugugauguaagucuauuuacucaaaauauguuuuaaauguuaacacauucagaaaaguugaaauuauguauuguuucucaucauaaugcuauaaaacuuaaaucaaaaaaaaaaguuaguucuuuagaauuuucauaacauucaaaccuuaacucaguuuauuuuuuaccaaguaugaaacaaauuauaaugauuaauauaaaaguucucauaaagcacaaaagcagcauuuuccauuuuaaaaagcccucauaugucuacgcagcgaaaucaaauucauuauacaaaaccagcauuaauuugcccauuguucaauuuauagcuuccaaaugacuguucuguuucuuugcaugcacaggggcauucacuguguuuaauaaacaggagggggaaauucacacaagaguaauaacagcuaaugcgugaguagcccgaaggauaacagaaccuuacagaacuucacuuuucccugaagcuugcaugcaccacuuagcacuuaaaaauguacuggggggucucucugaaaauaauucauacagcaugacagggauaaacucauuauaaaguugacuggacugagcaagaaagaacugaacagaacugagcagauacaaaaugaagaagaccucuuguguaagaaguuuacucugccacaggauggacgaggaccuguguguucugucacaacccauccuguccauuucucuucuuuccaauuuagaauuuuaacuuuauuuggauuacaaagucaaaauaagauuuauuuaaaaaaaaacacacuucaaaaaugcuuccucuaaaauggcuguuucuauuuuauuucauauuguguagguuacagaaugagaaauauagcacuuguguuuuauucuggagaaaaaauagugugcaaugaaaagaauaaaaacauugauaaguuaucuucuaauacuuuuaaugauaguccuguguguacucacagaauacuuucaucccauguacaaaucuauauuguuugcuauauguuuccuggugcccacaauucacccuuuaaacaauuaaaauuaccauucaaguauacaaaacgcuaucguacauuauauugagaaguggaauuuuucuuuuagauauccauuuguguugccauaucaaccuuuucaguaccugcaugcgugacacagaauucuguuuuguacggauuuuaaaacucacugggaguuacaguugagugugagccacuaaacuuucacaaauaaauuugaugacacaggaaaaucagucaaacaccuagaaggcaauucuuacauaaguuccucuucaggacaggcaguauagaauguuaugauuauagccuccgaauugaauagucauggggaaaaaaacaggucaacgccauugcaagcaucauguguuuacccuggucucuugcaucugcaccuggcauagagcccaggaugcuuggggugguggugaaggucgugacaaucauuguugaacuaaacugaaggaaugaggacuuaugagaaacaaggacacuauauuauccucccugcgcucagaaauguauugucagugagcauaagcaguuauauugucuuauuaccaauuuuccucacccuaaaauacauacauuacugauguagauuccaugugugugucuuaauuuuuucacauguuggaaaccugauccuugaugagaccauauaaggggugggaccuuugggugggacucaagacauagagucauaaccuucaugaugaauuuuguacccuuagaaauggaacuuagggugaagcgccuucagcuucuaugugccuccugagaacaagaugaaaugagguccccuguaccaaggagggcuucaugagagcacugucauguugaaauccaugucucgccuuaagauacaugaagaauggcuugcuuagaugccacccaagcuagggaacucuguuauagaagccuagaaccaacccaaucuagucuuucucagauguguuagaacacaagagcacuugaauauuuuuucaucuaaacauagggucagaucuguaaugcucagacucgagaagcuaagacggaagaacugugauugacaagacagcuuaggauaugaaggaagacccuggaaacccugugucaggaauacaaacagauuagacucucucucucucucucucucucucucucucucucucucucugugugugugugugugugugugugugugugugugugugugugugugugugugugcauguaugauaguccucauaacacauaaaaaaacuaucucuagaaaaggaauuauuuuaccuuaauuuaagauaaagggcuuuaaaggaauauuaagagcccuugccaaguugacaggaguacaacccaaaaguuuugauuuugaugucaagguuuguaugccuucucccucagccuagcagaaaagccuagccugucaugauucauauaaucuaacgaauauuuaaucauaaauugugauaagaauuggcucaauguguaaaaugcuuauuacacaagugugaggagaggaguuuggauccccaucaggggauguggcuaugguggccuccuguaaucccggggcuuagggguuuuaggagguagagacuggggauccuuaaguccagcugaguaucuaggucucugguuucaaguaagagacucugcuucaauauaagguggaaaccauugaggaggauaccucauagcaaccucuaggcacaugaugcacaugaacacacaugcaaucauacacacacaccugcacaucacauauacaaaaacaaucaaauaauuuaaaaaagaccaccaucaccguguagcauagaagucagaggagugagucagaggagugagcuguauuuaaucggacaucuaaaagauaagcagacaucuuaucagacaaccucuuaccccacaaaauaggccaauuucugcuuuuggggagccuguaaagacagaaggaagaugcuacuucccacuauaggaauccccugugggguugcagcagcuaggacaguggaagcuucaguucaggaaaugccaugucuuaagccaugaagcuguggaggaagagucacuuaguaaagggcaggaugcacgccucaugcaggacagcuggaggaaccacaggccuacuaguuguugcagaaagccagaacugggagagugguccaccuuaucaguccuguuuguguuugcuucagagccuucagagauaaaguuccccauuuguccuuugagaugcuuccucagagacuuuucuauugacaguucacauuauaacucacagaaaauuacuuaagauuuucucuuuucauggccccugaucauuguuaacauucaaauccuguuuauugcuggagugggaguuuaucugauaguaaauauuagguauuagcguucaaacuuuuauggugggauagauguaauacacucaauuguugauuuuuacucuagaacaagagucauggucuaaggugugagugauagcgaggugaguaguuagaccaaaaaaaaaaaauuauuguaauggacacuagugagcagaaacuaaacaaacuaccuacagccaagacuccagaucagucagauuuuaugucagaauuuaccuaugcccccagauugcugagauuugcauuuuguuuguuuuuaaaagagcaaucacugauguaggguccuaaauaauacauccagauuuucuuauggcauuuaauuuguuuucauauugugcaauccuaacagauuuuagcuaugaguuggugaccuuucagcaaacauggauugagcauauauuccaugcuucucgugugcuauggaagauaccaaagaugcuaagcauacauggucuagacccuucccuuaaggaauccacacuccagcaaucaaaaugugcagaaugauaaucauuguaacccagucaaaaaagaauauaccacaaguauuuaauuauaaauugugauaaguacuauaaaagcaaauauauguaaaacaaucagagauaagggaagaaguaacugguauuugucuuggcuucagaaaggugagcgugcauuuaucuaaaggaugaaauggagcacgaacacucuaaacagaaggaacuguaucugcagagacccugagugagauagcauugagcauguccaggguacagggaggaggcaugggggauggauacauaguaaacgguaagaaucacauauuaugaggucagagagaaguuggguccacccaucauauguggcauuauggucaauguaagggauuuugugaaauaagcaaauccagauauaacuucucaacucuugcauuguguggcuuccaugcuuagaauccuacccagcguaucuguauacagcacagcagcaaacaagccccgccaccggaguugaccaaacaaggugccuuguuucucacucauaccuggagaacucagaugugugcugaugccgucaaaacucaugccacauuuugagugcauagauuuuaugaagaugguuagggagguuggcagugcuucaauauuaacauuuagggaacuguguuugagucuuuccauuaugugccauaaaggagagacaagugugaucaggagagagauggaagauuagaaaauaccugaauuuaacuggaaaugaaagaauaccaggugauguuaacaacacauuagagggugugaggaaauuauuacagcauauuaauguauuuuaaaaaccauuuacauaaaaaaauacugaagaugagcagaacacucacgaacugcgauauaaugucauguuaacguguguuguugggucucaaaagugauggggacaguaaaagaacuuggagggaaaaauagcucaaaacuuuucagaugugguacagacuacagaccuaugggugaaggaggucugacaugauuccacccugcccccaggcuauugccaaggcuauuggcuauuccacauaucugaugguaaggcugaagaugguaauuggugaagauacaaccuauuuauguuauugaacauggagaaauugagcugguccccaccuaacuaucagucacccuuacugacuaacuaccagaggagaaauaauuaucaauuuuauccagucacaaauugcaaccuacagcagagaaugaucugccugcaacauauacugguacaauagcggugcaaauguuaugguaguaaccaaccacuuccugauuagagguggcagaaaccugaggcuagauggaucacggacccuggcgauaacuacuauuauucugcuaaaggaacaguaaagugauuccccaugacauucuccuauaaccauagaucagugccuugcucauucaucaucagagaagcuucuucuuacaguagaugggaacuaaugcagagacucaaacuagaugauguggagagagagagagagagagagagagagagagagagagagagaaagagagagagagagagagagagagagagagagagagagagagagagagagagauugagagcuagaaagaccaaacauuucucuuuucaaaaguguaaucacuucaggaaaaaauaguucccacuggcccuuugcccauaauaugaaacacuucaggauuguuucccuauacucugauggucucaccuucaugucaaagagaaaccguggcaucaacugaugauagagaaaacuucaccuaauugagugaagagugucucuggcaaagaggaagccagucccucucgauugcuuaggacccugaccucuccccuuccugcucugcuugcuccaucucuaccacgucucaacccuccaaacuccuuuuaaucuagguucuucuucaaaagcggaagacuaauuucuacaucaccccuuugcugcaggagggaaugccugguauacagagguuuucaaugggacuuuucacagugaagcaaggcaucuuuacccugggacagacuggcuucauaggcccaaggaguagacuacaugcaggagcuggaugcagggagcaucaggguggagaagagccagaaagguccaguggcaaggugcaacuaagacaaacaaacaaacaaaaccagggcuaaagaugauugcccuggaaaagaagacauuauauuuuuuucagagccacacaaaacagcaugcaaacagcauacacaucucaugcuaacaguaagcuagcaugacuuguaaagaacucugaagagaacauacugauucuuguauuaugaggugguuuauugaugaaauaugauugagucucugauuacaugcaaacaguuguucuaauacccugaaaacuaacuuggucagcccuaacuagucuuugcuaguaacaauuaucccucagugcauuauggaguguaaauauggggacagagguuagcguauauggcaugugugugaccccucugagaauaaaaguugcuaugaaaggcaagugaucugcagagagcuagaucucuugcuuuccccgcacuggagagugguugaaaacucuggaugucuuuguggcugucauuucuccaggggcuucuuacgcagaccacacguucccugccgagaggaaggaugaugccguggcuccuggagaagaauacaccuaugaauggaucgucagugaggacagcgggcccacaccugaugacccaccaugccucacccacaucuacuauuccuaugaaaaccugacccaggauuucaacucgggucugauugggccucugcuuaucugcaagaaagguaaaaacaauaccugcagauccaacgacagcaaagaugcugggcuggcugggagauuauaucgggcugaagcuugggagaaccuugauaccuuccuguaggugaggcaggagaaggggguggagaucaaaucauggcuaagagaaagcagcacuugguacuggcucuucccacuucuucuaaaaccucccuucauucugagucaugacaacuuccuucaagucuacucugacaucgugccugcauacuuguaggaccaguaauguuuaccucagagccaggucuauccauuuugaaguguacaacacccuaguuacugagagaguuucuggaaaugacaucgacugguccaacugacauagcugaaguuccuguugguggugauuagguuuauaaacauguauaacucuacuuucuuuuuugcuguuauuugguugaagguggguugguugguugguugguuaguugguuggcuggcugguuggcugguugguuaguugguuggccuuuuaauguuuuuaguagaaagggccuugaacucagugauauuucugcccuagcuucccuaguggcagaucccaggugugagucaucauccccagaucagccgauuucuuaaaaacaaguugaacaauuuagguguaguugacagauuuugugaguguugacuuuugcccaccuauguagaucuguguuugugaggcuugggauuugaggccuuuaaagaauggauggacuauagucuaaugcucuagacaauuucacuuccguuuuagugugcuuugugcaugaaugaagcaaagcaaugauccaagggaggaugucugcguucagaaaaacauguaaauaaaugcuaguaaguaacccuaaauauugacagagcagcucuuucccagagcuuucucaggacagaccaacuuaaacacaauugccuggcacauauguagauagauuauaucugggaaagcaugaaagcgaggcagaaggccauauucagauuuggagugcacugaccagauuggguucuauagcuauguucugacauccagcaaggauagcauguuuuauaaguugaagguaaguguuugucacaggaaacauaaaaucacaucucagaacaauccagggaacaaagugcaccugagcugaaagguccucaucagggcauuguucaccauggggcagccuuucgacugugucccgacagucaggaaucccauuagcugugcuucuuagaaauacacuugauuucuccuuucuuccuucucuuacucuaagagacuucaacccaucuuucauuaaaacauccacagaaccacaacagacuguacccuggagauaaugucauuuauaccgauacacagaucauagacccagcucucuuauucaucaugcaaauauauuuuuaaauuuccugacauauaaaagauucugugauugcauugggaaaaacaaucuuauacaaggcacuuucauuugaucacuguuuuacucauauaaauauggauucaucuugauacaaacuuuucucuagucgcaugucccauuuaaugaggaagcuucauucaacacaaguuauguggucuggucuaggagacuggaagaaaugggguuuuucauuguugauaauguuagauuuugacuuuucgagguaaacucuuaguaguccauaauggauuugaacucccuauguagcccaucuguccucaaacucaugauccuccugucucagcuuuccuggguccugggauuauaggaaugcauccuaacacuugacugggaauguaugauucaaauuuauaucaacauuacuuguuucuagccucaacuucagauguaugagaacauggaaaguacucuuuacucuuccgucuggaccuggauagaagccuaucuuuucucucucaggcacccugaccgaggaugggacucagaagauguuugacaagcagcaugugcuccuauuugcuguguuugaugaaagcaagagccggagccagucaccaucccuaauguacacaauuaauggcuuugugaauaagacgaugccagguaauacaggggccaggcaccauucagcaaugacagugucccgaguguccaacguugguccuguucuuucuuuaaggcagaagcuaccguguucacugguuuccagugccuaguggugaagaaucacaaucuucugcaaugauucggggauuuucaugauuuuaucaucauuucugucuuacccaggaaguacaacagauaaaucagaaguuaacaaggaaccuuacuugauacagccuuguuaggugugguguucugagcauaucaaugucugcucaaguacagagucacucuauaacaguaugcucuaccauucaaaaaucuauugaugaauaauguccaguggcauguagguuuucucuucccaucugcagauagaauuuuguaagaaaguaaaaucauacaagcuguuaaguguguguguguguguguguguguaugacuuccacuguacuagcuaauuuuauguugcuauaacaaaacacugagugcuggcuacuauauaaagaaaaaaauguuuuuuaaaaaaauucaguguuagaagcagaaagaccuagacuggcagcucaucagcucagccuuugaugagggaccacuuaucuaugucacaguagggcagaagaagcaaaaagggaaauggcuacauguagaagaggcuaagaacagggauggggcugaggcuugcuuuauaauaacuugcucucaugagaauuaaccaaggucccaugagaacuaacuguauuaaucacuuccaggaacagcaccuccaguauccuaaccaccuuccucuaggcucuauguuucuagguucuaccaccugaaauucaucacacagagucaagcuuuuguauaugcaccuuugaggagacauacuguaaccauagcaaccacuuaucucacuucucuuuucugucuuucuaguagaacugacuuacaaugaaaaauccaauucuaguaaaaaaaaaaaaaaacaaacaaacaaacaaacaaaaaaaacagagaagaagugguauagaugguugcuaugguuaugguacgucuccuaaaggaggaaagccuagauuuacucuuuccuuguucucauggugauugggaaacuuuauuucucugugggagauucuaaucuugacuucuauuccagauuaacauuucaaauuucaaauuuacaaucaccagauacaagacaaugggcuaagaauuggucucuuaauauguauguguguacacacagauacaucccauaauauguauguauagauauaucccauaauuuauauauaguauuuauuuauguuuaguguaggaaaaaugaaaauauuucuugauuaaaaaauucugggggcuggugagauggugcagcaagcaaggaugguuuucuccaggucugaucaucugaguuggaucucuaagaaccucauggugcaaagagagaaccaaccuucacagaucguccucugacccacacacaugaaucauggcauucaugcccaugcccauacacaaaauaaauaaauaacuguaaacaaaagcaaaaauucuaaauuucgucauguaucaauaucaccaauggcuugucuuacagaaaaaccaacauugucaagagucagggucugauauugcuuucaaucuuuauuuuauuucauuuggugccaucuucugccagucucaugcagcucugaguauugauucugaguuccagaacuaggcuccugcaaaccugagacugcacuaacugaccuccaaauuggaagaucugaauucgcaucucauuccuuucccugacucugugugguccuuaccaacuaggagucuuaauaugcuguucccagaaauggaaucaacaaucccacugucuguguccugacagggagaauaauccauguaaauuuauaaaagcugaaauaguggacugaaugugcaauauauacuugacugaaugugcaauauauauauacuugauugggacagagauauuauaaauuuguacuugaaaaaaaaagaguagccucaaauaagugcaaacccuuaguagacacaauacuuaugcugauaaagccccgagccuucuagaauaacauacacuaauagaugugacaauacuaccguagauguguucauugcugggcagcucagugugggcuguuucugcgugggauaaacacacccgcaggaacacguaccuucuaguucccucccagccuccuguuugcaaggcuuucacaaaggacaaaugccucuauggauaagaagcuaaaucccagaccauccucuuauaucuagugauuagaaaucuggguaggagccaggacuggacucucucccagagcaaauaagcauuuuuucucaaucacuguggcaacaaagaaagcaaaacugggcuuucuccuugguuuucuuccuccguuguuagcaaucuguccucaaaaggcucucaguguccgcuuacaaagaggacaccaguaacaaccgagaaaucccuuguuacuaacauaacuucagaaaggguaaagacaguaggaaauccuucagcacauccucacacuuucuucuacuuugacagagcuuggucucuauuugcagaagaggauuagguccuggcacccaggccuauugaagguacuggggacuucuuccaagugaggccagaugggugugaacaguuacuccauuuuacccaggacuuuaucagucuauacacugggagcccuguguccugagagaccucuaaaucuagacaaacugggauagugcaucacaugcuuaccugccuccuagccuuugucccuuagcugucucugcagcucugaaggaauggcccccauucuaaacucuaccccuacacacacaguuugugcugcuacuugguaugugaguggugacuccuuguuucccaucucucuguuuggaugaugucucucccucucagaucuaacagucugugcccaugaucaugucagcuggauguguauggcuguugucucucccucucagauauaacagucugugcccaugaccacgucagcuggcaucugaucgggaugagcucggggccagaauuguuuucuauucacuucaacggccaaguccuagagcagaaccagcauaaaguguccaccgucacccuggucagcgcaacaucuacgacugcaaacaugacuaugagcccagaaggaagauggauuguuucuucucucaucccaaagcauuaucaaggcaagaaaccuuucuuguugugguuaaaauuaauuggggguuucuaccccaccuuggaucauuuaguucccaaguucccagguaaaagacacaaaaccuuuauauuuauaauaagccuuaacaucacuagagcuggacagacaucuaccccccaugccauuuugucuacuucccucuccgugacccugagauaugaccugccacguucucccugggcugcucuuccugcucuuacuccaacuggccagaccucacagccauguucucauaacucaucucucccauuguuucuucuccucccucuucaucuuccugcucuccuccucaugcucucugccccagacuccaagucugacaaccaaagcccugccuaucucucuucugcccagccacaggcugcagacaucuuuauucaaccaaauguuuuacauuaaggugcaagguuaccuagcaacccuuggugaggaucuccuugucccucgggcaaccagagcugguaguuagcaucacaacacauagcaacagacuaaaccucaacagguccugacaguguugcguugagugagcaccauugcuucucaggcuacuaacuuauuucuucuccuuuaccauuuaguugaccccaccuagacaugggcauccugguuccuaagacaccauuagaugcuuugcucuuagacucaaaacccacuaauuggggaugaaggaggugcaggcauugacaaggacguuuuaagacaaagcaaaagcuuaagaggucucuacuuccauaacggaggaggagaacuaacaccucucugaauguguucuuggaugucuuucauaugcagccaaaggaaaggaaccuagaaacuagacagaugaaaguaaauauccacaaauuuauagaaguacagagcuaccaagacugaccaggcuaaacaugauaauauaguccugugcaaugagaugggcacaagauccuugcacagaaaagaacucaaucaauguguguugaauggaucacaaauguuuuuauuuucuguuuuauugagauaggaucuucugcuguaugccaagcuguccuaaaacucaccauaaauucuuagcuggcuuugaaaucaugguaacucuccugucucaaccucuccaauguggggaucauaggcaugagccaucacaccagcuagaaauggacuucagagagcaucagugaauucuggagcggggcggggcgggugugugugugugugugaagaacccagcaguagucaugugguaccauguaaauuaaacaucuaacugucauaucacacauuuuuuuuuccuuuagacuauugagaagaacauucaucuugcuagagaugaaaaucuaagcaaaucuauuaccguagaaaaccauuuaucacaaccaggugugugagcccuggagaaacuaaauacuguaugagaacauuguguuuucacacugagcaaucaagacuaugaugaaaugaugauccagacaaacuaucucgaguaguuacuaauagaaauaaagcaaaaacaaaacuaaaacugcagacaauugcuauuaugcauuauuauuuaauaaucacacuaaggauacacuuugauagucuccauuuaacaaagggacgaauaacaaggaaagacaaaauuaaaaugaugucuuguuuuauauauauauaaagagaaacagagacagagaugagagcuguguuaaggaucaaaccgaaggccaccuacacacuaagcccacacuucaccauuucaccagcccuaggccuaggguuuuuaguuuguuccugcugcacacaaaacacagagaaccucaucaaccuuucccucugacccucuccucuccuccugcuucugacucuugccuccuucugugacccauuaaaagaguccagacuagcauagccgaagacugucugagcauugcugucuccuguuauuauuugccuccagugaauugauuuuuuuaaauacacauuuugaugaauaauuguuucucucaaguucuaccucugccuuuauauucuaauccagcugggaugcaggcuuacauugacauuaaaaacugcccaaagaaaacgaggagccccaagacccucacucgggagcagaggcgguacaugaagagaugggaguauuucauagccgcagaggaggucauuuggaacuaugcacccgugauaccugcgaauauggacaagugaguuggggcucagaccgccaagucaagaucaaaggcauggcccacaggguccuuagugugugggucucaauuaugaugucaugaguggccagcucuuaagguaggugugcauugguuuccaccuaggcauucuuauccucugagacauucaauuauccccaaguccccguggggauguggccugaugauagcaacagggacaauggcagcuagaacuuguugaaugcuugccacugcuaacccuuguaguagguguuugcuaagggucucacaucaguucuacgagcacagugcuguucuuguguucccguguuggagggaaggugccagagaagcucuaguaacucuucauaugacauuccuaguaagaaaaaugagagugaacuuuuacuggggugcuacucuguaccuaacagacuggcagguucauaucccaccaucugcuguugaggcuucagaaagcaaaagcuaucacacacauucugguggcccaaugugcugcuaaagccauuccgugggauaacuuggcaaaacggguuagaaugguaaacacauauacccuuuaccccaggcacugugcucuuggaauucaaugguauaaaaguguucuuguucacagguuagaagauguaugaaaagggugcucacugcugcugcgauguuaccagugauacaagauuaaaauuaacuccaaaaguccuucaauuggaaaagaguaccaaguuauagcauauucauacaauggaauacuauggauccaauaaaauaggaaggaaggaagggaggguauagacgugcucugucccuguagcuacuucucuucaguuacguauggcuuauccaguggcagaggagaugacuccugguugcuacauggaggacaucaggaugcaaacuacacucagacuguucccagaaguagcauuuuagcaagcagcacuugcacgcacaaggguuuccccgucauccauugcacuggacucgcugccgcuggaaguagucuaaccuuuguuucauuauuucauuucccuuaaagaauuuacaggucucagcacuuggauaauuucucaaaccaaauuggaaaacauuacaagaaaguuaucuacaggcaauaugaagaagagaccuucaccaaacgcacugacaaccccagcaucaaacaaagugggauucugggcccuguuaucagagcccaggucagagacacacucaagguaagcaacagaaauacggaagcaaggaaaaauuaaacagggaaagacagaucaagggacuggcaguuuuaauauauuuaaauguauucaucuaauuauaaaaucaaacauagcucucaguuuuauuuagcauuucauucuuguauauccuacuuaauuuaaaagaucugggaucgauaaaguagaaaagaauagagagaauaaagcagagucaguaucauuggaggaguaaggaauacuauaugggaacuaauuccaucuggucacaaauaagcauaaugagacacacccauacauccccaagguugucugcaaagugugucccaacucuuauagcaaaguaaauaugaccgagcaaggugcacacaccagugaaugcagcaguucgccugggguagagagccaggagaacuuucuugcccuggguuuucaagucaguguccuugacaaaagccccacaagugucgcagaacagaaguccugagcggcuuuggaaaaugacauugcccguuaccagugugagcaguugacucagcacagcggagaagagauaaaucuccacuccagucucaguguguggcgcuaauggcuggucuccgauuuauacucgcacaagacccucuggcuggcaagauggcucagugcauagaaccaauugaugucaaacgugaacaccugaguucaucacccagaguuuauggugggaagagagaaucaacucccacagauugucuucugaccugacauauacauacacaacaacaauuuaaacaauuucuuuaaagccugaaacuuucaucaaauaauuaccuugaacguucuaccauaucacagagcuagguagggacccagacaauugaagguuacacugauuggcaggacccuaggauauagggucuugauguugacuaaugauuauucaaaggcuuuggcagcaaaccaagaugaagguaagguuaagguugucucuugaagauugaaaggcuaauuagaacuucuaggaagauuaugcccuaaacaaaacccauuuuguucauuugaaaauggacagcgucuuccuucccugcgauccgccccucauuuuuggcuccacugggaugcauuagauuucaguguaagcauagucuaucugaaacucagggucuggcuacugcggccauucaggaaguuaacuucaagaacaaugauccugggaaacaaaacggcauuguggucuagaggagagcaggcacagaggacagaugcauagaugcagugcaaucugaaagaagaagggaaggguguggggaccagcugggagagggugagggguuaggaggaauccuuccugucggguaacgagggaggcugcugccgggauaaacagaacugauuuucccacugcugcacugcacaucugugugugcacaccuguccauacaugcacacacaagcagcugccuucaucucgucugaaauaguucucaugagugaccuuaaacacggaaauaauaacuaugacuuaacuuucuagaucguguucaaaaauauggcgagccgacccuacagcauuuacccucacggggugaccuucucuccuuacgaagauggaaucaauucuuccuccaccucaggugggaaccuuucacuucuuggagacuacugaucuccgagaggcauccacaguguucucuuguauuuguccagugguuaugacaaacgcagucauuaauacggaaggguuaucucuccuuucugagugucauuggcgccaucuaguggacagauauugaacagcuacaugcuauccauagucaggaguuuuaauacaaaaagaauauuuuucuucauauuaauuacucuaaauaaaagcuaagguagauauuuauuaugaugaaauaauuuuucuaaaaauuaagagcguauauuuucuuccaggcagucacaccacgaucagaccaguucaaccgggggaaaccuucacuuacaaauggaacauucuagaguuugaugaacccacggaaaacgaugcccagugccuaacaaggccauacuacagugauguggacguuacaagggauauugccucugggcugauagggcugcuucuaauuuguaagagcaggucccuggaccagagggguguacagguauuuuauacauaacauaaccuuuaaaaaaaaaaaaaaaaaaaaaaaaaaagaggaauuuccccucgcuggcacagauuaggucucacuacggaauaggaggauuucccuucuaaaacacaccaaucauuagucuucuuuggcaacaguguggggauauuuaccaucaggaucaucucgcaugguguccuguuucucugacuccuuuccucuggacucugacugcagaaagcacaucccacuggauuguauuuuagacucaaaccuguugacugugugaugaagaaaccauugcagcuccuuuaauccuuuccucuggucaaauaggcaacaauaucccuccuagaaauguguuuacaggguggcuuaggagcucagugagaacuuggcgccaaucuccgcucuuuucagaggcaaacaucagaggcgggagagagcccccgggagcaaggacauuuggagccauaguuuuagugaaguuugagccugccaaaagcccuucuuuggugaaacuaaguuaugacaaacaaugugaucaaagagaugggauuucugaguucacuuuuauuuugagacauggccucaaacucacucuuguaguccagaauagccuuggacuuuuuaaaaauugucuuuucuuauccuuccuuuucuuuucuuuuuauaguuuagguuuaugugugugggugucucaugugcauguauaucugcauacaguguguauaccuagugcccacagaggacagagaagguguuagcuagauucccgguaacuaugguuacagaugguugugagcuggcacgugggagaugggaauugaaccccuggugcccugggagaucugccaaugcucuuaaccauuugagccaucuuuccagcccacccccuguuuuauuuauuuuuuuguuguugguguuugcuuguuuguuuuucuuuuuguuuugagacagguuucucuuguaauucaagcaggccucaaauugguuauuuagucaaggauaaccuugaaccuuggugccuccugagucccaggauuagagacgaaugcuacuguaccugguuuacugggguacuggggaucaaacuuggggcuuuaugcaugccaagcaaauacuuuagcaacuaaaguauauccucagcagccugaguuuauucucauugacaauucauagucucauauuauuccccauuaggcuaauuccuauuaggcuaaguaauauuggaagaggucuuauccaaaggcaugcaaaauaggcagaugucuagaaaaaucagaaaauuugcaagauccugacuuacugaagaaguaaacacuacuuggaaggcugggugugguggggcuuuccuguugcagcauccuggccaucccuuucguccauuuggaacacggucagucagccauucugaaaaguuuuccauuacucugaccuacagguguuauacuaagggaauuuccccccuggguauuuuugacugaauucucugacuccuucucuuuguguucacauauuagcuuuaucucugacaaggguuugguaaaucauggccuccuaggugccagacacguggcuccucuggaccccacgacaauggggacaucggcagcccaccagagcagugaucacugcccuuuccccugcagaggguggcagacaucgagcagcaggccguguuugcuguguuugacgagaacaagagcugguacauugaggacaacaucaacaaguucugugagaauccugaugaggugaagcgugaugaucccaaguuuuacgaaucaaacaucaugagcaguaagucagacucccguguccacacugguggucgcagugugucuguacccaaaggaaaaaaugugaugcugggcauaauccucucuaaugcacccuccccuccccuccccucccuucccuuccccuccccuccccucuccucucuucuccucuccucucuucuccccuccccuccccuccccuccccucacucacagcucuaggacuuauugaugggcuuguugaauaccccugggcuaggcauauugaaaccaugacacugcacucccugguccccauaggcuuguucaaauacaugacucuauggggaccauguuuagccauagcauaauaaaaaguacauuuaguccaacuuccaaagucccauagucucuagcagucucaacaauguuaaaaguccaaaguucaaagucucuucugagagcuauccaaacacuuaacuguaauccccaaagcaagacaggaaaccggcugggcaaacuccaaacucugcaucuccaugucugaugucaaagcagucuucagaucuucaacaccuuuuuucaucuuuguugacugcaacaaacuucuuuuucugggaugguuccacucccuguuagcagcauucuucagcagauagcauuauggcucuggcaucucaaaaaucuuggggucuccaagguaacuucaacauuacagcuucuuguuucaaugucugggauucacacaugaucuucugggcuccuccaaagggccugggucacuuccccagcucugccuucuauagcauucuaaacucagauggauccacuccacugccucugcuguucuuggugaucaucccacaguacuggcaucuucaauacacuggggucuuccacugcaacuaggcuucaccaauagccucucauaggaucucuucauggugccaagucucaaauucuuuggaugaccucuucaguccugggcuaucaacuacaacugaggcugcaccuucaccaauggcccuccguggacucucauagcaccaagcuucaacuguucuucaugacuccuucaugccuucaaaacuaguaccaccuggguaacucuuacacauuacaaaauacaacugcugcaggagguacaaccuuggcuaccucuugaacauagcuuuuuugugcuuucauuaaacacuucccagaagauuucaccucagugaugcugaucucuucuuaauuaucacuaauuucuuagcuccagcuaaccggcaucaauugucccaguaguuccuucuauucuggacucuaaagccagagccacauuuccaaagcugcugaguucugcugcuugcuggggcuggaacaugggucccuuguucuauuacaauaucacaagcuuucuguuuuccaacuccuucacuaccuaagcuuggcuguccuggaacuugcuucauagagugacuuugaacucagagaucugcuuaucuuugcuuccugggauuaaaagauuguacuaccaugccuggacccaaaguuagcuggguaggaucuugcccuacggucacuuaauuauuccuuuaauucaguuuaacaaccuugaacacaggauucagcuccauuuuacuuccugguacccauuuaauccgcaaacuauauauuuuguauuuuuccuuucucagcuugcuauguuuguucaaaauguucuucaugagacuuaaacagagaacaaagucuaugaugggcaugucugagacuuccuuugccaaugcaauuaacacgagucucuucacuuuagccucaggcagacacuucagauaagggcaaagaaguagucacauucuucaccaaaauuccacaagaauggucucuaguccacauauugaaauuuuccacugaaacucuugggccagguccacacaauucaaaucacucucaguagcaaagucuuccauauuccuacuaggauagccuguuaagccccauuuaaagcauuccacugcuuuccaaauccaaaguccccaaauccacauucuuccaaacgaaagcaugguccggccuaucacagcaauacuccagucccuggaaacaacuucuaucuuaauuaggguuuuacugcugugaacagacaccaugaccaaggcaagucuuauaaaggaugacaucuaauuggggcuggcuuacagguuuagagauucagugcaucaucauuaaggcuggagcauggcagcguccagucaggcauggugcaggcagaacugagaguucuacaucuucaucugaaggcugcuaguagaauacugacuuccaggcagcuagggugagggucuuaaagcccacacccacagugacacaccuacuccaacaaggccacaccuccaaauagcgccacucccugggccaaacauauucaaaccaugacacguguuugcagaagaauauguauuuauuugauccuuaaagcucaugucuguggaguccaccuacaucuuaguagccacuuguagccaguccaucacauuaggccauuaagcauagcaucuggaaugauguagaaacuaguagcacacaccuucagcaacucuacaugaauuugguacauagucacuuaaaaucuuuuuuauuuuaguaccaagcaucauacuaggacuggucacaaugaugaccuguguguauagauugugcccucaaaugaauuguaucuuaaugggaucaucacccucagcacauaugcaaauuaaaauguuaccuaaauuggucuuccuuuaauagaaauuaaaauauaugaacucaauacuggaguggaaacuguuaggucaacuguagguuaucuaacagauaguaggucucaaugacaaaugugcuaagugagcuucuuugugugacauucauuuuacucauaucuacuaugccaagaagauagaguuauuauaccuagacuuguccuuccaguagaugcaucuugaacaauuuaaaucaauuuauaucugcuuggugaaugauuaacuaaaucaacauccacgaaaggcuugucuucauccugucuuuuuccacucagccaucccugacaaagcugaauguggccuaugaccugcucacacauuguuagacguuauaaagcuuaucuuuaauaaucaccauuuugaugccaccaaaugaacacagggaccuggagaucauuagauguggguccucuuguuguacaggccuggcauuugacaacuauuccuccuucagcuaucaacggcuacgugcccgagagcauuuccacucugggauucuguuuugaugacacuguccaguggcacuucugcagugugggaacucaugaugauauuuugaccauccacuucacugggcacucguucaucuaugggaggaggcacgaggacaccuugacccuguuccccaugcguggugaaucugugacaguuacaauggauaauguuggugaguaagaguguagauacugggagagcucacucaugggaucucagguggaaaaggucuguugagcucucuaaaucaccaccacuccuggugugucucccggaccccugcaggcuugccuuacacugcuucuuguuguuuaugguugggagauuagcuugcacaucccuggaacaacugggcaguaaagacauaccauggcagaaaagauaaauguaacuaugagaagcagcauaaagauauuagccaugaaaacaaccuuugaugucauuucucaggucuuguccaccuuuugaugaagcacuagcauagaauuugccaacuaggguauagugucuacuaaucccaaggucacaccuauguacacuucccuggagcuguuuguuuagauguauuuauuuuauguauaugaguauacugcagcugacuucagacaccacagaagagggcaucagauuccauuacagaugguugugagucaccaggugguugcugggaauugaacucaggaccucuguaagaacagacaaugaucuuaaccaccaagccaucucuccagugcgccgcccuacacacacacacacacacacacacacacacacacacacacacacacacacacgggagcugucuuuacaaacaugggcuaccaugccuagcuuuuaaaaacaaaacaaaaugacauggauucuagggaucaaacuuagguccuuguggcagcugaaccaucuccccagacccacuuuuuaauucuuagcagagaccaucccacccucuggugaauaaucauuagauaagccucagaggcugucucagagaccacauuggcuuauaagacccaaguucaaaccacucucugccacucaguguuuuugcaacuuuagacagguuacucgcccucacuaagccuuaagucacucauuugaaaagcaggccagugcuuuacagaguugcaucagcuccuagcuguaagauaugccaagugcuuagcacucaacacgcaguucccacugcagaugucccagaucauccuuagugugucaguaauucacuuucaaugugacucaaacucacucugucccccuguaugucauuuccuagaaauacuuaaauaucccuuuugugugaaaaggcaaucuuaucaccaucucccaaacucugagucuuaggcaaauuguauaacuaagaagauagucaugauuuucaagaucuauuuuaucaucaaccccugucccuuuuuauugauauuuucuaaaacagugacucuugaacaauccaaacugaaggucuauuuuucuccuucaucuccacagaucauaaauacccuagccuauaugucacugaucuugugaccuugugaccuugugaugccaaaacaauaucaaguuacacuuuaaaaauuuuucuaaauaccuuauuccuguuuuuuucuuuuaugucaccaaggcucaggaauuuacuacucauagaccagccugguccauagcucacguguggcuaccucugguuaaaauucacuaaaaaaauuuuucuccaacagauccuccuguuuuuguaacuuuuccugagcuuucagccuucucuucucugucucuuaugaaggaacuuggauguugaccaccaugaauuccaauccaaaacgcagaaaccuaagacugagauucagagauguuaaguguaaucgggauuaugacaaugaggacucauaugagauuuaugaaccuccugcaccuacauccaugacaacucggagaauucaugauuccuuagaaaaugaauuuggcauagacaacgaagaugaugauuaccaguacuuacuggcgucaucauuaggaauuaggucauucaaaaacucaucauugaauccagaggaaaaugaguucaaucucacugcucucgcucuggagaacagcucugaguucauaucuccaagcacagacagaguuguugacucaaacucuucacgaauccuuaguaaaaucaucaauaauaaccucaaagacuuucaaagaacacuuccuggcucaggagccaccguggcugguacccuccuuagaaaccucauuggcuuagaugagaacuucguccucaacucuucuacagaacaucguuccagcucauaucaugaaaaugauauggaaaauccacagucaaacaucacaaugguauaccuacuuccucuugguccaaaaggaucugggaaucgagaacaagauaaaccuaaaaccaucaagacaggaagaccccacaugaugaagcacagguucuccuggaugaaagcgccagcugguaaaacugggaggcauucaaacccaaagaauucguauucuggaaugaagucugaggaggacauuccuagcgaguugauacccuuaaagcaaaagaucacuuccaaauuucugaauagacgauggcguguggcuucugaaaaggguaguuaugaaauaauagcagcaaauggugaagacacagauguggauaagcugaccaacaguccucaaaaucagaauaucacaguaccucggggagagagcaccucucacacaaacacaacaagaaagccaagugaccucccaacauuuucuggaguuggacauaaaucuccacauguaagacaggaggaagaaaacagugguuuucagaaaagacaguuauucaucaggacacggaagaagaagaaaaauaagaagcuugcacuacacaguccucuaucuccaaggggcuuugacccuuugagaggacauaaccauuccccauuuccagacaggagacuacuuaaucacucacuguuacuccacaaguccaaugaaacagcucuuucuccagaccugaaccagaccucuccuucaaugaguacggacaggucacuuccugacuauaaucaguacucgaaaaaugacacugagcagaugagcucuucuuuagaucuuuaucagucagugcccgcagaggaacacucuccaacauuuccugcccaagauccugaucaaacacacucuaccacagauccuagcuacagauccucuccgccagagcucagccaggggcuugauuaugaccuaagucaugacuuuuacccugaugacauuggucuaacaucuuucuuuccagaccaaagucaaaagucaucuuucucuucagaugaugaccaagcaaucccuuccucagacuuaagccucuuuaccaucucuccagaauuggaucagacaauuauuuacccagaccuggaucaguugcuccuuucuccagaagacaaucagaagaccuccuccccagaccugggccaggugccccuuucuccagaugacaaccagaagaccuccuccccagaccugggucaggugucccuuucuccagaugauaaccagaagaccuccuccccagaccugggucaggugccccuuucucuagaugacaaccagaagacgaccuccccagaccugggucaggugccccuuucuccagaugacaaccagaugaucaccuccccagaccugggucaggugccccuuucuucugauaaccagaagaccucuuccccagaucugggucaggugccucuuuuuccugaagacaaccagaauuacuuccuagaccugagucagguaccucucuccucagaccaaaaccaggagaccuccuccacagaccuacugacucucucuccugauuuuggucagacaguccuuuccccagacuuggaucagcugccacucccuucagacaauagucaggugaccguuuccccagaccucagccucuugacccucucaccagauuuuaaugagauaauccuagccccagaccuuggucaagugacccucucuccagaccucauccagacaaacccugcucuuaaucauggacacaaagcauccucugcagacccugaucaagcauccuacccuccagauucuggucaggcuucaucgcuuccagaacugaaucggacucuuccucauccagaucucacucacauaccaccuccuucaccaucucccacacucaauaacacuucuuugucaaggaaauuuaacccucuuguuguaguaggucucaguagaguagauggagacgacguugagauuguuccaagugaggagccagagagaauagaugaagauuaugccgaggaugacuuuguaaccuauaaugaccccuacagaacagacacuaggacagaugucaauuccuccagaaauccugacacuaucgcagcaugguaccuccgaggccacgguggacacaaaaaauucuacuauauugcagcugaagaaauaaccuggaauuacgcagaguuugcacaaagguuuggcuaguuuucuuuuacacucucauucugugucaccacuguuaugaaaaucaccuacaauauuucuucugggaugauggugaacaaauuauacuuuauauagucugacccuccagugauauuuccuuugccauuuccaauauuagcuucuaugcuuuagauaacacccaggcaaaacaagaccauuacuguggaagucugugguaucccaucuguccauuuauguuuuguaccuguaucuugagaguccuaucaugaaaauccuugcucagagcagugucuaaaaucuuggggauaauuaugcuuuagcaaaaucaaaacucagaauagccacucuuaagguacaaggccacuuauccgucaaauuauuauacauacuguagaaauacuauaggacuguuaaaggaaauuacuggguggacuauaguaauacuauguauguuuaauaaaugagacuugacauagcccaaaagauccuagaaaucuuaccuaagaaaauauauuugagcagaaaauuaaaacacauguagucaccuguguuuccauuuacauauauuuagcuaauuggugaaaugguuacuaaauauucucugcuaccaagcagauuacuucuuaaguucuuuucaauuucuuuguuuuuauuuuauaugaauguaugaguaucugcauguauguaugugaaccaugugugugccuggcaccacagaugccagaauauccauuauauuauauuauauuauauuauauuauauuauauauuaauaacuagaacuggaguuacaagugguuuaaugucccaaagugggugcugggaaccaaaccuggguacccugaaugacugaacuaucccuuguaaauuuuuccaacacuuuuaaauuucuucuuuuaaaugaaugcuauugcuguuguuuuagugaaauggaccaugaagacacaggccacacuccaaaggacaccacauacaagaaagucguuuucagaaaauaccuugauagcacguuuacaagucgugauccucgggcagaauaugaggagcaccuuggcauucucgguccugugauccgggcugaaguggaugaugugauccaaguaagucaccauccgggcccccuagaucuccaggggacaugccacaagcaccaaacauugcuaagguggaggcaacaaaacuauaggugauuggcuucagaauuaacauauaauugugcucuuuccccaccaagacugcuuggcuauuugacaauuuuugagcuacagaaaagcuuuuauacuuuuuuuuuuuaacagugaacaugauuuaaucuggaagaaauagcacugaaauuucuagcugaagccagccuguuuugagcuaacauggaaaaugagucaacaguaucccauggcugagguggggacagcaauagcauugauuuauaaaaauguccccauucuuucuuaagagagaagauagugaaaugaaaggaaacuagaaaucagaguaaaaaugucccuuugcccuaaaugagccgguuucuuaaguaucuuaccagacuuagucauugauugcuuucaaaauccuguauccaguucccagacaauagcuuauuuuuauuguucugggauaucugcacaaccagaauucaaauuggaagucuuuaucaagcaggccagcgacugccuggagagaaauacuuucacagagcagccccacagaaugcauauuauagggaguuuuuaaagacaaagagcauagaaaaacuacauccugguuggcaguugcaggaggaagcaagcaagcaguaaaacagaagccaagaauaugcaguuagcugaggccguuugaccaugagcuucuagaacaauguuggguguuuucccacaguacuuuucaaggcagagguuagaaaccaaagaugccuucagcuaagacaagauggaaaauuuuuuagccuguuacaucauaaaagaguuuauuucccccauccuaccucaccucucacacaccaaacaauaaacaaaauaauaacaauaaacaaaacaaaacacaugagaacaugcuguggauccaaagcaaaccauucuguguccaaaaacauaaccuuuuacuaguguguuugccaaauugucaguguccauuugcucuuuuucaaagagcacacagaggguggggagauggcucagcagguagaguaaccacuuaguaugugauauguaagacccuguccuugaacuccaacacaucaagaccaaccaaucauaaaagacaauggaaaucuguuuuagucaucuuucuguugcugugguaaaacaucugagauaagaauccaaggaggagggcuggugagauggcucaguggguaagagcacccgacugcucuuccaaagguccgaaguucaaaucccagcaaccacaugguggcucacaaccacccguaaugagaccugacgcccucuucuggugcgucugaagacagcuacaguguacuuacauauaauaaauaaauaaauaaauaaauaaauaaauaaauaaauaaauaaauaaaucuuuaaaaaaaaaaaaaaaaaaaaagaauccaaggaggaggaaaaacauuuagcccaugauuucauccuuggcugcuugacuccuuugcuuuggguccuccauagaggcuggacaagaugguugcuuccuuuaagguggcuagaacuuaaagagaaagaaagggaggugccaguguccugagaucgcuucaaggcaugcuccaaguacucuaucuuccuucucuuaagcacuuugcucacauccaaagguuuuaccucccaaagugucacaggcuggcaacuaagccaucaucaacacaugguuugggggggaggggcacaaaacaacaguaagauauaagucucuuaaugacucuauacauucccugaagacauaggaaguuuugcugagugauuggucacuagaaguaacagaggaaagcagccagaagauucccuccaugagucugaugaugacucuaugccuagucucaacugucaccaggggucuuaauccaucucugcauuucccaaccuagccacacgcaggcuuucccuugcagacaucuuucugcucuucugggaaccugaaaugacccucuucugauuuguccauucuacaaaggccaaucccauuuuuccugagaaccuuuccauggguucuuccaaauucuccuaaacacucagcuggcagcuguguuuccaaggcagacccucccaaacccacucacacucugugcauagcuccucuuauauccagagucgugcuuuggguucacucaugucugucucucuucaccagaaaucuaaaagcuuaugacaaucaagaacuguaccuuauuuggguucaaaucucacuugugggcauguuagaucuuuguugcuguaacaaaauauacaggaggaacuauuuaaaaggaaugguuucuuuuggcuuguggguuuagugcuuucgguuuauaguuaccuguccuccaucucugugggguugugucgaggcagaguaucauggcagggagcaugaggugaggcauagcugcuuuucuuguggaguccuggaagcagacaauaaaaagggaccaagcagaugauaugcacaucaaggaugugccccagagagccucuuucuucaucuaggucuaacccccugguuuucaccaccuuccaaugugaucagauuaugaaucugccauccuauuuaucuguuggccagaacucuuaugguauaaucaccauccugaagucccccggccaaacaagcucccaacacaugagucuggaauggacacuucaaaccauuagagaaguaacuuagaguagcuuagcuugagccuaagaacacauuuuguguuucuagggugaguugcucagguccuaauucauaugaucauugauaaaaauagaucaaguaauaugcauaaauuaauuugcaauuauaggcacccaguauacccuagcucugauaucauaacugccuaucacagccuguagcauuguggguuuugguuugcuguuucuugguauguuaauacauuuguaggucacuguuuuguuuuguuuuuuccucuagguucgauuuaaaaauuuggcauccagaccguauucucuucaugcucacggacuuuccuaugaaaaauccucagaggggaagacuuaugaagaugaaucuccugaaugguuucaggaagaugaugcuguccagcccaauagcaguuacaccuauguauggcaugccaccaagcgcucagggccagagaacccugguucugccugccgggcuugggccuacuauucugcagugaaugugguagguuucaaguucuaaugucucccucauuaaagaaccauaguuaaccauuucuuguuaaaagucucuccugggagcugggcaguggggacacaggccuuuagucucagcacuugagaggcaggggcagguggaucugaguuugaggucagccaggucuacagagugaguuccaggacagccggggcuucacaaagaaagccugucuuaaaaucuaacauacccugagacccccaccaccaccaccacacaccaaaaaagucucuccuguuuuuuauggggcacaagaaagggcugccauccccaguauagcugccaacaccagggauucuccaugcaguucaucagaaagggcgcagagaaaaguguucauccaacggacaugaugaggauuacauaaaugaugagugcucacagagaaaugugaucauuaacaauuuuaaaguaguuuagucuuaagacaggcuuugggggacugcagagggucgggagagggccaggcaaggacugagccaacugugugggcacauaucacaugcuggguuugggaguuuaaggagcaaaguuuuucccugcucccauuaagcagaaggagauucaauuuguuacuucaugaguagccuuugcuaauaaaggauuuuuuuuuuguauuuugauaauaagucaacccuguucugaguuaaauaaggacacagggaggaggccacgguguccccagaggaauaauccaggcacauuccaccccccaagcagcccccacaggaaggugggaguaacuuguuucucuagacaaacuguguugaucauggccagcugugccaaucccccugcccucuuggcuggccuucagcgccuaggaaagccagagagaagccagcauccaugcagugccugauauacgcucagcugccuucuuuccccuugaccaugagacacagaggccuuugcacagugagacaccagacaagagguggcugaggacucuccccagguucacggccaacaaaacacagagcccucuaccugggaaagggcagccaagguucagauuggcccucaaacacggauuucuuuguaagacaagguaucugggcuuccacuuugccccuggaugagugguuauggcugauuuuuaccagggucaggauaccagaggucaggauaccagaggucuauacuuuuuggaagcaggugaaggggucaaagccaucacaggccuagugacgacccccaccucaugugaaaggcugcucaacuaacaaggaaacagagcccaugucaagggcagaggaguucccaagagccuucugaacucagugccacaagaaauaccaugcuugucucugacuauguggggccccacugaacauggggcuccuggggaaaggcaccaggcauggaauccagggccagacacagcacagcacagcacaggcugaguuagccucaggcaagggugaggggaacaaguccuggccacccacccacugugccucucugucauagaggaugcaauuucccacuuacuguaacacacacacacacacauacacacacaaagggacagagacagagacagagacagagacagagacagagagagccccccuccggguguagacaaaugccuugacauucuuuuugaacaguccugauaagcuuuuauaaccuggucacugacaauuuaaggaucuucacuuaucuuuccacagcauacacaagguucaaaaccacaugcuucauguaguaaaugcacauguguuucagugaagagaaagagagauucauuuuucccguaguaaaaagcgcgcugacucgguuuccuauuuauuuguugauguuguuguuguuucguguguuuuuucaaugcugagcaucaaacccaaggucuccuauaugcucaaauauuugccacugagcaacacccaccccgacgugucugugugggugcucuucuaggcguagauguaaauacucauucuaucacuacaggggcacuaggagaacaauuuacccuuauaaccacagguucuaaaguuaaaauaagauagagggugugcaugguggccacaaucugugauuccggcuacuugggaggcuaugaaacuggcucagaguguacucaagggcgaugugagcaauuuagugagauccuauccugaaaaauuuacaagaggcugggaaugaaaaucaguucaguucccaguuccaaaauagagagaaagagaaagagaaagaaggagggagagggaagggggagaaauuaguaaauacauguuuaaugaaugcauuuacauuugucauuuaggauaguugucaggauuaaauaaauaagcuacuacaaacaaagccuuuaacacaguaucauuacucaauaaaugguauccauuugguugacaauguuauuguugcucagauaaaggauaacuacccaguuuuagucuuuacugaucuucaagaugggagccucuaaaaugagauuuuucuguuaagcgagagcugugauugucagaagagaaaagacgauccaggugaaaggcaaguguuugcaauuugcucuucuuuuccuccaggagagggacauccacucaggcuugaucggcccccuucugaucugccggaaaggaacacuucacauggagcgcaaccugccuauggacaugagagaguuugucuuacucuucauggucuuugaugagaagaagagcugguacuaugaaaaguccaaggggucacggagaauugaauccccagaagagaaaaaugcccacaaguuuuacgguauuuuuuccuuugucuuuccaucuacucucugguaaaagcgcaccaggucacagcgguuccugcacuuaggucuucacaagauuagaccuuagguguuccugaggagucaggagcaucaauuaagccugguuccuaaagucagcauccuaaagucaggauuuggcugguaggaaacccugcuaaagaugauugagagagugcaggauagcacgcaugggcuacugccagacaaaccaacaagaaagugggcccugugccccagauagcagcauucauuggagugagcauggcaucacucuuuaugacacuaaugaccuuguuucuuuuucucuaaaaaugugaguaaucacucuaagacaugaucacaugugugucucuucugaaaucagaguggcucuuggaggcccaucucuucgcaguugcaggcagcaccuaugccagguggccugagaauuuaaggaacuaggaaguugaguagccauauaacgggacacuggcaagacagccaguccuuaggaggucacacuaggaaaaguaucgcuucagaaguccuuugaucugccccauucugaucugccuguggccuguaaauuggcagguuaauuacaaaacaguuuuagaaaaaggcugaaugaagggcuuaguguacagucaaaacagcaacagcuagaaaucagaagaaaauaaagacagguauaugcuaggacggcucagcaaagaagaacacuugcuuccaaacccaaggaccaugcccccaaacccaaggaccacccccccaaacccaaggaccacuaucccaaacuugcaugaugggaggaaaggacagauucccaaaagguggccucuuaucuacacauacaaaucacagccauuugggcacaugcacacacauacacacacacaugcaugcacccaugcacacgcacacauaaauuuaaaagcaagugaaaaaggccuauuuucacaguuugaaaauggagauaguuggccugaaacuucugauuacugaggucuugugcuuuagguaaugagucuguuagaauauugggggagaaaaagcuugcaagugccuaaaaucccaacacucuggaggcugaggugggaggguugaaaguuggagacuagccugagcaacucggugagaucugucucaaagaauaaauaaauacauaaacaaacaaauacaggucaagauauuuuuauaacaagcauuagaugccaccucuggccaaccauugaugcuagguagcccuguaucggugacacacuuaagacacacuucuucuguauuugacgcuacuuccgggagaauuucaauaaugucaccuguaaaaauacuuugagauacaagcaggcaaacaaugauuuguuguaaaaaucccacccaugaaggaugaagucuacuuuucaggaaaacauuuaaagauuuuaaaaauucaaaugucaaaaaauucuguuaaauagaauauaguugauucagacagcuauuagacuacaaauaguguuuuuugcuccuccccuccccuccccucccccccccccaaucccauccccuccccucuaggccucucagaucuggugcuugcucacaugagcaggaugugcacccuuuagaaguccccucagucuaguaagaaaguacagacugcagagucagacaggcuugucucucagcuaugcccucuaagaaauacuuccugauuuucucaaaaagucaaauacauuuaguacagcuucaguacucaauacaugcuucauaauucaugggcucuaugcaauuccaaccuacaguguuuaucaggcuaugugacaaacagaucucuagaguccccagccccugccuggcuuuuguagcaugugcucaggagauauaugaauaaaugaacaaauccugucauucagcuccaucuaucaaauguucauugaguucuguuuaaaguccucacucccauauccuggugcagccuccaacaaugcccacacaauuaucaccucugauaacaucugauucuuuaauagaaacugaagcaugggguugagggcuggugcccagguguguagcuaggcgcucccacacuuagugugauuucacaagugccaaaaugauuucaacuccuuuccuuccaaaaagcuuucuugacugguuuccaaaauccuacaacgaacccuugaagaaaagauuucuucccuugcuuauguuucgguuuuugguagcaacaagauuuaucauuaaccuuuuuguguuauauuuuuaaaacaauuaagauuguaucaggugcuuuaaacacacacagacauacaccacacacacacacacacacacacacaccacauacacaaagacauacagacauacaccacauacacagacacacacacaccacaugcacacagacauacaccacacauaaacauacuacauacucccagacacacacacacacacacacacacacacacacacacacacacaaaggcaaacagugguaguauggccuaggagaaaucaagaaggccuugaacucaaggucaccuugggcuaaaaagugaguuccaggcaaaacaaaacacaauccaccuauuucacuaaaggaauguagauacaacauugcacuaccuugacuuagacucuaaccugagauguagguagaggagccgucucuacaaggagagugugacacacugaaccugucauuuacucucacccuagggcuuugcauuauccacccuuucucauucuucugcagcaaaugaacauuuauacuaucaugugaagggaaaaugggcaaagccuuaagcaggagagggacaaaaucuaggggaaaagacaaaggcuguuuugaaauggagcugaaucauacuuuugcagguguuggaaguucuaauucagccucuuauugguucuauggaacugccaagaacucuuucuauaucugcguaggccuagaaaugccuggcaaugaggaagauggguggugaugggggaagccuaccugacuccuccuugugagacaaguucuuaaaugauuacaacuuucuuuccuuucagcaauuaaugggaugaucuacaaccugcccggccugagaauguacgagcaagagugggugaggcuacaccugcugaacaugggcggcucccgagauauucacgugguucacuuccauggccagacccugcuggauaauaggaccaaacagcaccaguuaggcgucuggccccuucugccugguaaagaucugagugauggaagaggucccugcuaaggaauagauggggcaccuguaagcgagauagggcgccaucucucuuucucuccuuguacaucuaccauuuaaggaaucagaagagaagaucuagauccugaggcaaagcucuguuuccaugcuguauacagaacacaaaacagaucuccuaugagcuguguguaggcaccucgcaggacagauuugugagcccacuugguucuacagagauucugugucccaugcaguuucuccugugucuuuagaauuagauuuaaguacaugacaagauaagucaccaaggcacaggaaaaaagaaacaguugcuauugggagguugauuagaaacuuaaauugagcucuucuggauucuuguaauccacuucugaaaccuucacccugacuuucugaggaagugacucugagaaucauaagcuugaacagauccaugacucuggagggaagguaccuuuuaaugacucuaagagcugaugggguacuuagagcuuugcaugugaaaguaggaggguuaguuuaguguagaucuaaacaaacagcagucaucagugaggguuuuguuguugugucccuaaguuguuuccagggagaccuguuagugaaagggguuaugagggcaagaugccacugaagaccuaagacacuagcuaggaugcacaucuacugcgacuuuacucucagaggcuuuggauaggcauaggucuuggagaggagagccaggauucugcaucucuuccaaggucugaggaucuagugaaaggccaucucuuugcaggaguuagggugaggaagucaaugugugaauuggucucauauauggacauggagauagucauugugugaauuggccucauauuugaauuuggaggaagucacugugugaauugaucucauauguggacauaaaggaagucacuguguaaauuggucucauauguugacaaggaggaagucauugugugaguugaucuuguaugugaaaauggaaguccagauggguccauuuuacuaagaagacagaaaaauggcuucuuguuugguucuuccaugccacuuucuaagaaauauagaaagugauguucuguuuaacuucagacacaggauggaccaccaaauucagcccauauuuucacaagagaagaagaugagaaaucuugcucacuguguuugagaugaauagucauccacuguuaaguuuuaccuucagucagggaccugguccuaaauuauaucaauggaauuuaagcauaggaucaauuggcagaguagacaucaagugucaguaugaauaagcagagguuuuagaaacauuuucauuuuuucugaaauaauuuauauacauuuuuacccauguauguacacuuuuaagaguauuugaaaccauaaggaaaggauauuuuuauuccuuacauauuaacauagaagaagagagaaagaaaacauauuuaauagccauaaaguugaguaauuuugaaacuuggaacuguacuugaauuguguaugggguaacuuguaacaguacagauaaauaaaaauuccuuuuuaggggagcugauagauuuuuuuuaaugucuaaguuauuuauuuguagcauuuuuuucuuauuugucugcuugaugguuuauuugcucaaaauagucuccuguauccccauacaguaacagauggcuuugaacuccugauccuucugccuccuccuaugagcacuuugauuagcagcauauacuaaggugcccaguuuauaggguucuuggucaaagucgggacuuugugaauucuaggcaagcauucuccugacuguaccuccccacccuaguuuuggugauuugugggugcuggugcuguagcugcuguuggguucauuuucaucuguaacaaccucaagagaaaugcaccacuuuaauuaaagucuccuacacaugggauacagggacuucaagauucauagagagcuccgucacaacauuaauguguuaaccaucgaguuuguaauuuuguccucacucucuauuuuagguucauuuaaaacucuugaaaugaaggcauccaagccuggcugguggcuccuagacacagagguuggagaaaaccagguagcuggcaugcaaacgccauuucucaucauagacaaagguaucacuugcauguuguuuacgggugagggagugccuaguacuagacuauuuccaacuuccagauugaaaguaaucugcaagugugaaaaugugaagacgggcuuuuuuuucugaccauuaaaaacauaacaauuaucucuacaacccuaacaaauaggucaaauauuccaugacuggggaaccaauagaaagugcccuuccuccuaauuugugauccaugggaaaauauacauaagaaaaucucuaaguuccuagaguagagcagaaagaguaaucagaauucugcaguaacaggcaguaaucucuccacucaugagcaguucuugccaagcaucugucgacuaccaacuacagugcucacauccagguacccauuaucugguauuucuuuccuugagcaagauguaaauagcauuguacuuuccaggucaauggccaagagugcauucuuaugaguaauaguccuuaauguaaauaguuugcuuuaaaauacaaccagauggacaucagcuuaaacauacuguuuuaaagacuccaguuauuuucugcuguguuaguuacuauucagauaagcaccagucuugcugaguguuuaucucuuucuaacugggcauauuagagucauuaucauggaugguaaaugaaaauaaucucuagacauagagguuuuacuugucauauguaguuucugagcaaaaagcauuuguuuuuguuuuuuccuagaguguaagaugccaaugggacuaagcacuggugucauaucugauucacagaucaaggcuucggaauaucugaguaaguauggacaucauagccugugaccggccaugccuacagucucaguaugcaacucauaaagcuaugcaugacagucaucuaugagccaauuccucucucuaggcuuucgucugcuauagcuuaaugaaacaaccccauuuaugggguuccucuggaagaggaagaagaaauauuucaggagcaaaaauccuauucauacauuuaucauuuccacuucuugugauguguauuguucccaaagggccuguucuaggaaaaaucaagaauucaacuuugcugauauauccgccuaggcagcccaguagcucuacagggaauuggcagggaauaaauaacuuuaucuuaugaccuuguaauuauuucccaaauuccguuuaucuuaccuacauugacucacacgcaaaaccuccaacaagauucacaggguucuaucaccuaaggaagagggucucaauguuuaugcuagccauucaucuagucaagaaacauuacgaucaaaguaucucuuaaaauuuuuuuccuucugccucaaaucccuuccugagaucuagaggcugucaucaaaagaauaaugagguucccacauauuccucccaagucuuccuguuugguaggcacacucggcaguagccguaucaacauaacugagaaaacacaaacaugaccuaugugcuagaaaggguggaugauggcuuacaacugacuaaacauggccugaagccaagguuucaucacugaggacuagcuuggcagccaaaguucaugucaccugccuggucucauaacuauagcauauaggucugguucucugcuguacuaaacuuauuugagaaguugguaguuuucuauugaggguggggagaauucuucaagccagacaugguaguauaugguugaggcagaaaaacagugaacuuuaguccugccuggucuauauauacaacaagacuuuuuuuuuuuucaaaaauaaauuaauucacaaauuccuuuuuuucuucuuuugaauuuagcuuauugggagcccagauuagcacgauuaaacaaugcugguucauacaaugcuuggaguauagaaaaaacugcauuagauuuucccauuaaaccuuggauccagguacgucuaacuaaccucauaauauugguuacgaugaugacaacacaggucguggguuuaguuguuucuugaaauggcaaugaaggaaacagcccugaguagauguaguuacuguucucagugguugcuuucucauaauugacaaugagagguaggucaaguaauuuucagucuaugaaagaaaccccagcaacaaaggugucaacugcuuucccaaagugcagcacagcuagucaguguccacacugacauucaaguucagaugugcuuugcucaacugugggcuguaccucgccacuuaaugaauuuacuaagaccuuggguauucccaaugcuaaagaaagcugauuauagcuugaguuacgguaaggugugacucacuaacaaggaugguucuguuuacucgcuugacuguguugcagguggacaugcagaaggaaguuguagucaccgggauacaaacccaaggugcuaaacacuaccuaaaguccugcuuuaccacggaguuccaaguggcuuacagcucugaccaaaccaacuggcagaucuucagagggaagagcgggaagagcgugaugguuugagcacucauuucuagcuaaaucuuaaggcucacgcugggcuuuccauagcaguagccuuucaaauugcauuucggggaguuagaaaagugaaugaauggcuuucuaagggucuuaggaagugaaaaugauaguaugaugaugggucuguacaauaaaaaaaucuucaaaucucugcagaacuugaaaggaaaaacauugaagcaaguaccacuucaaaacagauuggcagcaguauucagcgcaguguccacccuuguucaacacagccccuaugcuaggaacugcuugugucugcaaaggguuuugauuuuucuaucaccuuuuacuuuguucuguaucucacacaccuugauuuauggugauuguggacauccauugaugcucugaggcaccguccuucucuggccaccuuagaggacaugccagaggacuuacagacucccgucugguauuccaugagcccagacaagaugccuagaucauuccucauucccaggcuccucccccaagaauaauauccaaacacugagagccugucugccaugauugcacaaacaccuugagucuguuucuguugguacuuuauguaaaucaaucacuuuaccacgugcuacuuuuucuuugcugucuugacuguuucuaguagugacauauuuguaauguagcuuagauaaaaaucacuaaaaaagaaaauccuaaauuccggugcuuaucauaucaaccaguaaggggagagaaaacuugauagccaucaaaaucaugccuucaagauuuucagauccauaucuaugcaggacuucggcauguaguuugaugguucuguaauuugauugucucaagcuuuaauaccacaguaauagaagacauguagaugccuagaucaauacuuccugugaaucgggaaguauucuuuucuguguucuggaugugauuucugaaguccaugagaauagcuucauucagcagaaaucacccauaaaacuaucaggaccugaaaggcacuuugugggaaaauuuaaauucaguguuuuucauuagcuguuuggagguuaucugaauaucugaauagucuauuucauauugggugauuuaugauacuuuguguggcauuuaaaauaugaguugccuuuuuucuuuaaguugcuggucauguguguagggucuaauacuaguuguccuccaauccuccugacaucagagagucagagucuguagcaauguugcuuauguaaucucugguaucaucauuuuucucuuuuacuuuuagaucaggccugcugcagacuuguccauuuguuuucccaucauuuccaagugccaauuccuuuauuaaauuuucuucuguggcuucaauugugcucugucuugcagaucuacucuuugcuucuguuuuaaauggacguuuuacgauacuucucugugagagaaaggggguggggcacagccugaugaccgccagguagaggucagaguccaggcucucccuggacaccuuaggaggcauugcuucccuuggcugcugaguagauauagaguuccacacugguuucuccugacacagcugagggcuucuuauugggaagagucuggagcuccuaggaugguucuuguaccacuuuugucccaggagccucaaagucuaacccuuucauuaucgccauugccucuaugcuuggcuuguaucuggguguuuguuuuccugugauaguuggaugguuuacaacaguuaucuaaggagaguugugggguuuuuuuucaccuauaagacuggaacauacaaaguaagcaaaaagcccccccuuggggggcggggggggcaacaccauguuauucuuugauuccugagaggcuuggguagucuguuuucuucaugcccucuuuccaucuuucuuuucuucuuuuaugcauagucccaaguuucuacauaacaggaggaaggacaggaaaaagagcaucagcaauagcuuccucgaaguagacauauccacaauuaguuuuucaaaccaaauuaaauugaucccauuucuauaaaggaaccuuacaaaacuuguuagaugggacuuuaaaaaaaauauggucaguguuuagagaauuguuauuaaugguuuucucucucccucuaguauuuuacugguaauucagauggcucuacaauaaaagagaaucgacuugacccacccauuguggcuagauacauuaggauacacccaacaaaauccuauaauagacccacccuucggcuggagcugcagggcugugaggugaacgguaaggggcaagaaguaccaccuucccacggacacucuagacucaagauucggguggugugggagaggagcauucuuagauaacuucagugccuuaggcuccagaagaaccuuugcaagacaaauuccaguagggaauacucucagugugaucuaaauggaggcagagccugguucuaguaguccaggggguagggugggggcagcaccucacuccucacugcauggugugagcgucauggacacugucuggucagcccauuuucagugagagccaccugacucuccgucacugucauuuuuuuuuuuuuuuuuuuuuuuuuggugaucagugaucgaucagugaucguuuuuuuuuuuuuuaaucugaaccuggcuuucaacuucugaaaaccaugugugugcucugugcucuguuuuggacucgugugagaaccugagucuuccuaagcaucuacuuuuuuuucaggggaugaaauuugucuugugaucuaauaaaucuaggucauaauaacagucauaauaguccacugacuagucucugauuuuuuuaaaacaaggcuuuccaggauuguuuuaauaauuugcuuauuuuuuauuuuaugcacauugauguuuuggcugcauaugugucugugugaagguguuggauccuggaguuacagacgguaguaagcugccuugcgugugcugggaaucgaacgcaggucuucugaaagaacacucagugcucuuaacugcugagcuaucucuccagaugaucuuuccagcauuuuuaacuuucaggaacaugcaggaaauacugucaucguccaggcauucugggguaaaagacaaaaauacccaggccucaggugacugcuaaagacaggacuaggugagggaugaagagucacacacggugugucaugcccugggaagcucucucaucuuccccugagguaggggagaaaggcccaacucacgugaagcgaguaucugaacuuuggaaucaacuucuuaccaaagcagauagugcugcaugugacauuuguaagagcuaugcacagggagggacgcuugcccguaucuggauaucagcaguguagaaaaccacccauacagaaugcaaauguuguauaggcgggauuauccugugaagcagaucuguaagucauuggggcgggggggggggguaauucccauaaucacaguguccgugguagcuuuggucaaucauguagucuaacaaaucuaaaaugugaggugagguucuguuaauuuacuaaaaauauuccuuuucuacagaaggagcauggcauuuuucucuucgcuuuuuggaacuuacauagcaagcagugaauguuucuuucaggauuuuuuuuucuuuuuuugacauagagaaagcaagcuauugcuucaagaaaaugucugugguuuuguguuguucccccaaggaaaaacauaguaccacuaagacagucagcugccuucacucacuagcuagguuuccuaugccaauaguucgucuuugcuucccuagaacgcucaaaaguaugcccaggcaaaguucuaaagaguguauguguucaaaauguugaaagugaaaauagaaaaggugccuaccaaagccccacuacaucuccauggcuucuguuggcagaaacuuuccuuucaguacagccaugcauugcugcaccacaggaauccuuucuuagaacugcaucuuuaggccauuuuguguuuuacugugcaaacaucauagauuguguuuacccaguaccggccagucacccaauguggucuugauacaaucaagagacagagcaagugagcauaacacuacacuguuucacaguguucaaaaauaacgauaagaaguauagccaauacacaaagcaguuacguugggguuuauuauugaauauuaugaauuguacauaacugugugcacuguacuacacaugucuuagcacaguagguugauuuauacagacaccaucacaaacacagaggcuauauauuacuuaugacaacuaugaugucacaacagcuccauagccuaaugggaccacuaggauuuguguacucuguuauuaacagaaaugacauuauaugcugcauggugguacguauuguucagaaccagcaucuaucucaaagcaaagacuugagacucuacggcugucugaagaagggagaacccacacuuaaauacuguguugagugggacacuggcugucaguucaguuuccucuucuucugacaguuuugucauguucuuguaucuugcuguauucuguguccacuucugucauggguguaugagcauugaauaauauauuaguagcaucagagugguauuugcacuugaauugaauaaauuguucuuuguuuugcuguuuccuggaagugauaauuuuuuuugggucuucuguguugcaaaaugcagcgcagggaucauuagugcuguguaauuaaucauauuacuuuccucuugacaggauguuccacaccacugggccuggaagauggacggauucaagacaagcaaauuacugcaucuucauuuaaaaagucgugguggggagacuacugggagcccucccuugcccgccugaacgcccagggccgcgugaacgccuggcaagccaaggugacagcaaccauauaaauggaguucucucacuuuccagaaacaaacaaugaccaccaccacaggggacaggaggguggcugggaacuggagugugagccucugaagucccaggucugagaaucuaggaagacuugcagaaucaacagcuuucggcucuaaccaugacucagagaaaagucguaccucuuccuuguaguucuugcgagcuuugauuuaaagcagaaagggacaacagcuugcaaagaacuagauaguacauauuuuaggccagugguucucaagcuuccuaauguugugacucuuugauacagugacuuguguuguagugaccccaagaauaaaauuauuuuuguuucuacuucguaacuauauuuuugcuacuguuaugaaccauaauguaaaugucugauaugcaggauaucuggcaugcaaaccccaugaaaaaccauuugacccccaaaggggucucgacccauagguugagaaccacuguuuuaggccaaguuuucugugcauucuaaguccucauguaagugaauggggacagucguggcuuaccaguuccuaggugaggcacuuuaacauuaauaacagacaacuaauuaugguuuauaacauaucucuuuuuucauaauuugccacuuuaaaauuuuuccuucccuuucuuugugacauuccucaagucaguuggagguggcacaguuguaaaaccaggagucuaaaucagugauuugaguuaaacaaacaccuuccggaaaguuccuuugaucuugcuccacuaaguauugcaggccauucgguuugaagauaacuguuaauagcugacuuauucuuauuucauucuucgccugauagugggaucacaauacugcaauaacuuuaugaucccuucagacaagacaauccaaguucauuaccuagucucuucccaucucccucccuuaagauauguguuaauauauauguaaauauaugauagauaaauauuuauacguguaaauacauccuaauuccuaaauucugaagaaaucuugguucuaaucucagaguaggccaguagaaacaaaaguguggcaagugagacccacgcgguggcuuaggagccaaccccugugcucugaaacccguucucgccuauugugaacucagcaggcugggcuggcagcaguuuguaaugaagcaucucuccaaaucucucugugcacagauuaaaucucagcuuagugucagggcagaaucuuggcuagaauuccauucucggcuaaaacuccagauguuucccuguaugaagcaacccaaacauuucauuuugcaauucugcagaagaaaacugauacucggagaaacuaaaacaauuaaaauaguaacauuacauuacauacugacauaaaaauauaaaaaaugaaagugucauauaguuauuauaccccagauaucccuuuaaaccuguacaugguaaaucuugucacccuacacucuguucuacauccuuuaaaagaaauccuuucuauagaguuagcuuuaaucacugggauuguaauuaagaccccuucaaauaaaugcuaacuauaguuuuuuaaugucauauuuaaucugaauuucucagucauaaauuucuguuugaucuaaccuucucuuagcacaaaguaucuuuauaugauauuuaaggaggaugaaaaucaaagccagaaacaugcaggugugcauagccuaucuguccauggcugagugccucuuaccugauauauaugaaacccuucaccuuuaucuuguaacauugauacaaccuugauuuuaagucacucuaagaugacacacagagggucucacaaaguuaacaaaguuuuaguccuuuaauucaaucaauuuucuuaaaaaaaaacuuuaucauguaaauauuuagauauguauucauauacacacauauguccacaugaauaggaacaauauugaggaacuaucauuuauuccauccauaauugcaugauacgucucccaaagguagaaacucaucccagacaacuccagacaugagucccucugaacucucuucaggagcauguccucucggaacaugaggagaccuuuugugaggcuagauuguggcaugccucagauacucaauccuuucucagacgucccugaaacaauuuacagcauuuaaaugaacuugcuuaaaacacuugcaaauaauuuggaaauuuauucuuuugguuuaaaguaaaauucauuugucaguuaaguauccagcagcuacuuauuaagcaucaacuauguaccuuauauugcuaugaauacgggggggggggggacuaauaaagcccccacccuggagcagcaaaagacauaaacaagcaaauaagcacuguauacaguaugaaaugcauccauagaaauuaaaucuuuugaaguugguauacaaagcaauagguuuguguguguguguguguguguguguguaugugugugugugugugugagcuucuuugugguguuuugucauuauacuucgcucuuaaccauuuauuucccuuuagcguugucuuccccagucaggcauacucuauuacuuucucucuaacccccccucccggucaugauccauaacaauaaacaugaaauuacagggaagucuucuaaaagacagcgacuuguaaaggaggagauggaaaagcuuuaugcauuuucuaagcaucuuguucuucuauuuuugguugugagccuggccuuuaacugcugagccaucucuccagcccuaaacaucuuguucuuaaggaaaagaaaggaguaauacuuuucucaucucagugcuuuuguuguuguuguugcuuccguaggcaaacaacaacaagcagugguuacaagucgaucugcucaaaaucaagaagguaacggccaucguaacgcagggcuguaagucucuguccucugagauguacgugaagagcuacagcauccaguacagugaccaggguguggcauggaaaccuuaccgacagaaauccuccaugguggacaagguacaggaggcuguacuggcgacgguuuugaaaacugucuggaaacuguuuuccgaugagaaauaacaguagcucgcauuucucuaccccuccccccgagucuucacaaccccggccucacccgcuucuauggguggcuggucucagaagagaccccauuuguaucacuuuucugacucagccaccugagaaacagggaggagaaacuaccagggcgggcgugcugugaggcuuuuguuaucucuaacuuagaaggauggugaaccuauccagaaagccugucgauauaaugauaaagcccuugcugcagauagucuugcugcuuguagcaaaucagaugcccaggaccacaagccucuguaugccacacugcuacuaaacaggaaacauuuggggagacuacccuccuugugaaaucaacggcucgguuacauuccuaagucccucugccuucuaccagcugguuucauaacgcuaccagaagcagagccagggaaauguguuuaggaauccaggagugagaaccaggcuaaaacucccacauagagggaaacugagcuuuaccgaauucuaccuaaaugcgcacucagcacggaacauguuugugccucuuucucauguuuuaaaucccugacaguagguuuucucuuguuguagcgggcuuuccucaccccaggaaaccugcugucagagacucugcuguguguguucaucucagggaacuuccugagagugaaaacaaaaaaaccugaacaggagcaaacacucaaggggaagaagcacacaaccgaaaggagaaauaaagagaaccgcagggucccguuuauacugagugucaauaauagcaaguuauuuacuggcaucugcugcauggugcucaccaggcucuugcuguguguuugcacacuuucaaaccugugcagcgccuguggggcagagcuuuuaucauucucauucugaggaggaggcaguggagugcagaggaacauaaugacuucuucaaggccacacagcgacuaagaggcuaaagaaguaauuuugcaaacacucgugucugcuuuauuuauuuuuuccuaacgacacaucugauugagaaaugagagucuuuaaggggacaucucucuggcuugugauuucccagcauccugagaauaaauuuaaaaaaagaaaaaaaaaaaaaaaaaagcaaagaugacugacucugguauaagaagauaaauuaaugccaauuagagcuugcugacaggagcccgauauagcugucuucugagaggcucugccagugccugccaaaaacagaaguggaugcucacagccauccauuggacagagcacaggguccccaaucaaggagcuagagaaaguacccaaggagcugaagggguuugcagccccauaggaggaacaacaauaugaacuaaccaguaccccgccagagcuccuugggacuaaaccaucaaucaaagaaaauacauggugggacucauggcuccagcugcauauguagcagaggauggccuagucagucaucaauaggaggagaggcccuagguccugugaagguucuaagccccaguauaggggaaggccagggccaggaaugguagugaguagguuggggagcaggaggaggggggaggggauagggggauuuuuggaggggaaacuagggaaggagauaacauuugaaauguaaauaaagaaaauaucuaauaaaaaauuaaaugugcauaugaaaguacauaaaaguaaugauuaaaaaaaagagaguaaaacaugaaugcccacgaugccaauguugaccguuuuuaucauguuuuccuuucagauuuuugaaggaaacagcaauaccaaggggcacaugaagaacuuuuucaacccgcccauuauuuccagauuuauccgcaucauuccuaaaacauggaaccagagcaucgcccuucgccuagagcucuucggcugugacauuuauuagaauuaaauuccaaaaagagaaaaaaaaaggaaaagagagaauaaaagcugaagaaacuccuucaagccuaaaccauuuagagcaggcccuauagcauggguauuuuaaauguuaacagaaguucugcuauuuuuuucuaguugagaauaagcuuuaugugagaagcuuuuaauacuccuucaucgcugccacuaagugagauggcagcuauuauuucuucacugauuugaauauaaauggggaaauauuaagaccuggcaagaauaugacuguuuuucacucugauuaaagacauuguauaauauaauaguuauauaauggaaugauaugauucacuguggcucuuugaaauccuguagacauuagcaaaagauaauacuuuuggaaauuuuucauggaccuagaaagccuuucuuucuauauuuuucuuuuaaaagcaaacuguaauuuguaaacaauagaaacaaaaguaguugagguuuuuuuuuuaucauagagaaaaauauaucuuguuguaauuaagugagaacuuaaaaauacccaguguugggcuggcucagugggcaaaagugcuugcugccaaaacaaaacaacaacagcaacacaacacaaaacaaaccuuauggcuugaguucaaguccuggaacccacagugaaaggagagagcauauuccagaaagccguccccugguuucugcaugacccacgaccauguacaagcacuaacgguaaauaaaagauuuuuaaagcuugc

SEQ ID NO: 472 - RNA, 16342 nt, Mus musculus
ugagugaaaagggaaaauuuacuguaaaauauuuauuuaauaaaaauaguuuuauagucuauacagauugaauaaaaaguacaacagauucuuuucacgucuucaucaaagugcauacaguacagcccacuagggucugcauucugcaaguauggccgcgugguaaaauguggauacagucuugauuuagacacguaaagaaggaucagauuagaugccacaaacacugaacugaaucccaaagaaauauugcuuugguaaugugaacaauuugauuguaccauaauacauguuauuuaaaaaaaaaacaaaaugacacuucgcaaucacaauguuucuucuuguuucugggcaaccaacuucuuauagagcaacaaggaaguauaggaggaaagagaccaaaauguaagacuggagacugcuacucugaccuuaguucuccaucuccuuaguguucuucucuuucccuagcugcaaaggaagacguacgccauggccucuguuacccucacuccucccaugcacguuugcacuuuggucuuuccagugcuggaacuugagccagggucuuccacacacuugucaagcuucaguuuugcaaucucaguauugagaauaccgugcagcuacguccgucuuaacaaggucaacacucuaguugaaagcaccuaccuagauuucuuauacaacaagacaacaaaguuggcuuugaaauaguuuucaugucucacaaauauuagcauguagaacaucauucuuucaaguaaggaggagauacuuuuaaguaucucucaagaugaucuaacuguaggaacgaaggcgggcaggucuaagguccaaaacgcaggcaucaagucuauccuacugccaagcccagaacaaucauuaagaagaggcucaguuuauaaaaaggcuguggaauaauccaguuccgacugauaucuucucgucuuggauaagaaagccaagacaaugagagguauaugggaaugauauugucucaagggaaaagagcucauuuuguuuuggaaauaaaaggguaugcaaauauaaaaugggcucccuguaucucuaaccuauacacgaccuuuucaguugcaauuaagaguccuucauacauaacuauuacagacgagcaaaccuaucucauuagcccuccucaguuaucagcaggcuuuaaaaugugccuuuuguaaugaaaugagcuucucugggaagcauacaaauaaugcagaaauguauucuaaagaacguuuccaaaaauauacaacggucaaauugggaagaagcacuaacucucauaccgugaacuuuuaaaauaaaaucagacacaacacuccucagaggacagagcguugaacccgagcagauacugccaguggggaaugauuuccaucugcagacacacacacacaugcgcacaaguaacacugaaaccagaaugagguggccggggcaagugcugacagaacgugucugucgaggcuuguaccauccuguggcuccugaagcccuggucccaccaggccacaggucugagugcgugaugaaugugacuggaaagcaucacagucacaugcgaaucagggaaagagcagacgcgcugcuugguuauucgguuuuucacaaucaaguuuuguggguuuucuuaaauuacugcucauaagcaauccaagaaaaaaaagcuuccggcuucucuuagcaguauuauacuaacuccaagacugcaagguguuaguugaguagcugcuuugaagccaugaaauauacauucagaaauagcuaucugaaccaugaggaguuuaaauacauccaagcagcugcggugcaaaauccuugcuuggaagcagcagcacuucgggagcccguuaggacguggaggcuugggggcuggagcugggaucuuccugcuuucugcauuucuuuauaauacugacuaugccauucgccaggaaaaccacagagauggcugcgaaguaacuggcguaaaucaggaacugcaagagagaaaaguagucguucaugaaauuaucuggagauggguuguacgcacacagacucuacccgaggacuccagaguggaugaaaguggccauucugggagcaucugcacuacugcuuucucgaugggucacauguugagaaucguaauacuuaucgaccuuaacuacuuuguauuuggaugaagacuggcuuuauaaagaggaggaaggggacuuaaagggcucugaggggccacgaagcagggcaucuaauacaguacuucaggguuauagaugaagaaugaggggcuggagagacagcucugcagcuaagaacauggcuguucuuccggggggccugaguucaagccccagcuccuacauggcaaccgcaagcaucuguaacucuagaucuagggaccaaacuucccaugguugagaaggaccuucaggaccucauccaaaagacaauggucccaacauucuccacagaaaagaccuaagaauggggagguggccgaaagacgggaggacacuuagguuggaucuguucagaauguuugaauuuguuuucauaagacgugucccacuucugccacccucaucagguaaacuacuuucggggccgauggagacaucucaccugaguggugauacauaagccaaggccccuggcauccacgacaaucagagugagcagagucugcaaugccagggcaaugaagguguucacgccgaacacaagggcguaacguuccaugcugagguucgcagcaaucuggaaacuuucaaaagaaaaacggugacuggaguacccaaaccuccuccuaaacuguuacacauuuuuacuuucaacaugaacauauccccuucucuuuacugcuaacucccuuucugaaaugugaaacaugguuuguugcugcaugacauauaaaucuuaugggaacauaagaaaacagugggauaaaaauacaagagaacaaacaaauuuucccuaaauauuuccugggugggggugguggggggaaacguacaauaacuacaauacgaagcuuucucccauuugccuccuuuaaauagaaauuuuaauauuuuuggguuguaaagaaauccaaguuuaucuugcccauaacuuuuccuaauacuucugaguuaaaauacauacguugcuauggugaugaguaccauguagaugauucugaagacaacauaggaugcauagcacacccagaugcucugcacaguguccaugacauacacugcagcagcaaucaggagagaacacaggaacaacgucauuucuccccaaguugaccaagauagcuuuauauagccaacugcaaacacagcacuagcaccuacaaaacaaaaaaggguucuaaucauugacuauagaaacucuauuucaacacaauaaaaaugcagcucagauuauuaugcauucagaccuucaacguguaaauuaggaagcucgagaacacggaguuccuugaaacuuaagcagagacauuuugaacuugauggaauagcacguugccaccgaggugagccugaaucagcacaucuggcaaguagacagaagaggaggacacaggcccagccuucugcuauggaaauguauuuggccugaagcacgggcuagagucccagaaaauuacugcaucugauuuggcaauauggcugggugagucaucucugcuucagaccaagacacaaucaaucuaguauaugcaaaauggcuucucuucccuugagugacgugaugccagugaugacagcuauaauaugggagugcuuucugggugccagccacaauuaguaagugcuuagagcuauuauguagaaucuuccaacaaccuuaugaaguagggcaacaaaguagaaaggaacagaacguguuaucaaggacacaggcucugaagccaccaugcccaaguucuaaucuuuauuuugcuagcuaccauuuauugauuuuagauaaauuaucaacauguccaaaguuuccaauuguaaaaugacaacaauaauuguaacuaucucaggaauucugaaauacaacuaauauaccuauuguuuacagaucaguguucaguacauauuaacacucaagagacauuagcuaccgucauaaacuauaguacacugcuauucaaaaucucacugaacacaggcaaguggaacaaggauaagagaagaaaaccaucuugaaaaucaguaccucccauuuccgagagugugucuguuggucaaagaucccuaccacuugauuauguccaaguuuuucccuaguaaaaaaaaaaucggagcuccaaacaagccauuccuuugggcucuuucagagcucgggggagggagagagccugaagccugcuggccuaacuacuuacccagcaagguugaaacggccuccacaccgccauuguagaugucagcauucugagaaggcaucaccuucucccacaaucccugcgcguaguucaccacuuggaaauagccgcagguggacagggcccaccacacggaccagcagagcagagggcgggaggaauaacacaucaggaagucauuccacaggacucugaacacccgcagccggucuggcuugggcuccuccugcacagcaaacggaaacagagcugaacaccgugguaggguugcugcagacauggcgcaagcucaguuuucucagagauuuuuuuuuccuuuguaaaaaccaagugcuuauuuuacucgagcagaacaauagcacagguuagcaaggacagacaggagcccugaagcuacucugaguuuugguccuggcuucacuguuuacauuuacacaaccuuaggcaaauuauuaacuauuuacaguaaaauaugcacacacacacacacacacacacacacacacacacacacacacacacaggcacacucauaucuauacuuaugagcaauuauguuuauauccucuugugcagacaggaaagauuauuuacaaacucacagauaacauuuacagcaaaggaacacauuuguuugcucucugcgguuggguuaguggugacaucaguaccguccacuggguaugaaaugcccacucuguacgcucaucugagaccuuuauauuaccccauauguaaucaaaauauagacacaccaauaaggaaguaaagucugcaaaacuaauuaacuugcccuagaaguaguaggagcagaguuuggagucauuuuuuuuuucuuuaaaacaucacacagcacuacuaaauacuacaggagaaacguuagcaugcacacugcgggugcuuacucaaaggaaaagugccagucuggaaaggccuuucagcuugagagaacugugaagaaggaauggcauggcaaucucuaucucagaaagggguugauuugaauuuuguuuuauuuuacuuuaagacacuuugugauguagcccaggcuguccucgcccuugaagucuuucagccucaguuuccagaauaaggaauagcacaccagugccacuauacuagaugacauuuuacuuuuuuuaaugcuaggaguuaagccuagggccucacacguuuggucagugguuucccacagagccuaacgcuagcccuccugaaagaaaaaaaaaaucacuggcuuugguguccccucccucaaugucgguccccuuugcucuaaagcaauaggcuaucucuaaaaagaacucaacaauacuugagguaagucuaaggcaaguagaccauuauuccgaguccugcuuaauuuccucuuucugaaaagucacgauaaaccacccaccuagccaucuacucuuaaauuaacauugcaacugugauuuaaugugguuauauguuuugcuagcuuaaauggcucugcaauccucaauaucuauauccuggcuucccuucacgcuuucuguaggaaaacagcagucaaugugguggccaaagcacugcccagccaccaggguaucagccacugagccugggauaucaggaaaccaauggaagcuaaucucucccacacuguagcuaaccucacagucugacaauguaacucagugaaagccuuuaugagguaaagugggaagugagucucauauugugugugaauguuaucugugcaaguauguauaugcuacugaucuuggaugccaaucuuaucucgguaagaauaggagagaugagaucuaggcccucagacugcucuaugcccuguugggagauuacuucuagugaaaauugccguaugcuuuaacauguguuuuuguuggggucuuuugagacauggccucacaguguaacccagguugacagagaaccugccaucuuccugccgcagccuuggagugcugugacaauagguguguacugccacauccaguccaaauacugacauuuuggcuacugauaaauaauaaaguucacguugguauagaagagcuauugaaacuguuaacucaacguggcaaaaaacuguauuuaauaggcaaugacuugaauuuaaaaaguuaaugaaacagauaacagaguaaauauuguccuauaaaguucuugguuuuguuauacauaugcauacaacaacuauacacacauuuguaugcaguggcugcuacaaacaaaugcccuuuccuuuauauuucuuaauauaaaaccccacuguucuauaaauuuuuuaaacuauaacuaauguuaauauuuaaaguauauacuuauauaacuauuagguauauucagguuugccaaagccacuguaacacacuugaaaacaaccagaagaguccauguuuucccuacuaugugagaucuagcaaaugaauagaaccaaccagcccucugcuaacucuccagugccacuuaacaaacuaugccagaauccacauacuuaaucccuggucauuuugaccagagcuggugcccugaguagucagaggugugucccgugauaggcauaccccugucuguagaggacuaggcucccugagauacaauuucaacuagcucccugggcgaggcuuuuauaggcugggaagaaacuacuagguugauuuuagguagaaucaagcuauucauaguaguucugcauuuucauucagucuacaaaaccuauaauucaguuugagauucccuaaucaagacaggaauguuaguaggcuuauggccaagcaacauuucaggaaaacccaaacugcuucaguguagcuggaaugaaucuuguccuugucucucacacccuauaaccugacaggcaaaacaacacacacacacacacacacacacacacacacacacacaccuuuauauuagaaaaauaaacuggggcguuaacucaucuuccuaguuacaaagaguggggagacuguuuuaaaugcuggacuccuccucucuucuaagaaagagcuuuaaaaucacaucuugauuugucugcuaucuucucuaucauucauucacugcccuucuacaacaaaccaacagagcaucauuugaaauaaauaacaugcauccuuccagcccagaaaaggaaaguaauucucuaucuuuaaauacucugagcuucggccgggcgugguggcgcacgccuuuaaucccagcacucgggaggcagaggcagguggauuucugaguucgaggccagccuggucuucaaagugaguuccaggacagccagggcuacacagagaaacccugucucgaaaaaaccaaaaaaccaaacaaaacaaaaaaccaacucugagcuuugagucagaagcuacaaguagacacagaucaccaacugaaucauuccaaaugcucacuagcaaacacugucugagugcuuccuuugugucuagcaagcaguagggauacaaaaaugaagaugcagccccaagucauuucugacaugacucauaacgcuaugcuagugcuuugaggaucaugcauucuaggggagaauaaauugauuauccaguauauaaaucaguugcaucuuaaugacugaguggcccgguggaaugggcuugccugucuguuucacuaccauuaggcaacgcacagaacagcaaccacaaacuuaaggcugaacucaccgguucuuccaccggaggcucaucuaaauuuagagggauuuuugacucaauguccucccauccaggaagaugguuagcugcugggguaucaguaacgaugccaccguuuuguaccuugaggccguucacuccaugacaggaggaaggaauguggugaaagaagaggcucuucuguggcauaggcagaaaccaggccacagcaaaagccacagaaacacaggugagggagaugacguucaagcugaacagugaccagcccaccacggagacgaggaucugcccuaggacggagcccacuguaaagcccaccaagguggcacuucuacaguagcuugugacuuucugguacaugcccagguccaccacaguauagauauaggaguaguaggcgauuucgguggcuguggcgaugccguagaagaauuccaagaacugaauggccagcagucccugggcauagagcagcaugaaccacgucacaaucaggcugagucccugcagcaggaugacaggcuuguaccggagguagucuguggcaaggaacacgggaaacagcagcagcagguaagaguacguccacaccggauaaauuucauuguagaccugguaggaagagugaaagcucguuagugaucaacagacccgacaagccauaagaauguauuccuacaaaacagcccaccaacacucccuuauccccggagaaauacuggccacaguaaguucagguaacuccuggaguagccuuuccuauccccucggcauaauaaaacccuuucccuacaccaaggaucuugcucuguggcccaggcuggacucaaaagcacacugaagaucaaacuagucugggacugcggagccuccugccucagccuuccgugugcugcgauuacggggauuuucuaucucacucauccccagcacuugaagguuucugagaggcggauccagcacucaucuguauaacuuaacaggcagcagacugucuggaagacacaaggaccaacacauguuuuggaaauuaaaucacugucaauuuaucucuaaaauuuauuauuauuucuauuagauuucauacauauguacaaaguauuuagaugauaucuacuucuacuccccccccuccaacucuucauuauuacuuucuccucuucccagacuccuccuuuuucuauaacccagaguccgacuagcauugcuuauaugcacauagguguggguaucgggucauccacugaagcaugggcaauguauuaugggccaccccuuuaacaguguguaaugagacuucucugauguuaagcuuugcucuuugugggguggaagaaaagagugugucugucuuaugccuugauaaaacagcucuuccugggcagcaggacuaugcgcagcagcuguggcuuucuuacuuagugguaacaugaccuaaaguuuaaguguuugguguuuuauuuuucuuuuccuaaauuaaaaaauaauuuauauaguuguacauguuuaugagauacaguguaucuugguacauguauacacuguaauacccaacucaggauauuuagguaauuuaucaucucaaauauuuauuauaucuuuauaauaguuacacaggaauccuugcuuuagcuauuuugauuuauaugacauaagguuaacuggaacuuauugcuauuucguuuuuaugcacaauuuaaaauugagauucuguaaacauaauucucaagaugcauuuuaaaugagaaagauugcauuuggaauuucaguuccauuacuuguguaauuaagagcuguuccucaacuuagaaugggugagugcuaauaaacuugcuaucagcugaacauuaaaaaaugugcuugggguuggagagacaguucaguugaauauaaacauggggaccugaguugagauccccaguacucaguagaaagcugugaucucagcacuggggaggaagagaugggaggguuccuggggcuugcuggccaauuagcuaacauaggcuaaucugguaacaucuggugagcuacauguucagugagagauucuguaacagaaaaauaaaggagaauggcugaggaagacauccuauguuuaccucaagcuaaacguaucaugcccucauuucugaaagcauaaacaugcaucacacacaaauuuaaagaaaaguauuuaguguacacaccccaaagaaccucaccauuuagcagugcagugcccuguagaguaccuguuagcuuccuucaugaaugaauggcugcaaggaaacccggacucacugccacugcccagcauugcaacaaaaucucauggcuagcagaggccaaggucaaguccagauugugccacauucaaugagugcuggagagcuggaagcaggggcuuguggguagguaagguuuagucccccuucgaauucauccuuaucaucagcacaagaggacaaacccugcacuacaggacugucugaugcaaggauuaaauauauaaccacuuacucgccuuuccacagcucugaaaacuagaagacugaauaaaaauggcuccuggacuauaccaaccagcacaguuccaccgggagccucauuuuccugguaagagugaccacugaaaaguuccuucucuuacagggagcucagcaccuagcaaugcacuaaggaccuacagcagucaguuuaggguguuucugcuuugugguugcucuggggcuugggggguuagggggggccagugaugcaguagugacgacuggccuggaacuugcuauguacaccagaguggccucaaaaucaguaugaccauaggaacuggugaagggacucucugucaaaagugcaaauucuaacaagugagaaacaaagcauccugcauccccuagcaaggggguggaggauggaggcuggggggcuggaagaagccuucccuacagauauuuucaguuguguuccaaugagcaacucccugcuccccuguaccccuguucucccagauacuacccuccaccuggucucuaaaaugugacugucuccuaugugacauggucccuuaccaugucuuucucuaccacaaaacuuuuggccaauaaaccuuuccuuaaacgguauucuucacugaaacuauggucucgcugcacaacgggcuauuacuggaccacacagaagaaugaagccgggucaccugcagcaacacggauagaagcagaagcuauauuuuagguuaagugauccagacacagaaaggcaaauguuacauggaagccaaaacaagccaguaaaaauaccgcacagagauuaccucaggcugugagcauaguugagacagucguuccacuauguucuggaauggcuguacucaaucacaacugauuauauauuuuaugaguuuaugaauaacuggaagggagcaacucaagggcuccaaauauaaggaaaugguggagaggcgaauuguuccgaugugaucgcugaaucccauaugcacgugcugaaguuguuacaguaacaaauggauacauacaauuauguuacuaaaacguuuuaagauauucucuaucacuuacuucagcaccccaucuucuugcguuccagaguuuuggccaacaguucagccugguaaaacuuuguuuagacauggaacuuucagaaguagcuguccuuaauuaauugcuaauguuccauuucguaagucccauccuuuaucaauugaaagggugugguggugcaugccuguagacugaggcaggaggaccauuaaguaguucaaggccaguuugguaacacaggaaagccuugauucauaauaaauaaauaaauaaauaaauaaauaaauaaauaacccucaugagguuagugcuacaccaacacaaacccacaauuugaauaaugaagaugagggaaaguaauacuaccaguaacacugccaugucaacuaaguacgccaagggauggggcagguggaacacgggagaccagaugggcuagcuuuaacucccucuaauuaagugaucuacguuuauucuuacaaggaacagcaaucaagaaaaacaaaaacagaaaccuccucucccacuaucaaaagaaccauagcagcacaucucccacauaccaugcugugaacuugaccucagcuauuuccaguuaauccaaacaguccuaagaagcaacugcuuuaccaucucuguuuuacaagaaggaaacuugguguuggagaaugcugcauuacacagucaggauuggcagagaaugauauucccaacccagcacaccaaagcaucuacuuucuucagucacaaaacugcuagugauuccgaacgcccgaaguuuccuucuaucgcuugcagaaguuuucccaucucuacggagggagaccaugacagggacuccucagagacagagaccacauagucuggagagguaggucucaaaggacauucuuucaaaacauuucugauagagaagucuuaacagcagaaaaucuuccuuuaauagauauuuggcucuugaagaacagcuucucacaggcaaaaacaaacaaagggcacacauccccuuauuaccuuucuguuggcuagcucucaucccaggcaacacccaccacgagaucaaagggaaucaaucgaucuguucuagucaaagugccuuucacaaccuugggcagaacuuguuugugugcauuuucuucugggagauaugcuacgggaaaguaaauuguucgguuuuaaaccaauucccacguugacugaagaaaaccagguaaagagcucugugacccuacuugaugaauacauauuuacauagcacuacuuaaucuguauugagauuuuaaaagaaugaaugaaugaaccuuuaguuccaggaguucugagccaaguaagaaacauguacacacacagaauuuaaaauggaaacugaaaacaugguggguccagaaagauaaggaagauaggaaaagaacccacagacagacagacagacagacagacacagacacacacacacacacacacacacacacacacacacagagagagagagagagagagaaagauuaucucaagcagagaucauacuuuugaguacuggaccauacauaggugaguuggugaauauacuagauuuagaauugucauaugaaugaagccuggauggacuaaaagggcaaaaggaaucuccaaggcucagagugucaagcagaauaugugaaaugguuuuacaagucaaagaaaagcaguaaacaucaaaaccgaaugcuaccaagaaaaguuaaaacacuuuucagagauaaagaauucuguuggcuacagcaauaaacaaucguaaucccagacaggcugaggcaggaagaucauaaguuuaggaauacucugagcaacuuuucaagaacaucccuaaaaaauggucaacaagacuagcuaaggcucagugguuagaagcaucaacuacucuuccagaggaccggggcucaguucucagcaccuaugccaguugguucauauccacccauaacuccagcuaaagggguucugacauccuuccucuucuggccuucacagucucccauacacacauggcaaacacuuacacgguccugcacuaacuacaaaauuaaaaaagaaaaagucuggaaauguagcucagcaguauagcaaaaggagccaaaggagcccuggauucaguuccuagcauaauaaguaaauagcuuuuauuaauguuuggcuuuuaaugauugggacauaguccaauuagaaccugccucaaucuuaaagugguaaaauucuagaaugggaauggagaggggaaauucugcccuugagccuuaggcacucagcaugauuuaagauaacccagguuggcacuucugaugucuucaagggaaaaauauaaacuucaguacaaaugucacugacuauaaccugggauuuacuuugcuuaaaaaucauucaauguuuuauuuagcuguccguugcugaaagcaagugcucauucgugaaggacaacagugguucuauuucagcuacuagguuuucguuuuguuuuuaaauguaggauucucaaccuggaaagaagggcuacacuagcauuuuagcaaagacuccaagaucccacaucccagaucacuagauuucucuuuaaauccccuugccucgacuacuuggcacuaagacaagcauccuuguguugucguacaaugaacaagcauuugcugggcccagcacgcugcuauacucuuauacccccuauauguaaggccugcugagagggcagagcaugccauacugcagcacacagcagcucuugauccagguccccugacaaaacauaucaacuuucaaauaucaacaccaagagcacauuucuccucacaugcuucugucaggcaaggacauacacugugcagaucgcacagcaguuugcaugcaaacuugcuuacucugcucacaugcugagucaugucugccucagggucuauaccucagguucagugguuguccugggucuccaagaucgcacuuucuuauaaccacagagcaauuuucuucuuggaaaaaccauucuaaaucagaaggcuuuaucuuucuacuguuggcuuuaaccagcaccaaaauacacauggauaaugaauaacugugacaugauccauaagacuagggagcaggguguaacauuacggcagaagucagcuguacuugcuaaaugucaguggauccgggauuccacacugacucucaauucuuucccaggugaccuugaauaaaggcacaacaaacuggacucugaguaauuauauccugccagucugaaaugggucugguagugucaccucuugcucugaccuggcaugccaaguuauugaguuaguugcuccucagaagugaugacugacaggaaaugacagggaggcuuaaaugggagucauauucuacagccaccugggcagggaagcagcgcgguaaggaaggaaaccggguauaggaagaagguggcaauuauucagcauccacucaucugacaguagggaaaagacaucggaccugagcuuucacucuuuuggauacucaaggaaaggguccuggagcagcaaucuccaucuacaagcuccucugacaaaaccaagugccgggauaaugagcuuuaaucacaggaguuaggcacauuucugaaguauacuaugcacuucuguggugcugugcguacaaguuuguaucuugaauaaaugucugcgcaggaguucuuggucauggcccaugugcaucacagcccucaaaaacaccuguacggaggauaaaaccuguaggugaagcaacacuucaccauccgagaaaagcuaaguaccaauuauaugacaccgucuguuuucaucccagagacggacuucagagggugcaguaaaucuuuggacacagucuuaccuaaucaagcacccauauucggauggcguacuacuguccuguauuguccuucuguaauagcgcguaucuaucuugucagggguaaacaaagucaaggaggggaaggaaagggggacccucucacaaaaacaaagccaaauaacauccauccauauauacauacaaacacucauauguacauauucuacugaaagucgaguuuacuguuuucuuuauccacgcacuguccccgguccccagcagcucccacaggacuuguccgggcagaaccggguuauccacauacggccugaaacacacaugcacgugggcugcggcccaucuugcuuagucucgcacggaacgugcuagaaacgcaaagaguaaggccacuuuuccaagcgagcagaaauccgaacagauaucugcguagcccgcuccgggacuccgccgccagacccuccacaaacaucugacaugcucggccuccccgccugccgcuccugccuaccugucucucggucaaguucuugucgggucccagaagguagggcgugaggaacggcuccgacggccggagguuugcgaagaagccguaggcgcagagcagcgcggucggcaggaaccagcacucgcgagggacgcgggcaguacgcagaagcauccuggccgccgccgccgccgcucgucuggacacccuggcuggcacguccauccugggcgcgaggggcuggacgccgacacggcccccuccuccuucucggccaacgggagggcgcccgagccgcgagcccgcgcgggcaccuguaagcgugcgcgacgccgccucgcgccagggucaaggugcuuggaguccccaccgcccgccggcggccacagcucgcuagccgaacgcccuuucccuaaguccgccuccgggucug

SEQ ID NO: 473 - RNA, 134423 nt, Mus musculus
ugggaucaggcgcuaaucaguuaaaacacauggaagaguuguggcuucuccauccuggcuuucccuuggacugauggacugugaagaaccagcaaggucacucgucuacuuucuacacaggggcugcugaguuuuggguaaaaggccuggggugaaauauuguaggcuuuuggaaugaugaaguaaaacugaagaaaguuucuaggcacccacaugagaaaacaaaaccauuuuuuucuuuuaauggcaaaaacauuuuugguuaaguaaguaauaagaaaaacagaaucuacuuuauucaggaugacaccugauuuacauggauucagccacgguuuauaaucaucaaauuggcugcaaacuuuuucaagcagucugagggucacaauuuaccaaucuuuuguuuuagauuccagaaggcaaagagcacaauuagaggccaucacugagacaaacacugccuuuacuaaggacaguguaaacguaggagcagaaguacuucuacgucacaugacugggcacaggcagaacaucaaacucaugagccaagauaauaccaaguuuccaccgccuguugugggacaacccuagucccgucaugggcguccccauccuucuaugccugggagcugggagaacacuggaagugcgagagcauuucagaauaauuccaggcuggacuauuggaagcuccuuuagucacagauaccuuuaccagcucauuuuaccagcuaaugaaaugugcacagcauaaagaagaaaagcaaauguuuauuuaaugaguuuauuacucuaugaacacauaccuaaacuucauuuaaaccuuuagggaaaaaaaauuuaaaacaucuuggcuuuuccuucuacauuaaaacaguaauucauagcuccuuuauguuauagucugacagaucuucuggaacauaugcaaauuaaacaauaaacugguaaacugaggaugucucuugguaaaucuuaggacaauauucuuucggcaugcaugggggcaggcagugggauugaagcuggguccuggcaagcagucuagccaaagcuuuuuuuuuuguuguuuuuuuuuguuuguuuuuucgagacaggguuucucuguguagcccuggcuguccuggagcccucauuuuacaguuuugagacagcaucugccuagguugcccaugcuagccuugaacugacucuggagcccaaacaggguaugaauuugugauccuccugucucagccucccaaguagcuggaaucacaagccugugccacaaggcccagcuuuaguguuuucaaugucaccauuaucaccuaguaaaguuuagcuauuccauuagaaaaguaugcuaccgacaaucauauuaaccuuuauaaaggugauccccagcccucuccuccaguccagugguccccaaccuuccgaacgcugagauccuuuaauacagcaccccgugugguggugaccccaacagcacacuucguugcuacuucagaacuauaauuaugcuacuguuuuguauauauguaaugcaaauaucugauacgugggggucauggcccacauauugagaaccucuguucucuaggcucuggauaaacaguugcuugaucaaaugcgugugcacacuuaugcaugaagcacagcuucugguguuucacaguauacacugguuuccuaacagugcuaagaaaugccuguauaaccaauccaacccagcauuuccaaauucauuuguucauagaaucauuuccaccugauccuuauuauuuaaaugccccagaccuuacuaucuguuugcuaaauuaacugucaucacuguauuuuuaauguacaagucuacaauuuuaauauuuaguuaaauuguuuauuuuagguuugcgaugagcccuauagguaaugguccaccccuccuaugauggcagugcuauucacaugcuugagagaaaguucuguuguuauacugacaaucacauugcucucccgagacaguuaaaggaugcagacaagugacaucaaauauagguauaguuuucauugauccauguagcacaaacaucuguuuucacuaacaauaguuacaguguaguaaaaauaaaacgaacaguuguauuaccugccuuacuagauaaucaagggggagcucucugaguucaaggccaaugaguucuagggcagccaaggcaacccagagaaacccugucucaaauaacgcccuccuacuccaaaauaaacccaaaacacaacccucccccccaaaccaaaaaagcaaccaaucaaacaaaaaaccaaaucaauuauuaucaaaacaaaaacacuuaccuuuguuuuccgaacuuuuaaggguagucauuuuuuccauaacuaaugagaauacaauccaagacuuucaccgaagaccuagagauguauacauacgaaagaauuaaagcaauaacaauauauucagagaaugcaucuacuuuaaaaguuauuuuuuaauuguuucugucuuuaguacccacguucuucauuauuuccuuuugacgggcuguaauguauaccuguuaaauaaugaaaacccaggcauagguuuaaguggucucuggagucuagacuguagaauaggugaccacacguccuaaaagcugacuguuccuagauguauacgauucaguacccggucuaacuuccugaacaucacaaauccuugcccugggaaugcauccugaaacucuauccaauggcaaacagagacuuuaaagucagaaacuucgcugggaccaugcgaugccgaugagcaaguguccuugucuaagaaacaccgggugaagguguggggaggcaugggugccgaguuuaaaaggagaggagguggaaaaauuaagccugucagccucauuccccaggaguaugagcccaaguuugucccugucaggaggagccucuucccagaacaaccuuuaaaucccaaaccaauggcugccgaacuccagcccagaccauccucuucccaccgcguccggcacacgggccggcuccaggacuuaccugugauauccuuacuucaauguccaccgcucaggcucuucacucgcucagcagccggcugacuuguaaacuccccuggcacucggaagccaacccgcccaagccucccugacacgcagcgccucgcucacucuaaucacuuccuauuacacaggguuucauuuccggaaugcucuucugaaggacaaggaccaacugacacuucgugcuguguguaaaaugaagagagacagggucuacuauguaucggcucggaaagcgaaaacuggaagauaucuacuuaaaaaaaaaguaccaauagauaaugcaagcgguauggacgcuuaaacuuccgggucacuaccagccagacggaagugaacgcguuggaacggagaagguggcgucgcguugccccaggcgaugaggcaaaggguggaucuuugagugaaugggcggggccuaauuacucccagccaauggagacgaagcagcuucgaggcggcgucuucgaagcaguggcuggaggaaggcggggcuugcguugccagaguaaccggaucauugguggugguguagucuuccuguguacaggaaucuauuuccugugcugagaucuacaaacuaugguaaguguuauagggaggcccuaugaaaggcuccgagacccugguuacggaacauccaagucuuugggcgauugggcaccccgccuuucaucaccucuuaccucgcuaggagcaguuccuucugccucugcgcaccccuuuucuugcagcacccuaauuuccauuuuagcgccacuaagaccucaagcuagagcaauguaacagaaaguaaaugggggugauauggaaucuaagaaaacccgaugagaauuauuucgaauaaaccguuuauaagcuugcauuguuuaucuuuuucguuuuucaagcuugcagacccuuaucgacguggugcugucucaacacuaacuuggaucugaaucucccugagugcuggagucaguucucccaagcgguggaguucuaccuugcaucuccuaccaggaccgcuuaguaauagcugucugcuggcucagcgucuaguucauuucauacuuuccagaucacuguguuuuagcagguauguuuuucaggauuacuuggagaguucuagcauucaccaacaccaccauaaauuaugacugaauaggaauggggcuugauacuuugcguuuuaauaagccuuuagaugguuuuaauguacccauugcucuagugcacagaguucuaguuaacucaucuuuagucaucucugcacuugugcgugguggacgggacagagcaaaauguugccuucagguggguguagcugugacuuagcaagaggcaucugcacaaugaggcuuucucauugacugacguucagcaguccuuuuuguuaaccaaucugguccuuugguaccaaagagaccuuuucaaaccuuuacuucacagacccaaucucuuuccucccucuuuucuccuuucuaggcacuugacagaaucuaagaggcaauguauucaguauuggauuccaaauaaucaaugauuuuaccuauucuguagccucguauuucuacuuuaacgaaggaaguguggaagugaccguucaucuguuuugcucuugauuucucuugcucccaucuauuguaaccauuuguggcaugaaguuaguuagcauuugaucuggugugugugugugugugugugugugguguaugcugauuuuguuuuguuuuguuuuguuuuucgagacaggauuucucuguauagcccuggcuguccuggaacucacuuuguagaccaggcuggccucgaacucagaaauccgccugccucugccucccaagugcugggaucaaaggcgugcgccaccucgcccagcuaagcugauuauuauauaaguacuuuucuuacugugacucaugauucaucaaaaucaaaacuugguccuugagcaugaagaguggaauucuccgggcaugcaggcuuaccuuagagacaguccucuuacuguuugguagaaaaacuggggcuggggguggggugggguggggugggggaggccuaaaaacaguuaauuaaaaaucucaggguucccccuccccuccauuugcugucaguccuuucugagaagcagcaaaauguuuugaaaggaggggaagcuagauguccuucccuccgugugcagucugggcacaggcagacagauguauguggcaaaggccgauagggugauagugucuguggaggauggagguuguucacugacauaaguauauaaccagcauuggggguggcuccguuggugaagcacuugucuugcaagcgugaggaccuauauucagucccccaaaugcacucaaaacaaaagcuagacaugguggcaugugccuguaaucccagcacuggagagauggagacagguggaucacugguuggccagccuauccuauuuaguacauuccaggccugucucaaaaaccaaacaaguaguaacaaagggacccguaucauacaaggagagaacuaacuccccuaaguuguccuaugacuucuauauauguacucugauacacgcauucaugauacauaaauguaaaauuaaugaggaaugacacccaaggauauccucuaucuucuacaugcauaugcauacacguuuuugugugccccaacacacguguauauacacacaaugaguuccaggcaagccagaguuguguagugagacccugucuacacaccuacacacacacacacacacacacacacacacacacacacacaugggagagagagagagagagagagagagagagaggggggggggggagagagagagagagagagagagagagagagagagagagagagagagaauaaauaguuugacaugcagucaaggucaucacaagaugugguuuucaaacugagauuuuaguaauagaaaagaucucagguggcucuggauuccucgaggcaaggugagugcagagguguauuagaggcucuggaggaacagaggacuggagaaggugggcacagacccaagauacuggaguauauggcgcuuggcaagaauuuuagauuuuauuuuuugauguauuagcauauguguaugugugucucauauguuuuaucuauuucaucauuuaaauuguuuccucuugauucuaccuugaaacuucagccauauuaauuugaucuagcaguaccaauuuuuuucuucugaucuguaacccuuacuauugaaauuucuuagaaaauauucucucucuuuggagaccagagauuccuaauuucucucuucauaauugcuguuuuguaauuugguuguucuuuauauacacacacauacacaaauauauguagauaucauguaaauguaauuguacucugaauauaucguuuuagaauuuaugucuuggggugggggcuggugagauggcccagagguuaagagcacugacugcucuucugaagguccugaguucaauucccagcaacuacaugguggcucacaaccauguguaaugggaucugaugccuucugcugugucugaagacagcgauaccaguguacucaaauacauaaaauaaauaaauaauucuuuagaaaaauuuauguuuucccucacuuagcaggaaccuuguauuuuuuuuuccuggcugaguuuuaagaauuacaguuuaccuuuucauuuucucugguggagucaauccguguuuuaaucuguuccauuaucgcucuauauaauaaguacaucucauacacauccauuguuucuuuagaauaaauuagaaaggugauaacuaaguguagggucacgugcauuuuuaagauuuucaucugcugccaaguuaaccccagaaaaguuuuaccaauguauacucugccagcagaauacaaaccaggcuugcugcuuuccuaacucucagaacugcuguuucugcccaguacauacauacauacauacauacauacauacauacauacauacauaaauacaucuaaaaguagauuucaucuuuuccuaagaaggccucuugcucuuaggauauugagaaagaucacagauuccugcaugcuacauaaaugaaaguaauugcuaauauuucccucuaauauuugccuguuauuguuuuuuuauuucucucaugaaguguuggaauuugaaguauacugucuguauaaggugaggaugcuggacgcuggcuucagaccuccuuacucccacagacgacccgcccucucuuuucuagcuguauggaagagguugcuuguugcuguggcaggcccuccugcagagccacaacugcggaguuucccacuccuucuuacaguccuggucucagcacugaccaaggaggcagacacugggggaucuuuggggcccucgucuucucguucaugaaaucagaaagcugcuauuuauccugauuaccuuagggcacuucauaaacuauccaauguacuauccaaauggaguauguuguuuucauauuaacaagauuacuuccuaaugagaaggaaauaguugggguaaaugggaagggacgaaaaucuaaaacaagcuucagacguagcuauuugaagcugcgacgauucuugaccacuuuuacuauugagaaauuuacuuuaguauauuaauuuugccucaagcucucuuacagauucauuuuccugguggaagcaguuauaggccagagaaaagagaggagaggguuagaacuagggggacuuggucuugaguugaguuuucagaaccuacaggguccgguggauggccacacacccacuggugaauguaccacauacuggacuuggcuacuaaaggggaagugacccgagguugagaggggcugggagcugggggucgaucugggaggagcuagagggggaauggagaauggagaugaucaauauacauuguaugaaauuguagaauuaauugaaauauauuuuaaaagaacacuuuugguuuggggggauagggcagcuaaacaugccugauuuuaucaggccuuacaucugauaucuauggguucuucuccguuuaaauggauuaauugugauuauuugcuucuguggcuuguagaucuuugguuuaacuuucagugacauuugauccugaauauacauuaagaguguucagaccucgugugaggcuaugauuucauugaucaagucaugcccaugacacaguguuucauagcacuguaucucacuguacgggggcuuugacguuuucucugucccucugcagccagucguaaagggggugguaugaaggccacauguaggguggagcacuucacggucacguacucucagugucucgaacaugucugcauucaccugugcucauuauaaacaauauuucucugauucagaaugagagaaguauuugucuguggauauaaauguaaggguuuagaagacaacucgacacugucaguuuagcuaagcaacaguaggaaguuccccucuugguuguagaacauccuuagccacagcacuuaacugggcgugaguucccucuugguaggcaggccuggaaacugaucagagugcuugguuuccccgcuaaugguugggcuguuguugcagugaugagcacgucucgccugcggguugguauugcaguucauggggucaucauguggagauugaugguuauugacgccuucucuuccccagcagccggcguugcauccucgggcaguaugagagccugucagcagggaagaaguuccaguuugguuucuccauauauggcacccaagguguguagugucuucagcaauagagccuuaucgacuaacucuggugaacagccaagaggaauggcaagagccgguauuguguggggagccucuggguucucucugaccaacagcauaaauggagguaucccacauguggcaugagacuuuuguuuaauaaccccuggcuauuaggcaccugugucuacuuguuuuguuauagacaaguauucagaggcguuucagaaucugaggaacacagaggagagacuaaucgguaugagauaagguuaauuuuuguuuauuguuuuuuuuuuugguucaaugaugaagaccaaacccagcaccuugugcuugcuaggcaaaccccccacuaccaaauccccaagccaagaaauguuaauuaaaaauaacauuauggcuuuuccuguguuacuuuuuuuuuuguuuguuuguuuuguuuuuuuuugagacaggguuucucuguguagcccuggcuguccuggaacucacucuguagaccaggcuggccucgaacucgaaaauccgccugccucugccucccaagugcugggaucaaagugcugggaucaaaggcgugugccaccaugcccagcuccuguguuacuuuuauucaaugggcuuuaugcuuucuuuaacauaugaauauauauaaauccaaagugaaaguuggugcauuuuaaugccaacaucaaucccuaaauuuauuagaaggcauucagagacaguaggacaccauauuguuauggaucaguguuaaaguucagcuuuguuaucuguauaaugaaaugcuuaacagacucuaucugucugucugucuaucuaucuaucuaccuacguaucuaaaaucuguggcuaacgauacuuuuuuuuucuuuugaggcacagucugugguuuuagacuugcauuuccuccaaucaccccacucuuuccucuaccuguaaagcuccgucuuuuccuuuaucccugugcucagauggcgccucagcaggaggcaggacagcccuguccacccuuguaaagcagcagcccuccccgucccucccccccaaccccccagcccccccccucuccccgcuccauccugcuuccuuucuccaucucuuuccauauuagugcccgacagaaacauggcaaauuggaagucguuucacaaauaaggacaguccuugaaauuuuguagcuuuucucuuuuaugucagucaggaggucuaauuaauccacagugucucuggagggugcugugguaggcacagagaagauaauucuacacuguugagaacagaggggcugacaccuaaagaagaaagaagugcuucgaagagauagcugagaaggaaagagagcaaguugacuuucuaugccuaucugcgcuggucauucgcuagaaaccugggcagagaaggauuucuugucaggccuaccugguccuguggaaaacuaaaagucuagaucagaggcagcagauguuuauucugagagagucuggcuucauccaugcacggucacuguugcauuucuacucugugcugcccacuggucuagacaaccuucaaacuccuaaggaacuaaaauggcugagcuuggagagauauacaguuuuggggggaaaaggacaugauaugauaucaggcauugcuaaucacgagaaaggaaccuuguaaggcugcggagugaggaauacaggaagggcuggcauuggauagucagggaaaucccucuccagucccucgagggagaaugggcuggucagagagaaucaaucguccauguccauuguauggacugagcagguuguguguguaugcguaaggacacacacacguaacaguaauuaaaagacgucaugaauuggaaagagaacaagggagugcuaugcaggaugguuuggaaggaggaguuugaagggggagguaacgugauaauauuauaaggacaaaaauuaaaacaauuacaggguggguggguggggcagcuaggacagugguucucaaccuguggguccuaaccccuuuggcaaaccuuugucuucaaaaauauuuacaguacaauucaugacaguagcaaaaguacaguuaugaaguagcagugaaaauacuuuuaugguuggggaucagcacaacaugaggaacuguauagaaggguuguggcaucaggaagguugaguuagagcucaggguacagccaggucagucagacagaaaccguagugaggaacggggugguagucggugugaagaggagcuggaccuggagaacuuagaccaguguggcguggcauugugacgcuuuaggaguggaggggauuuccgguuuuccuaauuccgaugauucugacacugagauugucaccuaaugcguaguagagucaccuaaugcucuaaauugugaauagcaguaggcccauaaaacaguaagcaggggaccaccggauagauggcugccgguuaagagcacuggcugcccuuccgggugacauggguuaauuugcuagccccacgugacagcugacaaccaucucugauuccagcucugugggaucugacacccccugcuggucuccacaggcacugcaugugcagcagagacaucaugucggcaaaacauccacauauauaaaauaaagcgaaauacagucucaaaaguguagugauacguggacauauugaggauaauaaucauuucauagagguugcuuuuuacuucugcuguuaugguggugaugguggugguggugguauguguguguguguguguguguguguguguguguguguguugguucuaguggaaacuaauucauauacuugacugauauuuuuaaaaaacauguucaugaucuccgaaucuagucuagucuaguccccaaauuuaaagauaagcaagcugagacacgcuuugaggcgacgugccucagggcggcgugcuugcuguuugucauccacuggcuguguacacuuccugugucuacccagcugaccccguacugaauugguucuggcuucucaaugaagggaaggaguuaaaagcugaaaacuaauuuuacacacacacacacacacacacacacacacacacacucucuuucucucucucucucucucucucucucucucucucucucacuaaaucuuuauaccacaagaaaguuauucuugagguagcuaauagaaccuuuauuuuuaaguuguuuuccucucauauaauagauuuaggugugagggggcaggugaggagagucaucuguuauucacccuccaugacgguagagguugagccugauaauuaauuuauuaguggcuaaaaaccaaggcuucaaacuugcuugagaauaaccuggggagaugaccaaaaaagucagucacuuuguaaugugaggggucagacauuguuggccugaccuggcaugaagaugcuguaguagaaccagaagacagccucuuucucuuaggaauuggaacgggagggaagcccggugcuccucggaguuccugucugcccgcugcugaguacuuagcuggcugcagcucuuugaguagugauguccugauuuuaugaacacucaaggcgauggugcagcucuaguguagcccagguugagguuuuuacuuuaauuuuuuuaaguuacagcucuguuuaauuucuaaagugccauagguagggugaagguguuuaacguuuucuuuuauugaauucuagcgaaugacucugcagcuuucuuguagcuguacagagaaugacauguuagcuuuguuuuuaaaccuucaguucauagaagacagagugaaacauaccauuauuuacaaaaauuuaugacucaccuggugcugcuugacuagacccuuuacaaguuugcuaugauuuagcucauaaucgcaggauuaaauuggugaacugguugugugacucagcuuuggugacauguuguaaccacagugaacacuagguggcgcuccuccaucacuggauggcauccuuuucagugccucugaauuucauugguguucauauugaugagccacucagaugccaccuuuguugaagucaggaaugcacagaaccacugauuaugucucauaaagugaaagauuaaaaaaaugugaacgaugaauucuucuguuggauuaaaccugaaaaugcuguuugucuuaccaaaaauguaaggauucaacauuaaauaauaucugaguugugugaggcuaucuaggcaaaugcaugaaagaaaacucuguccuaauacguaugucuucagguaggcucuggcaaucgugguauuaacacaugcuggcauacacaggcuuuucucacuauagaaggaugucuguguucauagccucucagucccugucugcuuaccaucaacacaccaucuucuccagucacgaauauucaaacacccuucacuccugacaaaaaugcaaacagagucgggagugacuugcagcuaaugccccguggugauuguugcagcgcaugccaguccacauguguguuuggcuucugcagcauuuggcaccuaaggcugggucuugcugugcucauucuugcagugggcugggcaggguucgggaugagcuacaggugcccucguguggcacacauuuccuagccaauggaaacagugcucugagacgagcacagccuucucuaugugcacagacguuagccccguuugucagugacacugcuuaucuaugcugucaacuccuagagagaaaaaugaauagaguagucuaggaaggguugaacuugcuaaaagugcggaggucaguuuaagcaccacaguggagacaggagcccuucccaguguauccacgccuccuacgccagcuuccuacaccagcuuccuacgccagcuucagguuguggugccuuuuuguuucuugaacuccaucuuccccaucauaacucuauacuuuuuaucucccuggaauauuuuucuccuaggucucuacaugacuggcuucuccuuguccugguauugucuuagagggagaccuuaacugucucuccuaguuggaggccgguuccuuaccucuuuuaccuaaaauuuaucacguauacuuauucccuuuccuuagagcauuuaucaugacaaguauuguauuguuuguuuuuacauucuaugcaaaguaugaagagagauaggaaaugaauagguauggucuauauuaauagagcucuguccauuuugaauauucuaagugacuguuguagugucugacaaagagaagucauuaauuuuuuauuaagcaaaugaaagaaauaaauucaacuuuuaagaaugccuaccuuucccuuugugccuaccgguggauacauacugcuuuucaaaguucuucauauauuuacucaaaaaguauuguguugcauuuucuacauacugcaauauacuauacuauacauacauuauacauguaguccuuucagaugcagucuugagccaaacagacauuuuagcaggggaaggaacucugcagucaacgucuguugcaugaagacaguaagugcuacagggagaauggcuggcuguugugagcagugagcccuccuggugguggauagaacuucaaggagguggccaaggucucucucauagagaagaagaugaaaguggagcaggguuggggaggagaaggagugagccaugagauauuggagggaaacaucccaggaaguagguaggagcagcggugggaaggcucuugggugcauacaaaggauuaugugccuagggcaaaguccgcaagagugagcgucaugggaggccaucgcagacagacagaucucacaggcuuugcuugaauggagacacuucauacucguguacuagaagacuugauuuuccaaugggguaaauagacugaacacaaucccugguaaacucccagaggcuaauuuugcagaaacugacaagcccauucugccuuugagaugguaacaugaaguacugaaguuagccgaggcgguguguaugugugugcaugaguggaagcgaagaggccagaggucaacacugggugucugccuauuuauuucccaucuuaccuucugaguucgugucuuucacugaaccuggaauucacugaaaggcuggguugguuggcuagcaagccucagagaucuggcugcccaucuccaccucccgugugcuagaauuacagguaugugccgccauacccgguucuuuuccaugugugcuaggcaccagacuuagcuuuucaugcuugcauguuaaguguuuuacaaacugagcuaucuccugagucccagccaagauaauugcuuaaaaguaugaaauuggaagauuugccuuuccugaaugaaaaagguguaaaguuucuguuuuagacagugugaugcagcccagggauagcuagguuucaugaugaguggaacggaguucagagcccagagguaaacucuuggcaauaaauuaguuuuuaacaaaaaugucagcaccauucagugagaaaaaaaggaguauuugcaaguuauugcugggauaacugaauauuugcauuacaaggaucaauuuagagucuugccuugaguagcucaaaaaaaaaaaagaucauaguaaaagcccgaauauaaaaccucaaaucggaaaucucuuacaaugaagcguaggucuacagcucugcaguauugugucaagcaaagcuuucucgaauaugacaucaaaaccacaagucaccaccauucccguccccuugccggugaaguguucuagaacggcaagugugagccaggggggcuucuggagcaccgcgccuagauccuagcuggacacagggaaggauaucugcggggaggaagcaggauaagggcugaauuacaaaggugugggcagauagagaaacugacaaggagcugcaggcaucaggaggagggacuggcaagagcagagagcuuaucagggugcaagagaacugccagagacuggcuagugucugacaggagcuguggcuucagcggagcucagcaacuaaacagaaucugacugggagcucggaauguaaacaucucaccccaguguucuuccuugauccagccguugucuccucccagcaaauccaugugaaagauggagcauuaaguagucuguggugaaugaaguucaugaagguuccucccugcccccaggucccgggcugacuguaggcaucugacugagggucuggagggacgaauggaaaauguccagcgcauacauuuccaggccuaguggugugaugguuaaagagagacauaacauacucacccccaguaugcauaugaccuugacaguuguaaagcucagacauacugguauuuucucggcuauuauaugguugagcuagagucaauucuguaauugaauauugaauauaaauaguauauaauuacuuuagaauuauugugcuacauauauuuagauccagcauuuucguuuugucucaaauccauuucuucucuuagaauugagcuuaguugauaggugucaugcauucccugcggguagucuuugccccguuuuaccuaacaccgcgucaacuguucuguaaggcgcuagccaaggaccacggguaaggggccugaggcgggggagggggagcuuuagagucuuuccagaaaaacauaacaaaauauuuuuugagucuuuuaaaauauugaauauuugauuuuugccaucuuaccaagaucuaucuaucgaauguguauuuccuucuuuggaucuuuauuucaguauuuguuugauguuucaaagaucucagaacuacacaugccaauaaggacuuucaaaagaaaugauagucacuaucuucucuaagcccguaaucugguuaugaagagaauuuuaauugcacaagcauaccagaugacaaggcagcgcuauucugugggaacucuggcugucucacaaggaaacaaggcgccuuguaaagccgagcuguggaccaagucacagagcucuugccaagucacuugucugcaguucuguucccucauuguuaaugucccuuugauaucugggccucugugaaaacugaaucacaaguccagaaaucccaacccccgaugggcuggaguuggugugggaagacuugagagcaaucauguuugcuuuaagauguuugaggcagguuugcccuugauuugcagagagcuuucccuugauacaagucuguaauguugccuuuucacaaggcagugaucuuagaagucaagagauuuuuuuuuuuuuaaauagauggggcucaagaagaaaaagguuuaaaaacaaacuucuuuuugagcccagacuggccuggaacucccuguggagcccaggcaggcuuugaacccgugauccuccugccucugccuucaggguacugcuguccuguuuuuguuuaaaccauaaaaugcaaacuggucuuggacuggagcuuuccccucgccucccccagcguuugcacuuuaggagagcaucuugucgagcccaaguuuaaagcagcuucccgcguacacucuggcucggcugcuguguuccauucccuggcuuauccugcuguaucuaagguaggaacugcuggcuuagcugcuuacugugccugguaauacauuuuuaaugacucacuguauucucggaaugcucagggcaaaaugaaguuuguucuucggaaccacuuuuuacucucccuuacuggaagcagcuggcuggaaugggcaggucucaggugccacgacuucagaugcagccggguaaagccauucaggggaguuacgggcacagacgagaggcucagacuaguuuaauagccuguugaacuguaaccuuuauugccucagaguuuaaugaagccacacaguagccgguauuuauuuguuaagucagauaaggagcuagugcugauucuaacuaugcagauucugagaauccaaguuuuaguuaguugaagacauugcuccauggugaaguauauaccauuuggguaugauauagaugagaaucauuuaugucuugcuaccucuuguaaaauacuuuacuugaaauagagcaauaaaaugccaauguguaauaaaauauguguacauucaguguugcuagacuugugucugagaacauggcuggauuuguugcuguguugcuguuuuugcucaaguggaggauuaaggggacaggguaugauugccagaacugaagaugugugugugugugggggggcgugugcaggucugaggcccacucuccagaguccucucucucucucucucucucucugcggguccuggagcugaaacucaguucaucagaccuugcugccugcuccauacgagcuccaggcgcuucaccguucuuacggaccaugguuagggcauguguucugaaaucuaacugccuggcuucauuguuguacccaggcuguggaauccucuguaaaggaaacaguauccugcuguguagauagaaugcagucucaggccagagccccacuggcagugcugcuccuuuaaacucuggcuucucacauugcaggcuaggaggauuugcuuauguguggccaucacagcucugauguagucacugugggaauugcuucauagaguucacaggauuugcaauagaauuauguguaagggaagaacuugauccauauuuuggaaaaaauaaugaugggaagagguaaaguugacauugaguucuuuuuuuuuuuuaaagauuuauuuauuuuauguauaugaguacacuguagcugucuucagacaccagaagagggcaucagaucccauaacagaugguugugagcuaccaugugguugcugggaauugaacucuggaucucuggaagagcagucagugcucuuaacagcugagccaucucuccagcccaacauugaguucuuuaaaaaaacaaacguugauguggagacagaacaauccauuuaaucucuaaacuauucuaaucucauguuucuauuggaaaacuaugcuuaguuggaauuauguguaaaguuauuagcauacauuauuaguauauugcauuauaaaucaccuguaguaauaaaacacuaaugagcuagcauaaaacuaaguagagacagaaauacugauaccccggcucucuucagcagguccaguauuucccggauuaguguuuuaggagagggcgucuuaucuggcacuucaucaguaauuugcugugugugguuuuuuauucuggaaaacgacaucuuaggguuaacauaaggauuguguaauaacagauggcaaaaauauacagcaccacuucauauaucaugagggcucagaguugcugauguuaauggggggugguggaaaacuuuuugagaauguucaagaaauuauuaauuuuugucauuucuuacuuuuaaaauaauuuugagugcuagcaaugcaucuuuucugaagucuaagcuccuucagccaucuuagucagcuuuauaaacauuuucaguucccauccugggugcccaacccaucaguuuugcauauaaguagcuuucagcauugcucuuuggacagcgacccuuugcacgugcguaauuaaaugugucagcagcaguguucacauuccuagccuuccucccggcucccaggcacugcaucaggugugcauuggaugagaggcaugcauuugacuucaguuuuaacagaugaauuguuucugaaaaauagguuaguuuggauaguuacuguuuuaaggacaaaaauucccaaguauuguuucucuggauacauugcucaguaacauuagugccaugucauggaauucugugccaguaaaugcuucaagaugaaauaaagacauuuccaaacauccacuguaguuuugaacucacauugcuacaccuugcuacuuauuguuuguauuaaauuucucuuucucucucugccucccccccccgucucuuuuucuucucucucucucucucucucucucccccucucucucucucucucucugguaugcuuuucuaucccaugaacugaguuucacuuacuggcuucauagaauuugguaucaaacuuagccagugaugaauuucguaaagacuuuuuaaauuaaaaacuauguccuuuaacuauauucaucccccccuuugccuucucacucuuucuguuuccaaauaguucccuuucuaccuugauggagagagagagggagggagagggaaaagaagagggaggauaucuaaguuccacauacaaaagaaaaaaaaugcaauguuugucuuucugguucuggcuuguuuuccauuaugugaaggccuccagucuaacuuaccaaacaacauauuuuuacucuucucugugguugaauaaaacuucauguguauucauacuuccuuuuguuuauugacuucuuuguugagggacacuagacugaucuaccucuuggcgcuugucaauggugccacaauaaacacggauggucguggacuuucauuuguuuguuuacuuguuuuuuguuugguuuucugaggcaaggugugauugcauggccuuggcugacuuggagcuugcuauguagacaaagcuaccuucuaacccacagagaucuucaugucuccuaacugccaggacuaaaggcuuguaucaccacuccugacagaugagguauuucuaucguguguggguucaaauuccuuuguguaucuuuuuuuuuuuuaaagauuuauuuauuuauuauauguaaguacacuguagcugucuucagacacuccagaagagggcgucagaucuuguuacagaugguugugagccaccaugugguugcugggauuugaacucuggaccucuggaagagcagucgggugcucuuacccacugagccaucucaccagcccccuuuguguaucuuaaauaacauugccagaaacauugaaaguaagaacugaucagagcuguucuuccuaggauggaggccacacuggugggccauggugagugcugauuccuucuuaugccuguauccuguucucuccagaguaacuaauaggcagaccaccuuucucucuuccuuuaccgcuccucuguuggcucaucagaacucuucacccuauuuuguuccucguuuugauucagagcuuuugguauuuggacaaaauacugauuuuuuuuuuuuuuuuggcaccagacacaacuuuguuugaaaguccaagucuggcuuuggucuagcuguuugacccaggaagcacugaaccucuguuuucacauggguggaauguagggagaagccaaaacugcagccauguuuugaggauuauuagcuguauacauacaaaacugacugccauaguguuagcugaucucauucuaccuccacccccacacuuaauguaauacuugauucuagucacuugggagaaauaaauaagauuuuaagagauuugcuaaaauauuaguaguucauagagcacuaaguacccuaauaaaagccaccaaguaucagcaguggaccucacugauuuaugaaagguacugguaguugguguccucaucccgaaauaauaauaaccuccuucuucuccucccugauuucaccuucccuugaugguguuuaugagcuuuugguccuuaagagugaugcugucagcauguugcuaaacuuacuccuuauuuuuaauuuuucucugcccucuugaggcuucaucagaauaccagguccuggaaaagcauaaggaauuuuaauuagggguuuuguuacaucagaaaaguguauuaacacgacuugucuugagaaauguuguaauuuaucauggcuaacuuaagaggauuaaucuuccacaggaaugagcccccugauugguuauccaaugccaaguggucaacccuaaaaucauacauagacauguaacacugaauggacucagcagcuuguauuuauccuagauguauauagacaugugacacugaaugaacucagcagcuuguauuuauccuagauguauauauguaacaauaauaauuaaaggaaaagaauaaaauuugagagcuauugggagauguuggaggaaggaugauguaauacuuaauuaaaaauaaaaaaauagauaauuuguaaugcaguaauuccuuaagauuuuacuucacuugugagccauuaaauggaaaauacaguaauuuauuugaaaagaauuuugcaugcuuuauuuuugauaccagaaauccuugaacugaaaugcugcacauauuuauuccuuuuaaauaaaauacaagucauuuuugucauaagccuugauagaguucuuagguuuuccuguuuggcccuguaaacauagcuguaacuguuuuuuaguuuuaggguagcuauguggcauuaggcuuucuguuuuagauaaauacacugcuaauaaguacaguagauaauaugacuuuaaaguuuaugccgagccuggcauaaacuuuguguaacuccagcacuuaaaaaguagaggcagggacaagcagcacucccacucuuggcuauaugacuaaggcuauaugaggcccugucucuaaacaguaaauuacaauuuaaaauccauaaaacauuaacugugugaaugugaaggcuuugcuauuuucauaacaccuuugauuucuguaugaaaccaaaacacagcaguuaauuucucauagcuauaauuuguucauaggaauuucauaccaauugguguuauugaugaucuuuuucaauaugaaaugccuugccuauuuuguuaaguucagaguauaaaacaaaucauuauauaaccgauggaauuauacaauuuaaaaagaaaauugcugcccaauuauuagacagaguaucugugauugugugagcuucccgcagaugcauaggcagagccuccuucaguuuaccugcugugauguguguucugcagcucacaaccccccagggucuuaugugcauggggcauaauuauauacaacugggaggggggaugcugcucaggaaguagcuggaaucucagauggagaucugaugucccuccucccaugcuccuucugugggggaacaucaacaggcccccucaggaugcuggagugaucccagcugcucugacuaaugaggagcuggcggguaugcaggagcccagcguuccacagccacccugcuucugauucagccgcucuaagaaacaguuuugggcuuagcuagugaacgagccugaauuuaaucccaccacuaucaaaaccaaaacaauuuuuuuuuaaaagcagaauuuuuucacuauaauguaauguuugaauauucucuauaaaguauuucugagagaaauggaaauguucagugaagaugggaugagauuauuccuguaaccauuggacacauuauggaacuaacucaggguggcucugcucucuggguguccuacgagaaucaguuucuccuggaguucaccuacaaggccagaccuggagaaagcagggugcaguuccuggguuuagcucagucacaugacaggcuuugcgauauuacgcuggucgaguguauccuguggaacucaguuucuuuaucuaugaaaugaaggguuugaacaaagccaaaccaaacauugguaucaccuggaaaaugagaaaucaucuuuuuugauagacauggcucaaugaaauugaaaaguaaaauuuugaaaaugaguaaggucugggaguguguguguguguguguguguguguguguguguuucacugaggcaagucaugguuauagaggaaacuggcuauuuuuuccagaugacacacaggguaccucucugccuguaguuucuauuguaaacucuacgucauaacucgaagaaucccuaccugagagcuuaggagugucugaagcuuuugaaaacaguggaaaucaccucgucaguuguucugucuggagcuuccucaucugagaggagugaacagaggccugucucgcuucuguuucucagaggcgaacacucuccccugcuguuuuuacaagaugauacagcugugcaacuacugagaggagagacauuuacacauuagugcaauagucuacacuugccaaacuccugaguuuaagauauuaaaacuucuagcaauggagucucuuaguagcuuguugauaauuuugaaguaaacuugacugcggaccaagcaugaguuguuaaaguagucggaucccgagcucgaguuccaaagacugcugacugaauggagacaauugacuggccuugaagagaugauuaaacugaccuuugaaauacacaaguguauuuaaucagaaacuagcaggacaaauuucuaagaaaagaguacuugaguauaauagcaaagauuuguuuguguaaauauuuggaaguccuuagagugcuuauacgguacugauaaaauucuuuguuuuccuucacagaaucagagcgagagauucgcuuucauugcagagugguaugauccaaaugcuucauugcuccgacgcuaugagcugcuguuuuaccccacagacggaucuguugaaaugguaacugaggacuggaaagaugguuccguggguaaugcgcgugcugugugagcaugagaaucugacccucagcgggcaggugaacagucaggcauggcggugccuccucguaaucccagcucugugggagcagauuguggacuugcuagcuguguggucuagcucaguggguaagccccagguucagugagaaguccugucucagauuauaaggugagccaggugugguggugcacaucuuugaucugguauuccagaggcagagaggcagaggcagagaggcagagagaggcagagaggcagagagagagaggcagagagaggcagagagggaggcagagaggcagaggcagagaggcagagagaggcagagaggcagagagagaggcagagagaggcagagagggaggcagagaggcagagagagaggcagagaggcagagagagaggcagagaaggcagagaggcagagagagaggcagagaggcagaggcagagagaggcagagagagaggcagagaggcagaggcagagagaggcagagagaggcagagaggcagagagagaggcagagaaggcagagaggcagaaagaggcagagagagaggcagagagaggcagagagggaggcagagaggcagagagagaggcagagagagaggcagagaggcagagagagaggcagagaaggcagagaggcagagagaggcagaaagaggcagagagagaggcagagagaggcagaaagaggcagagagagaggcagagagaggcagagagggaggcagagaggcagaaagaggcagagaggcagaggcagagagacagaggcagagaggcagaggcagagagacagaggcagagaggcagaggcagguggaucucuaaauuugaggucagccuggucuacaaaggaaguuccaggacagccagggcuacacagagaaacccugagaggccuugccugaaaaccaaagaaccucccccaaacaaaacaaaacagagcaaacaaugcagguaagggggauagcucccgagaaccaggucugaggucaccuuuggcuugcaugcaugugcaugacuguccauucauacaugggagcucacacacugguaaauaaccuuuguuugcuuaaaaguuagcaaaauuauuuccuaugggacggggagaagacugaagcugccuuucuguaugguugauuuugaaauggcauuugggauguauuuuuuuaauuuauuuuuuauugaaaauuauauuguuuccauacaacagauuuugauuacaguuuccccuaccccaacucuuucuagauauuccuccuacacccuuucuuucucucuuucauuagaauacaagcaggcauaaaauaaaaacaaaccagaauaugacaaaacaaacagaaaaaguuccaaagaaaagcucaagggacacguaaagacacugagacacacacauccaugcacaccgugaccaccugcaggaucacacacacauccaugcacacugugaccagccugcaggauaacacacacacacauccaugcacacugugaccagccugcaggaucacacacacauccaugcacacugugaccagccugcaggauaacacacacacacauccaugcacacagugaccagccugcaggaucacacacacauccaugcacacugugaccagccugcaggauaacacacacacacauccaugcacacagugaccagccugcaggaucacacacacauccauguacaccgugaccaccugcaggaucacacacacacacauccaugcacacagugaccagccugcaggaucacacacacauccaugcacacugugaccagccugcaggauaacacacacacacauccaugcacacugugaccagccugcaggaucacacacacauccaugcacacugugaccagccugcaggaucacacacacacacaucaaugcacacugugaccggccuacaggaucacacacaaacacauccaugcacacugugaccagccugcaggaucacacacacauccaugcacacugugaccagccugcaggaucacacacacauccaugcacacugugaccagccugcaggaucacacacacauccaugcacacagugaccagccugcaggaucacauacacacacauccaugcacacugugaccaccugcaggaucacaaacacagauccaugcacaccgugaccaccugcaggaucacaaacacagauccaugcacaccgugaccagccugcaggaucacacacacauccauguacacugugaccagccugcaggaucacacacacauccaugcacacugugaccagccugcaggauaacacacacacacauccaugcacaccgugaccggccugcaggaucacacacacaucaaugcacacugugaccagccugcaggaucacacacacguccaugcagaccaugaccggccugcaggaucacacacacguccaugcagaccaugaccagccugcaggaucacacacacauccaugcacaccgugacuggccugcaggauaacacacacacacauccaugcauaccgugaccggccugcaggauaauacagacauccaugcacaccgugacuggccugcaggauaacauacacacacauccaugcacaccgugaccggccugcaggauaacacacacauccaugcacacugugaccggccugcaggaucacacuaaugcacagcaucgugggagcauccaaucacucuguagagauauuuuauuggauuucuuuuucuuggugcucaguaauauaccaacacaggaagauaacuuugugcugguguauauguauguauguauauauauaauuuuauuuuauuuuucugaguuacgugguagacaggauuugaccacauaauaccaucuggcugcucacuugcaaucuggucuaaucucagcuaggauuauaaauguccaccuucacacccagccuuguugaaaauuucuaaccgaaguauuuuugcaagauuuuacauuaaaaauauaagaacagcuuacgcuuggugacauuggacuauaauuucagcacuuaaaaggcugaggcaggggaauuccaaaguuacaggcuagccugaacuguauagcaaaaccuugucuccaaucaaacaaacaggccuagagagaucucuuagcuggaaauaauacuggcugcaaaagugugaaggccugagcuugacucuuaagcaccuaccuacauaauggcugggccuuguucccugugagaacuccaauccugaguaacagaggcaggagcucccuggagcucucuggccagcugacccaacuuaaagcaaacuucagguucagugagagagccuguguuaagacaauaaugugagaaaugacugaagaagacaucaggcaaccuccuauaucauguauguuuguagggaugcacacuugcauauaacacacauauauagaaguagauauauagagagaccccaaaaugaaguaggacaacuguuuuuugggauuaaucaauauuugauaaguaguuacagauaaaugguuaucauagucauaaauauuacgguuaaaaguugguaucuguauaaaaugucaaauuaaagaggcucuaagagggucccuuucuuugcaucacuucauuggcaaucacuuuaaaaagucagcucaguugggguuggagccuagagagaaggcucaguuaagggugcuagcugcccuuguaggucccaaguuugguucccggcaccuacaccgagccgcucacagcaacuguaacuccagcugcuggcaagccaacagugacuucugcaccuucacucacauguaccuacccacagaaagggagacacacaugaauacacaucucuuaaaggaaauacaauuuuuuuuagugauugggauguguacauaaaaagaaauaugagaaucugucucugucacucauagcuggugaguuacugaaauaacuuggucuauuuaggauauucuaaaauauauauuuuaauuacaaacuuuuaucacuagauuggauuggaaauaaagcuucacaguauaaaauauaauuuauauacguaguuauaaaguaauaggauauagcugucuuuuguaaaaucaauuggagacuuuucucuguaaggcguacguucuucauaaguauucuuacugugucuguuucuagcaugauguaaagaaucgucgcaccuucuuaaagcggaccaaguaugaggaccugcgccuggaagaucuauuuauaggcaacaaagucaauguguuuucucgacagcugguguugauugacuauggggaccaauacacagcccgccagcugggcagcaggaaagagaaguaagaacagccgggccaucuuuuuccauugaaaccuugccugugacuuuggccacuaacuucugauuuccucuccucggucauguuuucacaacauaguuuuuccagcgaccuaauauaauuuuauaacauuaaaaauauuuugguacugauucagggauugguuccuaauuagaauauugaagcaauaucuguagucuuaggaggugacuguuuggauggguggguggcagagauaaagcucuuacacauucuaucugcuuuuuauauuugucacuaaaaccuaagacuauuugagcauaagguuuucuuccuaagcauaagcaugaugcugguacgaaucacgguaacccgggagacggugaaguuaguucuugcaaaacugaaggcuuuguggguuuguucugucuugauaaaacugaauuaaauuauuaccccaauuagaugaacuggggagaaaugcuaaucaaaggagugaguauagagaaagauccaaaggugggaaauccugucuuaaguuagaacaacuauuugcuauccugcuuguguaaguugggggcuaaaacuuauaaaaguuuaauuacuacaacaaugaucugaauuauuaugguaacaguagauaugcagaagaaguaaggaguguacgugauuaauagaaaugcagcagugcaugccaggaagcagcucaguuggggcagugcuugucuagcaaagaugaagcccaaaggccugagaccuagccccguguaaaacuggaggugguggcacguuucugucaugccagcaugugggaaguggagguagaaagaucagaaguucaagaucauauuaguuuacagagggagucaagggccagcuuggguuacaugugacccugucucaaaaaaaaaaaacaaaaaaacaaaaaaaacaaaaaagacaaaaaaacaaaaaaacaaaaaaaccaaauaacaaagaucaaagacaguucaaguuaagaauggaaguucuagaaacuuugggugagaugaugaugagaagcugccucagggcaauuuaacagaagagauaggcaagguaacagagaauagacccugccccaaggagagagcgaucagaacaucagaaaucacaaagcaagaaguagcuugcuccagggaauuuuauucagcuauagagagugaaauucuaacaucugcaaggaaguggacagaccuggagaucauuacauuaagugaaagaagccagauuacugaaagauaucaaguggguuuuuuuuuuaaauauguggaauauagauagauggauagguggguggguggauugauggauggauggauagauagauagauagauagauagauagaguauagaaaggggaccauggagggaagaaguuuaaagagaguggggaguuggggagugagaaauuguaauaaaauauacacgucauaaaagcuaacagauuacugggugaagggaaagggacuaacaagaagugagucaggauuagggagggcgguggggugugaaaaauagcagacuauaacaaaaauaucaccaugaaucacauuauuuuauauauuagcuaaaaauaaauuuuuaaaagacaauuaugucaacuauaaugugugggcaaacaaaaaggacaacccagugggacggagugggcagugcacugcuccacuggggcagaucccugcaggaggaccuggggcagggugggacagaagccucaucugaaaggggacagaggaagggacuggguaagcucggucugugagugaaggucaaggagguacauuaugaaaauggaacacugaagcucauugcucugcgcaaccacuaagauaaauuuaaauaccaaaacccagaaauucgggacuggauaggaccuggggacgauucuucucuugcugucuuacucauuuccgugucuucugcaucccugagcaaaucucuuuacgcauugcaagagcaagguuaauuucaccuccgaguuuugcagccuucauuccgugacuuuuuuggcucaaugcuuugggucccugcaguagaacacauuaugaaggauauugagugguagaggaagcuguuuaccucagggcacaaaagggucugcaguccuaacagcccuucuaagcugugaccuaaagaccucccaguagcugcaccacacacacacacacacacacacacacacacacacacacacacacacugcacacucucucgcacacaugcagauacccccacauguaccuuuuuauuauucuuuccuuacugcuugccacccugauuuucuuuaguuuugguuuagaaagaaacagaaccaauuggagaugcagcuaaaaagcaagcuuuaaagaaaaaccaaaaaccaaaaccaaaaauggacuuaauaaugauucucuucugaaaaaugauuucccuugcuaugaaauggcauuuuacuuuucauuguccacauuuaugaguugcagcuuucugagaauagauuaaauauguugguaaugaaauuuuaauucuuuccuuuguguuuuauucagggauagaguauuugaaagauauuaucucuacuuguguacuuauugggguagcacuuaacauuaaggauaauuguugaaaguuaagacuguaugcuuaaaaguuccagaaacuacuuagcuuaaaaaaaaaaaaaaagcaguaaagcuauuuuaaggccuacuacaaaaauaguuuaaugcuuaauaucuguacaguagguagccccgguagaauaggguauuucuuucugcaacuuccuugacccuuccuuacauuuccuuucuaauucuugagguggcuugaagcccaggguagagauuagugcacagguagugaagggccaaagguagaaugauugccucacgggaaacgagcaaaggacaacuauaaaauugggaaagcccuguaguacuagacuaagaggcaucuccuguucucauaagauugacugugaaaagucagugacucucucucucucucucucucucucucucucugucucucugucucucugucucucucucucucucauuuucccccugaacccagcuagcucucagaauugagaaugaacugaugaaguucuuuaacaagcuuuaggggcacaagagcugagcaauguugcucuauuuuaauccucuaagcuaaucuggcugccucccagccaaaaucuccaagagacuugcauguuauggcuuucucugcucaagcuguuuucuucugcugucuccuggacucccucgcccccuugucacaugguaaauucacacuuccgcucucuccuucccucuccucuggcagggaggaaguccaucccuauucucucuuccugcucagucauuggcuaaucagcuucuuuauugaccaaucagggaaaaauuggagagcaauguuuacacagcguugagccuggacagucuuuagagcgaggacugcaacuggauauggggacacagaagucagcauuugaguaaaacaaggauaaucuuuacacagugcacaaugacaugccuacaaccaugcucaguuuuuagcguggguuuuaaaacucaggcuuucacacuugugugauaagcacaguaccaacugagccacaucuccagccucuauaaccccuuuuaugagugguaaauaucuauagcuuucauucaugguggacaaugauauacgccaguguccuggcuaguuuuauauaaacuugauaugaacuaaagucaucugagaggggggcacuucaguuaagaagucuccuuacgauccaguuguaggcaagacuguaaagcauuuucucaauuagcgcuccacgugggcgggucaagcucacugugaguggugccacccuggguugaugaaaaacuggcugagcaagccacgaggagcaggccaguaagcagcaccccuccauggcgucugcauucgcuccugcccugcuugaguugauguccugacuuccuuugauggugaacagugauauggaaguguaauccuuauaaucaucaugguaggaagcacagcaguguccaggcagacauagugcuggagaaggaguugaaaguucuauaucuugucgcccaggcagcagaaggugacuguacuccacacuggauggagcuugagcauaggagaccucaaagcccaaccccacagugacacacuuccuccaacaaggccauaccuccuaaaaguguucuuuccacaugggccaagcauuugaacacgagucuaugguccccauaccuauucaaaccaccacagagacuaauuuuuaaaccauauauacuuuaauguaaauaaauauuugaaguauugggccuuuguaaauaucguuaauauuaauggauguaguaguguauaguccacugacaaauuauuucaccauuuucuuuucugauuaauuucuaccuauaaauggauaguaaauaauagcagccauuugggugauuugaauaaacuucggaguuuaggaauuuaaucggauuuuauguguccauugcucugaaauagaguguaaguauuccaaguugcauuuaaggugguaucuguacuuaaaaguuuguuuaaagaugccuuucugggggcaaggagaauguuuaaguacauccaaauaauuacacauuuguuuaacacagcuauuccucauugacacagcucugugugugggcccgcacuucuucgguuuaauaccaggagauuccguucacuuccgugcugcaccugaguguuucuguccacguuacauuccaccccagcugcaaaaccaucugcucaucuauuuccugaacauuuccaccuggauuuuccacagguuuuuaacaauuaacaaauucaagauggaguucuguuuuacugaauaaccuauuucucagccuccaacacacuugcagauguaggcgguucagggcucccugaaucccaucuucauuauaaucccacauccagauaggggucacgaguuaucaacuuaccuuccccagcaacuucuucauuuaucagcuugccaucuuuuuugaucuuuucauuuuaucuagucuccauuucuccucuagauuauuguuucaaaacucacagugccaggaucugaaguauuuauagguuuauagguccuuaucucuucuuuggcgucucuucugcuucuuccuuauguuggugcacacacacacacacucucucucucucucucuuucucucucucucucucucucucucucauauuaucuuuauguagugauuauugugagcaugucugugggagaacugcagaacugccuaaaugugcaagauggauguaccgugugcuugugcaggacuacuugagaggcagaauaaacuuacuuagcuccuggggagaaaccgguugcuucugucuguuuccuagaggagugggcagucugugugagcauuauccaaguucaaagcuuuuucuagggcugauaaguuggcucaguggggaaaggugccagcugccaagucuaauaacuuggacuugauuccugggacccaaaugauaaaaggaaagaacuuagccucucauacuguccucugaucuccaaauguaugccaugaugugcuugcacaugcgcacacaccaguauacaccacacacacacacacacacacacacacacacacacacacacaaaacuuaaaacugcaguuaaacauucuuuuuugguucugcaucuaugaugugaacaugugccuucuggcuuauccugaaguuguagaauuuggucccagauuauuuuaggguugaucaucuguuaaaaucuauuucuuccucuaguacugaagagcuuauuaaaauucaguuugccagaggccauguuagcaagucaaaagcaacuuugauucucaacuuuucugagacuccauauuuuagauuuucuugauagcuguuuacugucuagucgacucauuucgaccuuaaaauguuuaucuuaaaggugcuuggcaugggaggacaugucuguaaaucuaacacucaagaggguugaaacuucaagguuagagcaagaguccuuccuugccuuuuuccuuccugccucccuuuaucuguccuugucucucucccuuccucccuucccuucccuucccuucccuucccuucccuucccuucaguaaguauuacccauguuuuaaaaagaguucucaguagaaggaugccucuuuagacuguaguccuucauccgugaauugagcacauacuuuaugcuugcaaagagaacauaagagagaucacagaucguuguuuaaaguggauuguuauauccuuagaaggaacacgaauacauuuugaaacauuuuccuaaaugagcauguuuacuccuugaggucuacugcacaggauugacacagccccugcacaggguccacacuguugucuaggaugcuguuuuauggcagacuacuaguugucaucucacagacaagguugcugcaguuuugcuuagagccugaagcuuuugagagauguucgucugcauggcucuggggggggggggggauugcuacuuuccagaaaucugcauccugucugcguugguggaaugcaaggcugaccaaucuguuucucacugucuguugagagguuaauuuaacauauugguuuucacaucguuuucucuugacucuguccccugaugcgcagaaugcuuguuucagugcaagcaaggauggggcugcaggagccagcuggacugagugcaggcucggguggugccuuggaggaaagcaggccucauguuuaaaggcugucguggcgauugacgcucacaugugcuguugggcgagaggacgucugggucuuguguuuuaaccuggccaugaguagagacacaggagaagaauuuauaaguacuuauggggucauugcugaacugaaaacauggcaugcauaaguuuuaguuacuagagaacaaacacuaaguuccuaguauauuuaaugcaaguucuugcagauuaguucucuauguaaaaauagccuauaauauauaaacauuuuaaacaccugcauuuucuaauuuggguauuuagaacacagacacagacacacacacacacacacacacacacacacacacacaucacuuuagggcugaugagauagcuuaacaggucaaggcaccugccacugagacagaggacugaguuguauccccgacauccacaugauagaagagggcugucuuucacaaauugucuuuuggccucuguucacaggcuuuagaaugcucauacuccauauauguauggagugggguuuucauauauauaugaaaauuaagaaacuguaauaaaaauuaaaaauaaaaauaacuuaaguugugucucugccuccacuacuuccucuuauuuuacuguauuuuauuuuauuuauucauuuauuuuuuuuuguuuuuguuuuuuuuguuuuuguuuuuuucaagacaggguuucucuguguagcccuggcuguccuggaacucacuuuguagaccaggcugaccucgaacucagaaacccgucugcuucugccucccaggugcugggauuaaaggcaugugccaccaccaccuggcuuguauuuuauuuuauuauagauagagucuugcuauauguucuuggcuggccuggaacucucaauguagaccaggcuggccucaaacucacaagagggaacuaccucuucugcccucugggugcuggaauuaaauaaauggugugccaccauaccuagccucuugcuuuuuaaaaauaagguuuagcuaauuuuuguuucuuuugaaaaauugugaucuuacuuuauguaaguuuaagcgauaucaucuuuaacacacucaccuauauucuuaauuucuauguuaauggucugauaaguuugcaaaagagaugacugcuuggacucauaaauaaaaauuaugggacugcuuucauuuucaaauccauucuuuauugcuuuacagaacuuuagcccugaucaaaccagaugcagugucaaaggccggagaaaucauugagaugauaaacaaaaguggauuuacuauaaccaaacuccgaaugaugacucugacaagguaauuaacacgucucucguuuucagcuauauaaugucauuuaucuuucccaucagccuuuaaauaaacgaaagcaaaaaccaaaugaacaaaaagcccauagaacaaccacaacaaauucuuucacuaauggcaaguauagaacacgauggugacgaaagcaagacaauagcuaaucggcuaaacccaucgcuuucauaacagccauucuugacucaaccucuucuuuguaggaguguacugugugaagguaauagagggugugagcaucuagugcuuucuguuaguucugguugccauagggacgaguuuagagauguuuacucacauuauacccaucuuaauguggcgccaguaugcaugccggguacuucuccagaaagcagugcgauccaaccgaauuagagauuucuuaaaggguuugaugagaagaggacuuacccuaggaaggcuuuucuaucacaaaauaacugugauccaggauaaaggggaaugguggccaacagucacaaggccaagcaaaggacagagaagugugucugccuuccuucagugccagugucugacucaaggaaggacagaaauaaaugaagcgacgcagcacauaucaacauuuggucgaugauagacugguauacggugguagccuuacagcguuccaguggagaugagaauucuuuaucaccuagugagaucauagcuguccugucagacaucguuagcacuguuuaaagaugaugcugguguaaacaacaaauggagcauccaguaguaggaaaguagagcagaggaugcgguaguuaauaacaaauuacuugugccacuauugaccaguccaaucuugcucagguccaguguaggcagccacagcagcugaguucaugaccgcuauggcugugucgagcccagcggaucauuacauuucacagucuuucucccagucuuccaccucuuagacucuuuccacccuugcuucuaugagcaucccugagccuuagaggggaugguauacauuucuaguuuaggacuuagcacucagcauucgggcugagcgcuccuuagggcugagugccuaacugucuccuucucucgguaccuugagcauccucaaucuuugcaucgaucgcuguucccugggaagaggcuuacaugaguaagguucuugagagcagcauuugucuuagguacaaacaguugcauagaagacaguuugacaccugucaauuuagguaaagaacagcaguagguuucccacaauggucuauggccucccuagccauggauaagcucuuaaaaguauuguauacaaaaugauuuuucaagucuaaaagguuuaaaaguuuaaaaggguuuuugcuagugaacacuuaguuuauuugcaauuuuaaaaaauaguugaagggcugaagagauggcuuagcagagaaaagcacugguugcucuuccagaggagcccaguucgguucccaguacccacaaggagguagauaaccaucuguaacucuaggggaucuggcacccuccucuggagacagcagguacugcaugcaugugcuaaagagacgugcaggcuaaacccucuacauuuaaaauacauuaacauuuaaaagauuaguugguguuuauauauaguuguuacauaacauaaaaucuuuucaauccaguaagaaaucugcacaguuaggauuuuggucggggagaagaaagcuuuuauuagaucuuuaagcuuaccaguuuagauuauaguaucuuuuuauugucucuauagauacuuuuaguggaaauguagauuuuaauauguauaauuugugaagcaauuaaaaauacaaauauguagaucuuuuccuugaauauaucuagcuaagaacuaagcaacaacuaguaaguuaaaaacuacagggcuugagaugucgcucaagagaagagucccuccuagcaugggugaggucccagguuuaucccagcaaaugacaaaaauaaaauaaacuggagccuaaauuugaaagcuuaaaauuaauucuaauuuuugaauuagaagcuguccauuuuuuuaugugacuuguuuagauuuuaaguaacaaacacucuuacugaucugauaucuaacauuguauuaacaauagaaugagaugcuaguagaauggaagacaggugaaguguaacauuaauaaaaaaaguaaaaauauccucuuacuuuaauuuuauaucuuuccauauguaggaucauuacuugggauaugcuauuuaguggaaagaacauuaauuaguuuauauauagaucaugugugugugcuuuaaucuuuauuuuaguuuaugaauauaagcuaaaauauuuuuauaaauuuuaacuguuuguauuuuuauuaucuuauaggaaagaagcagcggacuuucauguagaccaucacucaagaccuuuuuauaaguagguacucagcuuggggacuaaaauuauuuucuuuauacuuuuaauagauaagacuuuuuauauccaccacucaauacuugaaccuuuaaucagaaacaaaugggugaccuauuuguuuuaagaaacaucucuuuuauaucucauugaauuaaaagaccaugcuuguaauuauauuuuauguuggcaauuuuguugugcuuuuaaggccuuuauuuuuauaucuaguauggacaaagcaguagucacaaaacuaaauaaggauauguguuuuguuucauuggcaaugacuaaucauauauguuagaaacugaaaucuauucuaagaauuuggauguaauuaaagugaaaugugcauacucacugucauggacaaaggaaugacaaauucuaauaaagacaaugaaauauuagccaaucugcuacaguagacauuuuauuugauaucauacauagaagaauaacuuuuaaaaaagaaauauuuauaacaaaauuauuguauaucauaucuugugaacuaccauauauuauaaaauguuccuaaacuuuguuagcauuaucauauacauuuguuuggcaauuauucuuuguuuuagauucuuuguaugcuuuuauaauacuaaauuacagcucuuaguuuaauauugucuauauaauucauaugcagaaaguuucaaugaauaaauuagcugguucuguggcacugagacuuaacaaaugacuagcuagagaaacuggaagucagucaugaucaguaucuucucaguagcccaccauucccuuaguugucacaugccacauuagagaauucuguguuaauuggauacuagauuagauuguuugagguuggaucuuauuuuauggcuuagauuuugacauguggauaauauugauaauuaaauuccuuccuuccuccuuuccuuccuuccuuccuuccuuccucccuuccucccuuccucccuuccuucuuuccuucuuuccuucguucucuuuucuucuuuuuguuugguuuugguuuuggcugcuaaagccuagcagaaguuugaggaggucuuguccucuuagcacuguggcuguagauacuuccuuuuacaugcuauuucuuggaaaugcucuacuacgugaacugcagagauuagugaagggcucagaagcuuguauuccaugcagcccuaaggcaauaggcaugggaaggcccguacacugccuuccuuucucugagaaggcccuguccucucucugguuugccucuccuuuagaagguaagaggcaggacgucacuuuauuucgaguuaaauuuaucguugcaucgcgugcacaugaagaaauaggaaaagagaaugaagcgucagcuuucauuuccagggaacugggacucagacauaaacuucaauaaaagccgugcgucugguccaccccuuagauaucauuacccaggcagguuuccuccuaacgaaggccuguuuuugaaggccuguugccauucuuuuucuuuaucacacugacuuagaguugucacucucugcauugcaguaguuacacacaacagaauuaacuaaguccuucuugagaauguuacgaaauaccaugcuugucacugcuguuauaacauucucccugacugcugugguaaacuguuaggaaacuaaaauggaaucagcuuuguccuucuuagaguaguggggaauaucagaucagccaugugcauuuuacguuggcauaaucauccaaauucaacaagugucuccuucccuuccaaacagaagugaccuugucauaucuucuguaaugauuuuguagcaaacucagucucuguaaggcacuccccuuuucccagaaacggaucccaagcaggccaguccucgagcuuacugauguccuaacaugucuucguagucuagcaggugucuagauuguaguagagaaguaacucgggcuuuccccugcuucccagcgaacugauccaguuuaucacaagugggccuguuauugccauggagaucuuaagagaugacgcgaucugugaguggaaaagguugcuuggacccgcaaacucugggcuaucacggacagaugcccccggaagcauccgagcccucuuugggacagauggcgugagaaaugcagcucacggcccugauacuuuugcaucugcugccagaguaaguugguuuugagaaauauuuuccuucuguuuuauuugggaauuuuuugugugugucaaaguaaaacguuucuccugcugaggacuuugggagguuuugaacagcuaauguaguagugggaaacaccuggugacgguuuucuaggaucaaauagggauucaaagccaugcccccuuuuaaaauuaguccuguugguugcuguuguugagugcaguuuucucaaaaucugacauuuguugccacccaucuuucuguaaaagauuaaauugcugaggcucauguuugugacuuaauuuagcuaagaauacuaguuuauggaucuauaguagauauuccaaagugagguuucauuugaguagucuguuuguaauccagaugagccggugguguaagcuaaguaggugacuagaccuagaacaugcagcauacaugaagaagcaaggacccgaggucuugggccggcaagguagcucaggcaccuguagcaaagccggaaguucugcuguguuaccugggacccauaugauggaaggagagaaauuuauucccauaaauuguucucuagcucaugcacauacacacugcaauacacauagacauacagacauguaauaaaguuuucaagcaaaaaagcuucuucuuuuuuuuuuucaaaaagaaagaaagaaauguaggucuuaacaaaaaauuaagaauucuucugugagaagcuuggaugugaguauuuguaauagcuuguuuguaauaguucauguuagcaguaucauaggcgcccagcagauggacgaaugaacaagccaccauguagccauccauggaccccgacuuguaaaaaagaaaaaagggaaaagaauguaucacagagggcuggugagauggcucugugguuaagagugcagacugcucuuccaaaggcccugaguucaaaucccagcagccccaugguggcucacaaccauccguaaagaaaucugaugcccucuucuggagugucugaagacagcuacaguguacucacauuaaauaaauaaauaaucuuuuuuuuuuucuuuaaagaauguaucacaggaaggaaaucucagaaugcuuuuguugagugaaagaagcuagaaaaauagcauauauuguaugaaucuauuuauauaaaauuauagaaauuaauuuauagugacaguagguuaauagucaguaauaaucauuaauuuuaaguauucugcugacugacucacucaaauauauacaguauuugaaguaaauucuccuccuccugcuugcuuauguuuuuaaaaauauuuacacauaaaaguagaagggaggccauuaaagaagaggauggagaaggacagagggaaaaguaagaguaaugugggauugguaaggucacagugcauguggacuucuaugaaaauguccccaugaaguuucuuguccucuauaaucaauguauucuaacaaaauauaaaauuuguuaggauagcauauuaauauaucuguuaucuuuagauuuuuuuuaauuguaaauuugaaucaaggucucacuauguaaccauaguugccugggaacuuguucuuucagccaagggcacuuguacuagccucuugccucuucugucuccggaauggcagguuugaucuuucaaguauaaauucagugaaaagaaaauacauccucggaggcagguuuuguucuagguguuuggaagcuaguaagcucugcagguugguucuuucuucgaauuuauaacgugguagaugacaaguccuugaauagucccagcugugagggauacguggugcugaugggggcaucaggaaagcucuguggagaugagcauauucugagaguccuguucucacuggcagaugcuggagcauggaacagaggguuuuguggagaacaccguggaaagaauaaugcuaaaagcuuagggcagcauuuaagucauuagaagaacugaguaaugugaaugucuuugugguucauucagauuaccgacuuguugguauaaugagccaugggcaaagcaaauaaccacugugugagucacgccauaauauauugcucauuuugguguauaauagagcaguuguaaguuaugauuaguuaaggcuccuaagcaucaauguucuuguaaggauauccuuguuuaauuuuauuuuauucguaaugcugaaguggagcuaaguuacucagucuuuguaaauucacauuuagaaagcuugaagcaaagacuuucugucaugaaacuuuuaaguguaauuguguaucuccagaaauagucuacagguuucagguaagagaucaccugugucaaauucuuuuccucaucuuccccaucuuuaggaaauggaauuguuuuuuccuucaaguggaggcugugggccagcgaacacugcuaaauuuaccaauugcaccuguugcaucauuaagccucaugcuaucagugaagguaagugccguguuguagauguuuuauaauggaauagcuuauuuugcuaauguuugucuucuuacuguguuuuacaugauccaagucaaguauacuuuaauauuucagguuuuuuuuuuuccuuugaaggcacaugacucagggcuauauuuaagggaaaucugucuagaugucugucuuuauuuugguaucugugcguuugguaucuguaccuugggcuccugcucacaggcauguucuucuuuucuuuuuuuuuuuuucuuuuuuuucuuuuuuuagauuuauuuauucauuauauguaaguacacuguagcugucuucagacgcuccagaagaugguuguaagccaccaugugguugcugggauuugaacuccggaacuucggaagagcagucgggugcucuuacccacugagccaucucaccagcccuguucuucuugcuauaaacaaaucuugcuucugugcuuugaaucuucugucuuuccaaccacauaacugagguucacucucuucucuuuacuuaaagcacuguguguacggcuggagacguaacucaccaguuaagugucauuauuguuuuugcaaaggaccuggguuugguucccagcacccacauaguggcucacaacuaaccacaacuccaguuccaggggaucugaugcccuccucugaccuugaggggaaaagcauauaaguuuauuacaucuagagcguaucuuuacugagagaguuggagauacugccucuaguccucaguaucugaaacaguucuuugauggacaugaauaucuaucuauguaucuaccuaccuaucucuaucucuaucucuguccacauucauaggcauauguggauaugcacacauauacacugggucaguaaaaguucaccccuugcuuuuaucucuuuuuccaucuauuuguuugagucaauugugugcaucuccaucugauacuccaaguuguuuuggaaauaauacgaauaauuuaaaaaauacuccuuggaaaauggaauauacugaguaacauacacauuagaguggaguuuuuaauguguucuaagcauacauauaguagaaaaacuugaaaauuguaauacauauuuguacaagagacaauaaaaguuuaccuaaaccgggcacagugguacacacuuagaaucuuagcauucagaagucugagacaggacaauggugcguuuuaagccauccugagcuacauagugaguuugaggccagacuggacgauauauuaggaagaucuuguugcaaaaaauaaaagcugcuuucuaucagaauuguuauuguuaauaguuugguauguuucuuucugcauuugugaguguguguguguguaugcauauauaauacauaugagugcaguguagcugagauguguaucuauauucuguuucugucauuuaauuuuugugagcauuucugaccuucuuugaggguucaugaauauuuuaaugauuaauugaauauuucauaacaaucauauguaugauauuuggguuauuucuguuuuuuuuaauuaaaaauaaguuucuccuucuuuugugcucuucuucuguugguuugccuuguccaacuuugaugagauggguuuuguuuuauccuauuacuuuguuauguuuuguuguuauaucuuagaggcccauucuuuucuuucuuuuuaauuaauuuuuauuuauuuacauucuagccauuacccccuguucccccucccccacaguuccucaucccauuccuccuccucccugucuuggagaggaugcacacacacacacacacacacacacacacacacacacacacacacaucagguguucccccucccuuagccucaaguuucuggaggauuaggcaccuuuuuucccacugaggccagauuaggcaguccuuggcuauaugugugcuggggccucgaaccaacccaugugugcugcuugguugguggcucagucucuaggaucucccagggguccagguuuguugagacugcuggucuuccuaugggggucauccuucccuucagcuccuuccucuaauuccucauaggggcccccaacuuuaguccagugguuggguguaaguaucugcaucugucucagucagcugcugguagagccucucagaagacaccaugccagguucuugucuguaaacacaucauagcaucagaaauagugucaggccuugguguucccgcccucaccccacccccuuccaugagauggaucccagguaggaccagucacuggacagccuuuccuucagucucuucuccauuuuuagcccugcaguucuuuuagaugggaacaauucugggucagaaauuuugacaguaguuugguagcccacacuugggacucacucuaucuacuggaaguggacucuuugaguucccucucccagcuguugggcauuuugacugaggucacccuaauugaguccugagauucucucaucucccaggucucuacaggguccguccccccacauccuacccccagaaguuauguauuucuauucauucuccuggcccucugggcuucucuucucuucaccaacccccauaccugauccugguccccuuuuucucucacccuccccucucccacccaggucccucgcucccucugccuucugugauuauuuuuucccccuucuaagugugauugaagcagccucacuugggcuuuccuguuuguuuaacuucuuugggucuuugaguuguauccuggauauucuguauuuuuuggcuaguaucuacuuaucagugaguacauaccaugcauguccuuuugggucuggguuaccucacucaggaugauauuuucuaguuuuauucauuugccuacaaauuucaugaagucauuguguuuaauagcugaguaguauuccauuguguaaauguaccaaaauuucuguauccauucuucuguggggggaaaucuggguuguuuccagcuucuggcuauuauaaauaaggcugcuaugaacauaaugggccauguguccuuguuauacauuggaacaucuuuuggguauaugcccaguagugguauagcugagucuucagguagaauuauuuucaauuuuuugaggaaccuccagauugauuuccagagugguuauaucaguuuacaaucccaccagcaguggaggaguguucucuaccucuacauccuaacuagcaugugcugucacuugaguuuuugaucuuaguuguucugauugguguaggguggacucagggucauuuugauuugcauuucccugaugacuaaggauauuaaacauuucuaauuuauauuuuccucaguacacaugguugguaaauuuucauaggaaaugauagcaauguagauggccaacaaccuuuguggcaauaaugaaauauagucuaaaauuucauaucaaauuuauuacuauauuccugaguucccugcaaacugcugguuaauguuauacuuauuuuucuugcccagaggcauauguauagguauauaugcaaauguauauaugcguacaaacauauauguaauauaacacauauauccccaaggcuguuuuuuuuuccauuuuuuauuagguauuuagcucauuuacauuuccaaugcuauaccaaaagucccccauacccacccacccccacuccccuacccacccacucccccuuuuuggcccuggcauuccccuguacuggggcauauaaaguuugcguguccaaugggccucucuuuccagugauggcugacuaggccaucuuuugauacauaugcagcuagagucaagagcuccgggguacugguuaguucauaauguuguuccaccuauaggguugcagaucccuuuagcuccuugguacuuucucuagcuccuccauugggagcccugugauccauccauuagcugacugugagcauccacuucuguguuugcuaggccccggcauagucucacaagagacagcuacaucuggguccuuucgauaaaaucuugcuaguguaugcaauggugucagcguuuggaugcugauuaugggguggaucccuggauauggcagucucuacaugguccauccuuucaucucagcuccaaacuuugucucuguaacuccuuccauggguguuuuguucccacuucuaaggaggggcauaguguccacacuucagucuucauuuuuccaaggcuguuuuuauguauaucuaugaugugcauacguaugcaaguacauguacauauuuuuuuuuaaccugggagugguagguauguagcuuagucauaguuuuauugcugugaagagauacaugaccaaagcaacucuuacaaaggcaaacauuuaauugaggcuggcuuacaguuucagagguuuagucuauuaucauagcaagaagaauggcaguaugcaggcagacaugguacuggaggagccgagaguucuacagcuugaucugaagauguccaaaaggagacuaugucuucugcaagcagucaggaaaagacuuuuucacaguggguggagcuugagcccuuggaacucucaaaacccaccuacacagugacacacuuccuccaacaaggccacaccuccuaauagugcuacuucccaugggccaagcaauuucaaaccaccacaguauguauguauggauucuauguaaacuccuauuuuuaucgaguuuuacauaugcuauacauguacaaacauaaccuuuugaaugagaggaaacaaauacuuaaauugcuaagcaucagcaucuuaaauguuuuauucaguuaaauauuuaugugauuuaauucugagguccacauaggacuuuccacuugcuaggcaggcacuuugaacuaaauccucaucuccuguuuuaauuuuuuauaaaggaaaaaaugugagguuaaauaaauuaaagcaagauuagaauaaauauuagcuuuagaauaaauauuagcuauguaacuugucacauagauaaauauaaaugauaucuaauaaaaaugcauaaauuaaugaugucaaaaugcucaguuuuauuacacacauauaauauuuuacuuauauacauuuaaauaaucuacuuuucaaguuuaaaaacauuaagauauaaaauuaagaaaaaauuauaaacucuucucaggugccaacaugaacauuuuagaguuuuuaaaaccuuuuuuccuuuaucgcuaagcuugaauuacacagagacuuugugaucauuuugaaauuuaugaucaguccaauucacuguggcaauacugaaauuugaagguugaagucuuaugucaaauucuuguagcccucauuauuuuuuuacaguuaucucuuccuguaauaauccauaugcugcuauauuugauuuuuacccaugguuacucuaggcagagacuuaagguuuaaaggugagucacuaguuagagaaggacugaagaggaauagguaacaugcugacuuccucagaauucccuggguaccugauccccaagcccuggcugcaggagguuuccugccagguaaccuguaaggaagagugcggccuugaugcgguccucauagacugggccugcaggguggccauuggaaaauacugccucggauggguucuucugucucucagagauggagccugcgcagaguucacucugucacacaguggauuggaucacagcucugucuuuuguguauacagucuuugauaaguaaguuguuugcccaguuagagggagcuugugaaagaaacagugccuguuugagugguguauuguugggauaaaugacuggggcaguuccuggugugcaacaaugaagccauuuacugacuugcauccuuaucuuucacgguaagaauuucugggcauaaauagaagucauguguauguaggcagugcuaguucuuaguccuacauuuaaucuauaagguuacaguaauuucuccacuucugagagggcuagggaaaggagaaacuucuguuggguuuuuuuauuuuuuuuguuuuuuauuuuauuuuuuuacauugugaggagaaaaguguguuugagguuuuaugugugugugguuuuuuuuaaaaucuagauugaaauacguuuucaucucagagcucagaacugaaaagaaaguaaaaccaggugaauguuugguuuuggauauuuuauuuuuaauuucaaaaucauguguauauuuucucaguauuuauauguaguuaauuuaauucugucaauaaaaugaauagucauaaaauacagggauguuagaaaaaagucauaacuguauaacauaauuacacagaugaauauaaccuacaaaucauauauaauuucacaguauacauaauugaaagguaucaaaaugaaauuuauguuucauauauaauuuuuauguuuauauaggcuuaaaucauuuuagucaguucucuaaagguuaacuguaaauagagauauagguagauaauuuuauucugaaaucugauuauguuccuugaauacuguucuguuacuauccauauauauuggaucaauuauuucaccuuuuuguauccuguuuauguauuuauaaaaugauaauaaugcuauaccuuuugggugaccagggauuaaacucuuagauuguaugaaaggugcuuaggacaauaccuaacacuugauaagugcuguguguguguuucagacauuguugcuaucguggugaguauuguuuuaccaccaauaccacggcuaauaccaugcaugagcuuuauuuuccaucacaguuaacuuuucccuagugcaagagcaguuuaaagcgcuagcaaaacccaccguccacaugggaacaaaaguaagauuccuaucauugcuuaaggaaaaaggggacuuuaauuuuuuucuuaaagucugugucuaaauuaaauucauaaagugggauuguuucuuaaaaggaacuaauuuagcagcuacuuucuuuuauuuauucuuuaacaguuuguaucauucauaccauguagccugaggguaccauguuuacccuuaacuccccacuuccacuuccccuagauaucucccaaccuaccccuuucccacucccaugcccuccccccuuccuuccuuccuuccuuccuuccuuccuuccuuccuuccuuccuucuuuccuuccugauucuccuucugcccucuuucccucuuucucucccucucucucuuucucccccucccccgcauccacugaauccaguuagugaugccuacuggaauauugacuguccuuguguggaugaccacagcuacaaugaagucauucgagucacagccgugucacagccguguuggguccagaugacagcuuuuaacaauuuuccccaucuuucaucgcauacauucuuuucacccucucuuuuuggggccccuugaccuuuuuucgggagugugaaugggaagguugauacggaugucccaauuaagguuagagacucacaagucacugauucucacugcuuugaccaguuuugaguuugcauacacugcugcucacugaggaugcuucucuggccaagguggagagcagcacaaaccuauggguauaaacaugaacuuagaaggcagauuggcaccguguccauuagcagaacaacaguauugguuccccuuuagggccuaugaccaacuagccauggcuugcugcuuucugguugccuguuauggugcuaggcagaaggagguaacugggcuggaaauacacuuuuacacauggaauggccaaacaauuucacuuuuaaaaauauugagacuucuuaauuaagacuaaagauuucuggggcuggugagauggcucaguaguuaagagcaccaacugcucuuccgaagguccugaguucaaaucccagcaaccacauggugguucacaaccaucuguaacgagagcugacucccucuucuggaguaucugaagacagguagaguguacuuacauauaauaaauaaauaaaucuuuaaaaaaaagacuaaagauuucuuagaacauuuccaaucuuauaacagauucaugcaugagacuguucuauuacauagaucauaauauaguuccuucugaauauugcuucuuuagucaaaccaagguguuuuaagcuuugucucaaccuugaaguugauguagucuaugauuauuuggaguuguaucagaauucauaauaaaaaacccuauagugcagccggguggugguggggcacaccuuuaaucccaguucuugggagacagaggcaccugaguucgaggccagccuggucuacagagugaguuccaggacauccagggcuacacagagaaacccugucucaaaaaaaaaccaaccccccaccccccaaaaaaacccauuagucuguauuuuauguuguuuggguugaggauauuucaaagaaauuuuaguaguuuugaaauaaauguaaguaaacaugguugaguuuucuuuguuuaaccgacuguagagcauuuauuaggacacugacaguuuuaacuuuggugcuagaauuggcucugauggugccugacugacacaggucugguagcaggaacaucuuaucacaucucaaucuggguuuuuuuuuuuuuagagcuucuuuggguguuuuaauauuuacauggagacuaauuuugaugccuuguagaccaagagcccugcaagacacauucugucuagucagccuccuaauuuggggcugauugcauuauuaguuaggcucccagccuuuuaaauuaaauuuccuuccuggcauucagcuucugggaagcuguagaggaggugugaacauucuuuguguagaaagaagcauccuuaacuuuguugaaacaaugacaaaaagauuuggcccaggcugacuuaggucaaauuugcaguucugugcucugugugaguuaaacagauggcguuucuaucaaauguacccacaaguacauuaagcuacaugcaucacaaugcuauacuuuuuauauucucugaauuuuaaaguuuuggaacuuuuuaaauuugauuuuuaaaaauuucauauacaccuaccauauucacagccuuuagauuagcuuaucggccauggcgguuuguaggcuuuagagcuguguagagcuguuuguuaguugcuuucucccuugguagcuuaaguagcaccuuuggauacuuugagaacuaguccucaagaaggaggcuuccaggucgguucuaguucuauuccuccaagugcucugacugaaguaugugguaucuucaauucucgggucuuaccuucaaguucugggaggcagccaugguaauagcuuauauuguuuuugagucucuuggauugugaucaauaauuugaagggagguuuccaaauacuuaauauuggggguuuuguuagagagucuauggcucuuuaggggaggaucaucaucccauuuaaacucugugugugugugugugugugugugugugugugugugugugugugugugugugugugcaaagugccuaugcccaucugucuuccucucuagaacuuucucuccucgucugccccucuggucuuuuuuuacuuuccugguuucugccauuacuccagguuguauagucacaucuaaagauucagagcuaggauucacugaugagaggaauguacaguguuugucuuucuaagccuggaucacaacucgguaaaauaguuuccagcuccauauuucuuucaguuuaauguuuuaccugcaaauuucaugauuuuauuuuucauuauaaucaaauaguauuucauaguguuuauacaccacauuuucauagguuuuuauguuguuuacauuuccuagcuguuauucucuauagugaugaacauggaggagcaaguaucugugggguaagauaccgagugcacugggcacacgcccgcaagugauuccguuggaacaugugguagauuuacgguuuagcuuuuugggaauucuccacacagaucuucaucauggcagcgccuguuuugcaagcccugacauccuugccaacacuuguugucaguuguuuuccugaucuuagccauucugucugggaaaagauaaaaaucucaaaacgguuuuaguuugcauuucuccaauuaaugagaauauugaacacuuuuaaagauguuucuuggcuauuuuuguuuguucuuuugaaagcucucuguucagaucucugagcuuugcuuuucuuuuuucuuuuuuuaauugggucauuuguuuucuuuacucucuuuuagucccugugcauucuggauauuacucugucagauguguagcuggcagaguucucucccaaucugggcuuccucuucgcuugguugauuauuuucuuagcuauacagaaggauuugggguuguguauuuuugucuuuugucuguuucaucagguuccacguaugaguuguuggccuuaacuccuaagcaaaugggaugcuuuucaggaaguccuucccuuccccacaccauucacguaggcacugccuguaucuucuggcacuuucaaaguuuuaaguuucacacugaggucuuugauccacuuggaggugguuucccugcagggugauggguguggguggcuuuccuuccucuaacucauggucaccuggguuuccuagcaacuuuaaaugcacuuagugauuccuuaauuaggaagcaucccaggaacucuucaccuccucucuugccagugaauuauaacuuugagaaaggauaagaguuaauggcuccaggagauuguuguacguuacaauacagaguccuucaggaauagugaacauuaggaccacggcugaagcucaggauggagcagcuugccugugugcacaaagccccacauucaguccucagaugagaguaugcuuucauauucugaccuucuaauccuacuuggauugugaccauaccaucagguauggaaucugagaaucagaaaugauugguacaccccaaaaguagacccauaucgugccacagcucagauuauuuguaccaugaauauucaaaucaagggaucaaaacuauaaauagacaaauaauaauuguuguguaauaauucauaugaaugaugaccuuauaagugacaucuuaacuugguaaaaaauauucaguuuaugacaaauuuuggaaaaauugauacugguaugucuaauauaaagauaaacgaugagcucuucauggaaauuuuaaacuaggccaccuuacuaaaauuuucuaguuaaauuagaauaauaauauuuacauuuaaaauguauuaucguaguuuagccucaguugucaacuggauauaaaccuagacauaaauaggaagaaaggaucccaacggaagaacugucucugaggcccccucugugcucaugucugugggacaguuucuuaauugguguguuucaugagugcccagcccacugugggcagugccaucccuaggcggguggcccugagcuguguaagaaagggagcugagcaagccagggagcaaggcaggaagcauccuuccuccguggucucugcuuugcuccugcuccagcuucccuggaugaugguguguguccuguaagccaaaguaacgcuuuuuccuccucaagaugguuuugguuguggcauauaucacaacaacaaacaaacaaacacugggauauauuaaugucacaaaaaauagagauuuuuuccuauuucaagaauuuccuauuucaagaaauuaucuucauguuuucagugacuccucuauagcuguagguucugcaucuauguauuauaucagcuguaccugaaaauuauuuacauacacagaacugcaucuguacugaacauguggugacuguuuugccauucuuuacacguuacaguauaacaauuacauagguagcauuuccauugaggaugugucauaaauaauguagagaaggccaaguauuccgaaagauguaaguuaucugugacuaccaugccguuuuauaucagcggucugagcaucugcagguucuggcauucacaagguaccccacagucaguucccucgggccacugaggagcagcuguguccuugcuuagacuguuucugucauuccccuugcccuuucuguagguuagucuuuuggucuaccuuuaggcaucccacacaccugcucuucuuccuuuauccugccucuccacccucuuccagcacacccugugcauuuucuucucuuucuccccaaccuuaauguguaauuuccucagaguguggucccagcuggcuuucccucuuguacuccgugcucauuuucauagccuucagcacaguuugcuacucuguagcaugcauguauguaaugucacucaucgaauguacugcaugaugguuguuggcuaaugaccauuccaugucucucccacaaaauagaacuuuuauuaaggggacaguuuuauauuuuuauuauaauugaagacaguaugcuauuuaggaauuucuuuuaguaugcaaauaucauuagagaauacauggucucuagaauaauugggcuuuaaaauuauuaauaucuuuuguuaauuuauuguggaguuaagaaauguuucuacugacuguauguuugaggaaagaacaaaacgugccuaugguaguuuacacacuugguauccagccucuuguuuugggaggcugugggaggugagaugugaggggcagaagaagguuacaggggugagucucuaaccccugauucuggccagaguuucugcuuugguggaugaggaaaacuacaagcucccacaccaauacuagaauaucaucugucauguuccauacucgcuccccaugaaacccaaaugaauccuuccuggaaggaagacucaaaaugaauccuuccuggaaauuuuuucugggcaaauguuuggccagaauacuuauuauuguucugugugauuuucuuuucuuuuaacugcuuuuugugugugugugugugugugugcuugagucaucauuauguaugacuauuguuaauuauuaauuauauaauuguuaauugcuaguuauauagcaucucacuuuauucucauguucuuuguuuuugaacauauggguguucauaucuuuuuuccuauguauucaauauaaaugauuuuggugucuuuaaauuagaucuaguagucuuacaguaugugaauuuaauuuauuaauauuuguugcaauuaaugaucucuuugaauucauuuccucaaaguuuauuuuuccacuuguucuucuuggcuuucugaaagucuugcucucuaccacauacauagacagucuuuguauugcccccuuccccuuuguucaugagccgguucuagagucauagaucaggaauuuaaaaacauuacauggggccugaagagaugguccagcagaaagagccuguacugcguuuccagaguccagcaugcauguugugugguucacaucugccugcagcuccacccagagggaucucacaucucuggcuucugcaagguccugcauucacaugcacuccgcacauaaagauacacacaaauacacauaauuuuuuaggggaaaacaauaaacagcacuuuguccauauugggccgccugccugguuuugugaauacacuguuuuguuggaggucagccauagcuauucaguucugcuuugucuaugacuguuguuagguuauacagcagaagaaacuguaacuauaccaugugauggaaggagcuauaaauauuacuuacuaucugucuuccauagaaccuuccuuucccagaaguuaugacuuuaauuuguuauaccaaauuuuagcauguauacuuaacucuaaguuuuauuuaugaacuuaaacuuauucacuccagaauuugaugaaauagaaauuaggauacuuuuaacagcugcugaaaucucccauuguugugagaauguuaacuuguguauuuuuaauuuuuauuuuuaaaucaacuuuauugauuuaacuuacauaacacaaaaugcauacauucuaaguuuaaaguucugguaauauauuuguugucuugaacuccccaaaucaagaaguucuuagcuuaugaacuugguuuugcucagugcgucccuucuggagacuuucagaggaugugugcaugguuuuagcccauuauucaguugcucaauugauuggaacugcucacagcugaaggacuaagcagauucauucugugcuuaauuaucugccuucacaaucaaccuuccuauuaaagacaaagaaauggaaagucacggugucugcuaucauuugaagucagagguauucuaacaccugacuagagaggaaagugaaaucuguugcuaggcagcagucaaagcaccuagcaacugcaauggauuagacaugaggaaccuuagggucccuucagagccugugaugcauauugcacacagaagaucuguucucaucugaaugagaagaaacuuaggagucuaguaagcagcagggaagagcguugugacauccugccuugguuuguagugucuaauacuuggagucauuguuaccucucagaggcuuggccgugaacucugugaucuuggaaauagucccugaccuccuuaaagcccaacuuuucccaucuguuuaguagaggugauagaaucuacuuccugccuguuuuaaaauaagugacauccuuaguacuguuuguaacugugguaaaauguuagcuacuaauaguaauuauagaggccaucucauauauuuagaaacccaaauauauuuugaaacucacauugguaguauuuuaacuguggauuucucuacaacaaaccacccuccgacuuaguguuuuaaagaugauuaguugaugcucacaaguguguguacaaguguuauuuuuuguacaagugccaguugagaaucccuccgcagcguuccugaaggccuuaagcauguggcuccauucagcccucugggagugaugcagagcuggccauguacagcugucugucacccuccaggcucuccacauggucccucccugacugaagcucaggaugaggcuucugcucucgacccccacacgggauuggggugcacugugcagcugguguggcuucauucaucaugaugcuucacugcucaguuuuucugugucucugagcuguccuaucacccuuucauggauuucugagguucuuucucccuuuuaagguauguggcacuucuucagcgggucagcauuuaguccaccaucuugcuuaauaguuuuauuugaucuaaaauguaaaucuucugacugagucuaaugcuuaaauaagauuccacuuagaauuccucuaguucagagcacucuaaagaaugcuaagguagugagagggaauggcaucagucuauaccaaaaccuccaggacugauuucaggucuaccagagucaucugacccacuuugucccaguuugcucagguugcugccagccuuccuugccacgaacaagccaugcugccacagggaccauagagagagcucuggugaaguaacuggaguaaaaaccucgcucccuauucacacacagaggccaccuaugugugcuaaguaucaagacagagauguagacuuggcaguggcuuagaaaugaagaauuuauaagaggcauuaagggcuuugauccauaggguuuguuuguuuguuuguuuuguuuuguuuuguuuuuuggaguaugaaagaugugcagauguacaggcuagcaggaugcagagcuggcucucggcucacacagaguuacuuccggugacuacuauccuuuagcauuuuguauaaacauuaaggccucccaucguuucccaugucgucugucaaugaggaggcuugucagucaguaagccuguucuuuacauguucugcuccuuucucauaagaaccuguuguaacuacacaucagaauuuacgcacuuucaucuuccacagggcauguaccauuccuucgucuucugauagcagacagugcuuucuuauuuucccauuuuacaaucauuucuuaauaaacuaaauaauaaaaugucauauguggcaggucccuggaucccaccucccuagggccugccccagcuccucgcugggagagggaagggaggaaguaggcugcagaacagagcaccaugugggaaggagggaggucuguguuccucauugugcggcuacacaggcacuggugcucagggcuaggagaagaucggaaaccaggcagugcccagauaaacaugucugcugcaaggucuuugaggucaauuuuccuucagucuugugucaugugcaccuuaggugucaucagcucuaaaaugguugaagauauucccucuacuagaugaucagcccauuaacagacuagccugggaagcuagcgagggagaugggacucuuuuguuggagaccuauguaaccauuggcguuaauccucuucuagaagguucuucguauaccuagaacugaaaugcugaacaacugacuagucaagcacauaugucagauggcuucucagugucugaguggugacccuugaaucuuaaaacacaguaaaaugugagagaagggacuuacuggaguuucuuuuacaaauguuuaccagaacaaaaauaauugaguguccuggggauccagcucagucagcaaagucuuucuguuucugaggaccugagcugggacccccagcacccacauuaaaauacaaaacaacaaccaaaauucagaauggcagagcguucaucucuaaccccaguguugggguaagggacagacaaagacaggaauuccccaaguuugcuggcuagucuuagccaauuugaguuuccagauucaauaagagacccugucucaaaaaaugagaugaaagggcuaaggagauggcuuagugguuaggggcacuugucuuuacagaggcccuggguuugauucccagcauccacaugguggcucacaacugucugcaacucuaguucuaagggauccagugaccucuucugcccuucacaggcaccagguaugcaugugguacacagauguaugcacuugcagucaaaauacugaguaggacaaauucccaggggaaauggcgguauugcccacugugaaguuuucaguuuaguuuuuuuucaaaccgaguguucacagagacagcucagacaccuccaaugcaugucucagcccuacucuagagcuacugaacaagcucagaagauacuaaccuggcugagaaguccaagguuaaggccugugaacaggcauaguccacaagcucaagugcuuguagggcucaucaaaguuggaagagcacugucuaucaguaguggcgucaucguccuaccuccagcuccaggauucuucuucuauguuugcuugguuuguuuguuuuaauugauuugugugugugugugugugugugugaaucuuaucucucugccccuucuuauucacucuucacccuugcaagccccaccccuaaaagauaauagaaacaaaacaacaaugacgacaaaauuaaaguguagaaaacaucucaucaucaaagcuguagcaugucccacaguauuucccucuguccacacaucuucacuuggaaauguucgcugcaaugagucauuggucugguccgaggccucuggcuucugccacaccauugguacuggauccgggacucgucccaguuauccuguuguugcccuccuaugucauggcaagucuucugcuuuggaauugcaggacuggcccucucgugcucuccaacaguucacagaugguguagaauuuagggugggccaacucagaccccuggaucugggccuagaaguauauuagagagcugagcaagcucuccagcacugccccagcuagcccacccaaugcugccgccagcaggguuaaggucagcucuccugcucuccugcucuuugugagggaccacaaaagagcaggagagcaggauaaaaguuucacucugcccagucaagguaccagaaccacucucucaguugaugcacuuguggccccuagugaauuguuucuugauugucuuaggguuuuauugcugugaagagacaccaugaccauggcaacucuuacaaaugaaaacuuuucauuggagcuggcuugcgguacagagguuuagucuuuuaucaucauggcggggaaacaugguggcacagauauagacauggugacagagagguagucaagaguucuacaucuagaucugcagugcagcaggaagagacagugagccacuaggcuggcuucagcuuuugaaaccucaaagcccaccucccagugauacacuuccuccaacaaggucacaccuccaauaaugccccucccuaugagucugugggggccauuuuccuugaaacuaccacauugauauucagagguuuguguaguuccucccauauugacuuuuggacuugacugugacuuucuuuagcacuuaccuuccuaaggcacgcugcagucacaggcuugcugagcacacgugcauuggacuuugucuuugagugcucuaguuagaaaccaguggugugacuaagaagcucugaugaacacuaccuggagucuugcccucaagacaagcuauagcuuucagaagugucaaucuaauucuacgauuugcugacaagccccagaaaugcagaucucaagcugcucauccaaacaaugccauguauaacgaaagucucgccucuagcaccgggagcugacuucauucacugagaaugacucugagccugaggucuguggcuagaccagucucuggagccaagugccuauuguaggcuucacugauggagaggugaagaacucggggaaccuccgggugugagugggggugugugugugcuuguuaucugcaucacaguccuccacgaugauuaaugcccaggaguuugugcagcccucaguccuguggcugcauuccucacauuaugauacuugggagcaacccccugccucacagucaccucaggggcuacaaauugguagacucagaaggguggggcagucaguccaacccugggacugaaaagcuaacugugaccagcagaggccgcugcuaagcaacuagcaaagugaaggccuuuggggaugucagacagucaccagcacaguucagcacagagcagcagaaagcacaggaagacacugugcacuccuuucuggucuuuccguuguacuuuuaggaacauuuuacuuaauuuuacuauuuuaauauuuacuauauuuuauaccgucuucuauccaucuuuuuuagucaucuccauaaucuccaugcccuugucuaauuuuguuuuuucuuuauugagcaaucuucuaucagccuuuuuuuuuuuuuuuugucuccuuaucuaccuuuaguaguuuuuugacuguaucuuuccgauuuuguuauuguuuuuguuuuuuugagucaggguuucucuguguaguccuggcuguucuggaacucacucuguagaccaggcuagcuucgaacucagaaaucugccugccucugccucacaagugcugggauuaaaggcgugugccaccacugcccggcucuuuccaauuuuuaaaaaggcuuguauauguuuuugguuuauucccuucuuauacuuaucuguuaguuaugcauuuucccaugaaaucuuuuuguuuuccucugcuccagucucuugccuuuugcucuugccuucuuuacauucuucuccauuccuuuucuuuagcuugucuuuucuucuuguucuuucccgucuucauuuaccuuauguaucaauaaaaaauaacaaugaguaggugguaaagcauacaggagugagccuuccacagccaagcagucaccuccgaaggggggaggcuaacuguuggagaccuguaacaagagcuccggcuugggaugucgcugguaguuagcuccaaaacuauuuauuaaacuucacauggaugccauacccuguaccauagguuuauuuuuauuaacaacucauauauggaaauuaaguaaagcauaaaauguauggugcacacacacacaaguaugcuugugaauggguugaacauuuuagaagaacaugggagaaaugaacacagcaaugaaugccuuuauuaagaacugaaauucuaaaguaggggaaaauuuacuuucaugauauacaacuuuauuuucauuuuauguguuucaucauuuucaaauuaaagaauaaagaguaggagaaauuaagacaaaacuaauugcacauuuaugauuucccuugguuggguagguugaguuguggacauagaaaggcugugacuuuuuugugguucuuuuuugugacucucaagaaucugaggucacaggccugcaccaaucuaucccauaagaccuugcuuuucuguuaaguuuccaggucacgcucacacuacugaaagcuggcaccauacuuugaggagccucagcaucaaagcugucucauuaucagcaugcuggggacuagggggaaaguggucuguaccagugaacauaauacacacugcacaggagagggcaagaauuuaauuuuagaacacacugcacaggcgagggcaagaauuauuugauuuauagccaaggaugugucuauuuugaagccuguuguauacguggcaauguagucuuccugaagcuaugccagagccauucgaaccagcagaagaagcaauguucuugaaauauugugucuagauuugcaggucuccuuagcugugacuuuggguagcuaaaauagacaaaacuguguaguccuuuaaaaaguauaagcaaagccagauagccuugagaagcuucuaaaauguguuucuugaaaaggugacaaacaacagaacuaauuuuagaucagggaaaauauuuauuuuguccauauauggacaaauguuuacauggcuuagaguuagcuuuucagucuuuuugugguguuuggcucuaaaagaaacaaauuucuaccgguguuuuuuucacauauguagcauccuugugauugcacgccaucuuuaacugggaguugcucuucuuccagucccaaaggaguucaccucucagaugaggaggaaccuccccugcagggagcugggggucccuguggugcagagccugcuuuguagguuucugguuuucccuggucucguacauuguuuucuauucuucuuaaucuuuucagucuuaagccuguuaucuuauugcaaccaggcuaggcuagcuauuccuuauguccuuugcuauguuaaaccuauucugucuucacgguaaggauucguguuugauugcucuucccugggaguccuagcugcugucugccuguucuguccaugcuuuguugguauggagucuacccuuacuguuuucuacgcccacaguuacaguuggaucgguuuuaaugagugggcacuacauucuggguagaucuguaaagcucuuauugguuccuccuuccauugccuugcagugaguucugaguaauccuuauuagacaguugguaagggaaaugcucauuuuagaucuagauaugugcuguaaguggagggucacuaaugauauugguuaaaucaggucuguuuuguaaaccuacuugcuuaacaacuaaguugaauuuuaugguuggguaauggaucaauaugaggcccuaagugccuuucuuaguucuuaauuuaauaguuaaacugaaccuaaacuauuguauguuacuaaauuaaugcaauuauacuaaauuuuuaaauuauuuuuggaauaguagcauaaaccagaacaagccagcuguauuuuagauccuaaguguucucucacuacucauauguuaaugacauacuucauggugaccuuggaaggugagaccugguaagggguuuuagaucaucaagggugugucccugagguggacaagaggacagagcccuucuuuucucuugcuuccugaccauguagugaaugcuuugcucugccuggcaugucugcugugcuagguagucuaaucacagaccuaaaagcaacauaucauggaaugaaacaugccaaacugagagccaaaacaauuuuuuuucaguugacuuuuuagcuaucuguugagugguaagggcagcuggccgagauagaaccacaccaaucuguggacuucugaaacauuucccagugaaaguucccauugacguagaauugcuucauaauuucucuauagagaagacaaauauuuccacacaguuuuauacacaggguuauuuguuauguauguuugcuuggauuagcauuaaauuucuucuguugaauauagcaauucuugugauuucuuuugugcuuuauugcaaguaaaucuuaagugcucauaaucugcaccuuugguuuauguguuuuuaaaaacacacuauuauuuuuuaguuaucaugucuuuuauuuuacuagauauaaauuuuaaaggcaauaaaaugucucuaaugugguuuaaauuaauauuaguauuuagcauauuaucuacauauccauuuuguuaguuuaaauacucuuggcuguaucaagauuaaauguuccuuaacaaauccuaaaugaauaaaauauaaauauuuuuguagagauuuuuuacuauuuucccaucucuuauaguuucuuuuauaaagauucuauguguaucuuugucuugaugaccuaaucacucucacaggguaugucuucuaauccucuacuugauuauagccaaaaauuaacaauguaugcgccuccauuugcuaauacaucccuuuagcuuagggucucaacauagaacauucaguccaugggacuacuaugaguauugucugaggggguaugugacuaguacauacaacaugugugagaggagaaccgccggguccauguagcggucucaguguacacgugagaaguggcuacaaaggccauuuucccucaugucccugccuggcugcugcugagcuggcugaggucagcuccccucuguuggauugcuuuugccuaagguguggggcuguguguccagugcuuuuauuguuccacugacgugcaugaaugcagcugcucugcccacacucaccaucuugaugacaguuuugaguagaaugagucuucccacuugacacaaugucauucuaugucccagauuggccuugaacuucuccugaagucccaggcugccuuggccuugcaguuccucuucucacacuucggucucacagaugcugggauuuaagugugcaccaccaugccuggcuccacuucauuccuuccugaagcuguuuuagcuguucucauuuuuguuguauuuccauguaguucuagaaugguuguaucuuuauuuguauaaaauucuacuaagauuuugguagagauugugccaacuuaaagagaauuuuauaacuuguuaauguacaucucaaauccuaccacuuuguugaaaccaguuauuacuucugugacuuaguuguagauuaacauuucuaauauggaaaucuugguuagauuuuuuuuuccuuucugauccaaaugccucucacuuuuuucuugcuucaguacauugucuuaaccucugacaacacaucaagaugaaggaguuuucuacccuucuucuuuuucugaauuuauauucuuaaggguauugcacauuuuuaaaaaauuauuuucugcaucauugauaugaccauguguucuuuuucauagcuuacuagcauuacgacauuaauugacuuuuaauuagugaauaaggcuugugucccugaaauaguuccuacuuguuacguaauuauucucauauguugaugaauuuuuuagccuuucuuuccccagaugggguuucuuuguguaacagagaccuggcacagaugugaacaaauucagagacccacagccagacacacacacacacacauacacagagagacagacagaccuuggagggcucaacucuaaaugggacuccuccaucaaauuccuccccucauagcucaaggaaccuugaggaaaagaaagcaagaagacuauaagagccagagggagggaggaaaccaagagaacacggcccucugaaucaacugaacaagguguguaugaacucacagagacugaagcagcaaggagugagucuauaagggccugcaccagauccucugcacauacaugucauagcuuucauuguagcauuuucaugggaccccugaguguggggacgagugggucgcugaucucugcgccugcucuugggacucuuuuccuccuguggcauugccuuguccagccuugaugagaugguguuugucuuguauuuuaucauguuugguugucucuaguagccuggccuugucuaaugagagacagaaaaggaguaggucuggggcagagaggagguggggagggacugggaggaguagagggagggaaaacuauggucaauauaguguaugagaaaauauuuucaauaaaaaauuuuuaaaaauauucauggauguuuuaauggcaguuugaugccauguugguaaaucccuccacuaugucccuaucaccucuucagccaagaaaguguguuaccacccuccccaguuuugccguauugcauuaguguguacuuguggucugcuagguugggauuuuaguuuauuagggcucucaucuugguaagacuacugaugccuuuucuuucacaggcuucauaacauccgccauuuuggaagcuagccagcagaaguuuccagcucgguuucaguguuauuucuuuguaucuuacaaccaauauuuguaucuucagcaaaagggucuuauuaucuaguucuguuggguauccaagaggaauggcaaguauuuauaucauuucagggggccucugggacuucccuagucagcaguccauaaggacauaccuggcacugaaauuuuuguuuaauaaaaacuauggcuucuaggaacagcucaugguucaaauccugcaaguccccuggaguucccacuuaaugaaccuuaaacacuaugucagagccccaccauaccugaauuguacuacuguaaggagcuggguugccuuaucuuacaacccuuuaacuaccuuagaccgaguaacccaauguaaguuuucaccuuccaauuuaauuccugccaaaauguuuacuguuccuuuuauguugauuccaauugguuuuaacuugcccauuuuuaccaugugaucuuauuuccuuuauuugaagcaagcccauuuguauuuaaaugauucaaucuacuacuugugaaaguauuugaccuugaagguagcagaggauuuuguucucguuuuaugggcuccccuuguuaucauuucacuacuuuauucggagagaugcucucuucuaacugcucuuccgcucauuggcugcacagacuuuaagggguggggcauccucugcccuccguacucagccagcaucagaauggcacagguuuauucuuggcuuccggcuucagcacauccagcucgggauccagcaccuuuccuuccuacguaagcagguagcaugaggagggccccccugaugcaaggcaagaaacccaacuuggguucccugucucaguuuuguaagacuacaagaaaaggggcugugcugaguuuagagaaggcucuaauuagcgacuuaguaacuauguuaccucugcuuggucuuugcucucuugacucucagcuucacccuucuagauacauuuuccaguggagaaaggagagcugccaacuguaggugguucacuagcagaaggguguuuuucuccaguucuagcccuaaaacaaucccagggaagcacucuguagcuuaagccaauuaugguuccuaacuaaauuacuguggcuugggaauuaaaaagcuguggcugcuuuugcuaagaucugagcuuuauuggguucuauaggaacuugcuaguaaaauggcuaggaaaucccuuuaaaaggagaguggguauagucacaggaaagagcaagguuaaauaaaaaauaucugcuauuguaugcguuaugagaaagacaucugaaaagaagcuuuuaaacaaaccaggugagaaacgcgaugcguggagaugacagugagacauuuaagaggugacauucauggagcuguaagcaagcuguuuuaaaaugcagccucuguacaagcacuagccaguuaagacacucagcuuuguuugacccauuuguccuuugcuuccugggaccccauuuuguuugauuuuauugcugcaugcaugugcuucauuuacacaguugcugccauuuguucagucaucuggacauuuucugucgaggauggaggagaggacacgugguuacugacucuuuguguucuaagcuguuaaacacaaaacugccuucuuaaacgcuccugugaccuaucaccacacauaagcaagugcucauaaaaaggcgguguccauggaucuugagcagacuggauagcagacaugggagcagugacuccauaugaccuaaacuagggaggaauuuucagauaggaaucagaccugagugugacuguccuugacagcagugauuaccguaaccgggaccauagcacccuacgugcuugucuguaaguagaauugugguucaaacgauccgucccacuugaaaacauagcuuaauaggauucuagauggauaguacagauuuauaauagauacagacuuuagauuucuguuuauauuggcuagugcaauacugccucacacuuccaucaaaauacaguguuacaauguguaaacuuugugugacaugacauuccuuuguuagguuuacuugugccuuuaaguguguugacauuugcacaaggcaggagccuggugaacauuguagugcuuuggaauagaucaagugaaaugccaagucauacuaguguguauuguacguuaaacugucaugcucuuguguggagaaaagggauagauagaacggaguacugugggucaucugaacacuuaugagaagaaaugggaaggacacaggaacaacuuuuguuccagaagugucuagggaaacucacaccuauacagcuauucaaacugcgagcucugcugaggucaacuacaugcauuuuuuugucauucaauaacacuuucaugccggaguaaucuuuuugcacacuguagaugugucucuguccuuccuugccugccuaagggcacuuucugaauuguuuaaaauaaaaagccuauggccuuuggcuaaggagagcaggaagucaggacuuccaggcagagagaggaacucugggaaggagugagguguggaggauucccugcugagauauggaagucagaugucugaguagagauaaucagccaguggcagaaccucgauuaguauaaucgagauaagcugguugggaacaagcuggcuuaaggucuaggcauuaauuuauaaauuaauaagcccccaugucuggaacugaguugggcaaagaaaaggcuaauguuuccauuuuuacuugacaaacuguugcuuuuauaccuaauuuugaaaagacuuuucuuuacaauuaaguaagcauguaauguuuauuuguuaaauuaucauguguaugcauguuuuaccuguauguaugucuguacaccauaugugcgccugcugcccucagaggccagaauugggcuuuggauacccuggaacuggugguacagaugggugugaaccgccacguaggugcuaggagcugagccuggguccucaggaagaaccgccacguaggugcuaggaacugagccuggguccucaggaauggcagccagugcucuuagccacagagccaccucuccagaccccaagguuaaguauggaaauccuguuacagagaacagcuagcaauagcuauugcuacagguaaaacccaggugaagacuguaaacgaaaacugaaaucucagagaacagccuccaccuccuugagcuauuuagcuucccaaacauauaaugugcugauacugggagugucuucaguuugugagcugcggcagaacaaaauguguuagcauuugaaagaccuccaugaugcagcaaaccgaugccucccggaugaucacugcgugguacaaaccgugcauggacaaagaauaugguagaccagugcguuuaauauuguggcaaaaaucaaagacuugccgaauuauacucugcagugacuuuuuaagaaacucccacuugucguguaaaggauauggaccuucgucuugcauugcuauuaaaguacgccaccuuuguccaacuaaaugugcuuagccaaaauaucauagauugaaagcuaaaguguauauaagcugcccuccguuaacuuugacguucaagagacuuuaaaaauauauaaagcagugucucuuaucacuaguaaauacucacuuuuccucaaaaauauuacuuucuguuaacagacaaagcauuuguuauauuuaaauuaauaacuauuuuuaaauuucuguuuuaauuuauaauaaauucuguuagauagaaucuauguaaauaacaguucuuuagaaucuuaaaaauuucuaagaauuaaaggguccauaauggcaaacaguuugaaaacugcaaugagcacugccuuuuuuucuuuaaaucugcaaacuucagagaaacucacauucucacucugugguugacaucaucaggccuuuacuuguguguacuuugagaaauaaguucaccucugguuugcuuucaaccuccaucccaugucaauuaaaauagcacuauuggauuguaauuccgauaguaaguaaaaaugcacacuaaggcaucauuuuugcuugguaacuggacuuucuaaguacuuauccugacgguuuagaauauugugugugugugugugugugugugugugugugugugugugugugugugugugugcaaguguguguaaguauugugguaaaucuccauccccaaauaagccccagcaaugaaaacaugacucaauuaauaugaauccaugcugugcgucuagauugggcagaucucccgcuacucuaccgucuuccucagcuuaugagaccccuuagaacuugcgguuucuccaggccaugugcuucugcucugcuuuucuucuuccuccucugcacccucucccucuuccauuuuuuccuucucuccucaccuucguuccaccuucccuuuuuaucugcccaaucaugagcucuacuuuauuuuacaaauuaaggugggaagcagguuuacaggaaaucaccugagugcugacucauuccuuguucgcagccccucacaggagaauggauuuaacaucaaauauaauuagccccauggcuauccacaacauguaagagacagaaagagggagauaggguuguaguuuacuugaaaaauccaaauuaucuucuagguaacuuagagugauugcagccacaacacagagcagcuaaggaugucucuucugagucugcauaagaaugggccccucagcagagaggauagagcggaagcucggggacccuccccccagugguagagucagagugucagguggguagguaaucauuguuuucagcugugucucuacccucccaggcucgcagagucuguucuaaucuaaaggucacacagauggcccugguugaauggggccacaacucaaaaccagaguugugauucugggcaagggacuggugggaguggcaguggugauagggaugggagggagaaaagagaggguaggcaggagagaguaaccagaacacaucauauaaggcauaaauugucaaguaacaaaguuaaucaauaagaaauguugauauuauaaaauuuuuauauuaaacaaaacuaucucaaaauuauugccauacucuuaagagucaauagaaccuuccccuuuaaaaaaaaaaaaaacaaaaaaaaacaaaaaaaaaaaaacacccauuugugaaggaauuuguucccgaacuccucauauugauauccgggacuaugcugguuaguuuuugucaacuugaugcaaauggugagcuaucugggaagagggacucgaaguugaggaccugccuccauacucucagccuauagacaagucuguguggcaaguucuugauuguugguugauguaagagggcccagcucacugugggcagugccaccucugggcaggugauccuggguuguguuagaaagcaggugacccagggaauaguggcagggaccuuuauuuaaucucagcacugaggaagggaagcagaggcaggcagaucucuaugagcugaggccaaucuggucuucauagcaaguucuaagccaacgaaagcuacauagccugucucaaaaagccaagagaagaagaagaggagaagggagagaaggaaggaaggaaggaaggaaggaaggaaggaaggaagggaggacaguaggaaggaagaaagcuaaacaagccauggaaagcaagccaaugaucaggcuuccuccauggucuguuuuacuuccugcuucaggccccugccuugaguuuuguaccuugacuucccuucaugauggagguuguaagcugagguaaacccuuuuugccccaagcuucuuuugguugugguguaugucuuaguuauugauaaauugcugugaagagacaccaugacuaaagcaacuuaagaacgaaagcauuuaguuagggaguugaugacaguuucaaaggguuaguccauuuccauuauugaggaaagguggugacagacaggcagacaugguacuguagugaguaguagcugaaagcuuaccucugauccucaagccaggggcagagagagacuggaccuagugugggcuuuugaacccucagagucugugcuaaaugacacaccuccuccuacaaggcuacacaccuccuucuacaaggccacacaccucuuaauucuuccuaaacaguccaccaacaaagaaccaaacauucacauuuacuugccucugaaggccauucuuauccaaaccaccacagugucuaucacaguggggaaagaaucaaacuagcuccacagaccuucaacuggggugucaucucucuuccuucuugguggucuucuucuuuucugaauugcucauacauuucucuuuagccugucauuuuucuucaggauuuaagagugauauauauuuuaauucccccuugaagucucugccuaccuuuucuaucauuuuauguuuuccucugaaauccagcaucuuguuacuucauuuggugauguuauuuuaaaguuguuugauuuucauguaauuuaccgcgguagauucauggggcuguaaaggcaaauacugccuuaaaugcuuuaaaaugcuuuccacacuguucucaggaccaucucugaugcuccugaagccugcggggcaucagaugaugaagggugugcucagcucagggguuuacuggcaucuucugcagagaugcugcauuuuccucauuuggaguagaaacaacgaucacugcuguugaaaacuuguauugcuuagaaaccuaaaauaguucaaauauuuuauauuuugaaccaauuuguucuucauuuguaggaauguugggaaagauuuuaauagcuauucgggaugcaugcuuuggaaugucagcgauacagaugguaagagccuugcaaugagccauguuguaugggagaauugcuuuuuaauaacccuuaaaauguguguaagugaauguuaacugugcacuugagauuugggcuuauuaaaauuaaagagaugcacauuccguaaccuggcuggaugugguggcacaggccuuuaaucacagcacucugggaaggagagguagguaugcauuugaggccagccugauguacgggguguguuccagaccagccaaaaccaccaccaacaacaaaacaaacugaaauuacagcaacaacaaacugaacucaauagcuuuauaaugaaacaaaaauauuuaaauuauuuaauccauauaauggcuacugacacacuaauauucagaugauaaaccagaguuaagcuucaaaguuucuucacuucuugggauuugggcugaaaaguaugaagcgaagacuguuuuagucuuaacaaugacagucaaagugaggugcaucaguggucuguguucuaaguuucuuagcaaauagugaaggaagaauuugaguucugauucccuugccacucucagcccgggccuggugucuaaacuguuucucgaguguuaguguacauaaucagcccauggcuuccccauacuggcuuagaguugccuucucagacauucucagagaguccuuaaccgaagucaugacacauacuucugucacuggccucacuggugcauuugcaagggcauucugguaucccugugaaugcaauuguaggucuuuagagucagcgaugcuaucaucaaaggucagcaguugccuaagcaggugacaauagucaggcauccuuagccucaguuuuucaucuaggccauugagaauguuacuugccacuguggguuuuauuaaguuauauuuuaugucacauuuugauguacuagaauaaaggucuuuaauaauauauucuucuaaaaaagaauacauuauccaggaaucacauuuugaaguuaaaagaaugagagagguauaguagcaacuaacuuuaauuccagcccuggcaagucugagguagaacagccacaaguucaagggcagccugggcuuuuuagugucuaggagagcagugugaggaaaagacaccacauagcaaaaaguagaacuguguguaugggaaugguaaaugccgagugcuaagggaucucacaugauuggcuuaccauuuuguuuuguuuuuacuguaguucaauuuggaucgggcuaauguugaagaauucuaugaagucuauaaagguguagugucugaguauaauguaaguaugaagauaaauuaaauaaugaaaugcaauauguauauuccaaauauugggaaucuuauaauguauaguuauucaaaguauuuuaaaggaugauuuauaaaccauagaucugauaaaggauuaauagcacaaacaacauagucaaagaagaaaagacaaaaaaaacaaucuaaaacuacauuucuuaaaagaacaagugcgauuggccaacagaugagugaaagaugcuagacaugggcugaagagauggcucagugguuaagagggcuuguguugugucagagggcccaaguccagcucuuggaacccuuggguauuuacucuuuuaaagcuuuuacuagccuguguacagaugagaaugaugaauauuagaagguuguuaugagaauuaauugaaacaaaucauguaaaguagucucuucauugagagugcuggguaaauauuagcugcuauugcuuuuguuuuuuauuacuguuuaguucaauaauucuuugauagaugauuuuuguugauaauuuauacuuacacucaaacuuacuucaaauuuauugucuuaaaaaucauaauuugaucugauccuguuauuaugaaaucagcacauacugacugaacgucuacuguagacuuuacaguuuugugauaaaaggcacaugauuuacauugauagaagugaaguucuaaugaggauaggaauuaguucaaccauuccauguaugacuuaggucagcaaaagacuuaaaaaauaaucaaccaaguuuuuagaaaguuuucuccuuaacuaaugucuuaguuaggguuuuacugcugugaacagacaccaugacuaaggcaagucuuauaaaggacaacauuuaagggcugguuuacagguucagagguucaguccauuaucaucaaggcaggaacauagcaguguccaggcagacauggugcaggaggaacuaagaguucuacaucuucaucugaaggcugcuagcagaauacuggcucucaggcagcuaggaugagggucuuacagcccacacccacagugauauaucuacucacaggaccauaccuucuaauagugccacucauuuagaagguauuaggagcaagcauguacaaaccaucacaacuaaaauugggagaaccaaaacauuuugagucgauauuuaaagaaacacauuguguguucagugccguucuuagcucccugucuguucuuccauccucuuugcucauuuagaguagucuguauaucugcuguucuaaauguugucugcugccaacaguaacauaaagugagaugcacagacaaaguagaaaaggaagagugaagaaagacauaauuuauuucucuccuuuucaaaaaauauguuugauaucucuucugacugagaacuuggcauuguauguauagguaguacuuuaauagcaugaaauagaauaucaaauucaacagaacuaugaauaaaaauugcaaagucacuuugggguaaauuuagggauucuaaugaguaggguuauauauaucacauuccuuaauaaagcacuuucuucugucauuuccaucaggucaaaugacaguguuuggguuaauauuuaaaugugcccuauaauaaguuguuuuaguuuggucuuguguguuauaaacucacugaagucaggauaagggcuggcacggccuggcacuaccccuugcccaccugguguucuuccucaaaguuguauuuguuucaucuugccuacagugcuuuucaguguugacaggagagggcaaaggugcacugagugguccagacacugagaagcgcucuugucugguccuguucuucauuauuccacuucacauugagugaauaucauaacaacuuuucccaugauucuuggcguuauuuugucauguauuuuauuucuuugaaugaucuuuuuucuguuuuuuaauauauuucuaucuauuucuuuggaaucacacaugugcaugcaaugcauuuugauuauauuuccccauccuuuccuuaacccuuuccagauuucaucaccaccacaagcucccacccccucccaauuugguuuccaaaacucaaaacgaacaaacaagcaagcaaauaaaacaucccugcucugaacauauaguagcucauuccuucaaucccagcacccagcagcagaggccaggagaucugcauaguaagugucaggccagcacaggccacauagugaggcuuugacucauacauuaaauaaauaacuaaacaaacaaguaaauaaccagcugaauccaguuggugcugccuguguacuaaugagugggaggccauucgcucuaaugcaguuggcacaccuggggccuuccucucaaagaaaacuaaugcuuuucuuuggauaauugucuuuuuucuguuuugaauauauuuauauuuaauuuuuuggaauuucacacaugcaugcaguauauuuugauuauauucucccaucuauugcucuuaacccuuucuggaugccccaccuucacacccuacucucucuccuagaagcuauguaaggucuguaaccccaucaucuagacaugaggacuuaugagccauugaauaauuaucuuuaaaacaguuacaagagaaagaagugcuuucugucuacugcuguuuugugcagguuuauauuuuuaugugcccuuccccuugagaacauuuucuuguuuauuuuugagaauuucauacauauguacaauguguuuugacuacaucuuacagacagggauuuggguucuggcuucccccagcucuuuuuucucuuucugugucuguguuuguuuguuuguuuguuacggugugguuuggucccaggacugacaggcaggccuuguugaugcagcugcuacaugacuugcucaccugucuuuaacuuuuacgguuuccugcugguugcgcuguucugcuugauccuguucuccccucucauuuuccuuccuacuccucuguuggauuucgacguuuauggguagaaacgugguguacuuuuuaucagcuauuuccuaaaauacuuuguccacuuuucuuccaagacaccauguuacacggugugacaccggaccacgaggccuuugcuuuucuucgcuguagguuuccuugcuggugcugaagcaguuccaagugccagccucaggucauuuaccugcagggcugugcccugcucacccauccaaagcacuaauuagucacaugucuuugguuucauuucuagauuugagucuucuguuauucauuuuuuuuccucagaauguccauaguucuccuauaauuugagcaugcaggcucaucuaugauagcuguauuagcaaucguguguucauuacauugcuccugucugcuggauacuugucuccuuacugacguugcuucugcuaguggcuugcauucuccucuugcucaggccugguaaugacugacccugcaugaugugcucugccauggauugugcccuuaagagagcugggcugucaguuaaguaacuuugcuucagcuugacucuggggaggcuugcguucaagcuugacucuggggaggcuugcguucaagcuuuguaaggugagcaggugcuaccucacccuauagggcugacuuaggacagccaugggguagagcccuucugaggccugcaccugaaguagagccuggcaguuguauuagggcuuuaccugauacgagcccaugugcuguauguguguaugagggcuuuaccugagguuggagcucauguauucuguggggguuuuccaagcucuggaugacagaagccauggacuccucuuggccaucucgaagcuguggagccuccggcuaauuuaccuucacuggcgaauacauagcuaugcacuuauccaccacagaaaaugaaaacucgaccacagaguuagaacuaggaaacaaucagcuuagaucucgcguccaucgccuguguucaguccuuccucaugcucuaaugauuacccucugcacgugcugcuguguccgccuguacauuugcuugcauguauauguuuuggcuagguucugcaagugggaaagaccauguauuuuucuuuccgauaccaugugaccucaccuacuaguguacauucuuauuucaucuguuaucuugcgaauuuuaugauuacauuuuucuuugcugaauaauauccaugugugugagugcgugugugcgugcgugcguguguguguguguguguguguguguguauacaccaguguuuuauuaaccacgcauucaccacucacuuauuucuaccuccuugcucaaguggauacagcagcaguaaacauggguguagaaaaagcuccguggcaggguuuggaguuguucuguauucugcccugaugauccuaucugcugggcuccauuaacugagcuugccucugcagugcuguggaaaugucaggcucuacuguaugcuucuaccugcccugugucuggcucgccugucugcggcuguuuuaugcagcaagagaaaagaauuaucuggccuacuacacggucccccuaggcugccaccauccaauccgugaaaacuagcucaucuauuuuuuuucuuacuuucuagauguuaguucuuguugcuaaccauguaauagauuuuuaaagguccuacaggagaaacacggcuauuuauacuuuggaaauauuaauuugauaaaacuacccugauggaaagggggaagucugaaaggaaaaugugugagaaauggcugaugugacuggaagaggcaaagcauuaccuugaaaugcuaguguccuaggagcggaggggagggaugagaggaaauauuuggaggcaaagguggcugucguuuagaaagagcuugugugcaggacucagaugggaaagaggucaaaggugaccgacuauuggggacuggagauaguggggaagcagcacaguuaaagguauggggguaaaacauucaguuauuuuaauuauuuuguuucucuugaauacugaaggauauggugacagagcugugcuccggcccuugcguagcaauagagauccaacagagcaacccuacaaagacauuucgagaauucugcggaccugcugauccuguaaguuauuaaacuauuggucuauuuuguguuaugaaguaacuauuuuaacaaguuuaauuuuuuaauuuuucagucuuguaacuuacauaaaagugaauaugcaagaaaacugcucaaagcagugcuuuacaaaagaauaauucucauuugucuaacaacaguagagaaugcucugaguaucuuuuaccauggcagaggacuauguguuuucuucuuuccauuugcuaacuuauuuuuuaaacuuggaaauaaaaguuuucuaagguguuccuucaaauagaaagaauauaaagguaaauaugaagauugugaauaugguggcuuuauucuagaugcuuaagaaauuaugagcgguuaaacuugucuacaugggguagaucagugaugacgaguacauacagagcuucuagaacaaccggacguacaggggaaaguaugaauaaagaccaaacaaaccuugguaguugaggcaaacucacauguugaagaaucauuugguaagagagaaucuaauacagggacaauguaaaccuuguuagaggaagagagacuugaaggacaaacuggggagcagggaagauggaagaauaucaaaagcugcauuauagggacagggagagcagugaaggguggagagcgcucugugcuaugcgagcagaagaugguuuccuuagccucaguuacaugcauuuuuggaagcaugagaaaauaaguauuuuuccuaaguagaggaaauaagaaaauguaauucuuauauauuuaggaaagaagaauucuuuauauguaacucaguuuuaaaaauuaucacagaauuguuucuuugguacaacuggagcacauuacuuugaaagagguuaaagaaagggauucuagcaguaaaagggagcagaccugggagcagcagguaaggcagcaaggccgccucuguguaguuuagggaaaggauagaaaggacacagugauacacagcacacagaaccggcagagaguggugcugaugcuguggauuuacccaaugucaaucaugagaggcuaagaaaggauaccuuagaccugaggacagaaucauuuuguuaauuuuaguuucagcuuccuguuuaauagccaaauggggcuuuuguuaauuuuuuugagaaaauuaaaaucggaaugaucaguugaccaaauagggaaaauuagagaaauaaaaauaacaaaaaggggcuggagagauggcucagcgguuaagagugccugacugcucuucuggagguccugaguucaaaucccagcacccacaugguggcucacaaccaucuguaaugagaucugacaccuucuucugguaugucugaagacagcuacaguguacuuacauauaauaauaaauaaauaaauguaaaaaaaauaacaaaaaggaaacaaguuaagcuuuaucacuguuuccuucucucaccuagucaguaagugguuauugaacuauugaacuugugcugacacuuagggauauagcgacacaaccuucaaccaggcaacaagguacaugcagagucugaaugcauggcgcuagaaggcucacuugagcucguaaguucgaggucaaccucggugaaaaagagcagaagcuucaaaggcuuuucagaguaucacuuaaccaucaugaguacuugauuuucaggcauuguggccgucccacugauaaauauuuacaaguaaaacaaaaacacagaauuuuagcguagauaucucagucuaaggaugcaaggcagcuuaccaaagaguauguggcaugugaggagaaguaggugauaaagguggcagaugauuaaagucauggcugcacagaaaagcaucacuuuauagcaagagagcuuucuaucacuuuagagcaagcucuagcaucacuuuguagcagacacuagcaucacuuuagagcaaguacuagcaucacuuuagagcaagcacuagcaucacuuuagagcaaguacuagcaucacuuuagagcaagcacuagcaucacuuuagagaaagcucuagcaucacuuuagagcaagcacuagcaucacuucauagcaagcucuuuucuucuuucgauggucaagaacaggcaguuaaggacagaggaugagcucacugagggagagcuggggaauggacacacagguaucugugggcaugagaguacuaaaagggaaaacacgcggauucuuuuccuuuacagacaguuauucagugagcauuucuugggugaacagcacgucgugcaagcugucagguucugcggcaggggcauccugaagaugacuaagcucaguuccuguccuugcaggagcucaguuucauggcuuaguuuggaugcuugcagguucucggaucuugccuccagaagguguaccugggauugcuccacuguggguuuugauguuguguuuuucauuuuuguuguuuacacacugcuauuagaucuuaauaaguacauguauuacacuguaucacaaaaugcgauuagaauauuugaaaauaguccuacguaucuguacauuuaaaugcauggccuugggaaaaggucacgaugagauugagaauucuagagaacaggagaucuacagagagccaauaauaauuccuggaauuagaaagcauuaucucagcccauggaaguauuacacguuguuccuucccuagcaguuauuuccccuucacucuggcccaguucucuuaguuaucccuuagcaauacaucaacaaguccuucuuguccagccucuuaacuucugcucaaacucucaaauuuauauuauacgaauuauauuaauuaauugugugaauggauuucuucauuuguggggcccucacauacaugcaaugcuucucuagagaccagagauacagcagucaacagacaaagcaaucaccuugcacacagaaguuacagccuacccaagggaacagaccaugaacagaccuuaaagaguaaaauccacuguguguccuuugguggcaaaugcuguggggaaauaauguagggaugagaaacagaguuaccaggagaggaagggugggaaagguggcaagguuauagagucgucagaggugggagaaagucacugggcuuccagauagaaggcacugggagcgccaaagcucgaguauucuuggugugugaggagacuccaggaggccacauugguaagagugaaacuggggaagagaaacugaggaaacaaugaaggacucuugccuuuacucagugagaggggagccacaggagagguuaccagagcaccagcuuagccucacauguuuuucaugggcaauuucuggcuucuuuggggucaagagcaggaggaagggugcauaaugcaugcuugcuuuauaauagggcucagaaaccaagcaaccuagcaaaugcuucuuguuuuuucaccaguaaaaugaaaaacuaaaacuaugugaugcuuaaacuagcuaaugugguuaugcuuguuagaacagugucuagcauacuguaaggauugcuagcuaauuuuccuuacugcuuuguuuuuguuuuuguuuuuugaguucuuaaggaaugugucauaagggaccacacagcagauagaaggcaggaugagaaggcuugagagugacuuucuuucuaagucuucauuuuaugagaguggucaaguuaggacaugcugaaugcugucuuaagagugagccccucauuucuucagaggagccuguguuagcgaugcugaagucaaguuaggugagaugaggaggaggccauugacacugcaccagugaggcuguggaggaggagaagggcgggaugaguggggcaggugcugcaaugggauuuauugccucuuaaguaaacugcacuguugaggagcagaagaaagcauacguuguaccaaaauaaugauuaguaugacacuaguaauaucugugucuuagcucuguucuauugcugugaaaagacaccgagagagaccauggcuguucucauaaaguauuuaauuggggaguuucucguacuuucagagguuuaguccauugucaccaugauucggagcaugguggcagguggcugugaugcuggagaaguagcugagagcuacauccugauccaaagccacccccagugacacuuccuccaacaaggccacaccucuuaauuguacuauucccugaugacuaagcaaucaaauauaugagccaaugggggcuguucuuagugaaagcaccacaguguuucuguggcuucuauuuggaucuuauagaacaaucucauggggaucagaaaguucauggggaacuguuuuuaguauacgaucuucauccuuuuuauuuuguguccuuuaagaaggaaaagaaauuuccaguggaauuuuaucaucuauaaagagaacaaacuggcucaaggaacuccuuacauuuaggagcuucaacuggcauaaauucaaauuugaauagagccaugucagauauuuauuaaaaucacacagcuaagacauugauagauguuucauguauuauuagaaggaaaacagaugcucauaggcaaugggaagacaaaugggagucaggucagugcuuccagggaggcacagagaccuggcuuuuguuuguuuguuuguuuuuguuuguuuguuuguuaaaggagugguucuguuucuuuggaauaaaugccaguguuucuaaguaggcaaauucuacagaauggaguuuccauaaggcaaaaugaggaucuacccuuuccagcucaagggauaauaucaccugagcauaaagguaguaaacuuagaaaauuuaguuggaaacaguuggugcaccauuguaauagguaauaagguuacugagauuuuaauaaaugauacuuuuaauucuuuuuaguuuauaaaucaguuaaagaaagagauaccugauuuagucccaacaaugauagcgacacaggugcuagcauccaccuaugguacuguuguuaccuugcuuuaccuacaaggagacugggcguaaauaaaucugcagauucucugcagucaggcaccucugccagacuauccuuuagguuagaaaugagcacgucauuauacugaagguucuuaauucucaagagagcuacauccugagcccuaacgucuccauguuucccaccuuucuggcagauagcuugcauacagaccugugugugaucaccagcagagaagcaaagccacuuuaaacaucacgggcugagcagucuuuaagaugugcucacuugcugccucucgcuggccuccaccaugguauaaacugggagagagcauauaacuuucccccugaagcugacacugcaaguauuaaugugaacaggcauggugcacaugcuuauacucuccauggcuggggaggaggagaaggaagcaucagagcucagggccagccuccacuacacagugaacucaacacagcccgagcuccaugaaacccuguuucuaaaaacuagggcuugguggguuaauuacugagauagccuggcgauuuucuaaacuugcuccuuccuaaaccucuuucuuaauuauuguuuuauuucuucgaccauaugccaaguacuauuuagauaccaagcauuccuagcccauaggaugcacuggugcuagagagaguggcagaaaugcacuaucuggcagugucuucgcuucacugauaugacagauaaccaacagguaaaauaaguaccguggaaugggagugguacgggagaggaaaagacaccugucuaaagauggacaggaaaugugcucuuuaagagucuuucuccuaucaguucaaaagcaacaauuguguuuuuaaaucacaguuucuaaauccugugggcagagagaagucaggaguagcaggaaaaaauagacugguugggaaagcacccacagggcaggcacaguuagcucucuuagcaguagcuaugcaccauccucacaucauccaagcagauacauacauaguccauuccaccauuugugcuuagcaggauuaguguuugaaugugccaacucagagagaccuagcucagcuccuaccuccauggacagucuaagugacauuugguugaguuuucucuguaauaggcaucagcaucugaacacugugcaagggucacucucuggucacucaccuucauuuccuucacuucuguuucaccguguauauaguggggaaggaaagaaaguuuuaucuuuucuuucucugguauuuucaggacaucugguauuaaacaaauacucaauauauauuuuagaaagaaugaauguuaguuuaagcagcucuuuguaucucuucaagaaauauuaauugauaaugcuguuuucuuuaagaucuuucgaggcugagaaguagcucugggauagaacccuugccuagcaugagagaggccccaagcucaccucuuuuucucucuccugguaaaaauacuauuguauccuuugcccuaaaagacuuuagacuaaccauauuccagucagaugcgucccucugacagucagaagguggaacuuaagcuugccuggagcagugcacccugggacagaggcgcagcaccagcuggggcugcuagcguuuuggaaucccaggaggcuggugcacauaugccagcuuuaucucccuaacaugacaugcuguuugcaguuucaaaugucagcucccaggggcacugcuuaggacaauagacugugcauugagauggaaggaaaauauguuuaaaucuuucugagacccugggaaaugaccaauguuagauacaaaagacccugucacuuuacaagucuacccaaagguaaaaaaaaacaaaacaaaaaaaacuagucacaccagcaccaggccuacguucugacucaguuacgaucaguguaaauaauccugagcuaugcugucucaggaagugucagugagacaguccuaacccuugaaaggccaaagagaaggauguuaagaacccuccaaugcagccagaagauguaugugacccuuuuaaucuugaguguugguuuuuguucguuaauaccagcuaguaaacaaaaaucauuauuuccauguaguuaauuauaagcauaauuuuuggaagcacuuaauucaaauauaaugaaaauauucacuuacaugugauuuaggaacugguuauucauauuaugaaagaaguuuguaguuuucauaaaaguacuuaaaaagauaucuuacauuuuuaaauaaaacucauuucacauuaaaaaauggacaguaaauguaaaugacugacugaguuguuauauacuguuuuucccugauuuaccccacugaccaguggaaauggacuuaucuuuuagauaaauguuggaucagaugagguuguguuuaaagaauuccuacuucagauuuuucuagacugagacuuaaaagcaagagccuuugcacccgaguuaucucauguucuuccaacuuuugcuucuguucagggcagugugguucuaaggacaaagaguuuucccaauaaacccuagaacccacaaauaaggucucacuucaaagucgagaguuaugcauccgccgucucccuuagcugcaaguuugcuuucagcaguuuguuuuucauaguccgccauagcccaaaacaguacauggaaaauucuagaaauauuuaguacauuuauauuauucuuauuaauaauguuuuacuguguucgcuugguaaaaucaacuuuauacaaaguuugucuguaugagaaacauaauauccaagcuucgugcaucugcuggaguccugaacauaucuuuuggagauggaggaucaguagaugcuuacgugcauccuaugaaaccuuuuguccuaucaaguaggcaguaagaguucagcaagcaaugaguguccaggagcaagaaagacgugcuccucauucagaaggaagagcggcguuuccuuuucugcccauguagaguauacauuauagaugcuccuaggagauuaugcuuacugaagaccucccugcccgucuuaaagcaugcaugggacugcauucauuuucugcuugcuuugagaagaguaucuggcuugcuuuccuccuagaaagugugagugccaugugcuguuuggagugagccacuuuggccuccgugguuuuuguauuacuuuuuccccugguuuccagaucuccccuugagucagauuccuggcaagugaaaucagacagcaaaaaucaagggagauaucucuguccugauagagacagagagaagcauauuuacccauguuaucauucuuugucuucuuuuuuuuuucuuuuccauuuuuuuauuagguauuuagcucauuuacauuuccaaugcuauaccaaaagucccccauagccacccacccccacuccccuaccuacccacucccccuuuuuggcccuggcguuccccuguacuggggcauauaaaguuugcguguccaaugggccucucuuuccagugauggccgacuaggccaucuuuugauacauaugcagcuagagucaagagcuccgggguacugguuaguucauaaugcauucuuggucuucuguuuagaaauaaacacuuauuuuggcucaagaaaacaaaaauuaauuaccauucuuguuuuucuccuuuucagaaauaaacacuguaauuuggcuuuaaacuaguauauuuauaaaauaagauuaaaaccauccaguaacuaauauuguauaauagcuacuuaauuaaguuuuacacuaacaguauuaaauaugcuucugcaggccuggggaaguggcccuauuaggaaagugcuuuugaccugagcucagucccuagaacuccguaagaagaguaagguuugccgggcgugguggcacacgccuuuaaucccagcacucgggaggcaaaggcagguggauuucugaguucgaggccagccuggucugcaaagugaguuccaggaccugucucaaaaaaccaaaaaaaaaaaaaaaaaaagaagaguaagauucaguggcaugcucuuguaauuccagggacagggcgguggagacagguacccaucuuugauugggcagcaugaccuccuucaucagcuccugggcuagcgagaaacccuucacaaaaaaaguaguaguuguaauggcucuugaagauuaacacccaagcauauucucuagccuccaugugcaugcacacacauguuuacauacacaugcgcccuugggcgcgcagguacacacauucauacacauucacauguuuguaacacauacaaaaauauauaacauuguuauuaaacucuaaaagccaggugugcugguguaggccuuuaaccaagcacucaggagacagaggaaggcagaucucugaguucaaggccagacuugucuauagagagaguuccaggauagccagggcuacacagagaaacccugucucgaaaaacaaaacaaagcaagaggcuguguggguguucagcauagggcuuagcucagcaucucacuauugcuaauuuccuuauucaucuguguagccauggagacugagcuuccgucugagcuuuggaacauguucuuauuacugcuuugaaucuauuucugggggugaagaugcugaaaucgacauaaaacaccccauuuaagaugcauuuuauuuugcucuuucuaaaacugugacaguguuaggagggagaguggcuuaaacuauuucaugcuuuccuuugccuuuucucuguguaacaagauggaugcccacucccaguggacauuaauauacaaaagagugacuugguauucagaguccucauuaaccuggggcgaugggaagcaggggagccgcagugugcagcauuugcucuuaugcagugcacagcucuguccucuucuugucacaucuaacacauuaggcucugcagagccugcaugaagcagcucacacaggaauuucuauuaagaaugaaugucuguucaccaaacagaaguuuaucgucuaaguuuuugccccuacacagggaguuuuguuugcuaaacauauuguuuucugugcucugcacucugagucaaaccaaccaaaaaggauauaaggaaaggaagcuagcuaaccagcagucuauucacacaagugcugggaauaauucauuuugagaauuuauugaauuguuguaugucaaaucgcuuucuuaauuacacuggaaagcagaauccaauauagaaacaguuauauguuuaaaugguuacauuguacugaguuaaaaauaggaauuucuauagcauagcuuaccaaucacccaaaaacaaaugaggacaaagucuggagaagacaucagggggaaggaagccuccuucccuguugcuggggguguaaagcgagacagccccuguggaaagcagugugguaccaccgaaagcaugcagguugaucucccucauggcccagcccuacggcuccuugcaggugaucagagaacucuauggccuauggaaguacccgcacguucauguuuaccaugguucucuccauaguagcaaggaaggagucagcccccaugcccgucagcagaugaauagauuaugaaaaccugcagacaugauauggaauuccauucagccauaaacagaaaugaaacuauggaauuuccagggaaaagagauagaauuggaaacaggauuaccuaggcccagagaagccaggaaaccagaaaggacucaugagaacugcaagaauacaauuggaauagaacugugggcuuuagcauguugagauagccugugcuaucuagucugagugucuggacaacagugaaucaaagagaagcugaguugcugaguggcugagaaggaagugggagacgaugauaggguugaucuaggacaggacaugugucagcuagcaggauggguugccuggauugggcuugcccaggauuccauccaaguacuauugaguggcaguuuggaagucgcuuuuccuaugguuuucuaagauaaaucaguuauauugaaauucaaaaguuggccuuuauuuuuagaaugacugcuuuguuccaauuguauaaaagaaaaaaugaauuuuuaauaggcccugggugaugcuugguggagaaaaagagaucagauaaucuaguagagaaugaggggauagaauggguuauuuuaccuuuuuaaucuagucacaaauuacaguuccauugggaagaggauaacauugccuuuagaauguaaccccugaggaaagguucuuuugugaugguggagggaaacuguuaaggaagacacuaagaaaaccaguuuucugauggcagcgacuuguaucagagcuauccaauuaacaugcugugguuuauuaaauguucucauuaaaggaauaauuaacacguucuaaacacgauugccugucucccccucucuacucccucaguaucugucucugucugucucucugucucugucuccugucucucucucugucucucucucugucucucucucucucuuucucguguguguguguguguguguguguguguguguguguguguguguguguguguuacuaggugcuaauuccaggcucuuacacaugguaggcaagugccuaccacuaaucuuuuccagccuuccuuuugcuuucuuaguuuggagcugaguuucccuaaguuaucuagacuggucuugaacucacccuguaacccuaggcagccuucgagguucugaucccuggggccagagagacaacucagaggcuaagagcacuggcuggccuucagcagaccugacuauaauuccuagcacccacguggugguugacaaccaucugcaacuccaucucuacauccucuucuggucuccaugggcaccgggcaugcacaugauacauaaacauacaugcaggcaaaacauccauacauagaauaaaaugguaauacauuguuuuuagauuaagauuauccugccccagcuacucaacuagguagaaucacaaacuacauccacagucccagcacgaugguuccacuuuagaaaauauguaaccaaggaaacaaacacaauugugcagcugugaggaacaguuuauccccgugugagccucuugccucauggucaugugccucagggucauacggaagaaugugaauuagcuagacauuagguggcauagguuuguaaucccagcugcuggaguggcugagguaaggggauuccacauuugaaaaaugucugggcaguugagugaaacaaugucucaacgugaauaaaacagugagauugagcucagugauaaaguguuuucuuagcaagugugaauucuuggauuugauacccagcaagaaauaggaagugggggaagaggagaaaggaaaauugacagagggagagaagggugggcaaagaaagaauaugcauuaaugcaauuuagcagaguguauuuuuuaaguguaguaaugcacugaacgaugacuuacuguaacauaaucugauguuuauagugcucaaguaugugccugcaccagaagacaccuuaguucuugagaauucaaaucugucuuaauaucacagcuggaaaaucacuuagaugcauuuaaaaucuaaugcuagucugauugauuguccccaucucacaguggugccacauggaauuuuauaucaaugacauuauaugaagucagagacccugagcaugucuccuucaaagauauggaacuacuguucaggguucucagugccuucgcagcccugugugcccugguuugcaaacuucagaagaacaaaaucaucaaugcccaaauagggaaguugaucugagcuaucugcuacucaaguguaaggacccaaguucagauccccaggccccaugcaaaaccagucaugauagcaugaaucuggaaucucaguguugcuguggugagauggggggcagagauaggcaaggccccagaaguucugggauaguuaggcuaauguacauuguggcaaacagugugacuccaucucagacaagguauaaggcaacaguugacaucugagguucuccuuugacuguggcacacagaugccucuacaggcauacaaacgcauauaucauacacauauauaugaagaugaaaaaauagaucaaucagauggugguuacuuauauagcaaaugaauuuucuucugaauuccuugagacaaacacuucuggagaauaagcaagaagggguuaccauugauuaacuaaguggcuguguuucuccacacugucacccuuaaugcauauaaauuuggacauuacugguccuuugauucauccacucacucucaugcuaagucauuaauacugauacuccaggcaucuuucaugagcuuucaguguguuggcuauguacagaucagucucuugucauuaaguuuguguggauuacaagaaugaacauauguguaaacaaaggagauaaaaguuaaugauagagauuaaaaaaaaaaaaagccugcuaggagaccacugaagucuacguauagcgugagaauaaacuguagcacugcgucugggaaggggacgugggaaggaaggcugugccgaaggaaguagucuguauguugugacaggcugggugugggcucaaggaggaaagaggcaauuggggaugacuucaaagcuuuuugcuuaggcuucuugguugaacucugguucuguucaugaggagagggaaauuaggaggaaaaaggcuaggagaggagauaguaagcuuacauuugaacagauaagaguauaaauuuccaauggaauaaccgagagauguuguugaguaacguuaggggcuaaagugucaucugaagagacauggacagcacugaaugggauggaauggagagggcagaagaugagaaggaagaagauaaaauagaagauaaggugacgggggaaaaaaaaacaagacuaaauugugaguggcaagaguagucugaggagaugggaucauacaugugggauguguaaaggggagcuucaggaaugugggagugacccugagggcucaguaucaaaagggcugaagaggugucugugacaguguaaagaugcuggcgcccuagccaaagcagcguagguggcauuguggguaauagacagggugagaugagacaaguuuucacucuugugucucucuccugugucagugaagacugaagggagcagcuuacugugggagcaauugguucuuuacaugggcauaguuuaucagcugggugaccaguggcauucucugaaaggcacacagcuuuccguucucuucuuuguucucaguuuugugcuagucaucauacuguguagugauuuuuuuuuccugcuguagacuuagagggcauucaucaggaugaggcuuuuuccucccacugcaggauuaccuaagcagcgaugagaaauaaccaagcaccuaagaacuugggcaccagauuguccaggggcaugagcaugccagggacgugguuguuugaaaggcuguugacuuuaagugcaaauaaacauuacuuuuuaaggggucuacuuuucucugcauagccugucauguauaaauacugaaguuccuucuaaagaauuguuuauuguguuacaugaaaucauuggugcuuaguguggccuuguugugucuagaaguuauuucugcucauuaagaagggcuagcaagggcugaagagagggcucagcgguuaagagcauugacugcucuuccugagguccugaguucaauucccagcaaccacauggugacucacaaccaucuguaaugggaucugaugcccucuucugguguaucugaagaaagcaaugguauacucacuauauauaaaauaaauaaauaaauaaauaaauaaauaaauaaauaaaucuuuuaaaagaaagaaagaaaggcaggcucgcacacaaugcuuuucaccauagaauguaaguagaagaaaggacaggaaucuguuaggaauaauuagggaaaaucugcuggaauauggaaggggcucaugaugaggaaagauuacucuuggcauuucaccuuauguuguguguuggccauauguggaacaugcauuuagggcacuucaguuuagcaagaccuuuuuuacaugauccaaaaugaaaaccuaaacucuugcaguggaggcugcucccuguguagcauggcaugcugcuugaucuaaugaauaggaguauuucaaggaugcagagacuagcaugaggagugcauuaacuacucacaucgucccucgauguuacuaucaggugucagcgacugugcacaguuauauuccuacccuugucuaugacuggcagaguguuuauuuacacuggcagcaccacaaucagguguauagcguauuaugccacauuaugacugucacaaugccaugagaugauaggaaaauacagcuccaucauggccaaugagaccacauucaguacauaggcuugcauugauucaguguguccuuauaaugacacacggcuguaauuaaauaaaugaaaacuuccaaagcagccuugauuugcugugaaugcuacucagcaucgugcaccauagucaugucaggcaccauccugguuuccauacucacagacaugguuauccaguuacuuagccaugcgcccuguucuauuuccauuguaccuggacuuuagccaccguucuaccucuagacuggugauugccaaucucuguccucacaucugcagauuuucacaugauguaagaacaaccaugcugguggucucagcugcccagugcacuucuuucucuguacccacaggccugccuuuccaucaccuugccuuccuccaccacucagggcuacacuuccuuacuuacgauuuuuacccaaauguucuuauucccuuguaguacucuugcaucuaucugagcucagcaaauccagggcuauuugugaccauuuuucuccuugaagaugugcuaaugcuaagcugauuuaaaguuuuuaaaacuaaaaucaauaccacaaaacugguuugauuuaaacaaaguuaagauauuuacuauccuuauaaaauauguuuucacaguaaucuuauauuacauaugccuaguaaucaacuaauaaaaagaaauguaauuauuguucaucuccuaauauaaugcuuuauacacugggcuacagagaaagcuuuucuaugugucuuagucaccguuuuauugcugugaagagacauugugaccaagacaacucucauaaagaaagcauuuaauugggggcuuguuuacaguuuccuaggguuagucuauuaucaucaugacaagcagcauggugucacggggaccauggcagcaggcaccugugauacuggcaaaauaggggagagcuaccuccugauccacaggcaaggugggcaggaggacuaggccuggaguggccuuuugaaaccucaaagcccaucccaaguggcacacuucauccaacaaggccacacaauuucuaauccuucuaauccuuucaaacagaucaacuucauggugacaaagcauucaaauauaugaguucauaggggccauucuuauaccaaucaccacacuagggcagacaagauggcucagcagguaaagaggcuugcucccaagacuaaugaccugaguucaaucaucagagagaacugccucacacagauuguccucugacacagucucucucucuuugucucucuuugugugucucugucuuucucugucucugucucucucucucucuuuuucucucucucucugugucugucucucucucugucugucucucuaucugucucucucucucacacacacacauacacacacacacacacacacacacacagacaauaauacagcaggaaaaaaauuggaggugaggguggugagacaggguuucucucuguagcuuugacuaaucuggaacucgcucuguaaaccaagaccaagaaguucucgaacucagagauccaccugccucugccuccuaagugcuaggauuaaaggcguagccaccaucauccaaccuacuaacauuguuuuaauauuuaaaaaauuuauacuaguaaauauaaauuuuucaguggucaaauguuucauauauuuaugguauuuccaagaaaaguugucacccucaauauauaacuuggauuuuauaaaauaauguuuuauguagcuaauguuuuuuucuuauuaaugcauaugacuaaucuaaacuauauauguguauuucauaggaaaucgcccggcauuuacgaccugagacccucagggcaauuuuugguaaaacuaagguucaaaaugcuguucauugcacggaucugccggaggaugggcuccuggagguaagcagaagcaggcagcgaguccugccuguauaucaggcucaucagcaggcuccauaguucuuguacaucucaaaccauuugauagucugggauuauggguggcuuuugaccaugcaauaacuucauacuaauauacucaguaaucaaauauaaucaagcgugucccuauggucccagguacuccagacgguaagacaaaagaauuucuuucuuaaaguaauaaauguuacuaauuguuugagaauuuccugcaguguauuuucaucacaucacaccccaucccagcucuccccagacccaguccucaacugccuaccuacccaacuauauaccuuuuuuaaggaagaaaaauagaguccaguuugugcugcccuaaaccuccuagguguugggcccuguguuggagcaugguuguucuauuaggagucacaccauuaaagaaagccaacucuucuuuucccaaaagcuaucaguugccaauaucuccuuagcuaggaacaggacucaugacuucccuucaaggaaagauuuuuuuuuacuugaguuuguacaagucuuagcacgauuguuuuuauguguaccugcugucuucucucuagaaaagaauguucuaguguagucagccccugccucugggucuuacagucuuucuaccccucuccugcaaguagcccuuagccuugagaggaagggauauaauauagagauccuauuuagaguugagcauccuguugucucugauucuuugcacauugaccaauugugagucucugguuaaccaccauguauuauuuaccccaagaagaagauucucugauaagaguagagagauguugaucaauaacuaaaggcucuugucauugcucuuaguuagccuuucagaaccugaccauaugauacuacaaagaccauggagaaaucaagccaguacugccauggacguuccaucccuccuggcuggcuggcuuccacagugauuggcggugcuaugugcacugccaguaaaaaguaaucaacagucuuacccagauuugaccccugcagcuacaauaacuacuggacuggcaagaaaacccauugaagcgauaguggcaggaacaccaugcaguaaccaaucacucuguaguaugauuuauggcccauccuucaagguggaacccauacuggcacuguuauuagaccagaagaaucccuuaguccccagaguucccaggcagccucaggaauaaacugagaacagcaaaaguccaccuuuuaccauucuguauacauagaaagcuagucgucaaguaauuaauacuuuuuauuggcauagauuauaguuuaaaggguuuaauaagcaagaggcuacagaauugguucgauauauagaauguuguuuuaaauuagcuuacugcaauuauuaaauuugagucauaaaaauauuccaaugagacuuaagagguacaaugugcaauacuauagcaccauuugcuuacacuuaguaucugagcaagaacagacaaugcuguccccaaagcugcugauggacugugguaguguaguuagcauauucaggaagaucugaauucuauacuccagagcaauggaucagucacaccgucuccucauuuaaugcaccuugcauuguggacugggggaggggaggggaggguaagcgggggagacuggcccaguggguaagagugccuguguaaguguaagacuugaguugggguucuuagcuucaaugugaaaagacauguguggccacauguuccugucacaccagugcuggguagaaaggaagguggagcagaauuguugaggauugugucaauccuaacaaaaaucacaguauuuucuguguucagugagaaacccuguguuaaaggaacagaacagagagacuuaugggaaggacacaaaacauucuccucuggccuccaugggugugcagagguaugcacaagugcacacacauguauauauaccucgcucccucucccuuucccuuucuaccccccccccacauacacacacacacacacacacacacacuguauuaagaauauaccagaaaauaaguuacaaggaucuuacuccauagucucuacugguaauuauauaaauugugcuauauaauggaaaaauaugcacuuucccuuuguuuuccaucuccaaauauucuauaguguuguuaguuauaucaguuuuugguugccaacugggauuuaagaagcauuuaaacauugugugcaucaacagcugaugaaagccagucugaaacucagacaagucugugaguacauucuuguccuagcgacucaagaacuagcugaagguaaauauaaguguagggugccuguucugauuggacagcucuguauuuacaggccauagcuaguacagggcugcccacguccugacccucgugauuuacccuuuguuuaguuucugucuuggaggaagcggaguugugauucuuacuaguauaaugucaaagagggaacacaauguacaaagacaagagcaaacagcuuucucuuaggaucuaaaaauagucuagcaaggcugacgcuuugaccaggaagugggaggugacacgugaaaaguuauaagagucacugggggcauuguaaagucaugugaagacaucugaaccauccagaguuauuagugacccaagguucuaugcagggcagcauggucaugucuguguuagggcauucuggaugguauagagagcaggucaugggcuaucuguggagaaagaacagauguaacucuguguguguguguguguguguguguguguguguguguguguguauaguuguuuaggcauagaggucuauuggggaaggguaauucaagaaaauguuugguagucugaaugaauguggccauuaggauauucagaaacaaagauuuucaaaagacauuuaggaaggucagagugacaacaugaggagcacacugaaucugaaagaugagcguggggaaccaaccaccauaauacaugucccugcgugcagacagugggacaggguugccagccucaucuguacuacugaaacuacuggugucucucuuacucggcauaaguaagaguuugaauuuuauucaaaaacaaaaauaaucauaacaccugcuuucuucauacaguuucuguaaacauugauccuauaauccuggagcaguuguuguagugccuagugccauaaagagaacuggagguccauagucuuucaguuucucaguacaaccugcuuauuuuaacuuaguucuccucccauugugacuaggaacaagaugcauggcuuaaggacgacgguuaaugugacugaucacucuguauauagauauacagacacuuauaaaaaucaguagagacacuagcaauuuuuucuugaaaaacaaauuaauuaguaacuauggcaagucuauaaccaaaccauagggcuagaaaagaccuuaaaaggucaaguuaagagucuucacacauugucucugcuccuuuuguuuccaaagcacugcuuccuaaaguaagcugcagugugggaccuccuggaggcugucuuaaccagcccagcgugcuccuccuccgucucuggcuggcugcaucugccaagccugagcgccugcccuucuagguugugcuuugacacuguugccgugaaucaggacaccacacuuggacagccaccuguccuaagacagagacacugccaacucucauuguucuguucccucauuuaauguccuuauguuugggacuucucaaacauggaugguugcaaaacagaccagugaagacacugggggaagaucacgucccaccagcaucauuaucaauaugauuuaaaauggcauucugugacugacagucucuaaugguaaaauaaugaaucaccuuuucaguugacugacuugagcuuuacccgaagcucacuuuuauggcugugguacauuuagucgucugcugcauggacagcaggaacaggagcucuguccuguacugauagucaaaaaacagucguaaaagucacuccauguuuucugcuuguugugaucacuuggcucgggcaacuccauguaagugaggaagccacccccgccuccuccccaggugacagugucaccuagccuggcacugcucaccucuaggagcccugguuuucccugggaaguggugaaaagcugcccuggguggccaccauuugugggauggcagugagcagccguggaguuccacgucacugcagacucucugcacugccagcuuuauucaggacugauguagaaggcacauaucauguuucaucggucaagaaggaauagaaauguuuuaagauuccucaagucacaggaauauaauucuggauuuuauacaugcuaaaaaaaacuguacaaauuaaaauagaauacacaacuaaacuccuuuccaaaugugggaaaaucaggucuuucauucucgugucuagaauaaaugagcucaaacguaucauacacucuauauucagcuaugaucaaaugacaaauaaagauccaauuucauaguuuucuuuuaaaacuuuuaaaauaucacaaacuuuuuuaaaaaaaaaaucacauugagucuuucagcauaacagaaagaguuuaaaaauaacuuuucuuaauuuuaauugaaugaauuucauucauuugcugaugagaauggauggucaucucacuggcugcuguuucacuccagccuuuaaggaaccgaguguuagaucagugaaacaaguuagaugggcuugcagaauugagguauaguguggguuuaagcagcagcagacucgaguguuuagauaguuagcguguccggaggggucagaagcaguaacagugagagcucagugggagcucuguagcuguggcucaaggaaccaaggaacuggggaaaucccacuguggaaacagcacugagaaggccuugaagaauauaaagcugguuuuguuuuguuuuguuuuguuuuguuuuguuuuaaugugccuaaaaggacaugacaggcuguuguuaugagacacugggcuuauuaaaucuggucaaaguagagggcuguuuuaauaaauuauugaagguaaauauugaaaugcaaguuacagagaaguuauggggccuuuggaaguuuucugguuacagcaaacgcuaagcuauggaugaugaaagugauaaauguuauuuaccaagcagcauaggcugcauuuguuaaaauguuuacuuaggucaccugaccguuccauuaucuccaguucauacguggcagugcagcuuccgugggugacuccucugggaccacacuacaaauaaauggccgagauggaaguucaaccccagaucugccucaagucccaccuaaugcuuuuccccuagaaaacuagggccaagauugauuuaaaaaaaaaaaaauuaaaucaagagccaacucuugucuuauugggaagauuccaaggccacugcuagacaggcauccaucuccaugaugguuuuggagcccaccaugggugagggcaagagguuuuucuaugaauaacaaacauuagcuuccuuggcuguagaaaauuggauccaucaaagguuucugaacagaaaaugaccugauguuuucugaguuccccauaaccaaggauggaauuuaaggagaauagaagauacuaguaauggaagcauauauuauggucgucuauaaagagucugaaggacccaggagcccaauuagaaauauccugcugugaacagcccauauccacaugaaugcaauuucuuaacaauaauagccugccucccauagccucugcucagugagaaugucauugcuuguguuuuauguuaacuccugauuccccaggggcuaggcauucaaugcacugcucucaaaauucaucaacauuaaaagcaaugccacuauguuaaggccuggcucuguguuugaguaugucaaaugaaacgugaaucagacuaucuggguuuaaauuccaggucugccacuuucuugauauuuaagaaaguuguuuaaacuguugugccucaagcccuuauuuuaaggcucagaugauaauuguaauacuuauuucagaaaagaaaggcaauguacgaguuagucuguguuaaacuaaaaagaauagauuaaauuagggacuggagagaugucguaucagauaaaagcccuuacugcucucacagaggacccacguucgauuccuagcucauagcugccuguaaccucaguaacaucuccagccuccaugggcuccugcacucaaauucaccugcccauuacauacacacaaacauaauuuaaaacaaucgaaacccuuguaaaaaucuacuuuaaaagaauagucucaauuugaugucgauuaucuuguauuaucaaauguugcaccauuuuuuaaauuugaccauuggaaaauaaauguauuagagucaaaagaaaaggcaaugauguuuuuaagaaaagucccagucuuuaaauuuaaauaccccaaguauaucaacagaggaacauacuaccuuuuacuggcuaaaaaauaaaauaaaauauacauguuuauaacaucuuauaaaaaguaccauuuacaauugaucuuguuuauaguuuccuuccuuguugcaaaaagcauuaaaaauuaaauguagaggcugguaagagggagacugaagauaaaagcccugggccacagcagaggugauguguguccagagagagcucugugguaggacuccacucgucuaaugccucagugucaagcaugggguucagucaguagcuaagccauagugagagacucugaagguagaugggaaagaagaugcucguaaggacagggcugauaagaauagggcucaccccuggaugcuuucccagacauccaagccuauguccuagucuuggcaccucccuuauuucuguucuccuucucuccaaauauucccaagccauuucagguagugcuaagcucuacccccagcaaagaggggugaccaucgggcccaagagccuuugcugaagugcuaguguauggcuucccuggggcagauguguggcuucuggguccuuuggguacucaauuguucuucacccuuuuauuuaucucuguucacaucgaucacccuggagcaucaacacaugaacagcuguuucauccaccugccucugaguccucugcccaagccuggguagggugguucugauacagcugucugcacaugcucagauguucccuccuccucagccucugcccagggaggaagaggaaugguuguaauuuguauggcaugccuguuaguuaucaggcuucuuagccucuuuuuacaaauuacaccucagcuuaaguaaggcucccaaguauaauggcacuauaaggaacaacucacucugcauucaccaaauggaaaacacacaaaaaucugcuuucaaacacugaccuuuuaaaaagaaaugagaaagaggacuucaucauguguccuuguguauacuccuaugugugcaugugugggcaugugcgugugugugugcacgugcaugucauguguguagacaccugcagagguugguuucccugcuggaguuauaggcaguugugaggcaccugacaugggugcugggaaucaaaguugaguccucuggaagagcaauauacacucaugacugcugagcccucucucuagcccaacuuuuuucuuuacuugauggcuucucaguaauuccacuaugaaagauuaauagcugaacaaaaguccuugaaacccagggugauacggacaaccauuucuccauuagcugugaccugucagcaagaugcagcucuuccuuuugguaaccaggguccagagaggcuaguuugccuucugacuuugaaauuugcccuucucauagaacaugaaaguauuugugucagccuuaaaauaaguauucugucauuaaacgaaagugacuagggaucaggaaggcaccccaaaccauaaaguggaaagaaauuagaagacagacucaucaucuuaggacaacguaagugaggaccauuaugccaugcaaguauguccucuaaagaaguauguaacggaaacauuaacucucagagggacaaauacacaugcucccucugauuucauuucucagaagccuaaggcugaagaaccauagcauugucagaguguaugguggucagaacagguaacaacauugaguguaucguggucagaacagaugacaaauagcaucagaaguggcucaggucgggguuuguggauggcugugaucagauaucaaggaaggauguauuucuucaccaacauagcugauacucagcaccacacugucuggucucuucauguacuuagcucugaaaaucugaggggaaggugcaacuuucuucucugcacuuugagcccgaguccuugucuuuggccugcgcacuguucauuucuuagucagugccucaguaauuguuucugagguaaugaguaacucucagguaacugauuaaaggccugcaucgagaacuuagaaagaagccuaaaacacugaugaccuaaucaaauucauccucuuuuucauucauaacuacgaccgcuacucccucuuucuguccguuaggcaguuuuguuucuguucggauuagaaaaaagucaggaauaguauuacaggagaaaaauauuaggcccuggguuuccaagaacaguagacucagcaagguuuccagauuguuccaagccuuuaaagaacgucaaaagauuuuccuguucguguguccaaugccuccaacaccgugaagauacuaaagccaugugaggaacuuucuguaaacaauaggcaaugaaguuuccugcucugauuaccgugaacaugaauucaaccacccaggagcuaccagacagaaucuggacgucucaucuugucaauagcaaagucagcuucugucuuugaauuaagaauaauuuaauuuaagaaaguguuauuuaucuguuuuaaaauacaaugagaaaaaugcuuacuugauauagugauucacuaaggucuuguuguggcuacuuuauuuauuuauuuauuuauuuauuuauuuauuuauuuauuuuugguuuuucgagacaggguuucucuguauagcccuggcuguccuggagcucacuuuguagaccaggcuggccucgaacucagaaauuugccugccucugccucccgagugcugggauuaaaggugugcgccaccaugcccggcuacuuuauuuauuuuuaucuuaugaugaguauauugcuuaugguacacacaaguauacugugugagcacaguacccaugaaggccagaagagagugccagaccccuuggagcagaagaugugaacuaccaugcgaauacuaggaacugagccaggguccucugaaagagcaccaagugcuuucagccauaaagacaucucuucagaccuuugugacugcuuuuaaaaauucagccugauguagaauuuauuuauuuauuuauuuauuuauuuauuuauuuauuuauuuauuuauagucuuccauaccaucugacuauugauuuuauauuugcuuuuaacuuuuuuacaauuuugauuaucauguuuaauuguacauagguaugugugguuguguagggauaugugugccugaggaugccccagagaagccagagguguuggaucuucuggagcuggaguuacagauggugugaacugccugaaguggauucugggaacugaacuugggucuucugcaagaguagcaacucccuuaaucaaugagcuaucucuccagcuccaauuuugcuuuuuuaucugugugguaucaguguaagcuagcuuguaaagaggcuuggccucucgacaagaauuguucuaaucuaaguauuuuguaugcauucgcuaagcuagagcaagaaugcaaugaaguacaugagauaacuccuuuuacaacugaguuacugaagccgcuuucucagagccacucaucuggggcaugacaugcuacugaucgaacccgggcaguguggguccagaguuuguucccuaaccucauggcucucugugcagucucuugagcacgugacggagcagagaaccacaguagaagggcuaacugugagggaggacauuaccaaggagcuagaauucucggucuccuaagagagaagcagaaggauugagaagcauggcccacccuuguuuacuuucauuuuuaaggccucguuuauuuuauuuuauuuuauuuuauuuuauuuuacguguguaagugcuuugcuugcauguaugccugugaugucugcaccccaugcgugccugaugccugaggggccgggagagggcacuggauccucuggaucaggaguuacaggugguuggugugcuaccgugugggugcugggaaccaaacccaauuccuccggaagagcaacaaguacuuuuacuuauuaaaccaucucuccagcuuccuccuuauguuuuuuccccauacuuguuucuucuauuuuaaaugaaaauuacaaaauuacuuaguuuauaaucccucaguuaucggcuacugugccgccaugagcaagagcccugcagcucuugugccucucuggagugagaaaggaucauuugaaguucacuccgcuuaccugugaggagaacgucgucgcuauuuguuaagugagugcacauuucucaaugcuccuguuugaugaacaaaaccacauccuguccguaccucuccugcagcacuugacauucgggaguagcacuguucacccuaugcuguuucucuucaguguagagcucuuggagagcaggcaccacgugcuucccuguagcccaggaacuuagcaccuaauucucaguaauagaauuauugacaaaugguuguagagauaaagauaauucuucuuggguuugacgcuguuucgugggaaggagcuagagguaaccagacagggugugcauuguggucuguccuuagugcgucaaucacugcaggguugcugugcaguccuccaaaggguuucgcuguaguccuagugagucaauguacaguuagagauaagcacgcucauuuuuccuuaauucaugaagaaugccucuguggccccaaaucauggaugcaucaaagcuuucauuuuauaguguagauaaaauaaaauaucagaaagcagcugggcggugguggcacacaucuuuaaucccagcacucgggaggcagaggcagucagauuucugaguuugaggccagccuggucuacagagugaguuccaggauagccagggcuacacagagaaacccugucuugaaaaaaccaaaaaaagaaaaaaaaaauaucagaaagccugccuuagacauuaugacugauucuuuuuguuuguuuguuugguugguuuugguuuuuuugagacaggauuuaggcaugugccaccaccgccuggcauuaugacugauucuugaaaaauacaaauuuguaaagcauuugagggagaguaauguaaaguucacagccugcaauaauauuaaacauucugucugcaugcucuucagcucuccccggggcuccugcacucacauuucagcuuugucuuacuuagcucagugugcacuguguguuagauaccauuauucuuucuugaaguuuuaaaaauucagagauauauagguagauaucuauagcauucuauaguuuuguuuuucaauucauuuuaacuugagguagacauucugguucaauggcucuucagucuucuuuugggcggucauuuuauauauuggacacaguuuacucuauccauggaacuucccaucacuauagugcccuggaagaaagcugcauauggacucucaguggguacuccuaaggacuggagaaaugacccugucauugaggguacugguuacucuuccagaggaccugauucaauuccagaacccacauugcagcucacagcugucugaaacuccaguucuagagaauccaacucccucacagagacaugcauucaggcaaaacaccaaugcacgugaaguuuaaaaaaaaaaaauaaaaaacuguuaagagcauucuuucaaugaaguuuuugauauuucuuucacugccucuacuguaccauuuccugggcuacagucgcuaccuccaacaauaaaagaaucuagcgcaggaaagaagagugcgugagaacaaauguggugagaacaaauguauggacuaacccucucaucaaauugcaucaaguacacagugaaaacccauuacacgugcucagacuguuauauaauaguggugugcaggugauaaaacaucugcccuauuagcaucuucuauacaacugcaaauugccuaauccacugaguaaaugaaucacuccugcagguuuaaagccacaaaaucauuucuuugcuuagaauaucaguuguccaaaacucugagcaaaguccuccccuucaccuguugcacauuaacuccaugguuacuguauaaucaguaccugagagcuaagaucugcugcuuacaagucacacagcaaaggguuacgaaaugccacacacagggagcaugguggggcucuccuugaugcccuugugcugguagauuucugagcuugccuucaaguuguuuuaauaaagaaucuuuugcuccguugccugugugauaacuuuucuguagcaauagcaacaccagcauugcuagcucggcauucaguacuugguugccauuuucccaggagcucagugaccuggugacacggcuguuuugaauagccuuugcagacauauucacuggcugauagaucuguuuucuuagcugaaggguguuagccauauguccccuuagaucuucuacauuauauacuuugccccuuuucgccguuuuauauguuuacuacggccacccugucuagggcugaguaaggcaguuuccacucccagugacuuuaauggucuguaggaaagauugucauugaaaugggucauuuuccccucacacaguaaaugcugagauccuucgcaagugucauggcaucuuaaaaaaauuuagccuuuuccuaacaugaaagucaggugauauucuuggaggauaaagguuugcucugaguauuauagacuggauuuaagaaaaaacaaaaacaaaaggaucccauuauucuagcagaggaaaugaugugcaugcuaaagaaagccauggauuccauggaucagacucuaaaauacuagaggaagggcaggcaacaggggagguggcuaaggcucgagcuaugagcuuguuuccucucacguuugggaguuuuagauuuauucauacauuuagacucagagcuaacuccucuacacucuuuugaaaguggugcacauauucaccgucuuaugaaaaugauucauagcuuuuauuagaacucagccugacccgcaauccaaaaacuauuaagaauauuugcagugaaaaguccuaaggggccaaugccauaguuuuccauagguaagaugaaguagaacauuaccauggcccuguuucgaaucucaggaaauguggugcauugaacugugcuaauucaacaaauuaaaaucaccaggaagauuuccuuugcaaaaacaaaaaucacuaccccauucacugacuauuuuauugaggacccuggcuaaacaccaagcccuagagcagggaaguucccugaggagugaacaagguaugccacgaggugacaacauuugagacucccucccugaaccccaaacauuucuggaucuuacuuuggagcaaaucaaaccugagucuauccuuguuguuuuugucugugaggagagugcggcccggugaaggaaguagcuagccuaaggucacguggcuggacaugcugaagagucucuaaucagaagcccuggauuuuuccaucacuccacacuccauuuuuuuucuuucuuuaguucuaaccauaaauauacuuuauucuuuuacugguaugaguguugugugcacucuguaaucaaacauuggcucacuacaacuugaagccugaaaacugaauuccuaggaaaaugaaacuccuuaucuuacuguggcuaugccgggaagagugcacagugagccuuucugagcaaguccgaagucugugcgugcacgggagugcuuagcugagcuuuucauaguugugaggucugaacucgaguucaaaggcaaaaguugaaagucuugaauugguaaaguaaaaguuagaacgcgaaucuucuuaugcacuguggccuucauugaggucuaaaguaggagggaggccagagggcauaaggaucccaggcacaggauccgaagaggaugcucugaguuuaaaaucccacauucucccccuuccaacuucaugacaaacuaacucagacuaacuuucuccacgagaagaauagaaauaaugacauuucaccauaagaauugugcaaggcuauguaauaggcacuuaugucuacugaccauaagaaucaguggaguuucaggcaaaagucagaacgcacucgagguaucacaaggacacaaugacucuaaccaaggaacaucagugcaaaagugaggaaguuaacaacacucagaauucucaugucacugucuucuggauccagaugugggcagcuguuuugccaccaccucggccacaacugccaaccaaacuggcucucagaaccacagucugguaacaaagcugucagcauugucagauuccacuacaaauauucaguaucucuccaacauacuugucagcggccuaggccugcagaggaaaugaaucguguuaguggacucugcaaggaagucugggaaauguaguuuauagcuuuccaacuaccaaauaaaauuacacuguuaagucagucauuuagugucugccacaggaguacagccuagguucuggcauauagcaaaugcccaauaaauaaauauuguugaugagggggggaguucuaugguugauuuauuaucaccaaaguaccgauagcacuuaaugucuauguaugauuugcuuauuaaccuaaggaaguugacuugauucuauuucuaggggcuuucuauagaauauaaguaaaucuaauuaucaccuuuuuugggaacucuguuauuuacaacccccccaucaacaugauaauaugaaaugaaacaaguuucuauguauuuuaaauuuuuauuauaggcuuaugugcacacauguacaugugcacacacacacacacacaugaacacacacaugcauguacauaccuaacaugcauauggagaucaaagagcauuuugaaggaguugauucuccucuuccacauauuguucccagacaucaaacucacgaugucgggccucguggcagcacccuuacccuggccccgcaucugugcugcuuugucuacacucauuuuaagauggguaacagaagugccaggaaggagggcaaaggccgagcucccugcuuucucgugccggcuuuccacgugucucgugacccuagacauccuuagauggaacuuuguuuuugcucaaggaaagagucaauuuaaaaugacuuauaagaguuugcacaacacugucagcugaucagauguccuuagaaaagcgguaggcauuccaguugucuuuuuaaggucaaaggguaauguaagggagcuuucuccuacuuuagcuuaguagcauaaauuuuuuucucaagucauguuuuauucugugucuuaggugugcuaaucugucaaaaaaaauccuuauauucaaaaucaauauuaaacauuuaaauauuuagagccaagagaauugaaauuuuuuauucauuuauuuuuccaauaaaauuuucuuacuuacuuaaugacguugaaaauccagaaaacaaaguacuucuuuucuuuguauauuuucuguuauuauuugcaacaaggccuuaccaugcagcccugaacuuacucuacagaccaggcugccucaaguuuuuagagcuccaccugcuucugccucugagugcugagauuaaaggugugugcgugaccacacccagcgcuuagagcauuugaacucaaguucuauggggcaaaucccuacacuaagguaauaggguuacugauuaguaauuaacauacauucucuuuacuaaucagauuuccacaugauaucugaguaauaaacccuuggaaugcuugugacucaaacacuggaguuuuuaauccagugguaauggaaccaaguaacaguuugucgaauuuccugcacugcauaaugacuggaccacagagagucauacugaacauugacaccaaucuuaguucaguucaaggauguuucuaauuaaacccaauauuuaaaaaauugaaccucugacauucaagagucaucuaaacaaguauacaaaauuuuaaggcaaacauagauuuauaaccaacaggaaauaaggaaaagaauaguuuucuauccaugguucaguaugaagguuuucacucgucguuugggaaugauggcaacucaagugauacgcauuucacugguagugaucuuaugacugauugcauuccaaggggaugaguaaauauucuuccuuguucaagcaguuagaauuuuagaaaugcaggagcuauagugcuguacuggcgagcguuuuucccuuauguacuuagagauuagguccaacagccugguuaaaaagacuucugcucugcacacuucagucguaaagucuagacaaaagccacagagauugucauacgcuggucggcaacaguauugcauuuuauuauuuuugaggaucuauucccaacuuagcagcacaguggaauucuacagcaucacgaaaggacucaaaaaugucuuuccacuaauugaauaauccucaaaggaagggaacaguguguuucuuuagauuguaaaagaacucggaugagugguuuauugccagugcuaagagauuacaacagcacccugacuucaaauacuagauaguuaaacuaucuagucuuuaaacuuuaaacauaguguaagggguuuuauuuuacaugauuuaaauacauguauuuguauauauuuacucuauauuuacucuauauuaguaaaagagguuacauuauaaugcuaagacuuuuauggcuugguuuuguuuauuaaagaauguguuucucuguggaguccaaugguaaaagggagaguuaguugggcacgugguauacugguucaguuaucagccugacaaaaugcaaggcaaaauaaaauaaaaaugaaucaaagucuguucuuccaacccuucauauuuuaaaauguaaaguacaucucucccgugugugugucugugugugugagucuguguguaauguaugugcauagguguaccauugugcaugcuucugcaugcacggaagccagaggagggcauguaguauccuucucuguccucuuugccuuagucuuuuaagccggaucuuucucucucucucucucucucucucucucucucucucucucucucucacacacacacacacacacacacacacacacacacacacacacacacacaaccucagagauuuuucggcaaaggugggagccaacaaucccaagcacugcaguucuugagaccaaccuccuagguuguuaccugguugcaggagugugaacuuggguugcauagucgugcagugagcacuccccggccccuaaacuacacguucaauaauguuccuugugcacuaaaagguuaguguagaacucuguguggaucaaagauucaggaaggucuaaucuuaucacagagguuauuuggccaugagaacaaaguccacuuuuaauagaaucauugguuacauuuaaaugccuuuugguugacuuuacaacuuggcauauccaguaaauuggucugcugcggagcuccugugugucacaaacauaggcagcaucuugggaaggugcaaagagguaacuuuaacuuuuuaaaaaguuaauacaacaugaauaauguccuugaccaaaaccaauucauuuccucagaguauuuuugucauuuugacucauuauacaaacagaccauuuaucaaaauuugauacucuugucauagaaggcuggaaaguuuucuguuauaccaaggagagugauucacgaaggugguaauuuuacauacacgggacagugucaccccuagcccacuucugcacaauagcugacuuuucauuagcuguaucuuacacagauggaaaggaccaaaucuucaaugcugucauugaaaaagcaaugagugaggugcuguacuuuccauuuuuauuguggggaugguuuaaaacuuuucagaagauuaaggguccugaugguagaaccugcugucuuuuugcauugguuuagaaguauuguuuuuauuuuuauuuuucuauuuuccccacuuugaggcaagagucucacugcguagcucagucuggcuuagaacuuaaaaucuuccgaguauagggcacuagaagaauuuuuuuucugauuuuuaauauguccacagaugaauaucuuaccuaucaagacaucuccaggguggccgucauaggccugucucccuaaguucugagucccgucuccuuccuggaguuuuccucuuuggcugcucuucaaggaaaugaucaguccagucuccuuuuuaucuuauuugccacccacaauucaccggcuucuccuauuuucuucaauuguuuuccuacuagcuggguucauuggcuguggcuaucauaacagacuccaguaggcuggacagcagacacauugccauucuggaugcuggaaauccaaggccaaggaguggauuuuuuuuuucauuuuuaaaguuguauuaugcaagguuacauauauucaugaaaauacauacugugcucuaagcauauucucucuacugccuuccuuccuuucuuuuccccaucucuguuagccuccagguaauuuggcuucuacuuucaugccaucuguccauaugugauuuuauauaccuguaaaguccaguacacccaaaugagaggaaccauacaauaguugucucuuugagacuggcuuaugugauuaugccuaauugcauccaauuuucuacaaacaauauaauuuccuccuuaccaaugaaaaaguuccauuauauauauaaaaucaguuucuuuauccauccguccuuuauggacaccuagguugguucuguaacuuagcuguuguggauggugcggcaguaaacauggaugaguaaacaugaucucugaaguguuuccuuaagagccccauggguaaacaccgaggagguguauagcugcauccuuugagagcucugcugucuggauuggaggagccuuccaacugguucccacaguggcuagaccacuacucugcaguggauaaggauucccguuuguccgcaucccucccagcaucuuguuauuuguuuccuugaugaguaucauucuucuaaggaugccauagagucucagugcaggcuuuaguuccacaucucuagugguuagugauguuaaacauuuauugaucgaguugcucauagucuuaguuuuuaguuuucuucguccuuuauauauucuuggaaugaauccucuguuggauguguggcuggcagauuggcucauucuacagguuuucuccccuugguugccuccugugcuuacagaugcuuucuuacuucauugucaaucuugaugcuaaucuuggugcuuagagcaaauggggucugcucagaaaguacucguucacaucaauuucuugauaauaucuuugucccuccuuuccccaucacuuuuaagcuucagcucuuugacccauuugaaguggauuuuaauucaggcugagaaguagaggccuggugccauguuuacgugugaauacccagcuauaccuacaccaauucuuagaugcugcuuccuggauagcagagggucaugguuaucuaggcugccuaugaaccaggcagugucucagccuccucuuaaucccaucccucccauuugaguaagacccaccuuaguggagauaucuuaaucacuucuauaaagacccaaucuccaaacaccaccacacucugaagugugggggguggggggugugcuucagcaaaugagcuuugagaguggaagaaggggugugacucagccaugacacuaccccacaauagaaaucauaaugauuuuggucagaaacagggcuugacugagcaucaggggagccgcaggacagaccgauagccgaggcgugcccugagcccaguuuauccaaguucuuucuccgaagccucugaagggaaaugaaaugaaauccacugugaguaugugcuacauuuccucaccugcucauuaauggguaaacaauuaagugguguccuuuucuuggcaauugugaauagggcugucgagagcaugaguguguagauguugcuuuagaguagugguuccauuuccucuggcuggauucccacuggugagcucucuguaccaugugaugcuucuguuuuuaguuugccaaggaacccucacacuguuucccaucaugacugaacuaaucugcacccucuacacagugcugucccacccucccuuucuccacaacuuguuauccuuggucuuuuacuaaugggcuuucugacuggacuggugugguaccucaguguggacuauuuggucuuuaaaaugaaugaacugcuuucauuuguaacauggauggaacuguagaucauuacaugaccuagaauaacucaagcacaaaaagaccaguguuauauggagucugaacaaguugaucucacaggacugagaauauucagaggaugucaucagaggcuggggagaagaggcccagggagcaaugggacgaguuuggugcugaguugugguuagguaggaggcucugcugugcugucacacaguugguggccauagguaacacuaacaaaguguacauuuuaaacugccaggagaauggcuagguguaguggcacuagccuuuagucccagcaguuggaaagcacugacaggcaggucccugugaguuacaggccaggcuggucuacauaauaagucccagccaagcagaacaacauagugucccuggcccuaacaaaauauagcaacaaaugacagaaggaaguauucugagcacuauuaucauaaagaaaagauacauuuuugaggagauaaauauauuaagcccaauuuaaacauuauacaauguauacauguuuugaaacagcacaugacaccccauuaacauauguaacuuuuaugauuaauguaucacuuaaggauacauucuaacuuaagugaaaaauaaaaugaaguauuuuucagcaccucuuauuuuucaauuacuuugccacacauauuacauacaugcccacaaguaaauccuuaaaaugauuuuacaagaugcgaacagccaguguuccagucugugacuuuuugccuaugugaugcuuacuggggcugcagucaccuaggugcucggcuaggauagaauguucuagauggcuccuucacauggguuugggcagaggcagaggggaagcguagcuuagaggagauucuguucucucuguguaagcucagagcgucuuuaugugggccucucuccagcaagaagccucagcccuuacgucgcuguuucuagggcugccaagaucagaggcugcugggucuucuuacggcuuacaccaagcgugggaacgguagccguccauuauacucuccugcuaaagagaauuccagaguaacccaaauucgguagaaaggugcucuccaggccauaggaaggauguaacucauaaaggucauccucagacaguagcugucgugaacaauuccauuuggaaaaacaaaaugcagagggaagagaaagaugccauuagcuacauacuaaacacggagugauuuaucauuauagaacuacaugagugucuuaggguuuuacggcugugaacagacaccaugaccaaggcaagucuuauaaaggacaacauugaguuggggcuggcuuacagguucagagguucaguccauuaucaucaaggcagaaacauggaagcauccgggcaggccugguacaagaugagcuugagaguuuugcauccucaucugaaggcugcuaacagaauacuugcucacaggcagcuagaaugagggucuuaaaguccacacccacagggauauaccuacuccaacaaggccacaccuaccccaacauggccacgccuucugauagugccacucccugagccaagcauguacaaaugagcaaaucagcuugagucacuucauaaagaccaaggagauuuuuaggaugauaguaguucaaugacaucauugaaaagaacuuguacaaauacaguagaugaagucuaugaggguagaguaaggcuguccccucagaucaguguuuagggcucgaccaucaaaugaggagcagaguaaagaauuagguccacuagugccauauucccugucccugcucucucugagcuggaauugaugagacuguccacugguugacgucaaaguggguucaaaauccuuuccuauucggacaauuuucuuauaaugacacauaaauaaaugagauaaaaugagcaaaauaaaggcgagggggcagaacaguggcucagagguaugguaaaggccuugccacugaaccugacgauggcguuccauggcacucagacucacauagugacucuccugauucuuccaaacggucccuugaccuccacaggagugcaugacacacgcagacccacacaguaaacauauguaauuuuaaaaugaugggaaacuuuuuaaaaguaagaaaccuuugacauucuuuaucccuuuugguucaacuagcaucauccuuaguguuuguuuguuuguuuguuuguuuuucgguuuuucgagacaggguuucucuguguagcccuggcuauccuggaacucacuuuguagaccaagcuggccuugaacucagaaauccaccugccucugccucccaagugcugggauuaaaggcgugcaccaccacaaccggcuccuuaguauuuguuaaguacccgauacacauuugauaagaauauacauuugacuucacuaagaacuaucaauaauuguuacucuagaauuggcuccuggggguuauuauuuaguaauaauuuuugaguuuuguuaguaaauguaaggguaagugaacauugugacgaaguaucgccuccucaguauucugauuuuucuauucagugacugggaaauuuguguguugucaacagcuagcaaaucugugcuaagucaacauaaccugacuuagauaaggggcaggcaagcuucaggccgucagcacguguggcccacugccuggcugugcaugugcacgcucuguaaggcagugguuccuguggguaggucugcagcuguuuucuagccacacugucagaacuaagaggacuagagacucugccaacuauguuuccugccucuguauaggagaaguuuugugguccuucguuuuguuugugagaccugggaagauggcaggagauaauuagaagcuuacagcgcccuuggcuuauuagucuacugacauuguguugacaaugggguacgcacugaucuaggaaacggggacucggugcgagccugccucucaggacagcuugaucaguuucugcugucccgccacaaccagagcacucaucccuaaaauguuuccauuuaguugugaugaagucagaacuccuguacauuacagucaggccacugugccacugaccccaggcucguuccuguccuguguguuuucugcauuaccguugcgauggugucuuauuugcuguuugucccuccugaccacacaggcuuguucuccuucugaggucaugcugcuccauaggcacacuuuccagugcucauuugcuuugguacuucuccuaauuuuucaaaagacugugaauuucuaguuucuccagagucucccuuaauuacuuuuauuauuauauuuuccuaguccauauauacuaaaaaaacaagcuuucaacauauuugugagagcauuaauagcacauauuagguaguuucaaaaaaauuauuguugcuguuuaguuuuguuuucuuacugugauauagcaucugugagaaucggauccuugcuuauguuguuaauuguguucuuaguguucaacauagaacugaauacaguaguauaccauagaguguuguaaaugaguggaaggaauuguggcauaaacuugaagucgauacagguuuuuauaauuaccauaguuuuccuuuuccucugaguuuccuuaacucuggucuugaucucagugcaguaaaaauguuacccuucagugcuuucugauacucgacuuuaagggacggaaagggcauagaaaggagagguugaucuaaaugacagggcuguacaaaagucaggauuccugcauuucuuuauuucugugauuccaguuuuugcccaguucagacuauucaaucaacuguuaacuuggacuaaccagagaacccauaucucaauuuuuuucuuuaaauuuacuguuauguuaugacagaaucaaagccuaguuguaugagaaccaucaguguguguguguguaucaugugcguuaacaauugugaggaaggggauagggaagggcaccauggucaaagaugcugucugacacagcccugagguccuucagugugugccccucaguccccaggugucccacugccauccccaggcaggcugcaugcacuggaaaauaccacugaugugagcacaacuuagcucucuuuguaaugaguagcuacuuuugucguguugggacauaaugcuuuauaagagcaauuaugucaucacguaaagagcagaggguuuauuuuggcucccaguucaagggcacugucccugaagguagaggagccauaguggcggaagcuggaagcagggucacguugcaucucuagucaggcagcagcaagaggucacaaggcaagcuugcacucagaucacugucucucaacagucaggaccgagccggagcaguaaugucucucagaucaaggggugcuuucccuaccuccguuaaccuaaucuugauuaucccucacagacaugcccagagaugcuuguuuuuacugauucuaggucuggcugaguugaaagucacuauuaagugucccaaggacuguggguugugagagaauucaugaagauagaacucaucuuggacuuuuaaggagaauaaggcuagaggggaauucuuaagcugaugaaguaaggggaagcucaugguguuuugaccugccccccccccccccauagggaacuucuuucaacgacugucugaucuguucacagcuuucagauuagucugacauugucagugucuauauuagagaugucaaacccugaggcauaugcuuagcaugagggaaagggggacacaggccucagagccucuggcugguagcagcaaauggaugagguucccuggccucagaccgaagcucugcuccuuccucgcugcugagaccuaaccucagcucuggaauauagaggugagguguagucacugaggaccccagacggcgacuucaccugcguuagcccugcugcuccagguaucacugcuguccucuuagaucaccuugagggggucagagaugccagaagaacaaacugcagauuuucuugacaugaagaagucaggagacaggcggagcuggcgcaggcucuauagcucagcaauucagauccugcauuggucuuagcguuccccugaggugccucugaguucccuggugacagcuguggcuccagcaucccguguucauuccugcaagcaagaacucuagggcaaacgauacaagaauacagcucguugccuauaccuccauuuaaggggcauucugaagagcucugucugauaacauuugcuuaugugacagucgcaggcaagccugcucacuuacaguagaggcugugugcuugcccaccugucccgaacagcugauucaaaauuauuuuuacaaacgugaaaagcgccagucuugcugcuauugcuacugugagcuagucuggcaucuuuucucugguauaaaguuccagaaggcuaauuaagcuuagggagucucccccaccccccaaaacacuccugaccgccauccgcagucaucuagagaacaggcagccguauuuugauccacucaguucuguuuuagcuuuugguaugaguucucuguaaugaguaauuuaagagaggaauauuaaacucugguugauguaaauuguccagcuuuauggugaaucuguaguagggcuuucaaaauaaagcuuucugcucugccgagcaaaauccucaaaugccggacuugaacaauucacauguugugccauuccuggaaaucaaagaacuuuggaguuauucgugggucacuaguauucuuguuugauaagaaaucaagauuaauucaugauagaaauuuuuggccagguuuggugacaugggccucuggaagguacgcaggaagaugacaaguucugagcuagccugugcaaccuaaaaaaaacccuuucuugggauauagucagugauagaguccuuacgugauauguaugggaacccagguucaauccaugcauccaucacaaagaggacagggaugaggccaccacuuccuccucaccuggagugucccugacccuacugccugcacuguucauugcaacccagcuguggccuuagaggccaaguccuuuccccuuuccuuccuuuccugugagucuguuguuguucugucaaccuaacuacagaaggcagagaaggagauuguguguuaagcuuccuuuucacguguggucaacuuguaggaagagcaaaagauaaaagugugaaaagauuagaggaugcgugcugcggaugcuuaacaaccgcauauccaugccuacugucgacaacaaggcagucagaauggaugaaguguauuuacccugaaggaauuuggggucuaugagaaaggacauuuuaggugcagagacccuggucugcuuuugugugucaugaaaggaaacuugacaggaaaggagcacgugcuggguuuaguaggccgcagcaagcaaaaagcaagacugugcaggcuccuuacaccacagccagugaaugcucucuuugcuggcuaguuucaugucagcuugacagacuagagucauuugggaagagggaaugucuacugagaaaauguccccaucagaguggccucuggucaagccugugguucauuuuauugaucagugauggaugagguggaggggaaggcagcucauuguggacagugacauccaugggcugaugguccugaguucuguaagaaagaggcugagcggggcuggugagauggcucaguggguaagagcaccugacugcucuuccgaagguccagaguucaaaucccagcaaccacaugguggcucacaaccauccauaacaagaccugacucccucuucuggugugucugaagacagcuacaguguacuuacauauaaucaauaaauaaaucuuuaaaaaaaaaaaagaaagaggcugagcaagccaugagaagcaagccgguaaguggggccccucgauggucucugggucagcuccugucucaggcuccagcgcugacuucccuucaugaagggcugugaccaggacauagaagcuaaaauaaacccuucucauccaaccuggcuuugggucaugguguuuuaucacagcagugaaaaaacguaacuaagacagacugguaguggcuuguuaaaggugaaauauccuaccuguuaaggcacuuaaugugcagcaagaaucucuuuugaaaguaaauuuuaagauaaauguugaaaauuauuggugacucacugaaauaugguuaagucuuggaggacacuuggaggaccauugcagguugggagaaggcaacaaaaggaauauuauccaucacacuuaaguuuuaauuuuugaagaacuggagagagacaaagcuaccuugaaaguggaagaggccacuuaaggagacgugcacagacuuagaaugaacuuugaaaagggaguccugugucucagguguuuaagaagagaguaugugugcuucccacgaagcagagucggcaccugcaugcgugacaugucacuaguggguagcagagggggauucaggcucugaggacccagguuuugcaggcuggauuagggaacuagauaggccuuuucacugugucuuaaggcaugucagcgaucgccucugaaccuauagacaaggaagguuggcauaugaaggauguagacuuggguuuccucuuuuacuguagagagcucuuuggcugcgguaguagguagggccaguuuuuugaucucuuugaucagguuugaauguucccucugagccuguccuucuggagagcucuaagccuccugggacugucaccccuuccucacaacuguccacaugugaguauucuagggguaucagaagccaugacugagggaagaaaucagggaagagaguccagcacagaaagagccugagccccccaccugucagccugcuggaguggcuaccagcacaccccugcucaggcccagaaaucuacucugccagcuccuacccuguuacuccaccuccccaucaacuucgaaguucuguuugacucccauugcuuauuuuauuuugcuuuuaaaaaacaaaacaaaacaaacaaacaaacaaacaaaaaaaaacaggguuucuuugugcagccuuggcuguccugaaacuugcucuguagacaaggcuggcaucaaaaucagagaucugccugacucugcuucucgagugcuaggauuaaagguguguacuaccaugccagccuaauuauuucauuucuuauuuucucucucuuucuuucuuucucucucucucucucucucucucucucucucucucucucucucucucucucucuuucuuucucuauuuauuuuuguucugaaacaaagucucacuguguauucuggcugucuuaaaacucugaguagaccagaguaacuuggaacucacagagaucugccuagcucagccuccagggugcuggaauuaaaggcaugcacgacugugcccugcucacuacuuaauuuagaagcagcuccuucaaucacauugugcacuuagucccuagggcagccagugcugaaguaauacacccacccccuuggugugauacaaaacuagagcaaaaugaaaguguggcccuguguuccccauccauuaagaaauucuaaucaguaacagagcuuuaagccaugcgacccugugugacaacccaugacgccaugacuugagggggcacaagaagucagaguugguucccuacugaaaauaugaaugcauuuaaaacccagaaucauauuauugggaagggagcaaaaguaugccucuaucaaaucuuaucugaaaaccuaucugugcacaagcacauauucuauucuggugcuagaacucuacagcaguggacuagauaaauccccuaaauauuugagauaaauaccuaacuauugaauacucucuuuuuuuauaaagagaggaaaaaaaaaugacugcaugucuuccugccacucaagccaaaauuaagaaguauuugaaaauaaacuccuacauucauuuucaguguaaaagccuaaguauuuacaaagggaggccauagcacaaaguaggauugguuuacugaaugccaaaucccugugcugugaguuccaucggggcagugagcaguagccggcagcaggauugcucagcuccacgagucaaugcacagacccacagggagcucguccugagccuguuugaacgaauuacagaacauuuaccuauacuuaaacuccacuguuaacaaacacagcaugguuuuuugauucugguuauaaucaucaauaaaugcagagacugccccacagaaaccauaccuuaagggaaaagacugggcucaaaggcccaguccugaccacucagccaguucccggcuacuuguaggggaaggucaccugaccugagagccagggucucccugguaaggaaguggcaggaccaguuugucauggagguggaauuaauugaugaaaugacuggacaguacuguguuaaaggcagugaagauguaggcucuuuaagucuaacauugagagagacaacccagccuucagacuacucgucuaaguaaguuguguaucaucguccgcuggcuuagcagccacuuggcaagcucaguuucggugucagguguaauuugucuuuaaaaaugaaguuaagggcaugcaccuuaaccuucccaccaaagcaaagagcaaaaccaaagcacagcguuaaccccuucaugccguguuuuguucccgcugacgagcgccccuuucugucgaugcaccauugugauuuuauucuaucacauggguuuuccucuuuccaggcgaugaacuuugugaggaucgaguuuuccccauuuuuaaacuguugugggugucucgugcacagugugucagucaagugagugguuggugagaggaaagaaaguauguguggauagaagcaaaccauuuaugacuuacaaucucaaggcaaacacuucaugaaaauggggacccuaugugccuugagggcccccuuuccaaguagucagcgcucaguauaguaggagaccccaaagaaaugugcaaagaaaagaaagggccagcuccaggugacgggguuaggaguuguggacuuucuuauugugguuuuguuuuuuuuuuuuuuucuccaguucauccccaacccccaccaaugucucaucccagagcuggaggcucccuugggagaaauccccaggccugauccaacucuggucacuuuagauccuacuccuuaucaaaacuagcuccuguguccucuuucugcagggcuggucugugcccccacuccacccucuacuaauuuaaugacuacacauuccuauacuaguuacagacaucaaagaguauugacagguaauauguuccagucaagggaauggaagcaauccgcaacacuuaacccaaaagacaggcccaauaaaaccccauuaggagcugugccggagugucagauuccccaugccgccuccuccguggcccauauuggagccagcccuuggaaacaacaggcugccuguaggacuccugaucuuaucuauccacauuuauacugggcucugcgguggagcaagcuguaaaugugauaguugcaacacgcccuuuagaauacuaaauucacugcugauuaaauaaaauggcugagugaucuggaaucagccccacagaauggacucagagaaaaaugaaccaagauccugggcuugugcugcagcuguacucaucucucacuaggucggaugugaugcuaacgggagcucccacgugguuauuucuccuguuucccagcgugaaacccaggaauaaaguaccauguaugccuaaagcuagccccucuuacagaagagaaggccagguuuccucuguugaauuuuucucuuuacuuauuuguuugagagcacucuugaacucucuuuggagaaucaggucgccccauuugauucucaacugugggcaguauauucauguaauggaaaguguuacuaauccuuuaagagccagugugagcuacugcuggguuagaaagauucuaauaacugggcuuuugucugugaucgcugauaacauuuuuaauuaaaguugggcagucauuugguaauaaguacagcuggagcagagcaugcuauuguucuagaaccgauggaguucaaauucagguuuucccaaacagguacgugaccgaaacacugguuucugucccacuuugggacgccauuuucacuuucaaggugucuaccauaguuaacugcuacuugaaauauuuguagcauuuuccuuuaaauauauuuucuacucuacaugaguguuuuaaggccauagauggaaaacuacucuuccuuguucuuagcugaagauaaucaauacaauggaaguuaaagaucauuaaauucuaauuacauaauacccuuacuaaaaacaaaccugccuccauuuauuauuaaccugggauuuggacaggcuaacacaucgggggcucugacggauggaaagagccuucuccuuauuauuucagugccggccuaucuuugauuaacacugccuuugaaaaccucguucccuucuuuuugugucugacuggcuagaucuagacaaacagaacaaucaugcuauuuauaggagguaggugguggcucucucugcacacacccaagaagugguuagaauacacaaauguggacaugacaaaaaaucuacaaugaguguauggaaggaaaaccgccuugaauaagcgagcacuuaauacuaacguguugcugcagagggcuucugcuuuggaggcuugacccuguucuggcugaaaggaugcuugauaaagucgguauauaaugggcagucaaguggauguuaagucaaagaaugccaaggacauucacaaggcuccuagcugguacugugcugagcaucccagguggggagugcuggagagguugugggaaacaagauugggagagaaacuggaaggaaggaauagguaaauugcugugugccugugcagcagcucgaguauuggggacacagggucugugaaaccaguagguuugucucaccaacacuaugacccuugaauagcuucaaaacuguaaauuguccuccaguuuaaaauuuuucaugagaucccugacuccacuccccuucuuauucaaucauuaugaacauaauuuauucacagccuaaggaaagaugaacuguaucaaguucggguggcacacacccaaucccagcaccuaccuaucaagccccaguacagccaagguuccauggugagaccugauuucaaaacgagcuauuuauuuucaauaaaauaaaccguccucuuugcuggagugacaccccuguucccauuaauguauggcugauauuuugagaaaagcacuuucauacugaggauaccauuuaugaacuuugccaguuccccgguaauuaaggagaauuccuaaaacccguaaaauucgacaaccaggcugcucaacaaagcucuuuuguuccuuccugccacguggagggacaguuccuuugcuguucaucugucauccgugauuugcugcugcacggugagacaaggucuuacugacucuggaguucugggaucacaggugugguaugccauacggagaggaaaaaauggggauuuuuacuauggaacaauaggugggaacucacucuauuacuaguguuuguaaacuagcucuagucuuucagagucggcuggcguggaccugcauucucaguagccugaagguaggagggaauguagcugagcugugguuacccaggccuucugcaagguuuccagguccauaugucaccaucauucucauuugcacauccccauguuggcaauaccaaaucuucaaguccauuauaccagaaaguguaauuuuuuuaucuuuucugacacuaaggccauuuauuaaauauggccaagaaaguacauccugaaccagagggagaugcacacauuuaauucccugagucucaaaccuaaaauuuaauuuaaccaauagaaacauuuacacacacacacacacacacacacucagcgaacacuuuguugagcuauguauugacacaggagucaagauuuccuguguucacugaguggaacagcacuguagaacacuucuaaaaacaagccacagccuuccuuucugccucuuguuaacucggucaucucuuggggacaagguguguauccaggucccuuggguccuccauccucucagcagguggcaggugggagagcccagaccugccuguagcuaaugacagacugugcuugccuuucagguccaguauuucuucaagaucuuggauaauuagcucuccagaguaaagacgacacagacugagacgcccagacaaucgagucacacacgugaggaauguguucauucuuuuauuguccguuguguuaaccugacugacacaagaucaacaagagcacuguacuccuggcaauuauuacauaugcuagaacauggauuugcacuguagacaacacuuaacaccagucuaugggguacugcauugcuuuuuauaaaguucaaaauaaagauuuuuauuuucaaacaagugacuuugguuuuauuucauacauuacacuuuuucuugcagaaaaaaauaaaauuguacaacugcauaaauauaaaauucuuccaccaugaaaauggucaaaacauucauaaggacgcagcaccagcgcaugaugccuccagagaaaggaaagaaggaaaggaaauggacgaauaagcaaacuacccagcccaucacuagccacagugacaggcagaucccagucucagacacagcugcagaacacacuggaggacacggggagagauggcgagacagcauucagcacggagcacaacacaacccaucaccuugauuuuucuguacugucacuuaaaauuuaaagggcaguucccccaugacagcccaccccccagccccaggaaauaaagaaaaaaaaaaaauaauaauaaagaccugauaccacaggaagagacuauggaguguguuaaaaaugcucaucgaugggccguuaccuuugaaauuucagagccaagaaaauaagaaagaaaggaaaaaguaccaugccaguuuuauucccguugaguauuuacaccuuggacagcaaaccuugcucacguaaaguagaaaacagauaugauaaaacauggcuugaaaaaugaccagagugcgcaccuauaguacuguacacuaaauaaaauagacaaggcggcaauacuuaggggccagaacacugcucacuacaagucaguuacggaaucuaauuuacaguaaaaaugggcacgucccaaggcucaauuuuuauuuuucuuuugucauuuacaguagaauaaauauuuuguugcuauugcuacacuuuaaauuuacauucuaaccuauuaaaugcagaagcuaguguaaagcauagagauuaaguguaggucccauacguaugacaguuuguucaagacuaguagguuuguguaucuuuuuuuaacuuauuaaauggcuagugggaaagauuugugcuugugaucagcucuuaauuucaauuuuuacaucaaagcgucccugaaaacggucuuucucacuguacccaauguucucaccauacgccuuacacucgacgcggauuucaguguccacggugagguuggugaacugcacggccagcaggggcugcagguacuugggcugcaggaguuugccguaguagggauaauacugcagagggaagccguaguauccgcccaucccaaaguacucuauguucccgacuuuauccuuaucuucaucucucug

SEQ ID NO: 474 - RNA, 21789 nt, Mus musculus
cuuucagguccaguauuucuucaagaucuuggauaauuagcucuccagaguaaagacgacacagacugagacgcccagacaaucgagucacacacgugaggaauguguucauucuuuuauuguccguuguguuaaccugacugacacaagaucaacaagagcacuguacuccuggcaauuauuacauaugcuagaacauggauuugcacuguagacaacacuuaacaccagucuaugggguacugcauugcuuuuuauaaaguucaaaauaaagauuuuuauuuucaaacaagugacuuugguuuuauuucauacauuacacuuuuucuugcagaaaaaaauaaaauuguacaacugcauaaauauaaaauucuuccaccaugaaaauggucaaaacauucauaaggacgcagcaccagcgcaugaugccuccagagaaaggaaagaaggaaaggaaauggacgaauaagcaaacuacccagcccaucacuagccacagugacaggcagaucccagucucagacacagcugcagaacacacuggaggacacggggagagauggcgagacagcauucagcacggagcacaacacaacccaucaccuugauuuuucuguacugucacuuaaaauuuaaagggcaguucccccaugacagcccaccccccagccccaggaaauaaagaaaaaaaaaaaauaauaauaaagaccugauaccacaggaagagacuauggaguguguuaaaaaugcucaucgaugggccguuaccuuugaaauuucagagccaagaaaauaagaaagaaaggaaaaaguaccaugccaguuuuauucccguugaguauuuacaccuuggacagcaaaccuugcucacguaaaguagaaaacagauaugauaaaacauggcuugaaaaaugaccagagugcgcaccuauaguacuguacacuaaauaaaauagacaaggcggcaauacuuaggggccagaacacugcucacuacaagucaguuacggaaucuaauuuacaguaaaaaugggcacgucccaaggcucaauuuuuauuuuucuuuugucauuuacaguagaauaaauauuuuguugcuauugcuacacuuuaaauuuacauucuaaccuauuaaaugcagaagcuaguguaaagcauagagauuaaguguaggucccauacguaugacaguuuguucaagacuaguagguuuguguaucuuuuuuuaacuuauuaaauggcuagugggaaagauuugugcuugugaucagcucuuaauuucaauuuuuacaucaaagcgucccugaaaacggucuuucucacuguacccaauguucucaccauacgccuuacacucgacgcggauuucaguguccacggugagguuggugaacugcacggccagcaggggcugcagguacuugggcugcaggaguuugccguaguagggauaauacugcagagggaagccguaguauccgcccaucccaaaguacucuauguucccgacuuuauccuuaucuucaucucucuggaaaccaaaaggacaugaaauuuaauuuuaagggcauacacgcaucaugggucucgucuugcucuaacgaacgagacucucaaccccaucagaggcugcaguggcgugccuaccucaaaccucucagaagcuaagccuaucaagcaguggguggcguggauuggugacaccacaggauaaaggucgguucuggccgaaagcagccaagaagcauucacgaaagggggcucugcaaauggagacacugaggcagagaccaaguaagugauucucuaagcuggcucagccucgcaggaaggccaacagugagaggaaccccuggcuuuuggacaguguucagcgacauucucuccgaagacuuacauauguguccuuuauuucuuacauccaucucuuggcuugguacuguagcacucauuuuuagcauucauuaagagugaaaaaagaaaguuggccucagaauuuaacacaugccgugggcuagcucaccucugcggguccauaaacccacauucuauuacauuaaauucagauauuuagauaccuguguuucuugugccaguaaacaaacuugguuuuauuaguuacaguucugucccuuuuagcuuguauaguuacgauucaucuugggagccuaacacccaaaaguaguuccuugcauuaaaacugucccuuuaacugugaggagucucacccacuccucuugccccgccccacuuccccucccgcccucaguagccccgaaagcguucucaccuugccagugcacugaacaggcaggacauuuggauuauacuucaucaucaguggguaagucuccaaggauucauucuugggaggcuaaaaguaaaacccacacuggucagcaaaagauacuuuuuuuucugaaaacuaaaacucagcuguaguccaaagaaauggacauguugacaguaagcugcugaaauaauaagacacgucaggaaggcaaaugcgugauccaccuugucaaucugagacaacuuagaucuguuugaagugagcacuacaaacgagcuguggcacagccuacuacuguagcuaacacagcgccagccuacuguaaaccugacuagggacaaugagaagcuaacugggugccugcuaagauggcagucaccacauggaguguccagugcaccucuagugcaagagcuggacuuguauacugaggcaaggguaaauaugucgggcuuuuccucaacaaugcugucuucaaacaggcuuucacccuccgcuaagacugggggcagucugaaaacaacaguuacagccaaaugcacagccuuccuccuccaucccuggcccaucuagcuccaaaggcugaugaauauggauugcuggagagcagccauuugcuuacucagguuagcccugcaucugagccuugaccuaagauauggaguguagauuugacucuuuuagggggcuuucugcuaccaauacaucuaccuugaaaacuuggaauagaaaacacuuauugaucaaagagguggucagaaucuguccuccgaagacaggaaccaggcacaccaaugggaaugaugagucacagcacuccaacaacaacaacaaaacaacccgaucccacugacaagcuagcaggggauuuggguaggagggacaaauaagaagcagcaauguauuaacuggggaccaaaauauugaaggagucaauguccgucacagaacaggacauucagauguagaagacagaacucacacagugggccaggcuguggcucugugacacaggugccacugaaagugaugagcgguauuaaaagcaaaugaccgggagagcagaaacuggcuucgggcuuccuucauaaaccacagcaguuccuccuuuugcuagauuacccuagccaugugagucaaguacaagcgugggguaguaguccuaaccacaguacuucccauugcaugcuugucucugugggaagauuaaauaucuguugaaagguacacuaacauucgcaagagauccuucaagacaagcagccagccagccagccacugacaacuuguuccugucucugguugcauaaaggagcuuugaugcaucuuuaagguaauauuccugcugguguugguggcacacaucuuuaaucccagcacucaagcagguggaucucugugaguucaaggccacccuagucugaagaguuccaggacagccagggcugccuacauagauuccguagcucacaaaaagaaaaagaaaauccacguuuugauuugauuuccuuugggguagcaaauaucacggaaacaaacugacaugcaagagaaacugagcaguguucaugucagccuuaggggacccuggagaccaaagccacgccuauggaaggauggcauugcuucauucauggucugagaaauaaccguucagaaaagaugagacaacaccaguucuuuucuguaaagaauuucuuacaaaaugguuaacagugacaaccugcugaucaaguaauggucacuuguuagaaacugugugguuaucaaagggcagagaccgugguagguucuagguuuaguaaugaaaucaucacucggggaaaaaacuucuuucugaucaacagacagcauuucugaaauauccuugcugcuccuuuaaggacccaagccaaaagcagcacacaaccaggaaacccucacgugggcaaagaacucucuuaucuggacacgaagcagugagcacaccacagucacaucacuggggagacggggucaggaggauggggagcauaauaaggcuagccuuggcucaaagugucugaggcuaagccugguguuacaguccuaacggacugcacuucacaagucccagggagcauauucugaaacaucagcuaggcccccaaaugugagacuguaaaauagcgcuugccuucgguuugaagcccaacacucgguugagcuugauaaugaugcagggcuuccccucucuguagccguaagagucaucauugagaccggagcaguuccccagccagucaagcuugaaccugcacaccuuccucucuccucguucgugauugaugucgccccguuccuuggguucacugggaacaucugaaagcacaaacacauucauagcgugcaccaaccguucggcucugcaccgugaagaaagaaaagaacuucuuguuccuuaucauuucccacuggagacagggcuacgugaggccugcgcuagacaaggacuucccacaagcugucugcucucuucaaaagauaaagacguauuagcagaggcagucacuggugcgugaccccaaagccaaccugcucaccagcugugcuucaugaacagcagcgacugaggcuuggcuggucuuucucuucuucuaaggcagugauucuuagcuuuccuaaugugcugugacccuaucacauaguuccucauguuguggugacccccaaccauagcauuauuuucacugcuacuuuauaacuguaauuuugcuguuauggaucauaauguaaauaucuguuucccaauggucuuaggccacuccuggggaaagagacguuccaccccaaggggcccagacccucagguuuagagccacugcucuaauggaucgccuagcuacuuagggcugaaggaaagcagaccauaacuucagcaccagcagcagcagcacuuucacagacccacacagcgaugcucagaaacagggacauuacaacaaggacaugaauuuaaaagguugucaauacuuucgagcuggaagguuugggucagaauuuucuggagcuacgccuccagucggaggggaaauggucaaagagaagacggaagucaucaguuuugucuuuggaagcuguacauucuccucucaugacaagcacugauucaacugggaaauguucuucacacuucacguaaaaagccagagaaaagugaaaugaacauagaauuuuaagucaggcuguagaaaagcaaugcauauucucuguuguauauuugauauauauuauguguacuggcuaguuuugugucaacuugacacaggcuggaguuaucacagagaaaggagcuucaguugggaaaaugccuccaugagauccaacuguaaggcauuuucucaauuagugaucaaggggggagggccccuugugcguggugccaucccugggcugguaggcuuggguucuauaagagagaaggaugagcaagccaggggaagcaagccaguaagaacauccccccauggcuucugcaucagcuccugcucccugaccugcuugaguuccaguccugacuuccuuuggugaugaacagcaauguggaaacguaagcugaauaaacccuuuccuccccaacuugcuucucggucaugauguuuugugcaggaauagaaacccugacuaagauauuauguauggcuauucuugucauaauggcuauuucauuaacucauuucuccuucaugauuucuccuugcuuaucaugcgucccuuucucaucgucgugaaguaaggugaaaaccuuguguaaauucuaacgagaauuccgugacauugccuuuaaacuacuaaagcaacggagccaaacgacaacccguccuucucaauagugggaccacgugcacccauccaucccugagccagucacuuacugccacaguccucgaaaaucaugucguccuucugggcugaauccuuguacuuuuccaggaaccugaugauguuuagcacguaggccucguagcucuuggggucauuaggacggaaggagaucucagucuucuggaucuggggaaucugugucaauccuacgccagggaagagucagaaaggcggucauuauuaguaggaaggcgaccgggaggcgccaaacgcaggcguuccccgcacaaacacgcuucccucgccacucauucccacuuggcucacgggauggauuaaauccccacuccccuggugaauucaauccgauggcauuuagauuagguaucgaacuguaucgauagugauguaauaucgaaugucauccaguuuccuuggcaacacgucacaguagcauuaaccuguuuuaugaacgagaaugucacuugcagugaaaggcacaguguucuguccgagggggccagagaaagcaguagaaccagaaucccaacccagcugugcaguccuccaaggccuguggcucucuagugcccuccgaugcaaucacauuuaaagcugcguugcuagcagccgcuguacaggugguuucccgucaguaauagcacggaaguguggagccgacaccugccccauguuccaugucaaugaguuaguuaaaaucucagucucucuaaccucaacacugccccacagagacaauccuuuggcucguguaaccuaggauagauucuuucagcuucuaaggaggugugggggaugucaagauauauaugcaguugccaguacagaugucugagcaugucagcucugucagagugacauucaagacacaugauguggguuugccgucucugcugugucucucccguccagaagccccugcccucguaguguuuucuacauggguuccuggucuacacuacacaauagcaccagauccagggcagugcguuggaaaggcgauuacaauggcauuccaucccagaacugacagguaaagagacccaauuacauuccaguuccaaauaaacaugagacaacucuaaguaggaauacacacucuugugcaacagacuucuagguaaccagcuauccuguguuuucuguugugacaucuggcauccucacuuugugucaggggccugcuagucaagagcuauaccugaccuccuuccgucuccuccuggcagguggggguacccacaccauucuccucaaaggcugguucaacagguagccucacaggauccauuccagaccuaccugggcauaaccucuaagcccaaagcacccuugguuuagaagcacugcccuggaggaucagcauuugcuaguggugacaucggugcagacaauggcauaauucaaguggaugcacagacaacucgguuaauuauuuaucagcgccauguguggcacuagagaacaagccuucaacacaaguuacaggccauagcuguuaguuuuucuaguaaggacugccuugagcuucaauaguugcuacauggcccaacugcaggagcucggugaacagccaugcagaaggauggcagaagggauggagaugaagaugaggaagcaggaguagaggugggaagaggagugcucaagaugacaaugucaagacggacgauaagcaccuucuugggcagccuggugccagaggccuuuaauuccagcauucauggaucccuguacguuccaggccggccuggaacaaguucuaggccagccagggcuacacagugagacuuugucucacaccaaacaaacaacaaggaaucuuggggggugggugggugagguugcucugcagggaaagcacucgcuguacaagccuacugaugugacuggaucccugggacacacauaaagggagaaaggggaaacugacuccauaaaguugcccucugaccugcacguguguguaccauggcacgugaacaccucagauaacaguaaguuuuuuaauguaaggaaucuucuucaaaaggcaaacggcaaagcuuaaaggacacggggggggggggggggggggggaaggaacgccgccauuuccgaauuagcucauaaauucugcagcguuaaauaaacgaagggcacgaugguuaaauguucucccccaccaauaccaccccauuuuuuucaagacaggguuucucuguguagcccuggcugucccggaacucacucuguagaccaggcuggccuggaacucacagaaacccaccugccucugccuccccagcacugggaucaaaggugugugucaccacaccuggcuugauuaaacauucuguaagagcuccuaagucaggaaagauucuuuucaugucuaaaucaaucucaauauauucuagacauuuuucuuuuuaacauuacaugggaggcugguccugugacuuaccauugugcuauaaagcaaagcagcaacaaccacugaccucugcaaggagaaagccaucgagggcaaagaacagcaguggccagcaugggacagcaaggggacaggaaggggacagggccgaaacaaauaggguaggcagcuagagggccacccacgccuaggccgaguuguaaacaagacguaagucaaggugauuugcugacccuggggaagugaagggcacaggccaaaacuagagaauagaaagucaggagaaugagggaguuuuucuacaauagcccugggauccugagaaaguggacucuugagggguuagucaugccuaagagccaagagcaagugccugugaauuugucaggcagaacuggacaaagaaaggguagaacuaugugcccaggauuaccacagggccacucagcuuccagggcccaggaggaggguggaggcagcuggaaaggggaagaaaugaaagguguuggaugucagaaggcuaggaguagcccuaccuacuuuacagaaaggagagaagcugggagaaaagagacugcagccaccagcaauggccaccagcgugcuaaguaacagcagugcaaguuaugguccccagcugagcaggagauacagcaaagccccacccugggagucugacagacaagcuacucucacuaaagugaccuuagguucacacugaaaauaaacaagguaggacccagguggcaaagcagguucgcccaugucacugucccuucugcccuggcaucauuuggaauuccccacugccucucacucuccagcugucccucuauagucucuuccaggggccguuucuuaggugucuauacgagguacagcgaugccacuucucagaagagcacaggaccaugggauuacagaguccuugucauucucucacuacuccaagaggucuccauuaagagacacagagugacaugugccagaccccucccccaaauaugaguuccuguaacucaguccuuguuuuucaggacaucggguucacccagauguguaugccggccucacuuaugaacaggugcgucacugcccacugccugccaucugaccugugaaaacgauguguacuguaguuaccugugguggcaccacugacccauaagcgugacgugccaucaguaccauccuccuccagucaaagcaaauaaauaacgaaaccaaacgcuggaaccacaccgauucccaccacuuccauaguucacauccuuaccccuacggccccaacucaccaacugcugccuuugccagcugggacaccuacacaggagcuuuuggcuucugguugcccgccccuaaagcuguuaguaauaacugaagaagggcgagcccugccucagugcuaacccccagaggucagagcagaacauccaaaccacaggcccugaagcacaucuugccuccugacuauucucggcgccuaaauguccacuaaggaggugaagcucaauaaagccuugcuuugccaccaccgcaaaaacuaguccuguuguuaccuagcaaagucaccuaaggggacugaaacaauaauuugaauaauguuaauuugggguccuuacaaguacuucagcuauacauugagaucuggauuauguaaaagcaaaaacaaaaaccucuggcuuugcuagguggugguaacacaauccauagucccagcgcccaggagcagaggcaggugaaucugagcucagggccagccugaucuacagagguccaagacagccaggucuacacagagaacccuggucucaaaaaaccaaccacacacacacacacacacacacacacacagagacacacacacacacacacacacacacacacacacacacacacacacacgccucugacuucacacuugcccuuuccagaugcaccugccucuccugacuccaccuccuaugaaacaaaggaggcaaacgcccccacuucaggcauuagugggugcucaccuuagcugggauaaacagaagaagacaaaaauaaaagaggcuuuucauuaaccgccauuuuguuuccaguuaggucuacaauguagcaaguuugugauuucucagucugcucccugagcugaaguccuuuaaggagaaguggccauuuuaaccuuguagcaguuuccccagugaaucccaaagcucccagagggccacugcuuggaccugucauucgauaugauacuucugaugagucaaagccaaauacucuucauacagguauuaucuuccacagaaaccuccaagggcgccggaagcuaagagaaacguucccaugagcaugucuccuauccauuccaggcuuaaagugcuuuccaguuucaaagaaacaggagugacuacggcuuauugcacaugugccuuuacaguuacauuuggaagaguaccucccuuuaagugucaaucugaacaaccuagaugcuuuauuuuuauuuauuaucugugggauuauuauggacuaaccuaacagaauucugggaacaaguccccucccacuuaccuuuugccucaggguuagcaugugacuggaggcccaguuagcuggaaauaaauggccugccuugaggccacaggcccaucuauaaccuagguacacccagauaccucaagcgugcucccucugaaaagucuuggacgaauagcucaccuguuuucuacagucuacuuagcugguuaaccacccuugguguguagaaauuugcccagucuaaaccaaaugccacaaacucugcucccagguccuccaguauuucagaauaaccaucaggaguccucucagaagcugcauauccaacuucagauguugaggaggaaugacuuaguguggacauuauaucauuuaaaaauacaguuucauguggagcgugauguuuuggccagcgcaugguuguguuuauuccccaaacaaggaagcuacuacuucuugaugaaggggaagacauagacaagcucuggacauuuuacagcauggcuuuuuguuuguuuguuuuugguuuugccaaggucaaacaaagaacaaguguauacuugacuugucaaaugccaaaacccagcauuggcuaaguaacuaacacccugaaaucugacaccuuaguauagauaguacucuaggggccuauccccaaugaugugggguacuuuccuggucagaagcuauugggcaauaauacaccaucagaugcccuucauuguccaagccucucuggagucuggucaacgucgaguggcaacuucugcaugagagcccucaguggccaauggccuguccucuccugucugauucuacaucagcagaaaugaaugugugagcacagggucccagagcugaaguacuuuaaagagaaguggccacuuuaaccuuguagccguuucccaggguggaguucucuucuugugugaaugccacaagccugaagugacacugucuucgugucuuuaagcccgguacucaugaggcugagaggcaggaggauugccacaaguuucaggucagcccagaacugcagaaaaguggguuuuacucauuugaagacaaguaagcagagguaggacaucugcuaagaggcgcuaacaagggaugcaagugaccauggaggaaaagggcagauaugucagugucacuucaggcuuguggcauucacacaagaacugacugacaggaaaugguaaaaauaaaauaaaauaaaauaaaauaaaauaaaauaaaauaaaauaaaugccccuaacacucugagguacaguuucuccaaaucacaaggagaagcugauaucggagaaagccaaucaucuuguaguuugaaaacaguuuuucugagcgugaagcaugcugaggggugcgcugugauggcugugcccccauauggcuuagcuauguuccacccacaagaugaaacuugaauggcugcuccugcucauguucacccaccccaccuuccugccucaguucuggguacccaggugccaagagucugacccuuuuaaacugaguucucuccucacugagccaucuuuacaaauaaaacaaggagccucucacaacuuuaagaggaagaacagagaauacaaugccuaccuuugcuccaggaagcaagccagaugggaacgaacucugaggacucggcaugacacacagugaccuucgaauucacugcacaguugcuaguauaaucuggggugggggaugggugacacagcccaggaaagagacuuuuccauuacaccacugggcaggccaccaggugagcaaggccuggugaggaggagugugagugcauguggaguacauggaugcuugggcgugugccccgggcuugacucucuacagcacagcaaauggcaaugucucuccgagauucagcugagaggcgacacugccgcugugcacccuccaagagcuucuccucuggacagaagcucagaugcuagcuggcaggugcagguauggaagaggggagcuggcuaccguggcauucagauucaccagaggcucuauguguucuaauccacugauacccaaauccgcuucagggaaagcuaaggguggacugacaccaugaaacuuaggucugaugaggaugguuagcauccccgucacccaaagcuggcugucugggaaucagagccuucugcuucuagcagaaggagagacagaaaggacgaaggcugcugccaacagccauauuuaguuuaccucugcuaaguacuaacgcucugcauagaucuccuaucuaaucaucacaggauaugccucacaaugacacugagguuugguguggucaguggugaacguggugggggaugggaucaacuccaaaguccccgcucucccuucuuaggcugacagaauuucaggaagcccugucuaauagcuuugagcuuugaacacugcuuuaauacugauuacauuaagguaacagaaaguuagaaauggugauuuuuuuuuuccuuuugagcuacaaaaaaagggcuauuuaauaauaugugucaacaucucaucuaagacucugcucucuggguggagugagcagcuuaguucuaacaaccgcagcgguaagaccuuagaaggaacagcagcuacugcucagaguccagaaaucacaugacugguugguccuccaguuucccucccauuuuguaucuuuccccucugucugugacuuucccauuuggccuaguagcuuauucauuauacaaccuacacaauuauagcagggcaggauugccacaguuguaucuggccccgcccagucccacuauuuggaagagaucuaguuacaagguauuucaauguguaaaaacgcaugccaaagcugacuggccagccauguuuguauucaugccccaaggucagaggauggcacaccaugaacccuaguaucuuuaagugcuauggucuuacacacuucccuuguacaccugacugggaacucucucuuuacucaagacaaaaauguaggcuuggagacauuaauuaaguggaaaccaaaagaugaucagaaugacuuccacacauuuacucagucugcaggcuaaugcaucauuaauaccuuccaaggacacauucucagcaucuuuucugaaagauggggguccagcuagggucccucagggggcagagugcucaggacuguccaguagcuguguuuuucaccagccagggcucuacugcccugauucaaagucaccaaccaucauguuugaaaaagugucaggagagguagagaaaaacccacaggguuagggcagagcgguguguagacucugcuacuaaaguaaaagcuaaggacagacagagacagaagucacuaagauuaaaaacccacagaggagaugccugggaaggugaaggacugacaacuucgccugugacucagaccaaaggacaggaaugcauauuuccaagaugagccacucacauucuuuggagaagugaggguuugucaggucaguucaacugcugcgagcacuaaauauaggugcucauaggaaaggcugggaagaaaagagggagaugggaugggggaggggaccgagcaccucagacaagcagggcaaggucagcuacaaauccuuacucagcaucggucccuuggacuauuuauuuuggaagguaaaguuucuuuuuagaaaagcaccuggaaaacaauguuuuaaauuuuauuucauuauuucugccaugugugguggcacacgucauuaaucccagaacuugggaggcagaauccugcagauggaucugaguuuguuuguucaaggccagccccuucuacagagugaguuccaggacagccagcguuacacagggaaacgcugucucaaaaaaucaaaaacuaaauaaauagauaaaugacuuauuuuuccaaaguuuauagucaccccccccccauaaaguugacucuguuggucaccuuugcuucaaguuuaaguuacuauaaaacagaaucauggccuggugagauggcucagcgguuaagagcacugaccacucuuccagagguccugaguucaauucccagcaaccacaugguggcucacaaccaucuguaaugagaucugaugcccucuucuggugugucugaagacaguauaguguacucauauaaauaaaauaaauaacucuuaaaaaagaaauaaaacagaaucaugacuaaagaaccacuuauugacaaaacauaaaaauaagagcucuguacaaauuacuaugacuacuugugcuggcagaagaggccauggaagacaagccuuauaaccacaggaucccacgcaaaacacugaagauccugaaguucucagcacauuggaaccucgcuuuguucgaccuuuccuaagacccaccuuuugguacagaagagcugcaggcauccgggcaucaugaagcaggucgagucacugcauauacuuacacguucucuuuucucacuucccaccuaaauguaucugaaaauauccuggguuuugccuugugcccgaggacuguugacuuaguacugugagauacuguuugcaacuugugcauucugcaguuucuucuuccuuauacccaaggagaagugcgagacaugucugcaacagggacugcucagggcuugcagaggcccccaagacugucaccuacagauggcuguguccaaaccgaagccagccaaagucuugcccacagaagacacacugcuacccuacccccacccgcugcaaccucaaggucauuuauagggugagaagugaaaguuaugcaacacgaaccccacuccucucccagcuguccuccaugcagaggaggcaaaugguggauucccucuucuacgaagaucuauuuuuccugaugaaguuuuuagagagaacagagacagccaaacuggaaagagggcccacaaaacccucaggggcguacugagauaagccuagaggguguuuguguucaaggucaaaucagcaagagagaaaauagaccccugaauucaugguuccucucugugggcacgauuauuugaaggauuuaucacaagugaaaaaauacauguguuagagccagaacggcccuagaaugaaccagcugacaaagcacuugaguguuaaggccaaggagaaugaagcccggaggggaccugaugugcuccaucacacaguggggcugcauacaccacccucaccccagaacuguguaggacagacaucugcggccagccaucuggagcucagccgccaugcgggcagcagccauggcugcagcagagguccugaguccucccccauacuuagcuugaagcucuacuacaaagguuuucugaaggugucuucuuggcuggauguggaaccguuuuaucucuggagaagccacucccugaguuuuaccuggcggggccacucgguccugguaugugggcuucaguucacugaugguuagcagcauuacuuggauggucccgaugaagaugccagccaggcagccauaaaauaucacguagaacagaaggaucuuaacuguggggagaacagacagagacggcugugauguagucacaggcucggaaucaaaucccgggcuucccaaagaccuccuucccuguuccucuucagccuguuucucucaguaaucaaaagagggaggcacacuuuuuuggaaggcacagguggagaaaugcuuaagguggcugaagggcuaacaaacaggaagucacuuccuuuucugaaaagaaaaucagcagcaaaccagcagcugcauuggaaagcuuaugcaaugcaucugacauucggaaguguguucccucaggggcagggguaucgcucgcuugcugguaccccacauccuguggggcuaaaggcuaagaaauacagguggagcucucuuuaacaagucacugucuacaaagcacuaucuuuuucuucaaggacacagggcggcaacuggaaccaaucaaacauacaaaggaaacccuaugguacaaauggccgccauuuuuaccuuaucaucugaccagcagaguaaggacugcuuguguaagcuacauuuuucuuuucuucacagaagaagaaacaagaagaaguuaacagaaggcaggcugaaauagcuacaaauaaacuuuaaaaauaaaaaagcaagcaagcaagcaagcaagcaaaaaacacccugaaccaccgugaagccgguagacuggaauaaggcuaucaguuacugguauacaaggauuagcucccugauuagcagccuaguaacaggcuguacuaggcacuaggcauugccuggcuguccugagccagucaaacaacacaucuagaagggaaaaguggaagcaauagaucuguaagguuaucagaaacaugauugcggggggggggggggggggggggcgcacagguuccuccuaaaggguuucugaaaaaacgcuacagggugaagggacuauugaaaaggcguauguguacaugcugguagggggccaggaguggagugggcacacaagcuguggaaaugagccacacagccuucuccauacauggaaaaacaccaacuuuccccucaggaauccauacuucaagacagcaguguucuggagcuauugaaacgaaccagaacacacauaaaaucccacacaaaacgcugaaccucaucccuugucuccccuacauaaagaugaaagcaaagaugagaagagaggaggcugcaucuucuagaaccacagcccccauucugucccuuccuccuggcagggcaaggguuaagugcugcguuugguauccaggcagcgguaggcuaauggcaagccugugacgucaagggaucuggaaaauuuuuuccggcgaagagguacagaguugguauaacccagucggugagcgagagagccccuggagagccuggcuucucggcugcuguccuguccuguugcccuuccagugccacccugggugcucucagccacauuugccucaacaacuacaacccuucugcucauauccuggacuccuaagaaggcacaggacugaggcuacuguuuaaaagacaaauugauggaaaaauuagucauuuuacaagcgcaaugauuaagcucaagaacauauacacccuuuccacucugagcacagaauaccaaagcugggugagggauuguguugcugccgcacaggacuugguaaaccugucacugcaguaaagucauuugguuagacagagcgcagcacgcauaucuagugagcucgggcaauguucuccccaagaccaaggcuaccaguggcacggagaaacacauacaaagacuagguuagugccaccaaccagcugggugacaugauguuggaggcuggguuaucggcuuugaaggcauuuuguauucuuuaaaacaaauuuucuuuuccuucuauaauuaaagaacaaggagcacgaggaauuuugccuauauauauauauauauauauaaauggaauauaaggcgaaauaaauauauauauauauauucuuuaagaugccaaaaauaggguuuuaaaaagugaccuggaaaaccaauggcaaauauaaaaaccuaccaacacauggauaaacuuaaugaaaagguagaaagcacaaagugauuuuuguaaguugugaucucuccagcaggugacaggcucgagccuccugccguccaucuuggugaaaaaucuaccuauaagcaaaacggagccaagggcaucgugcccuggucccaagggcauccauguugggcccagagcuggaaagggggcaucucucucucuaugacauaggaacuucucugucauuucuuacauugugaaaggggcacagauaggauugcacaaaacacaaacuggguuucgagcucagcacccacaaaauggaagaugaguugcggcagcugcuuccuaaguccguggguaucacuaccuugcuggaugugacccucaagaccacacaggcucauucucucucccugucugauacagaagggcugucccauuaaaugucgcuuuaaagaacaagcuguuccauacugccuuccuuacccucuaaagcaaauauuauucaaagaaggagugugagauuggaaugaggaaaagaaagauguuuuaagaaguggaaaaacacuagagggcaaauuucacaaggucccuggcgucagugccacccccuugguccugugaugcugcugcaggggccagaccaccagggaaagcagcccuagccaacgugggaggaggggccaauuccgcagugcaccuccuaggccuccuagcugaguuacaaagaguugcuaggaaauagcccaggcuggucauccuuuacaaaccucacaucucuucaggucucuccuuccacguuacagaaacacggguaugcuacgggcauacucccauggaaggacagucuccacaaauaaaauggaauauaaggcgaaauaaaaagccauccauuuaagacuccauuuucccauggcucagggaugccuaugcucccugguaauaccguggaaugaaugaggcgucaccuucauaaccuugaagaaugaugcauuauuaacccuuuauuuuugagaggcucccuaacugcauuuuuuuuuucuuuaggaggaaaaaaaaucauacaucccagcuucuuccuuuucaaaaugucagccaagcgcucuuuucccugacucauucuccagucuauuuccauagacccuccccacacaggaacgcagcaucgcaucguuaguuuucaggguucccuuaguuccugcaaugcugcugcuauaggggugggagggggaaggaggcgagagagaagguagaggagcugguggugauggugauacuggagaaggaggggggcagugaugcagcagaggggaguucccucccucccuuccgcagucacgacucauggauuugucuacaacuaugcccuucaaaaugaccuuaaaaaaaaaaaccuaguaccuuuccaguguaaggagguaaaaaacaaacacgguauguaauuuucaaugggguaugagggggaguccagccaaggaagcaacaggcugcaugaaaugcucuaauauaaccuguuucuucguuuguaucaugaagagcuuaaaaacaccaugucuagccaaggcuuaaaaaacgagccaugaauggagcucacugggccauuucugggcugugaugacugcaaugugugaggacugcaguguggaugcauuucuucuccccguuccuauccauucuagauacauuucuagacuggaagaaugaugcuaucuaucgcagcaucgucugcauuagaacagguacgcucgugaguucugcucacggccccaaaucucguuuuucuaaggucuugggagauggaaagggaggguacauacauaggcuccuggaaccugaccgaauuucccaggaggaaaggcuuaggaaacgaagaucccuaccauacccaaaacccuagcuccagcuccccacccgaggcgcauccuggggaccccccacauuugucacuggaugccaagcccagggccgcacgcuccuagcagcuccuaccacccacucccuaacacccuggucagccccgcgggcgccgaacuguccgcagugcucgcguacagacgcgccuccuaagaaaagccaaggcgccgacggcagagccgcggagcgcguacuuacaccaacuaccaccgguccugcccaaaaacuccuucuucuccgaguuccagaugaauuucuuccagcugccuuccuccuuggcuuuuccgcgggccauggugucugcucagcaguggcggccgaggccgagggagggcgagugcggcgcgcgcccugggcguccucgcggcggcugcucgguguccccgcggcccggcucugucuccgaaagcgagacgcgccgcugccgcugcggcucuccgagugcgaggcgcgccgcggagcagccuaggcagagcgggaggagggggaggugcggcgggggcggagggaggagggacgagggaggagggcgcgcgcgggcugggcggcuccgagccccgcaccuagaggugggcgcgcggccgcucucgggcuuuccccgcacuccgaucgccuuccggggggcucagcgaaccccgcagcugcugcuucaagcuguagcugcaccacucugcuugcugugaccucuggcgagauggaccagggacaaggagggaaagucaccgggaagggcgagcggaguggagcgcgggcucggcacacgggcgcgcaggccaggagccgagaaauuggcugagggcgcacgcccuaccuuuacuauauaccgcgccuccaccauccguagcuccgccuaccggcggcacggcaagccaaucgccagcgccgagaaggcggggccugagcccccgaaggggcgggcgcggggccccgcacaaaggagccggcaaagcuaaaggggcuggcaccgcagcaggggugcggagagggacugggggcgggugaguacugcucccgcagcucugcuggcccucucucugccccgagcugugccuggacaauccuccucguccucccggcccccgcucgccaaugcuguggccugcaccugcaucgcucucugggaaccucggagaccucaacuccuucguacuggucuuaccccuucguacuggucgggguuuacugcagguccaccuccccuaggccauggccaggugggggaaggucacuccagg

SEQ ID NO: 475 - RNA, 27635 nt, Mus musculus
cacaucugggaaccacaugucagcggcagcuguauaaagucagcccagcaaacugagggugacauuuuuuuugccagaagccgggcaguauggaccucacucuucuguggguucuucugccacuggugaccacagccuggggccaguaugguggcuacggguacccauaccagcaguaccaggacuacggugaugauggaugggugaaucuuaaccgccaaggcuucagcuaccaguguccccacgggcaaguggugguagcugugaggagcaucuuuagcaagaaggaaggcucugacagacaauggaacuaugccugcaugccuacaccccaaagccugggggagcccacugagugcuggugggaggagaucaacagggccggcauggaaugguaagaagcagagagugcucuagagaugggaacaucuguguauguacugcaugggagaaguuugguccuuaaaauagcagggcucauaaccugggcacauccuaaacuugcuauugcaugcucuggcgggcagguguguacaauguagauaacauuguaaggugaaaaaccaggaugggguaugucccaugaaggauggaucugguucuacuccuucaaaggccaucccuaggcucagugugucccgcaagcuggguguguguacgcagaaugcuuaccagacuuccaaaauagagaugucuuaaggaauuuauagaaagugggcaucccugugacaugggaauaacacuuccauuuugggaugauuuaccguuuuccaaaaauacugcuccagggugguugggacaaaauaaacaauuggguccucaguauccauauccugaaaaaaaaauauugauucaaaguaagugauuggguaaacaagacugagaacuagaaacaaaggguccugaaguuaaguagugcucugcuguucugaugaaauauguucuggcgaguuuuacuacugagauuucucugucucccucucucucccuuucucuugaauuuaaauagccucuguugcuaggauauaguuuaccaaagguuuuuagagguacuguccugacuucugccuuuugccuaaucauuggaacugcauuggucccaguuugugcuucucugugguguuugacuaucccagcccuggcauuugcucagaagcccaucuuaagagacagggguggcuauacuggucauucauagcuguccaaauggagcccaaauuucagggcuuagggagaugguggaggcugacccuaggagaggcagacugagggaggagguagcccagcuggaaggcugccaggugugcccucugcugaacaagacaacugcaugaggggcuccugcagggcacuggcagagugagcaucugggauggaucaacauaaaacauuaguggugauacuuucagccauccaggagaaaugcccugagcauacaucacaccacacacuacauuaucugaucugaucuaaugcuuuaagcaagccuauaaaucaugcuguagguuggcaaacuguggucuggagauagguggguuuccuuagcuagaaagacaagauuuggauccagaaagucugagcuacagcggugggcuuccaagagccugcugccuccacccuaaguggacuccuguugacagagccagggccccagaaccacacucaagcugagagaaggugggaacuacagggacuggcccagugugguaaguggcaguuugauuagagcucugcuccugaggacagggccuaucuacccguguuauaggcagcauuauaggaacagaagcagacugaagaaucuguagaggccucuugagcagggcuguuaggccauccuucuccauucccucugcuucugccaaacagauccaaacccccuucagacacagaugacucagagaccaaacuugucuugaggacagaggacagacccuggugagucccagcaggcaggcucauugccuggcuucaaggguagaaaugaccuaguuguaacugccuguccaguccacccaccccaagggaccaucacauagacgggccagcuuucuaaccucuugaaagagccacagaaggacagcacugggugaagauugccuaaccccuaacugggggcagggcaggggggagcccuggggugagucacaagcuggguuuugguucuggugcuaaugauaaaauguaaugggaccuuaggccaagcuucagcugucucccugcugcugccuuuggaagaugaacccucaggcuuugcagucucuacacaaagcagccacucacuucagcgugcgcuuggcuuuugcuugcauucucuugaacuguguguucacccagcuaaggaaagaagccaaaugcuauuuagucugaaacaugccuguuuguagcugguuaccaugaacucccaaaguugaagagaggggggggaaaggaaaaaaaggaaaaacgugauuuuuuuuuuuuuuugauauaugggaucuaagauuuucacuuuccuccuuuugaccuucccaugguccauugccuccuccaucuccaccauucacagggcuagaaagucaugaacccacaaaacagcuucuucaccaccagacccagcugccccagaacugguacccaauuacucccuaggcauuuuucuccuagaugauuauggcuuuguguucagacuccagucucagugaaaaauuuggaaggcaagaaauuguucacaggcuggggagcaauuacgucuccccgacuggcugccuguucuuaaucuguucuggggaggaguuguugacgaguuuucugcaauuuggcugucuuguguaaguaaauuagcuuucagguuuauuuuaagaggcaggagggacaaacacaaacuugacaauacaaagaaucugcugaagaaaacuugcuaauggggagccaucuuuuccggguagagccauuagugcagagugcuguuacucauggugucuaugcugaaaaacauguuuucaaauaaaguuucgaguaaagcggggugccugguuccaccauugaaauucugguccccugugcauaugcacgccuccucagggacaggucugccgugcucucagaggagcccucugacuuugauuagcaaauaccaugggauacacaagucuuuuguggaguaagacaaaacuggacguuguaguaacucggaacugccuuaugguggaagguucucugagcuaggauucuucacacagcccagcuggacugucuuagguucucaauucccucuggagggcaggguauaggagaagaaaugagagaaauaaaacagaaauaaaaaaucaugaugcuucuaggagaagaagggaauucuaaaacaaaucuacaucuaaaacaaacauuuggcacuuuaacaucuuauuuaaaggcagucaauaaugacuuaguggauauggaacuugacaaaacuuacuuugggcaaaccaggcuucuucaaggcauguauuuggaggaagacuguucuauguguucgcaccauuucuagucccuguacuccagagaaucugcaaaggcauuuuaaaagcaucuguuuuauuagagcuuagauuuugaauuaauuaauccaugacaaugcauugcucauaucuuugaacuuuuguacuuccacauuuauaagaugaaguccaauauuucauuuuggcuuacuguauccaccaccaugcaugguagggaacuuuuaaguuucuuuaagcaucucuaaaacauguccagagccuggcugacccacauuguuaccacgagauggacuuguuauuggauuuacauucuccuauacuuuuaauguuucaguaaacuaaaauauuucauagcgaauucuuuguuucaaaaggcauaaggaguaaauguuacauaaugucuuggcuugaguccuaggccaauaaaagaacauuaaugggaaaacguguaaaucauaauaauuucucaagcuugggcugcugcuaaugucaucgaguguuuagaaacacacccgaguuucaggacacagcaccguggaagcugggugaaggacagacgugaaucuuacgccauuuuuaaaccuaaaguuauuccuaaguugaaaggugaaaauuaagaauucgggcugucgauuugcaugaugggaaauucaaagacaaacagaaugucacaguauucacuaccccaagccuagaaggggccuugcagagaauauaggccaaucuucuuacaacacagguuagaaacgaaagcccaggaacugaaaagucacugaaaccaucauaguaaguaaagaguagaugacccaggcccuaacuuacguggcguuuggaugcuuuguagccuuugccauuuguacauguauuugcucaaucuguggauuuuacuauaaacuuugcuagacuaugauaauaugaagauuaauaacacagaccuacacccuugaguuacucacagcccaaucauauucacuacaguacugggaggaagauauucagucucuuuguuuuccuaaugugggagcauggcucuaagcauuaucagugccuacugaaggucagugauggagaaacagucaagacuugugcucuauaccacaaauggguaugagguuuaaacacacacacacacacacacacacacacacacauacccauccauauccauacugagugcugagcuaaaaugaauuccauguacgaauuucuucugagaacaaagcugagugugggaaacaagguuguggcagacugaggauuugggccaacuucccaucuagguuauuuuccuaaguacuggaaaucaauugucuaggggaacuugauacuuuucuucucuuuaaagaaaguccgaugauaaaauuuacucuucccagugugggauuugccucugucugguaucugcugaugucagcuuuccaaucaauaaaagacuuccagagagcuggaaaccuuagucugugccgguaugugugcaccuguaugugugugugugcaugugugcaugugugccuguguguguguaugugugugcacaagugcaugcaugccuguguguguauguauguguuuguguuucaagguuucgaacuuuacccuuaagaggacuaauuccccacaacacaauccuguagcucucauguccucuguuucuaugucaacagaaauguguccuagaaaauauuauaaaauguuaaaggaugucaggcauugaggcacucaacuuuaaucccagaacucaggaggcagaggcagguggaucucugugaguucaaggacugucuggucuacaaagagaguuucaggacauuucauacaaagaaacccagccuugaaaaaccaaacaaaaauuuuaaaggauaucugugucuucuuagguaaguuaccuaacaucucuaaagccccauuucauguauaaagcagggaagaucaugcuagcaauuuuugcccauuucauagaauuguuuugaugauuaaaaugacuaaacagauaccauauuuaacagaauacucaaccauguaacuccuugugaagguuuguucaugaucacuguuagggacacuugguucucugagacaagccacaccuagcuaguaaguuucaaaauggaaguggcaggauacauggacuuuuggaauauauaauucaguuagaaucuaugaauaugaaauguacaauuucaagcaucuugaauacuugccacaacuuaauagauacugagcuggcauuaugccaacagguuauaaaguaguuuaauaacuuuugauuaugagcccuccacccuuaagccugcuugcugucuuuucauagucugaaaguuuagguuuaaaaggacauaucacaaaacaagcgggaucuccuccaaugcccuuugaauagucgcuacugacugcuuuucuacaguacaucuuucugccugacaggucauuucugcuuaauucuugguagacaguccagcagcucuagaacauggagucuggugacagaacucauaucuaggaacagcaagaacagagcagccugcguacagcugaacguuauuuuaaaagaccguucaugcccccaucauuggggcaggaaaauaagugaugcaguauuuaucuucaaaaagcuugucuugucacacugggggugggugggcagccagaugaagacuaguugaaaugaaaugugugcaucgauacaucccaaggaagaaaaacaucaaucugagucagaaagugugagacuuauuagggaguagagacugggacugcaucuuaaccucugaaacuggacgcauuguugggggaguucaguacuaacgauucuucauggaggacccaaggauuauaggggcuucuuaaauccauaaauaauaaguuuuaaauggaaaaauccagaaauucaguuuuuuagacuaaacauccuuauccugcaucaagguuuauaucccugccuguuaccucaacauuaccuuaccaggucacuaccaugacccgucuaguccccugcucugugcucuuccaucaucagucucacuuugcuucuuuuuaaaaugucugcacugucagaggaccugcuugucaguaccugaaccccaagaagaagaccaggcucaguacagagcagacuuuaacuuuaauacuuuuugaaauauuuaauggguacccuaaauuucuguggauuauguuuuaaaugguuaaugguaacuaaagaauuauuccaggaagaauagaauuaaacaccuaaaguuugauucuauguuacaauuauccacuacaaggaauggaagaaaauuuggaaaaguucaaaaggcugugucacaugguuccuucaauucagggaguuggccacugguaugaaacaugggcaaaacuacucuuauuccaugccagccauggcacuggagacaagcuaacagcccuuaaaauauguguguuaugaagugagacaaaacuaacccaaccagaucuuccaauuuagaaauuuuuugagagcuacugaccaagauggugcuguggccuuugcuuuuauacccaacucaauccuaguuucaguucauugauaucuuggguuuuccauacauuugaacaugggcuagcagagaucagaguuggugggcuaaaacuccacaaaccacuuaaaaagaaaaaagaaaaagaaaaccugcccucccccuccuccucccucccccuccccucccuccccucucuuucuuccuccuaccucugacuggugucauucguucuuccagucugaccaucccagacucggugaagcucacauauaagggacagucuagcugaggagcuguugggagcagauggacagcaaugccauuuuuguuuguuuauuuguuuguuguuuguuccguaccuccuugaagggaagugugcauaaacguuuugguaaaaaaacaagucgcagauccuuuucuaguuagugacuggcuuggcuacucucauucaggugucacuucauugaguccucaccaggucuaugaggacccacggagcacauucaugucaagguggaaaggagacucccugccugcggauuccucagaaugagguccucccaugaucuauuauuuccauuuuaccauugcagacagagggguccauuuucugucucugcuucuaagguggugaccuugagauaaaucguuuucagaaaggccauuuuccucagaacacgggagcaaauguuguugucacgggaagaguaauagccucaagccuucccuuccagaaaacucccagccuuuggcggcguggaacugauaucgcucuuguguuugaagcugaaauugaauagcaaagagauaaugaaaaaaaaugggaggggacucucugaagcagagcaccuggcccucgugugccaagggaacauuuucuuggagucugaugaggagucgggcucaugccacaacucaucaguaaagcuacagccuuggagcugacacgguauucggcagaccauucaaaagcaacaagccagugcugugaagugucccagagccucgacaugcccuuguaccguuguuuguuuucuuugguugagcugaaauguguggaucaaugcagaaccuucccgcucccucccucagccucaucagcugcccucauccauucucaccuccuugaaccagggccuguaauucugaauucugcagcucuacucaauguucacauaagcuuuguuaucuaagagguuauuucgaaggcgacugaggguauaaacagggcaugcgaguacugcaugaagcaguacccauuuggcaccuucauccuccaaaaggacugcuccugcagcagacguuggaaacaggaagauuaaccacugcuccaguuuccauaggaacaaccuaggaagaguuccagagccuuucaaaggcucaaaugauaggcccuuacaaguuaagucuaccuccaauagcaggagacagcuggucagucauuugcucauucauucuaucaaacauuuacgggacaagccucaggcauuacgacgaggaauccaaaauaaaaauuaaauggucuuuucccacaaggccuguacuaucugccuggggugaugagagauagcagagcaucuguguacagaguggccgaggcauccucucuccgugaguuucauccuaggggcacaacagcucagaacacguauacaaugcuucagugacacucagcaugggacuggcucucacaaaguagacuccaacugguuguguagacuacaccaaaguauaaucacaguaggugauuuacacagccccaaaacaccagcauucucaggguuuucuaugcauccucuuauuugguuuuuagagaaauacaaauauauauuaugugcauuuuacagagaagaaaccuacaucauuagaugaugugguaacuguucuaaaugacucagcuaacggugaggcaccagucuagaagcauagcccacgauaguaauccccgccccgccauguccgucuuuacauugugaauacauaccgcuaccaaaguccaguucuagaaggaacaauuccauaccaccaaacucauaucaggcucacauuaacaaauuaugaaggccauccagcugacacuguagaggaccacugauauucaguuaccuuucuccaaauggucuggagccggggucauguagggagcagccacucuucacagggaagcuuuauuugagggggcuugugaaaacgacaguacucuucuugcaagggccaugaggcuggcuggcuagcggagcgccagaagggaauuuguggaacucggacugcuuucagaacugggcuuccaugaaaugagucugcuuaccuucggauauucauuuuccauaagggaguucaccaccaugggaacucuuuuccuuauaggaagcugaguacacagaacagaaggauagaagugucuuggggauaaaagcacacccgagaugggaguaaaaaggcucugcuuuggaggaaaguaguuauuuaaugaggacaaaacaggaaaucucauagcacaccagugugcucugccuucucccucugaagaccuuaggguuugccuaugacucuuagagcauagacugauuuccucccauccacacugauuuggaauugagaugagcagacccaccugagacacaggaggaaaguuauuucuccaucacacuaugacagucauaguguaaugccaaauguauaagcccaaagugacaauacuuuugcaguuaaaaaaaaaaaaaaggcuagauaaucaaaagccauccaucucaauuuacauauugaauuucauuauugaucgcugaguucucacuccaaacuuguuaccacucuugagaacauaguugaguaagcacccaguccaucucuuaauucccuuuucaucauacauacagugguuaaaacagaauagcaguaagguauaaguuguugaugaaugaauguauauuuaaauacacauaugaaugaauacacacauaaaugauaaaugaauaaaaaggaaagaugcaugaguuaauuuccaccaauggggggagaaaaaaaaugauacuuaaguaaaugccccaguauuucagcucauuagauugccuguagguuuuaauuuuucucaaacccuauuuuuuaauaacauucuugaaugcuuucaacccccuuccagcucacagagguaguggaaaagaaaaguuauuaggauacaggggaaguggaccugcuuagaaauuguucuuuggagcaaaucccaucugccuugucaggaaauccacaguucaguucaugggucagcaguggcagcuccauccauuugcaaacacuucaugaauauaccagcagucuaguuugguagaguugggguagcaaacacgaaucagcagggguggcacaaccuagcagaaacagccaaggcuuggcugaaucagcauaagugagcaggaggaaccagggccaccagggaucccaggaguucuuuguuguaccucucucaacaaaguggaggucagcaaagacucgagacccagaagcauugauugcaaagcuagcuaugcaagcaagugcucucugucacugucuguugaguccaauugauauucccuccaaacaucauguguccuccaggagucuggccucaccacaugucuugccucagcccaugagucuguuuuagcaaaacuccacgugagucuguaacagcagacaucacucugccaaucagcuggaguccaaggaagcagcaagaagccaccagagcaccaccagaaguguuuuggugcauuucucucuacagagucauaauagacagagcucagcuacacauuguaaggcaaaccaacacuugcacuucauuagugaagaauucuucaucaugcauccuuccacgugcuugcuuuagcaaaacauccuuccaccugugccugcuucaugaaaacacuccaucacgugucugucugucccagcaaaacaccaugagacacaacugacuuuccaaagaacccuuaaguuuccacuucagucccccacucaguagucagugaagggaacaaucccccuuccauacuuucuagaggcaguuuuauuugcaaaucaagguuaaucuagcagccuucagacuauguaccaucagccacccaccuucugucucacacgagagaggacagaucgaugucccagguaccuaagaaaccaaaggauacagaagaagcugaagaccugauuuggaggggcuuguacuguaguuugaaucuguuucauguauuauaaacuaaauccuugaaccuguguguggacagcauugagacauaaguccuuuggaagguaauaggaaacagauaagggccccgugauagaauuaguuucucuguaagcagggaaagaaaaaauccaaacuggugugcuguucuguuuuaacaacagaaaccggccuggaaaaacuuagaaaauaucauguucuacauaagacaaggaagcuccgaggccaggaaggaaacagucaacauccaaacagaaaggaccaaaccgucaggcaguguguggguggggcaaaggcaggaagaggaggagccucacuguuccucacuuagagagaugccuuaaagauggaaggggugggccagcagcaccgguagaugaaagugaaaauucccucccaaauuaggaccaggauggaggacacaccaugaagaaaaaaaauuggaaacgauaggaaagaaaaggggccucuggaaagaguuugaacucaguuggccuguggauuuucuguugugaguuuuuccagguuccuggcuuaucuguagguucuagggguaaaguucagagacccaacuagaagaugauagaaagauuccuggauacgcagacagaauguugacuaugauccuaagcuucucaucagguucccaaaaccagcacugcaucuaucuauacuuugugugccguguagggagagaguaaaauauuaauuugaaguuuaacaacucauuacaguucuucgucagcuuucuaguuuaaauucaaguaaaaugauuuauagcauccucaauuguaaaauucacaaacuuucuuucaucuaagcauacauuuauggaaagucauuaggagcagggucucccaagcuuccuuccauucaaaguuacugagacauuggaaccuuuauggcacacauguaauuucuacaaugcaacagcuacucuuuguaucaaauagaauaacuugugggagugugggucaaagagcauauuaacugugucaagagggucugaggaagaggucugcauucaucagugcucugaugccuucuucucuucagguaccagaagugcuccaacaauggauugguggcgggguuccagagccgcuacuucgaaucagugcuggaucgugaguggcaauuuuacugcugccgcuauagcaagagguguccauauuccugcuggugagucugguaacuaaaucuuacuccuuagagcuccugggggugggggugggggaaccuacaaugaucuguuccuucaaauaagcccaggaugucacaaaccagugugauaagcagcagcuagacaauagaagagaaggaauggcugagggagaccauucauacuggaaaaagcccuacaggucauccaacccaaugucccuguauacuucuuugccaugcaaaaauaaacagaauaaugccuaguggcuccuguccccaagccuguucccucugucaugaugaugaccuugccucacauccaagucuguuugggaccuguaucccugcagcacuuccaggagugaccaagucucuucuggaccacauucugauaaagaguuggagacaggaagcaaagcaacaaucacagcaacagcaaaacagcacugguguuuucugaguugcuuggcagccccagccugggauguccuauuucucugucucucccugggaugaagcccagugcucccugacucuggcuuccaaucuucuaugagaugacacacacacauuuagucacccugauaacucacaccaguuaaccgcacaacuuaucccaaauucuuuggccuccaaacaacccaggcuuuuaagccuuggauaguuauccaaaaucaacauuugaagcuuggcucauucaagggcuucgucucuccauagucugauguuugggaggagagccuugcaguuucuguucucuguaaucaugguguuacuccacagaugugccaguggugcacaaagucucuagaguccaauaguucuucuugcagcagugacaguaaauucacagcucaaagucagcugaagucugaagcuacaugccagaaaaaaaccuccucuagcuucaccaaaacugcuucuuacccuaccaugacuggugagcagguacaccaagggcugaugauugagaccaagcagauccagaaucaaagaccaaagaucugcaugcuauguugggcccaaggaaugcugguacaggcaagggcauccugaaucucaggcuccgugccauuuuuuacugugaccucuuuccucguuguccccucuauaacgucccuggaaaggcaccuuuacuucucugaaaaccucaaugcaucauuggaaaugauggcaagguuuauuuacuguguuuccauaaaaaaagucugaugaaaacugcaguuugcagucuguaaggaugagaacaacacacuauuacauucuguguauggauaccucuuucuacccagacuuugaauaccugguauaggaaaacucauugaucuuugcauaaccaaugauugucuagcacaguguuugggucuuauaugucugugugugcacccauaugcaugacagagagacagacagacagacagacagacagacagacagacuaggcugaaguuucuuguuuucuugcguuaccaggaauccgucauucuaggcaaguguucuuucuagggcuguaccauagucccagucauaagugguucauuaauaggaagagaauucuuuuuuguuuuuuuguuagaaaaaaaccauagguuguuguuuuaaacuuaaauagauuuuuaacucuucauuccuacccucccuccucugcguuauaagcucugagcucacagagaucuugguacuuauguaugccaagcccuuuaaaaagaauuuuuauauauuuuucucugaguguguguguguuuguguguggaugaacauguguucagaugugugcacacauauguguggauguuagaugucuaccugggauauagccccuuaggcgacaucuuucugggagacaucucucugaaagagucucuuucugggacuuggaucuugcuguucuagguuagauuggcugaccagugggccucagauacccuccuaucuuggauuccccagggcuggugaucacuagugggaucaccaugcucugauuuugacacaagugcuguagaucaaacccuucaugcuuaugcaguaagcccuuuacagacugaucucucuccccaugucccaagacccuuuggugacaucagauacacagcagacacucccauuuguucaauuaaugaaggcuuuagccuacgcccuagcuuucuagugaggguuaaaugugauaacaggauccuggcuuugccaugggcuaugaucacacaaagcuggguuguuuucaaagcagagucccuuccacuuuccucaaugcagaagagaccuucuauccuaauaagccuuucaagggcagaaacacccaacaaggccaagcauugccuugcagaaaacagaacaugugacaggaguuggaugugcagaggaacaggggugagccaggggugcaccgaaucgugcucacccagggagagaaagaggauucugggacagacacauuugccaucacaguaagagccuagggucucugccaggaugaauaagagagcccacagugucugcagacagaucaucaugccugcugccugggguucugggcaaacagaacuacagggaaugggcuuggggcccaaagcuuucagcugccaggcagauaaaugcccaagaaaaucuuacugacaacagaggcugaacaugacaaaggcagaagcgucuaaauuuucuguaauccuugucuucuaauugagcaaccaaugaaaugaugcauauucugcauuauugugugucaacacuuggagcguugaugcuugaaacuuacccuguuuauggccggauacagauaaaucacuguguaccaaauucuacuacccaucuaaggaugccccagacuccagcggucaucugccuugcuuccccacaaauauuacauguccuuucucucuuuaaaaaugacuuccaaaguuuccccuuagauacagcucaucacuuauaauacuaagaauuuaaugacuauggaaagguacagauaagggacagagaggaucuugguuaauuuaacaauggucuaaaugagaugaguaacucuucucgaauugacagaaacauucagguuucauaaaauucacccccgagccuuggucuucaggguucuuccacuugccuuccugacccccaaucccuuauucucccucaucccaccuggguccagauauaucacaauuggucagagucacugggcagugagaaugauaucacaacucaacuuugaagcagacgccacaaaaugacugcuucaacgugauuggcuauagcucagacagcaccgugucagaaccucgugguucuguggaaaugauacuuuucucaaggaaacacuggagaaguggcauaaacacugugcaccaaacaccacgcaacacagcauaugacucacuguuccaagggugucuggacauuuuagugggaucuuuaaauugccugagucaugguguuauauuauacccuucuaaauugaaugaagcccccaaggucauacauuuucaauucuucaguaucucagcauacugucuggcccuuaguauaaaaggugucaaaagcguaacuauauguugcuagcucuuacgagcaguaauugcagugaaauuaauauugauagagugaguuuuuaauaaaugguaauaauaaaaaaacuucuuuucaccguaauaaaaauacccugaaaagguaacuuaagggagaaaggauuuauuuuggcucacaguuggaggaugcaugugcucacguacagaggucaugaggcaggagcuugaggaggcaacuggucauauuguaucuacagccaugaaucagagaauagcaaaugcugugaccacuuggcuuuuucacuuuuaaacuacuucguguauaugcaugcauaccuguggugauucaauaugcuuggcccagggaguggcacuauuaggggguguggcuuauugugcuugauccuuuuaacagcccugcauggugaauggacagcuauguucuaccuuccccacacugacaugcugcuaagcccuguccuugguaccuucucuuacgucacuuuagcugacuugaauuaaaugguggaacuagacacaugaaaggaugaaccuuuccaccuacaugugugugugugugucugugugugugugugugugugugugugugugucuauguguguaucugugugucuguguguccaggcaccauggaauccuaaggagaccauuagaucccuuagauguagaucuauaggagauugaaagcuacccuaugugggugcugagaauugaacuuugguccucugcaggaacaguaggugcuuugaaucacugagacaccuccccaguccuguguguuugucugacacaaguuuuauauauccuuggcuugucuaggacugccuuuguagaucagggauucuucaaacuuucagcagacauuuccugucuuuguauccugagagugcugggauugcaggcaugcuccaaugcagccuccuucccuucuacauugaaauucucucugcagcaugcaugagaagccugucaagugaaugucuggcaccucuguauuuucgagcauuuagagacucagaaauaauaucauuccgggauagaaaaacaaaaucaucaccaacucccagaugcaugugggauuuauuuguuuggugggagccaaggugcuguucugauuucagcgugauaucucucuggauaucacaacaucacugaaaccuggcaagaaaguaaauuccugcucgaugcaggcaugccauuucuaaucgguucccacuggacuagaugaguauguaaaugcaacacauauuuauuuagcuggaagaauccaaauuuguaguccaauggucuguuaacagccaacacaugucaccaaaagggcggcaaacaagacuacggagaccuuuugccucuuccacuguccucaaacagcuccagcuccuccaggucacaucccagucagucggccugcuggauggaagcugcgcauaugcauccugggaccgagggguuugaauuuaggaacguguucgcuucuuuauuguuuugccuaaugauccuucucuggaucuaugacugaucaguagguuuguagaaugaucugcuuggacacagucacuuguuuaaaugaccuuuacauugccuuucacugucacuggcuuucugugacacucaaacucagcauucuccaucauuuccccccugacuuccccaucauguccaguuuauaaggcagagaguagcuucgcuuaauuccuggacauuccuaguucucaacaacaaaagucaguuaaagagagcauuugucucuucucuuccacugugaauaauccagucaaagaaaaucuuugugaaaucgggcaccuuuguucugauuuuaacacuagaugagguuucuuggcaagaccauuccugugaugcuguguccaagucaggaaugagcucauaggccuuccgucagggagucugucagccugcccuggcuggcuggucuccuguagcauguuucccagaggccugauaaaaagaggaacuguacacacugauggcucugagcuagcauaggagcuauuauugcagagauggaagcuccuauaucuugauaaaaugaaucuggauguuaguguuuaagagggcacacugcauguggguacuccuguuuuucacaagcagccaccacccugcccuguguacacucauucuggagaaccacagcuccccugagccugcgcagaaucaauugucccuuuccucagcuggagcagcugucacaguuacuguccccuauuuauaauguuggcaucuauuugcgcauauaggagauacuccguuuuguguucagacuucaaacgcagacacuucaaagaugugucugauugucagaguaucagcucacccaaccugagccacuuagaacaaagcaaaccugucaaucacagccaaguccacuucaauccacaggacucuagaagacauccuucauuucuuuauccaauuaguuacuaaaugugaaaggauagaaaauauguauauuucacagauuuaggagaaguucugaaccauggcuauuauauugauuuauuuagugauaucauccuugugcucguggagaccaugagauauggaagcugugaugcucuucaaaagagugagcuugauucagaaagguccagccacuucuagaucccauguuauguguauaguguacagccacuuaccuuuaucacaggaagaaaauaagaauacagaucaaguguuaggcagcaacacagcagacaucuaauggcaaagugaaggagggggggguguuugcuuuauuuggagggaaggagaaguuggaggugaaacuguccuuguugauguacagcucaggguagccaggcuuaugacugucaacaguaaucaaaacaaaugugaccacugccgaccagcccugggcuugaagcaagagcucgaggcucccuuccaaaacagcaauuugaaaaaaguucagggacuuuccucuucuaauuuaagucacagacauccugagaacugugcuuccgcuguguggugauacauaucugaaccguuugaaauagaaacccccaaaugccacagaggauagacacuaacauuuuauguucccucucacagcccagguucccagaauucagucugucgacacagacaagggcacuaaugugacuguagaggacauggcaugugguccuauuuggccaaugcccagcucucugggagggaccaagacaccugcuucuuugccccugucuauuuauauuuauuuuuuaauguaaguccauuuggguuuuguuguaguaaacauuuaaccucaauugaggguuucuaccccgucuuugaucauucaguucucagauaaaggacacacaaccuuuauauuuauauccccaaugaaggaucuagagaaaagacccaaggagcuaagggguuugcagccccauaggaggagcaacaauaugaacuaaccaguaaccccagagcucccugggacuaaaccaccaaccaaagaguauacauggagggacucauggcuccagcugcuuaugcagcagaggauggccuuguuggucaucaaugggaggagaggcccuuggucccaugaaggcuuaaugccccaguguaggggaaugccaggacaggaaagcggaaguggguguguugaugagcagggcgagugggaaugggauaggagguuuuuggaggagaaaccaagaaaggggauaacauuugagauauaaauaaagaagauaucuaauaaaaauguaaaaaaauaaaagggaaauauaaacacacacacacacacacacagagaaaacaagaaagaaaccaaaagcacuggagcugggcagauaucuacccuauguguuauuaugucuacuucccuaucaauaacccugaguuauuacuugcuauauuccaucugggcugcucuuaaguccaauuggccagcccucauggucauauuuucaugacucaccuaccccauggugucuucucucuccaccuucuucucucuccccuugugguccuccucagacacccaguccaagaauugaagcuccaccuuccucucuccugcucagcuauaggcugucagcaccuuuauucaaccaauaguuuucaauuaagaagcaaguucacauagcauuacuuuguguaugugcagauucucucaucccugggacaacccggccuuggaggucaguauguggcgucacaacaccuagcaaaagaccaaaaccccaacaguguuuuaucauucugucuuugcaaaaauagcuugaacaagucgugauguaguauggauuuugcaugucagaaaguuaucaucuuugauuuacauauacauuguaagccagucuuaacauaucaagccuaugcuugcuuagugucucuucuaugcucuguaaacauuagcucauaaaauacguguaugaugccguacaccaaugaugccucaaagacaucuccauacccaccagccagugaugcacucagcaacuguucauccagucuagugguaccuauugacaagaucugugacucaaaggucacagaugggaaaguccugugucaaucucccuucgguucaaacugaguuuuuucauauccuuuaaguuauuccugucuuauccaucccugucugugcaagaacuuauacaaaucuuaaguuuuccacuucucuacguuuuggaacaaaaaauugagacgcuguaccccaacagauacuuuuugaaaguguuaggaaaguguacacgcauggauguggucacacgcacaugcaaacacacacacacaugugaauauacauaaacacaguggauuuuuugaugaaaagagcauaaauaugcccccuauauuucucagaaauacuuuaaaauacacuaauuucuuuauuacacugcccuucuucuccucuugucaagccgcagacguacuuguuuauuuuaccugggcuagaaaugugugccaaugcucuguaugagggacuuugccaaaaaccugucugaaacugcacaaugauucacaggaaagcugaaaccacacugaaucuuacucuuaucugcauggaagacaauacugugugcaauaaaacauuaucauccaguuuccgcugcccucucuugacuuucugaaaaaguacauaaacuuugucucaguuuuaacccuguaaguuuaaagccuuuuauuuucuugauuaacuauuacucaggcuuuuauuuauuaggacagugugugugugcacgcgugcauguguguaugugauaucauaaagaaguaaauaaacauauaucuauuggacuaaaaagauggaauccuagauuaaauugaaaagaaauucuugcugcgggugguguuuggaaggcucuuauuuuauuaaugauugagaccguuucuguuuccauaucuuuaguuuccagccuccuucacuauuuccccuaauucaagguucgggaagaaaguaaguuugaucuccugguuuuaugaugaaaacuaagcaaaacacaaccaaaaaucaaaguuaacacuaauuuggaccaauaccaauggcagacaccucaccuucucugggaaacucuagaaagucacuggucagcugacucugcuacugcagagggaaacuuccuagaaaccuaugcacugagcagaaggcucccaucugcucacuaaauuaauaagaaauccucaccagagaaaccauuaaggaacuguuugccccucuggaaccuaagcccuuugauguuuauucuaagugcaaauuuuucuuuccggcggaggagacuggauugcacacugggaagagccugagcauaggagaugucagaacccacccccacagugacacacuuucuccaacaaggccacaccuccuaauagugccauuccccuugggccaagcauucaaacacaugagucuauggagaccaaaccuauucaaaccaccacaccaugguuccaucuacauuuagccucaauuagcacaaucuggaaaauucccuccaaggugacucuagacccuuucaaauuaacaaucaauauaaaccuagucauaaucauuucaauugauuuuaugcucuaauaaugaguuaugauccaguuugaaacagcacccuggcuaacuugaauaggauggaaauaguucagcaugacuucaaaggcaggagagucuucugccuauguuacagcuacaguugcugaugcuguuguuguaggugcuaaguggacaguuugauagcuagggaaaggaaguggagaaauggaagaagguaucuaucaucauggcuuggcagaaaccaccuaacuucaguugcgauaucccaagaucucccgcucuccuucacacugaccuccugucugcuccaacccuuuguucucucugcacaggaugacaacagaguacccaagccacuauggggaagacauggacaugauuuccuaugacuacgauuuuuauaugcgaggagcaacaaccacuuucucugcaguggaaaggugagagagguaaccccuguccagugaucucagggcuggaggcugugcagauucacuccuugcugggguccugacuguggggucuuuuaccugaugaccccgauaaucuaguuuccuacuuagucaaggauuagcuguggguuugguuaggcggcgggaaccagugagaagugagaauucuugggaacuugccucacaaggcagugugaccuugccaagaaggacagagaccaaccuacugaaguaccacugcagccgugaacuuggcaugggcauuccuuaauguccuaaacaauuccugcagucagccucagacacugcuugcaugccaaggaaagguugagauggcuggaagggcauucgcccucaaacuggauccccuucuaguccugugccuuugugugcuccucacuuagaacuguaggaaaggaagagaagaaaagaagaggagaggauucacaaggaagaacacacaaaauccauucucucacuacauucagucuggucuaaugcaacauuugagacuagacaacuuauaaaagucagaacucuacuguccacagucccagagacuuggaaauucaaguucaaggaagcagaagauauuuggcaagggcugaucuuugcuuugaagacggacccucucauugugucuccacacaguggaaaauggucuuacugcuucaguuucuugagggcuaggauuacaagcauaguugguauacccacuaccaccucggguuuccaaucuaagcacaguagauugugagguuccugcuucccucagcacaugcucaugcuuggugugcaugcacacuuccccguaaguccauuugaaaagcaggauauuuaggguuguuagagggaggggaguugccaaagcccauggagcuaguaagcaauucaaucucccaugaucucaccccuacccuuauacaacauaagcuguuguuacaaaggcacuaauacgacucccaaggacagcauaauuuuacauaaucagcccccaacccuuaccucuuaguacuacuuaguucuaugauuacuuuagacacuaguuuccagcacacagauuuuauaacagacauuaacaugcagaccacagcaucuaacuaaucauauuuagaaaugaaaagggaggaaaucauuaugugaugaagucagaauauuucuggaguaaaaagacgaccuaaguaacucaagaaggaaaagcacuaaguugcacuucggcccugcuucuccccucauuccuuucugggccucucccaaggacacugaaaccauaagaaaagaagagucaaaaaauuccuguagauaagaucaucauauggcucuuguguuaucucuccauuaauccaugaaaaaguauggagaaaugcagaaguuaagagaugaguugacuagcuuucacuccaugauaauaaugucacacaaaaaugaauucuggaagauuacccacacaugcuuugcaaaccaaauaaaaccgaaagccaauccucuaacgggcuaugagcuggagucaauuugagugccaucuccuuuuguguauaugcuuccaaagaaaguugcauuucacuuagcugcaguuaacuuauuuacuaugaaacccacauuuuaaagacauaaaaauagcuguggaaaagcacauugucuuuuccagguuccauagacaaagauucugguuucuucacagaaggacaccacaguuuucauauguaacuggucucuguuugagauuggguuuuaacuuacuugguuaacugcuuucuaaaagccacaguuuagaagaggaggaauacuauggauaaacucagccaaugaggagaaacaacugagugguaaagauacuuaagacgagaccaacccaagaacucaaagaauauggaaaucuaaugucauugagcaauaaagugucugccaaaguucaggacacagugccaguaucaagcauuccuaaagauucccgggguaaaggggaaauugguccugaguuuucugguuaaaaauauaaaacaaaguggaaacauuaaagaaugaaugacuaucaccuaaaauuggugcuaaauaaauauuuuuuuggcagccaaaauggccaauucuagcuggcuuggaaaugaucaguuacauaaauuguacagaaucacugaagucugaggcuuagugucucuaaauuauuuuaaaaugacuucugccucccccagauaaacauaaaauuagcauaaauaaaauuagcaugcuaauuaauuaguuuugauucagucuucaacaaucagugguuuggaaauccacaguuuuaguuuguucauuuccauugaagauggggugcuuacccccaaucccauuggacaaaaaccagcugagcaagaguuucccuucuggaacgaaggucacuugucuauguccacuuguguaugggaugguuucucauucuggggacagaucauucuuccuugcaagggucuguucuaugauucuagguguuagccccacccacuaagugcaacugguaucuaucuaccuacagggugacaggcaaaacucuuugcagccauuaccaaauauaccauggagucacuuagccccuagaugaaagcuacugucuggcauggaaaacagaaccaagguagaccccccuugauucuuuuaggaccaagucuaaauuuuucucaacuucuauuaacugccucuuaaacuuauaucacagaugccuggccacagggccuuccuuaccuucuucaugcauagaugcgcauuucuuagcugugguaauuaaauucacucucaaaacacacuguaccaguuuguuagucaucuaaagcaagccguauccucugugggugauuuuuacaagaacaaauaucaauacacaucucauucccccaggcccuuaaagacaugugccggagaacacuauccccaguggcacugcauaggacacgcuagaaaaacagacucagaauuagaaagcuugccuugccuugggcuauuugcucaccaucccccaucccccaacuccaaauagcacagucaucccacauacuuccuucccauccagaaaccagauacuggagcugucagccauugguguuugguauacacuggaucagaaaugagcccagcagguucaaagagaaggaagaaggacuguacuguggaagaaacugcucagcugaauauggauaaaguaguuccacucuuuauugggauuaugccaagagcaugacagcuguguccucugguggcauuaaggacaccuggcaagggaagcagcaugguacaagagaaagaccaauauuugaguucagcaccuucgaaaucugacagcaucaccuuucacugguugguaaucccuuaaagcaaguccgauuacacuaagccuauuucuucacaaaacaaugagucacaguggggauuacugauaggacagguuguagagcaucuagugcaggguugggcacauuggaagcacuagggacuucacaaugacaauggucgcugucauaguuaaauaguaucagaccgcaggagugcugggcagaguauauaacucccugcauucccauuaagugguugaaaacaggacaugguccuaagcuuagcaaacagcagguaucugcaccauguuuuccaaaacugaacaguucugugcccucucaauuuuauccuaucacuuaaauaggcuauuccauuucugauaggugaggcauuuucuuuucacauuuuaaggugccuugagugguuucccacucaccuuagaugugguuucaaaggggaaacacacagugcaucuccuggagccuggcauauagagaguccucaggagaaaggaaauauuaugggaaauugcauuaccuuuuagaaggaaaauagauucuucaccgugaaauagagguagugcuaguaaaugcugaacuugugaguccuggauguugagccauggaggacugaccaccagccauaguaaaacccuccaugugccccauuaccagcaacgggcaauccaaccucacagauccaucaguucucuggagacuuuauugaagguuucugagaacaaggugagaaucuccacagcuccgaauccugccaaagcccaucagugcuuuuccccgggagccgcucuuucuccacucacugacauuuccuuuucuggcgcuccuccuacagggaucgccaguggaaguucaucaugugccggaugacugacuacgacugcgaauucgaaaacguuuaggcucgccgcguacagaaguccgggugaagggucagggcccagguguccugagggugucauaucacauauguuaauauugauuagaacaucuacacuucuuucuuuugcucucuucccugggaugggagcuauggugucggcugccuaggccuuucucaccacgaucacacauauaaauaaacucacaauuaagccauguuucucccuuucaacacauuccaagacaaucaugucuaguugcugauggcagcuuccuugcacagcacauguacagagccugcaugcuuacagccugccacccggagcaccugucgcagccuugcugugauucgcacuauaacuugagcuucagauucagcuucgugaacuuggagagaaagaaggagcuugagagaggugggauaaagguucucuguagccaagucuguuugagugacagcaccuagagaccucaccuggggugguggggggucacucucugucuugagggaacacgucuacucucuccuuccacaaaagccacauagacuuagaaguucaaguaaagaucuaugugcuucagaagagaggggacuuggaggugaaagggggaggugggaggguuugaggacugagcugaaagacuuuagacagaaagaacguccucuauucaaagauauacaccagcagacccaacagugagaaugaauaugagggccaggaaaaccugugcgaaucagucucaagacagaaacaaugaaagaaagauaagugaaugagauucacauugggaaccuggggagacaagaguggucagaggagaagagaucuuggguuaucagcagcuugagacacacccaguauucauaugaagacuguaauaucccuagaagccauagggacgccaucucuggauugguccugaaggauaauucucccuuucccauggcacuugaaaguguauucugcagagaugacacuguaauaucucugucucuagccauuuguaccuucuucuuuaaaaaaaaauaaaaguaucaauauucacugugccauaaauau

SEQ ID NO: 476 - RNA, 20453 nt, Mus musculus
cucugaucaaggcucaaauuuuauuguugcgacacuaguuaugaaggaagggggaggagacccgauucccgccgaauaaucucugguccaguagaaaggugcacguguguggcuccgcagguuccagcaguggguguggcagaccgaaugagcaggaagcuccaccccugagcaagcagguuucaggcuaggggaggggagacuacagcaacugugugugugcguggggggagggguggguaggagguuaaacaaaacuacaauguguacuguacaauaagacaucauccuacagucguuugcuucagugagucccagagaaacagacgugaguaagagacaacacuacauuuguuaaggaucauaaugcuaccauuuauuggagaaaagaaaggggaggaaacagcugugcaagggagagguagcucuccccagcaacacucuuucucuaugaagggaggaaaacgaaaccacaugaaccagauccucaagacagaaaaggcaguauucaagaauauauuuuuguauauaaaauuucaguuauacaauccguagcauucaaaaucaacuauaccuacacaauuauaaaaauuguuuguuuuuuuaaacaaaauguuuugaaagcucacuguaugagaacaggcacaauguucuaaaggcauacaaauccaccaccggcauuugaauuugguuuuacucccagggagugugcccaggugcccagggcccacacaaggaagccagugccuucaucaguggcuucugcacacccucacuggcaacuucacagucagaauuacaaaggacggaguccagggaggcuugcuuuguuuaccuugccuuccuuauucaagguaaagcaaagacaaugaaaaggccagaaaaaaaaacauuuuuuuugaacauuuaacagauggagccaugugcauggguccaaacaccagacuuggucuuugauuauuauuauuauuauuuuaaagauaggguccaauauacucuagguccuccugccucucucuaccucccaagugcugggauauuggcaugcaccaccaugcccaguguaugcauuuccagggacugaaccacaggcuccaugcuaggcaggcacucuagacauguagugccauuguucugaguacagagcaugugucaucauuuguucugaugccaugggcugaccucucagcuucaacagaauuccuauauacugggccuauuuuucucugguuucagaucagccaguuugcagaaagccacucugugcaucccgagucuaccuugucaguuaccagcuccugacagaauguaucugacuugauauugucagcuuauaugaaggaaggcucugccaccagcuaauuucaaaugucucccacagucacagcagggcuggaaauacucaaagcagaacacuccaccccgagcaaacugggauuaaacaaacuccacugcguucccccuucgcuagccgaaaaacacacaagaucucaaagcaaaacgugaacuggcagguacuuuaagaucacccccuaagcaauccuuuuaauaaaacuuccuaagcagcuuagauuucuaggggaaaauguauauuugcaaugaacuucagcuaagguucauucacuuuuaaaaggauguuaucuauaagcacauuauuaaacuuauuaaaaaaaaaaauacuugaacaguaaaaaccaaacugccacaaagucuagcaggcaucuuuauacugcuuuaaacacugauuuuauuuuauuuuuaauuaacuaaaaauaaguuuuaggcuugguuguaauugacucuacugagaaguuaccagaggaagaguaaagucaggaaguaggcagagggugcacaaaggaaaggaaauccacagccaugggugcaccucgacugaccaauucauuccaccaagucucaucccgugcacggcaaaaccugucacucacggggaucccaacaacaaaagccaaaccagccccgcccuucacauccauuucagauacugccccgaugcuaauuauuuauucuaaccaaaguauuaaagaguaaucguauauggaaugcaauucaugauuucauuucuuguucucucagccuacggugacuauguggaagggggguggcaauuaaggcauaauccacaaagucaccaugagagaaacagacacccaagcacugaaaaggccaagcuggggaugcaucucacccuuccccaagacaagaugccuaagagcuggggucugagcagcagccacacagaggagcaggagagacaaaagcugccuuaggcuugaucugugaaaagggacagugagagacaggauucaguggacaggcccccaccccacagcaucccaacagucagccuggaguagagguuggaccagccaaggggauccgaagcuacucuccugguccagaaggcacaaugguguucucagugaagcacuccagacugcagcccagggaaggcagcaucaggcccacaccuggaaaccagccuggcugaggaccacacugccucuacagugaucacucaacaguccccauugguuggcaacacagggaugcccugcuccaugggugugaauggggaagaauugaggguagggaggagaaacagauaacaccaacagccacagucagaggcuaguucuccacuucagccucacucacuaaguugcuuuuaaucaauacuacuggcuugguaggagacuuuagcagauaugaaguggcuuucuuccuucuauaguccagcaaaagcagggucagaaacaaccuaggguuaaggcaacugaaaaaaaaaaucugagagucuggaagauucuggaagacagucauccaaaaacugcuuaaauguguccagacacaaacuguugaagcaaacuggccacaggcuguaggaauuaggccaaagccuuuuauccagacuugaucucaaccuagaccacccucacugaggccccugcuccugggaguuucugagaccacuacuacuuuaugaugaaggcaguuauccguugccugacagucacugugaccauucagugagacaaugcaugacagucuacagugauggacacagaauaugcuagacaaacugacaggcaggcacccauccugucaccuuuagcacucaucaguuaguucauggagacccaacuugcugugccacaugcgccccaagcccuugaugcauucucuuccaccggcauccuccagugagccagcaggacuugucagcccacuauuaggaaacagugaaacugaggaaccaaacauuagguaacuuccaaggccuccaccagcaugggacuggaccacaucuggaucaccagcaugggacuggaccacaucuggaucaccagcaugggacuggaccacaucuggaucugcuuauuuucuaagcccauguucacacuguuaugcucuucauccuugcuauaccaucuuuaaaagauaccugggcucaagcccagucccugacaagggcacggagaggucagcuuuuuagguacauaacuacaaggcgguuggagcuugcagcaaugacccuacuccuccugucagcuaggauccauggguuucccuaaauuucccaauggccguucucacaucugagcccuucugagcccugaacugauucccaaggcuucugggacaugaaugugccucacacagccagaggguagcauguaacuuugcuuccugacugaagaccucaucgaugccuucaacagcauggcuggaaucuggaaagacugagcucccuucugcccuaauucugaucagccuauccacaguucuccaucucagaagaaaagacagucauuagccacaguucagcaacuggcaacaaccgcagagaugagugcucucaccuccuguggucugguggugaaaaaacagaggucaaggcuggcccugagcaaagggcaaacauagacugccaggaccucaagcugucaagacaggguacuaaugaugcaagggaugcacugagcagcugaaagggaccacgggaugcuggccauccuacagaugcagacguagcugccaaaaagcaaaacgggggagcggguagaagguggcacaauugacauagaugcugaaaucagaaaagguacaggccaggaggaugaaaggaacaguuaugagagacgacagacgcucugaggagagccaugccaggagacucagugucaaaacagaggcugagagccaagccacagcuggagcugugacacagaaaccaaccugagccccgguuccuugacugcaguugagacaacucauauggcucucaugaggaccagaugagguccccaacacaagaacgcugugugugguuaggcacuaggcugcagcaugcccaccuacaggcugacuacuaguguccagugcaggcugagagucaacgcuggagcauuuagguugcuuggcaggcaugccuucuugcuggcccacgagggaucuuucuuccauguacuuuccuuaucucaacuccagcaaaggacagaaaguaaacauuuauaaauaaugagggcaaauaaacaaagcaaggaacaugaagauguuucacuuucuaauggcucuuguccgaaaggaaauagcuuuuuaggucacuacuucacucgcaauuaaccggugucacaagacaaaacaagacguaggagguaagggcaagagaaagaauccacauugaacacuaaaaguguauuucauagccagcugaguucagaauagcaagacggugccaugcagggaaaggaacaauguaucccgggcaggcucuccagggucugggcagaaucacuuguucucaaacagcagggaagacgcugugcagggacuguggcaaugguuuuccuggugaggggcaaaucuucaaaauucuguacuuccugcugcuccgcuagaagcccugcuagaccuuccugcugccaccugggaaucaguugcuccugaggcugaucugcugcuaccagacaaagcugcucugugagaagucaguggaauaccucccagagguuaauggucacaagaagaguugucuacacaagccacagagccucggauuguguuacagacauuagggucuaggacucaugacuauucccacaggcaacccucaaaaauguccaaauugcaagccacacaccgcugcaagcagaaggcacgugucugugagacagagguuuagaggacauuuacagaauuguccaccagcuuccguccacggugcucccugcacacuggcaguguguuaugcaagacacacagcaaagcacuucuucacggcaucccuaggaaggaaaaacacagaaaugaaugggaaggccaugagcacucaaagaucuucuuugagcaucucccaggggacagugcugcugaggggaaacagggaggucgggccuaugacaucauuaagguguagucaccagggcuguucuucauugcuggcaagcagcagaaggcuuugaaggaacaucuucaggucccgggcacaagaugugugcaggcacucagcauugcuaacaggcugcccgggagucaguguaacucaggaaagcaaagagugggugcucagcagauggcuuaucuguccgagcagacccuucucuucauuacacccagcuggguaaggacaucuaagcucuuacccucacccugcuccaaguuugacacuguguucuugguguauaggaacuaaggacuuggggggggcgggggggucccaugaggcgagugaauccaacugccugagcaggcaagaaauuuuaacaucaaaagccaucaaagaguaaugaaugccaugguggcacaggccugagauaccagcacacagggugcugaggcaaaggauuuuaaguuugaggccuacacagagaauuugucuuuaaaaaaaaguuuuguuuuuaaucuaaaaagauucuagugaaagaguuuaaggucugcuacauacuaaagucccaggaguauucuguaaagucagggggcuuacggcuaaaccccaaaccaggucccuuccugcagcaugcuaugggaccugggaagaugggcaacaggagcccaccuaauuuugcuuaaucuauuuuacaaacucacauugucuuacaacuuuuacugcugugugaucugcucuguggacacugggaaaaccuauucuaaaagccacacuuagagcucacuuugugauuucucccuaguaaaggaaacaucuaucuggcucaacaaaacucacuaguucaaaaagaauuauaucagccaggcgugguggcacacuugggaggcagagacaggcggauuucugaauucgaggccagccuggacuacagagugaguuccaggacagccagggcuacacagagaaacccugucucaaaaagcaaaacaaaacaaaacaacaaaaaaaaaauauauauauauauacauacauauauaugugucucauuuccaucccccauacaugcccauccugaucaauucagaaccccuuaaaaagacgcuaaauaacuccaguuuuguggguaacuaugacugcacuaggcucugugcuuagaaagguccacucugguuaauaccuugauagcauaucuuagcccuggcuguccuggaacuugcccagaagaccaggcuggccucuaacucuaccugccucugccuccugacugcugggauuaaaggcaugcaccaccauacacagcaagagcccacauuuucauuuuuaccgggucuaguaaauuauguaggcagcugaggcaccaagauauggucaaacuguugccaaauugauuaauacuucauuagaugcucagauaaagaaggucuuggcuucuuucacacagcaagcuaacuccugggauaucccugcccauagucucagaauaaguuucucucugccccaaaggcaguauuucacaacugugauaccccugggaccugugcaugaaaguacacuuuaauuagcuuguuagccucacuccaaaacaccuucaaaucaccaugagcaguggaccuggaauguguaagucauaauguccuaccucuuccccagccccugcacaaucucucauuuccucaacacgauuauggaaaacaauuuuauuuaguagaugaccaagaagaaugaaauuaagaggcuucauucgaauggaaucagaggcaaccguccuguggcuaacugugaaaagcccaccaucaaaagugguuauguaacaaacucccaagccucuggggaggcccagccccacacacuccggguaucaaugucugcucugagucuugguggucuggagccaccaaccucacuaacugggaaacacugugccccugugguccugacccuacuuucccuucagacucuucugaaaaauuucagagugaggcccuguaagaaaacaggcaagcacuaggaaccccacagcucuuguuuaguuacacuaaacugaucaccuuucaaaucaucaccucaaagcuacagauuaaaggaacaccggugugcauccaaguacuuuccauuagaggagccugcccgaaacaccaggaacucagucuggccaacacaucacuagcuaaaucaugauugcuaaugagaucaggagacgaguggcccuuaccauaccgguagaucuauaaaacagacgugugaacugugccuaucuagcgcaaagaauuuuaguaaagacagauaaagaacauacguucucugcaacuaaacuaaaaucuccaaacuaagccccacaaucaggagguggagggaugguccaggagcuggagggauggcccagcagcuaagaacacugcugcucuuccagagaccccagguucaguucccagcaccccaaauagcagcuuauaaccauuuguuaauuccaguuaauuaaaccccuucuucuaaccuccagagaaaaugcacauacaugguaaagagauauaccaugcaggcaauauacacauuuaaaaaauaaauaaauaaaccuuuuaaaaaauuaaaagccccauguaaacacaucaugguuuacaagucaaagaaaccauauauccaaacacacagucuuaccuugcauacgguauauaggaaaggcuauaccuacaaagaaaaacaaaacaaggauugaguugaauggaagccauggaaagccuccagcagaaagcucccgaugcucugagagcacccagugauugaucccgucgugugcacucaugugugugcucacacuuuacauaaacacugugccugcccugugaguagcuauguggcagaggagaguaaggggcccauauaacuacaagccucugaccuuagcuuuacuuguggcacuguuuaaccacaugagccagaagugaccaccuaaaccaggcaggcuccaggugcccauaugguggcagaguucgauuuguagaaaauaaaaauaaauuccucaacaguuguguucuaaugcuuuauaaguucccaagagaauuaacgucaaccugggugagaucaguguucuaucccugcucccacuaauuaaaaaaaaaaaaauguagcuuggcucaaaugcuucaagaacccaagccacacugccuguaaggaaaacuacgcgggggagacaccugcccuguguguuagacguagacaaguggcgcaacagucacuucaaagggaaucaccauuuuccugagcccagaggaaugcugaguccuugagauuacuugagaaggagccauguauauguagaaaccaauuucuauagccagaaggacgccagagaauaaacgcaagccaucaggccaggcccuuacuaacgucuacuggcaaacgugucucauacuaaaaccaggugccaggcuccugcaugucucccucuucccagguacacacacuuauuuaccugugagcauggccaauucugaaaggcaguuugacagaguauaucuucacaaguucaaaguuccaaaaagaagacuagaucacguuuacacucucaagauccaugucuacuaaugagguaaccaggagacguugauuuagaaugcccacugaccucccuugucucuguauccuagcagacauuuuauccuaaguagaaaaaucacacuguacugaaacuauacauuguuacucauggauuaaacuuucagagcaacacagaaauaccucagauuagauacauaccaccccacucacccccaucucccuuggauguuauaggcggguuuaaauaaccaaacaucgacaguuccauucauggcuuuaaaaggccauguaucuggucacccuuuagcuagacuuggccuuugaguucccugauauucaccugaagcuccccggagccacuggccuccagggagugugcuaccaccacauccacguggguuucacuggccagcuccugcucccuuggcucggcuggcaaugcccucugucuuuuuacagaauacauuccaucacagucacugauuuucucaccagcauccuucucugcuagugccuguuugacuccuggccucuuuuuauaagcuccuguaauacuuucauugucuaggcacuuaacagacgugaguauauuuguacaucucucaacuaaccgugagcucaucaaaaaugcugugaccacaaaugagcggccucuagugaccgcucaaggaggcuaacaccaccuguugguggugggccgagucagcuggcuggcuucugacaccugccuuccauugcaauagugacagaucuucaauucaagagcuucuggguguuccuaacccucccauccacaacacacagguucucccucuuuucccuccgugagucagaggcaggacuggggacaaggaagggacacugaugucacuuaccacgucaaggccaaagacugcaaaauacagaagaugagugcaagucccuuauuccacuaagagaaaaaugacacaguuacuggaccaggugugacaagggcuauaaaccaaaaaggucacagaagacgaaaguucacacuuaccaaaaaggcagaacacaggguaagugcaaaacacagcuagagagagacaggaaacacucauuaauacaaugcagcucaaaacguuuaacccauccaaaccaccaugucaggaaaagagauccaacucaacuauaaaaaaugugugcaggaugaagaaaagaaagcugagcuucuacauuucagcuuucccuaaaugucugcaaauaagagcaccuuucuggacaaguuguucaaccaccaaccuucucauucaagacguaagcuagcugaccacaaaccucugcaauuuagcccuugucaauucuagccuccagaggaaaugcaccugagaacaaaggucaacuugagaugucagccucacagccaggaagccugcuaucaguugaccugucaccugacacuacacuauguccuuucuuacacaguuuuuccacaacagcuuguuaggccaucuacaucugaaagcuggggaaaaaaaaauagguguuccagccaccuacugcuuucugcucacucaccuauaauuccuuaaucaacgugcccuaagcauucucugugcccaucacuguacucugaaaggacauaagucaacggcaaauacagucauggccugggagaacauccuucuaugaaugaaugagagacgcacaagaagucaaauuuaaaguaugcugaucaaguucaaaucccacaauacugauaauuaugcuaggaaucuagagaauggggucuggaaagauuuugaaagcuauauggauaacuuggguaaaaaaaaaaaaaaaaaaaaaaaaaaaaaaagauauagucuguguugcugggauagaaauaaaaccuuccagucguacauggcaguacuggccugagaucuuagcgcucuauaaagccccgucucaaacagaaaaccucaaaggagugcagcucagggguagagcaucugccuaacaggcauggggccauguugaauucccaggguagaacaggaaaagacaggccaggcuguccucuacagagaccccguggaaagcagccuguccuuaccagcaccagaauuguggcgaugagacgcguaggcucaaacaugcgcuucagcugcuucagcggccccaugaggaagacgguacuaagaggcaaacacacaagccguuaggggcagaucagagccacaggaggcagggcagccaccuccccaggagcuccuguggccgugacaggaacaguauuagugugaacagcuccugccaggcacuggacuuccaggccuuuugugcacugcccucguuuaauucaucaaggaccucugaaguagggacaauuaguacacucguuuuagagaggaagaaaaagcccaggcgguuacauaaccaaggucacccaacuauguaagagcagggcauaaguguucugcugcagaacaacucucuacgcgcugcacaccacccucucugaaaggugccacucugccucccugacuaccuacccagagaagcaaaccaugacucagacuuaauaacaucuacuacgguugcuggugugccagccuacagccugcuaagugccagguguuacagacaguacucauuuaguccccucaacaacucugggcuggggguuacuguaccuaucugaucacaugggaagacaaagagcuagcgcucagcccacaucuacucuggaggccccauggugugauuccguaugaagggaaugccagaucucgcuaauggaagagcuguaauaagggaagcacuugugaccuaacacaacaagugaggcaccaggcuucagucacacuuccuggaucccaaagaagugcccaaguagcaaacagugggagcaccuuacaagugacacucaauacaagggacagcaggugacaauaacuacugagcauucaaaaaaaaaggcaguuuguuguuguuguuuacaauauguuugccucucuuugaaguuaagcuauuuucugagcucaaguguccaggcucagaaauuucuuuaccuaacaaaguaagaagcagacacaaggcacauguguauaaauagaaucuguauaaggucagaaaccccccgugacaccaaaaaauaaggcccuuccacugcuucccucugcccugcuauggagucugucccauuaagauaagcucuuuuggaguaagcacauacaugugcaauuaugcucacaauagacuauacauuuaaucuacacuuuaggcccaaugcaaacccacaaaagccgguauuugagaaagcuucaagggcaacaucacugagggccagcaucuuacucaaaacucaagguuggugaagcuaagaccaccuggguauggugacacacaaacgggcagaucucugugaauuucagaccagucuagucuacguagugaauucuaggacaggcagggcuauguagugacccugucucauuaaaaaauaaauuaauuaauuaauuaaggccagaucauacauuccaccaucuaccuggcucugcuggguaggaacagugcuggaguuuggguagaacugcggacaagugagguacacaugcaggcagcccuugacaaguguuuuacaguguaaacaagucauugccaccugugcugucgugugaguauagcuaggacagaaaggagcccagaggaggaggggagauugccaguuccaggaaggagacaguaagcagcaaagcuucacacaugugcacacacacgcaugcgugcgugcacgcacacacacacacacacacauacacacauacacacgcacugcacgaggggugagaugagagccaggaucugacaaaugagcaaguuaucucacagacuggggagcagagacgugggcagggcggcagacagagagcacggccugagaagcagcauggggaugcuuagagauauuccagcagcgcgguuuggauuccaccugcagagaaggggcagggagucacauggagggcuaugaacaaaggcucccuaggcagaggugaagagucugcagaaggacaacagagaaggauggaguaugcauaaggaggagauggacagagcuaagagcagucaguaagaagcugccccugacccgcugauggucagcucucuccgagcuucucuuccauuaucugcuguguucacgucucucagcauggcuggugaguccguuccacugugccugccuuuuguagucucugaguccaggucauagugcuuacccaguagggccaaaaucaagcagucagggccaaacaaccacacagggaugaggggaaaagccagguaagaaaagacaacagcgacugaauaauuauggcugaguaauuacggcacaugggaaaacuugggcuccuggacccccucccccacaggacucugaaguuauuuauagaaacauggggaaggaagaggaaaggggaaggaaagauggccuaguuggguuccagaacuacauucugacagggccaggcuggcaucacccaucuguggcacugucggagugaacgaggucaagccugcaucugugcaccugaaguaggcugaauggguggccuccucuggaaagcacccaucaugugccugccucaccccaggaggauggucugguauccaugguaaccagcugccagucucacaggcacucgccuagggagcccuuucagaagcagcagcugcaucucagucucugagggcagaaagagucacccagggagggcuggccacaccguguacccaggagaaacgauuccaaugccuucugucauaguucccucauagaaagcacuggugacaccauuucugcuuucuuccaggggugucacagagaaaacacacgacauaagauguuuuugaaauaagauaugaaugugauauacgccaaguaucuaccuuccuucuuucugaauccuuaaaaacaacagagcauccuucucccuuccucccucaaacgcgguagauauuuuauuguuuaauaaacagcacaguugaagcaaagagaaaagaaaaagguuaccucccaauugacaugauguuacccaggguguaaaacacugcaaagaggccgagucccuuccugggcacccacagcagaagaguccccuaaggggaagcagaggacacaugcacuugagcacagugacccccucccaccagagccacauagcugcccucccugccucccuccccuucuuauccacuccauguaaugagugucacagagaaaagucacugggccaaagggaaggcuacagcugagagcugggcaaaggcagcgggugggaggaaaccuuaccagcacugagcacaggauucccagagcaaagcaugcgaugaagccuuuuauucuggugccccagcucagcgacgacgccuccacaaccugcaguuucaaaaacggcaauuacauacgucaugcacacuuacugaaaacaaacaaacaaaacacaauuguguuagagauggucugaagggccaauaaaaauguugcuucgagggggcuggagagauggcucagcaguuaagagcacugacggcucuuccgaagguccugauuucaauucccaccaaccacaugguggcucuucugguaaccugaagacagcuacaguguacuuacauauaauaauaaauaaaucuuuaaaaaaaaauggugcuucaagcuggugagcuaguucaguggguagagggggaggcuuggagagcaagcucgggaccugagcucccucccuggacaccacauaaaggcacaacaagcagguugaucccuugccuccacccaagugcugcccaugcaacucacacacacauacaugacaaaaaaaaaaaaaauuaaggaaggaagggagaaaggagggagggagggaaggaaggauaaaggaagggaaugugggagccuacacacucacagcuacacaaagucuugcauacagcucucauuagagcgaugaacccguccucaccugcucuucccuccagcagcuuacagaaguuuacugcgccucaggagggacguccccagggcagagacuuccugcuucagcacaagcagggaggcugaccuuagccuacaguccaggcaggacaagccuacaacuagaagggcggggcucugccaggcaaggccugggccauggaagaagaugagcaagagaagccaaaaugucacagagaacucuacuaaaagagaagaguucgagagcaaaucucaauggcccuuucccauaccaaagaugacaagugugcacuagaggccuuucuaggcucuccauaagauacaagaggguucacugcccacagaugaacacaggaaucagcacagccaggcagcauugacacacccaagcuccccuuaugcaggcagcacaaccucacaaggagggugaagcugccuacuccacugccacccaacugauggaggaaggcgggugagugcgaccacucccucagcccugucuggcccugccucagugaccuauuucccacuugccaaaccagaagcuggaagcgaugacaaagaggcaccccaggugugcagaaaggcuuaaucuccacccaggggaaagcuauuuaagucaucagaaaggagcccccuccucuuaacuuccauagagucacagguaccgacacugcacacacacacacacacacacacacacacacacacacacacacccucugagcaucuguagaaacuuggcagaguagaacccugaagacacauuggggaggggggcuagggguguagcucagugguacagaacucaccuaacaucagcaagacuuuggguuccaucucuagcaccucagaaagggggugugcuacacaaucccuaacuacauuccaaauauuuguccuuaucccacagguaaguguaguacucaccccuccucaaagaaaccucucuuugcuaaagagaccaugacaaaaaaaacaaaaccaaucaaaauacagagauguagagcccagucccaucugauagcucuacaacagagcuccagcaccuaugguucaggggucauugcagaagaaggggcagaaaaacuuuaagagccaggggaacaggcaggcugcuguaagauuaugucuucuagaaaugucaggagcuacacccuugaagucccacuaacaaggcugccuaaacacgaccuggacaaggggcaucaauagacaugcuaaagaggacagggggcgggggggacuuaaagaggccucaacccuagacaaccacaggcaacuauggaaugcuaggagcaggugaaccgucuuccccagggagcacucaacugguuaucuaauaccaagugaucagcugaaaauacacaaguaacauuaugcaggcugagcaggugguaacacacacacacacucgcacacaccauggccaccagcaccaccauccgguaacaacaacagcaacauaagaacaguaacaacaaaagaaagaggccaugaaucugaaagggagcaagcuggugguagauacacaaaaagguuucgagggagaaagggaagggggaaacgauguaauuauaacucucuccgugugugugugugugguguguguguguguguacguacauauauauaaagaagggcauguaccaccaugcaccauguuaggacccgacagcagagccccguguuucuaagcagaggcuacuuguccaccuagaagagucuuguuucuccaacuucccuggcucuaaaguauccauggaugcugcuaccaggcuugacagggcccuagacaaucaaguuagaccucuucugacuaacucauguaauuacucucccaccaagagcagaaggaaaggaacagcgcccacucuucccaguccugcaugguggaaacagccacgccguauaaggagaggaggaguuucagaggagugaaugagcaucugagcaucaccagcauccacacccacacccacacccaggaaguugaaccuuuuucuguuuagggauaaacugaaaaguaucaacguugaacucgccuuggcacucauaacauuccagaaucuaagcaagacagugacagucaugccucugaagacauuaaaaucaccgacaugagucauccuguuaccauagugaugaguacccccaccugucaugugggagaccacaguuugauucccaacugacuuggagacuagcaguggcccuuuaaauggacaguagggguggugguggugguggugguagcagcaagcaaucccaucaggaggcagaggcagacggaucucucaguucgaggccagccugcucuauagagcaaguccuaaaacagccagggauacagagagaaacccugucuagaaaaaaaauacaaauuaaauaaaauaaaaucaccggcaagagaaagcauuucugccaaaaaguauggcucugcuuucuaccgucagacaagaguaacacuuaggcucaacaaagucucaaaacaaccuaaacgaucguccaaaugcaaccuguucuuuaguggggacagggcacaggauagggaacagggauaauucaccaccauguuucccacucuaucuguguuccgucaggggaagaggauaaagcuuuuguuccacuucuucuaaguagacuccgugaaaggaaaguacuuuuugucaauuuuugaaagcgaauucacuugauggaaaaaaccucucucuaagcuguuguuucuggcaacccugcuagcacagagcuuuuucaaaaaucaaaacggcuaaaauaguaccuagauagaacgcguagggaacguaaucacaagcugucggacuggcggucaugcacaaagguucuuuugacuccaggaugcagaaggaagagagacuccugccaagagcuauaguucaggacugcccagggaggcgagacuggcagccgguaagagaggaacgcuguuuuaucccugagagguaugaucagacacccuccgaccuuccuugucccaagaacccuuccagaaaacagaaagccuauucuuccagaaaggacuccacugaaaccaggccuugaaugugauuaggaagacgagugucagaagacucggaucguaaggcuguucguguguaugaguccugccaacuuuacagcuaccgaggagggacagaagacagaaguacucacacuuuuucgguuggcaacuaaaauaaauuagaaaaaaaauuuuuuaacuuuucugggaaccucuuacagguuauauaacugaaaaagacuugaagacggaauuuaaccacagaaccacaggagccuucaguuuuuccaggcucaaaaccauggaaagugugaccacacuaaugaguacuuaaagggaggcaggcccuaguaggugauuaccaagccaaaacauccccaagaggaacccuauuggcuacagacuauuuccugggguucaagcccuggaaaugccacacaaugaugcacaacaggaaucgcacuaagaaagaggaaacagaauauuuccuuucuuuuuuuuuuuuuuuuuuuuuuuuuuuuuuugguuuuucgagacaggguuucucugcguagccuggcuguccuggaacucacuuuguagaccaggcuggccccgaacucagaaauccgagagugcugggauuaaaggcaugcaccaccacugccccgcugagaauauuuucaaacaagagugaagccacagucuuuuuaaaauagauguaacauaugccuaaguguaaguggagaucaaagcccuuccauuuaggaagggguggggggacaacuaggcaguuuguuuucaaauggcgcuacacuauucacucccgaagaugaccaccaccucacugucaacaccguacccuccgccagucuccuuuaagaccccaacuuuguacaacagccuguuccuucuacagagcuuaucuuuacaugacagcgacggucaacuaaaucuuggggcuuuuugugggggggagggagcuucucauaugaaaguucacaagaagccagaaauuuuuuuuaaaaaugaaaaaauuaaaacaugaaaaucacuaauuugaauuuuaacgaucaugcagagauuggaaaguugcagcuacugagccuaauugcaacugcccuuggguuaucuuuaguccccaggaagcaguucuuucuugcccaccugugucugauguaacagugacuaaccucccggaaacugcuagggaaaaacaccuuggaauuuauuaucuuaacaagguuuucgaaugcuaucaggcagccucugggagccacagcugagauuccuccacacugcccuaacugccugcuuaccgcuuccacuaaugcuucugaaaaguaccuuaauuuguuaauuuguucuguuacucuaagaacuuaucaaacuguuaucauguuggaacacugaguuugcagaaaccugaaucuguccuggggccauggucacucguauuuggcuucaaaauaauuuauucucuuugagaugcaguuguguuuuguuuuguuuuuuugcaaagacaaaacucagaacaaaaucaaccacagaagugagcgcagaauguuggggaaaccacaagaaagucaaguaaacacuaaagaggaacuccaauuuccaaggaaaaggggcuauugcaucucguucaacacccuucuuucucagaaggggaaaccggggcuaaggauacaucaaguaaaacguaauucugucuucaaucaagaaaggaaauguaaacaaacuuccaaagcacccaaaauaugacauucugaguggcucuggagcacaggacuuuuguggucaaguuucagagccaucaaagcccuacuaacaaaacaaacacacuggcagucuccgagcguggugagaaucuauaguuuagaaaguagcccuggagauucggagaccugguaagucccuguuaucaggcguucacggaguuuuacaauuacaaagcagaacgcauaaggucuggcucucacaccccacaaccuaaacuaguccgcgauccggcgguggauccuuccacgaaggccgccggccucgcccaacuccaaagggcucucucucccuggccgguccggcugggauggggcucggggcccggauuccaggaggccccgggauccacacucccacuccacagauuucugaggucuugcuucagagccucaagcccuucggagggaagguuggagaggguucgggagccacgccuuccacaaagcucgcgcugccaccuguggcugugucccggcagagcucggcgcggcgggccggaggacagcagggcagcuguccaagaaaugccaacucccccggugcacgcaccucggacagaccgcugcgguccucgguguccuggccgcucagaacuuucuucagcuuguccaugucagggucccgaccgccgccuuuggcguucgcuccgccuaccacucuucggggugcgcagccgccgccccuccgcccgcugccaaccacggcgcgccccgcccaggcaccugcccaccugcccgcccggcaugccc

SEQ ID NO: 477 - RNA, 1558 nt, Mus musculus
uaugcuuaauugaggagaaggaaaagacaauacauaaaaagaagcaggugagugcaggacaggcauuacugaacagaccaaggacacggaggagaggaggguacacagcaccaaagggcaggcgaaguauguggggaagcauauucucaguggcagacuugguaacagaagcacacacacacaacuccucucagugacacuugcagcaaacugcauuucagccucuugugcaaauuuuguuauuuggggaacaagcaugcuagugucauuacucucuuauuacuauggccucugaugauaaagaauugucuucaaccagcuaacuaagaguuaaugaacaacucauccugagagagguaacccauacacaaaaagacaaauacuagguacacauuuucuuauauguggauacuagcuguucagucaaugauaagaaagguacaaucaauacagccacagagaguagguauaaaguaagggacuagagggaacgaauagaucucccugcaaagguaaauagaaugcacaguuauagauaaaggggaaugaagugggagaucaagcaggaauggagagaggaaaggaggaaauguggggaaagacagcuaaaauuaaagacuauuugagugguaguauggaaguagcagaagcuuccuaauauguauguauguauguauauauauauauauauauauauacauacacacacacauauauauauauuacacacacacacacacauauaugaagauaaucuaaauaacacugccaaguaacagaggagacagagccucaauuggacaucuugucaacaaaugugcugggauuaggcuacauguaguugaguuauuagagaaacaacccaggcuguugcaaauacuauagguugugagagcaacaaacugauggcaaggcgcuauugcugaaaauaccuacacaacucacugaacacagagaagucaagcuggcacuuauguagaaccuuuacccucacuggacacuguucuugguacuagaggguacucugaauaguacugaaggagaaacaacaccaacccagcuaaaaacacuuugcucuaagaugguguccugccugcaugguaugcuaaugcaauggugguacaaaguugguaggaguaaccaaccaaugucacauuugacuuaaggccuacuucccaagauggaacucauagccauguugcuugguugaccaagaaguugagacucaagagcccaaggaccuaggguaaaaccaauacuauaguucuacuaaaggaauguaguaauaaacagcuccuaaugacauucugcuauacucauagaucaaugccucacucagccaucaucagagaagcuucauccuguagaugggaacagauacagaaaccuacaaccggauaauauacagagagugaagagaccucagaacacucaucccuaaaugggaugucuucaucaaauccuuccucugagggcucaggggaaaucuauggagaggaggcagaaagaguguaagaucuagggaggguggagaacaccaaagaaacaaggccuucua

SEQ ID NO: 478 - RNA, 20616 nt, Mus musculus
gcaugaccaaguacgguuuauuauggacaaaugguagaaaccaagguuggugccauccacaagcaaguccccuugaggcaaauguaaagacagacugguacuaaaaguuugcuuuauuuuuugugaagucaagugcuagcuuuuaaguacaguuagauuuugcuuuccuucuuuucgaauguuaucagaauuuagcaucaccuuaucgguaagcaaauacacuagguuccaauguuucuguccacaucuagaauguucaggugaucaggaacucucuuacuggaucccuuuagauuugaguucuugguuauaucuauaaagaaaacagagaugaauaauuaucaauaccaacauguacagagggaaugagaagcacuucuugccacugucaauauaaucuuccauggagcuuauugaaauaggcugaaggaaaauucacucaaaggguucauugcuucugcucucuguuucagauuuuaaccaacuauaugauuuaaguuucuuauauaaauuuuaauuuuuaucacacacacacacacacacacacacacacacacacacaauuccagugagugggguccaauccaagggcucacauaugcuaggcaagcacuggaccuacgagccacauccacugaccuauuuucauucuuuauuuaaaagauaauuauugugugcauguguuuauguguacaugugaaaauguacagguuucugucaagaccagaaacuggauuuccugagcuuggaguuacaggcgguugugagccacaugacgaaggugcugacagucaaauuucaguccucagaaagagccacuggcacuccuaacagccacaccauuccuucagcccuuuauguucaaucuugagugacccugggccaaugggaauauguauauaaacuuccuauacauuuaaagcucacuuacuacauauaguuggaagcaagugaaaaggaggaugauggaaucuacuuagcacaccaugaguuuuauauguuguggugcuggucuaaaugagaauugcuguccaaagguucauggauuugaacacuugguccccaggguggugcuguuugggaaguuauagaaccuuuaagagguggagccuugcuggacaaaguauugucacugaaaguuggcuuugagauuuaccagucauacuccauuuccugugcccucucucugcuucuuaaaugugaauggaaaugggaucaaccugcuccuacagccaagcuguuccuaucgccaugauuucccaccaucauauacucugcccccuggaacuguaagccaagcaaacucuuucuuguuuaaguugcuuuuggucaugguaugguauuuuaucagcaacagaaaauuagaauacaauugugugugugugugugugagagaaagagagagagacaaagagagagagagcgagagagagagagagacagacagacagacagacuaugaaaaauggaucuaaaaccuagguaacacaagcuuagcugcuuuuauuuguaacucuccagacuuugauggaaacaacacauuucuccuucaugcacaauuuagucaauauaauacuugauacacccacagucauugaggugacuucugaaccacuucuaaaagcaacuuggcuuaccuccaaauccgaaacagcugagaggcuccugcugaccccacaaagaaauuaacagcgaacaaacuccaauuuuuugguauaauuacaagugaauaucuugaccaaauaaacccuguugaaacaaagcauuuuuuucccuuaaaaguuagauuuauuuauuuuuuuuaagucaacaaagagcauuaagugcaaaggaagagucaauaagcagcucauacaagaagaaaagucacaguguggggugaaacaaagcauuuuuaaagguauagacucuucuacauuauauauuacauaaaaauucucaugguauaauuuucaguauuacaugaaauucuuacauuagaaggagacuuggcuaggaaccagccauauuaacuauaccaucuuuccaaaagauuucaaaaaccugaaaagcagaaucucaagcagacccuuauuccuaacagccuuccuggcuaagcuguccauaaugcagcagguuuccuaaggauggauaaugugaguaaauaugugugcagacauuuggaaaauaaaaucacuaaugacuguaagaccaaagagaguuuuguuguuugugguuaauuucaguugugagacuggccuuuagaggcagcgcgaucgcuucagcuaguauguaguuacuguauagcaaucucuuccaggacaaccauccuggauaaguuaagacucaggauguuccucuuacuguuguugagagagaaauauaguggggggaugauuagaucaaaacauuauaacauguaugaaauucucaacaauaaugaauuuaaaaagacuugugaugauaugaagagaagcugguuaaaauucaagaaguaaauuuaaaauuaucaggaaguuccuaaaacugaccaguggcacuuaagucccucucucuuuaagcucauuauaaauaguaaagaccgcugagaaaaccucucaaacaagccaagcuuccuggaagauauucagacuaaccgaguuacuuagaagaaacacuuucuaaccuguuaacugucugcaguuugugcagcgaguuucauguuuccugccugucacccaugcugugguagguuuuccgugacacaaccaucugaguccuuucugguccuguaaguaacuccuuaccccuauuucuauaacuagcuccaagaaacucauugucucacuaagcugaacuuugguuguuccaacuccuucuguagugcauagacuuuuucucacaucucagaaauaguuacccaacaguagaacauggaaggguuuaacuuaccuguagccaucaacacaguggacugagcugugcugaguuucucugcaggucuggccauguccgcuaguccagcacacaccaaucccugcaaauagacauuaagacacgguggggccucaggagggagacuaucaucuuuaacuuuaaauuaaacauaaaagaguugugaauuuccacaugaaagcuauaaucauaauaaugcccagaccauuaagaaaauucacagcaagaaccccugccccugccccccaaaaaccccaccaaacaaacaacaaaccaaaaccaaaaaccaaaccaaaccaaacaaacaaaacccucuauaacaaauuuaggaguacuuccucauguuuucugucaauauuuuuuuguuuuuuuaaguaccuggaaaguucacucagucuuaguuuauuagauggcuuuuuccuauuuuuagaaguguucuuauuuuugugagcacguacauauaccaugguacauauguagaagucauaggacaagcugugggacucaguucucuccuuacuccaagugagucccagaaauugaauuuaggcuuagccaaaggagccuuuaccaucugagcucuugcuggcccuagaugauuuuucuuucauauuaaaauacacaugaccauaucuuccuuggugccuuaaaguuguuacuuuuauuuuuguggguaugagcauuuugccagcaugcacacaggcguacuaucugugugcacugcacauggaguccagacaagggcacuggaacccaugaaacaggaguuacagcuggcagcgaggcaucguguagaugcugggaacugaaucuaggcaugugcaagagaaguaagcgcucuaaaccgagcugucucuccaccuccaccccacuccugcuaccuaugucuucagugucuuuuacagaaccacaccacacauauccuaacuucagcaucacucagaacgcuugguaauaagcugggcugguguaagccugugauucaagguaugggcuaaggggaggaggaucauaaauuaaaagccugucgucauaacaacagaaugaguucaaagguuagcauaggcaucuuagugagauccuauuccaaaauaagaaguuaaaagaggguuaaggaucaaaacuucaaggcaaaucuggacaguuuacugagacaauaucucaaaacaaagggugaaaaaggauggcacgccauaauaaagcaccccugccauccaugcaugaggccccgaguuuaagucuuagcgcuauaaaccaaaccaaaccuaaccaaaaugaaaccucaagccaaagcaucugauaaugcuaagacugcucccaaauaucuaacugccucuccauauucuuuaguuuaugcaccggcuaacauagaccaugcaaaccgcugagaucuuuaguuuaugcaccggcuaacauagaccaugcaaaccgcugagauucaacuugcacaaggguuaguguguuaggcuggggaugcaccucggugcugcuacaccaccugccuagcacacguaggcccugggaucaaccugugguacugcacaucaacaaaauaaaauuaaauaauucuguuuaaagaucuucaggagguuaaagguccauuacaauguuacacccagauuagaaaaaagaaaaaaaaaauaaaagggagacaaaugcuauaaaugauaagggcucugcccagcauguauuauucuugcaacuguccccugugcguccuucuaaaaauacacuuuuaaauuaucauuuucuauguagaauagguugcuuuugaacuaaucugacugccugucucuugaguacugggauuaaagguuuguccaaccauacuagugcuaaaguccuuuguuacauccaauucccaacaauuuuuuuuuggagagauggagcaggauggaggucagagguagcagcauaaaagccuccccugucuuccaagcugccaguccuucaacaaaccuuauuucuuucccaccaacuuuuagcuccacaguacuggcuuucaaggccuacagccagcaacacaguggauauuauucagccacagaauaagcaaauucugacaugcaauagccuggagaacacaaaccagucauaaacacugcaugauuccaugggccuggagagaugucucagcaguuaagagcccuuguuacuccugcggaggacuaaaguuagguuccuagcacccaugcuggguagcucacaaaugccucuaacucuggcuucagagaaucugacacacucguuggucuccucagacaucagcaacacguacaaauacaugcacacagacauagauauuuaaaagaucuuaaaaaaaauauugcaugcuuccacuucuaugagguaccuagaacagucaaacucacagacacaaccaagaaguagaaugguauuuuaagagaaagaacaguaaguaggggaguguguaugaucccaaagucuccaagaugcaaagucuuugcagacuggcuaaaugaugaagcaaugaacaguacuaggauguauauuuaaaauacaaaagcaaaacugauuaaaguaguaauuuuauauguauuuugucauauuaaagcucacagaucagcaguuuucaaacuuggaggacacuagaaucaccugcagagggcauuaaaacagcuucuugggcuccaucccuggauucuuuucagacugaguaagcagauaugugauggggccugaagauccucacuuauaaaaagguucaaacagauccuuuucaauauaaauucaaugauuugcuauaaaucauugcuauagccacuagauugaauauguauuauauauacacagagacuauauauuauaguaaaauuauuaaucuuggagcuaaaaguuauaagccaucauuuacaccaaaugcucuuauguaauacauauauugacauagucauauacacuuuaggcuggccucaaauucuauauagagccgagggauagacuuaaacccuucccuaucuuccuaucucugucagucaaguacugggaaugauaggguauaccaccuugcaugacucuguauguuuuguuaagaauuuaggcucggugguagugaaagaugccuuuaaucccagcacucaagagacaguggcaggcguaucucuguaaguucgaggucuacagaguaagcuccaggacauccagcguggggggggaaaagccauuucugauaaauuaauaguguugagaaagguagguaguauacagcuuucauaaaauauauuuuaaguuaguaaauuuauauuaaggaauuauuucaaguaacuccuauuagaacuaagacuuacccauuucauuauuggagcccagaaaaaaacuguucuggggccugaaauauaaaagaaagaaaaauugagaaauaauccaguguauuauaugcauuccuuuauuagcuaacaccaaauucuacucugcuauacucuguauagaauacacuuuguauugagauuuaggaagggacaaaaauauaguaucaaucuucuaugugucuuuuaauauucuucccaauuauuuguauuuauaacauuaaaaauaagcuaaggugagccggguguuguggcacaaucuaagguggggcuggaaggauaguccagcaguuaagagcacauacugcuuuuacagagagaccugaguucaguccugagcagcaauaucaagugggccacaaccaccugcaacuccaguucuagauguccucuucugaccucugcaggcacuguacuguauaaauaacccacauggacauaaacaaauauauaaaaauaaaacaaaccuuaaaaaacaagcuaaagaaacaacggagauaguucuagaacucuuucccagugcuuuguuuugaacagaaacuuaguuuuaguuuagucacagacaaucuuuagaggaaauaucaaauuauaaaauuuuaguuacguaaguuuuaguaauguucauucuuuuuauuaaaacauaucauauaugccuaucaagagguguugcaaaaauucuguauauucuauuuuauuuaauauauuuuaacauaaacauagauuauacauuauuucucucucucucucucucucucacacacacacacacacacacacacacacacacacacaucuaaugucuauuuugauacagguucucaaagguuccuuaguaacaagguccuuguuuuugucagucugguacuuaucugcuuguuuaaaaugucaaauaaauaucugaaguauuggaaaugaauguugaccugugcgaggugaugcauaccuauuaucucaccacuugaaaggcugaggggaggcagguguaugcugugacuacauguugaguuugagguuagccugggcuacacaguaagggccugucucaaaaacaaagaagaaaauuguuuuucuuggauaaccugaaucugagaagcacgacauccagagggggaggaacucagagaagcuggaggauucauucaagccaugcaccuggugagcagcaguaagugggauucgaguuccuaacucuuuaacucauguccuguacuagauccacagacaacucuuuaccucaaaggauaugguacgauaagagaugacagauuuugucuggggaccuuaaaauguaacuaaacuugccaaauuuaguuauauacuggaauacuuaauauuauauauguucuuucuuauacaugggaucaacaaaauacauucccuucuuuuuucuuuuuuugagacacauucuuguuaaacuguagcucagaauguccuggaggcagugcugagacuacaggcaugucccaccauuccugggaugcuuauuucauuaugcaagcuaauauaaaaaauagugauuuauaaacaaauucaagguuaaaaauauaauuuaugcccaugucuauuacuacuaccuuacuauucuacuuuguaaggguaauuuuuugaguaagggccuggaagagaucaggcucgccuugaacgcacagagauccaucagauccuuugaaacuagagcuacagguagcugugaacuaccugaugugggugcuggggacagauuucugcuccucuggaagagcaacaaauucuuuuaaaccaugaaccaaccaccuuuccaguacucaguaauuuauuaucaaacauucugacaguccaauccaaagauauaugaauuuggugcuuacauacagagcaaagaaaagguaaaaauauucaaaacuggcuggagauauggcucagugguuaagaacacugcucuuccagagguccugaguucaauucccaacaacccauggugcucacaaccaucuguaaugggauccgaugcccucuucuagugugucugaagagagcaacaguguacucacauauauaaaauaaaauaaaucuuuaaaaaauauuuaaaaccuuuuuguaauuaaaccauauuucuguaagagcuuuguacuuuguauauacagaaaaaauaugcaauuuauaacauauaauagucuuauaucugagugagauguuucaggcaguacuugcuaacauuguguguugcgacuguaagcccagcacacaguguauacuuuguguucagaacugaggcuguagugaaauugugcaguauaacaaggguaaguacuaucagaaacaccuuaguucacuauguauuugauuugauuuauacgagugcuuugcucacguguaugucuguguaucacuugugugccuggcuaccgaggaggcuagaagagggugcuggacccccuggagcuggaguuucugacaguugugagccacuauguaggggcugggaaucuuccucuggaacaacagccggugcuuuuuuuuuuuuuuuaagauuuauuuuuuuuuuaaauuagguauuuucuucauuuauauuuccaaugcuaucccaaaagucccccauaccuuccccccgcaccacuccccuacccacccacucauauguaucagaagauggccuaguuggaaagaggcccauuggucuugcaaacuuuauuuauuuuauuuauaugaguacacuguggcgccugcagacacaccauaagagggcaucugaucccauuacagaugguugugagcaacaacaugguuguucagaauugaacucagguccucuggaagagcagucauuguucuuaaccacugagccaucucuccaaccccagucagugcucuuaacugcuaagccaucucuacaacuccuauguauuuaagcuugaguuaaguuuuuguuguuauauguucagaaacuuuuacuguugacaaaguuucuacugcucacaaauucaguuacauaaccagauagagggcugugagucacaacuuaagaagcuggguuaucacuugcuuuuaacauuaaguggcagggacccuggacuacuuuuccaguuuaucauauaucuugauucuuuuuauaucucagacuaguucucauuauucuuacagcuaaauugaccaauucaaugagauuuuaauacaggagauuuaaaaaucuaccacaauguauuuuacuuuaggguuuugaaacaaaguugcacuacaaaucccaguguguguucaagcuugcagcaauacuuacucuuggccucuuccucuuuugauuuuugguuucgagauaagguuucacuguguagcucugguuggccuggaacucacaaagaucugccugccucaccaacuguaugcugggauuacaggucuguaguaccaugcuuacuuagccuuccacaguacacuuuaaauaguagcugcuuaucuacuuaccuaugaggauuaucaaguagcugcauaauacaucuugcaugaauaguauuuaaaggaaaguuagccagcauaauggaaaaauaguuuauauuacuuaugcuacuauaaugaauaaagaagcauauacgcauaaaauagauauguauauacacauacacaauuuuaaaaauauacuucgcucuccuuaucaguggcuuccaucauuuucagauccacccaacuguggacugacaguaguuggaagcuacauguaguggugcaguucuuauaauucuaguauccaggagauucauugguuuauauuucaggacuaagucuuuuucaucugcauugaacaaaucuauguuuuucuugaaguuauccccaaacaaaguacagcaacaacuauccaacuuaaugccuuauuaaguaauccagagaaaacucaaaguauagaguuucuggaacucacccagcaugauacuuaagaaugacauaaacuguuuucgugagcuuggcauuagauauuggugagucugguuuagcuuuguguguguguguguguugcugacacuagaaacacaagacuuugcacaugguaguaguuuauacugcaauuaaucuuaggguaucauuuuuagaauucucugaacacuugaagaucacagaucaugccuuugugaguauaauuauaaugcuaagcuuuauuuuccuagguaucucauaucauauuauuuuuacauuuuccccauaaaccuucaccuacucuauuuauagucuaaacuguggaacaaauuuguagacaguacugaauuguagacaguugagagaaaugaaaugguuguugagagaauugaaacuaccaaaggguucaacuuuuugaugcuucuaauugaaugagaaaaaaaauccaucuguguuuguuuugccacaguuggcucugaccagugcuauucugaccacagccagucccucucuuccuaccuugagcaagacuagaaacaaaacuuuaagauuaagugguacauguuuguagucccagcacuggaggcugaggcaggaggaucaaugauuucuaggucaaacaaaauaccaaaaaacccccaaacaaacaaaguaaaaaaaaaaaaaacaggaagagagcuugggugugguggagcagcccuuuaaucccagaggcagguggaucucugugaguuugaggucuacaaacugaauuccaggauaguagggagagccugucucaaaaacagaaagaagggugaggagaaagaaguaggauuauugaggaacuacaccaaugcaguguugugugguacaagcuagccuguaauuccagcacacaccgguacucauuagcaguugguagggacccaaguggaauuuuaugauaaauuauacuaaggaaaaccaugauuuaaaagaaaaaaaauauuuuuugagacaaugcuuuguauauaccuuagauucugaacucagguuccuucugcuuuggcuuccucugugugacuauugggauuaggggugcaggagauaggaaccaagcaaacaauugcuacaaauagguaguuacagugguauugauucugcuguuguuaccagugcccucuccuaggcaaagagaccuggaugcuguuaaacauuugaaugcacaagccagcugccccagcaaagaaccacucagcagcuccacacuaauauccuccucuuaacccuuaacugccaucccucaaggucuugcuuuugcuuucagguuaucaaauaaaccuucuuuagcaucuccaguuuaagcuaaaugcuucucugaacaaccaaaacagcucaucuauucuacugucuucuacacugggcuuaacuaugcaugcccaggauagaagcucuaucaaacauauucaaacuuugguaggcuugacagagaauggcccugacauugcuuuauucucaaggccagaaucagugucuccucauuuucaggaacauaggcuuccuuuaugacuuuacuaacaagcuauucuuagaccauggagccuguuccaagcccagaauacagauccuguaauuucauuuagagugaguaggggagguaucauuuuucuuuaauauacauggacccuuggaucacagucuguauaaauuucuuaguuugguuuuauuauuguuugaagcuugguuucauuacuuaagaaaguguaccuucucagucucugggugaagagguguccauauuuucuuugaauuuuucuggauucucccagcccccaccaugucaaaacuguuuauucuguugcuguccccaaacuguuuucugaguaagguccuucuuggcuucuuugaaaguuuacaugguugaagauuugaguuaaugaauaguaaaguuuuccaguagguuuaucuaguaacuaauuuacucaaauguuccaagcuaggcaacaguuuauaaaaauuuaacugcacaaaugccaacagaaccaaacaaccaaauaaaucaaccaaccaaccaaccaaccaaccaaacaaacaaacaaacaaaaaccuuccuucaaacaugaauuaaguggccaggacuuuggaccaagaaagauacuuuaacuggugaaaaaauagauuuauuuaauguuaugacuaucuugccuguauguaucuauaucauguuuaugccuggugcccaugggggccagaagaugguaucagauccccugaaacuagaguuacagauggcuaugagcuacuaucugaguacuaggaaccagaaccaauccuaguuccucugcaaaaacagcaaguauucuuaaguguugagacaucucuccagcccuaauuagugauaauuuuaaaugaugaaaacaaacuaaaugagcuuaauaaguuuuaagugcuaaauaaaaaguauuaguagcagauauguaagacauuauaaauugcuauuuuucugagguacuugaaggcaauggacaaguuaauaucaggauaauuagaguuggauaauagcaaauauaaacaaguagcuguuuuuguuuuaucuuugagaugggguaggggaauagggauugucucacuccgcagcccacacuggcuuguaauuccccagguagcccaggcugacuaugaacugauugcuuuccucuagccuuggucucccaaagaauaaugucuuaggguuucuacugcugucaagagacaccgugacgcaggccacucuuguaaaggaaaacauguaaucggggcuggcuuacagggucagagauucagugcauuaacaucaagguggggaagcauggcagccuccaggcaggcacagcacugaagaggcugagaguucuacaucuucauccaaaggaagccaggagcagacugacucccacauggcuaggagaagagucuuaaaguccaccccacagugacauacuucuuguaagaaggcuauacaugcuccaacaagaccacacuugccaacaguucaacucccugaguucugcguauucaaacuaccacaaauaggauuacagguaugacccccaccacaaagcagcuuguuuuuguuuuauuuuuuuauuuugcuuucaaguuuuaaaaaagaaaaggagggcuggguauagacauauacacuuuaaauuccagcaauaaggaaacagagguagguagacuucugugaaauugaagauuuccuggccuacccagagauuuauaggcuaucuaggacuauguaucgagacccuguuucuggugggaguggggcccaaacaauauaacuauaaagaaaacuuaguuuucccuuucauuuguucucaacugauuuguuuuaucuucagauuauauagugaauaaaugcagauaacauaugaauucagauacagaagcagccacuggaucuaaaaacauuagugaaauaaauaacuuagauguagacauuacucaaauggcaacaaugccaaugcaauauuaagacugaaauaacaggauuaggcuauauaguuauauaguuauuaucacuggaaaacauaaaaauaaaugauaauuauacuguuuaauaugauuauaauaccuuaguaucaggaucaacagacguauaaauugauagaauagcuguuaauauuuacuauuauugaaauaauuaaguggaaaugaauuuuaaaaaucaccuuauaaaaauucccuuuuauagcucaacaagaaacaugauauucucagagagaaaugaacaccuuuauacaaagaauuuaacaauacauuuucaccuuuucuuaagacucuacuacucuuaaagguagaaaaggcaucaaaaauugauaauuuagaaauaucagacaguauucuauguauauuuaaaguuaugaucuauuuaaggauaagggaaauacaguaaauagcaaaauaauuauuuuuuucuuuuuaacauguauuacucauuauuuauuuagugggucugagggagugaugccugcaugcaguaggcacacucaucgaggucagagaacaacuuuugagagucaguucuuucauacugugcgagucccugggaucaaacucaguuugccugcagagccaccuuacccaguuccuuuuuuguuuguuuuugcuuuuuguuuuuuuuuucugagacaggggucucaucauauaguucaagguaucuuggaacaaacagcucaguucaggcuggccuugaacuuggggugauguccugccucagccucuggaagaggcuuacggguuuguaucaccaugccaggcagaaugaugcaccuuuucuccucuuuuuuuuuuucuccauuaucugguuuucugugacaggaucuuacuauguagcucuggucgccccagaacucacuagcaaaccuggcuggccuagaacucccagagaucuguuugccucuuccuccugagugcuaggauuacagggguacacaacccucuccagcuagguugauuguacuuuuauaagcuaaauuuuauuuccuauuuuuuuucagcugggaguaauugucaucaguggaauaaaugaacuuuguccagaacauaggcuauaaguauguauguauguauguauguauguaugauucuccccacuauaaaaauacuuccuucuuggaaaaacauaugcacacauauacuuacaaacaccaaacuggaguucauugugucugaaguaaagcauaaacuuucuuauugaauauuggaaggucacaaaggccacuaccucuucucauuccuuccacaccguucucuauuauggcuuuccuuuucucagcuuuuuuuuuuuuuuuuuuugguuuuucgagacaggguuucucuguguaccccuggcuguccuggaacuaacucacucuguagaccaggcuggccucaaacucagaaaucuaccugccucugccucccaagugcugggauuaaaggugugcgccaccacacccggcuuuuucucagcuuuuuaaacugcaauaacacuugguccucuucccuguaucuggacuggaguacaggcauuauuuucugggccugucugggauuugucauucuuucuuuaugugcagcucucagugggcagagguggaggaucagcuuaaggucagcuguacccagcuacauagcaaguccaaacuggucuauaugacauugucucaaaaaauaaaaauaaaaaagaaaucccaacguguguguguguguguguguguguguguguguguguguauaauguacguaauuguuaucugcaguuguccuagcauucagcagcauaucaaaacaucucuaauguaguuuacuauccaugcaacaaucauccuuuacucucuucacuuuucaauaucccucuuaguuccacguacuguacaagacuuacacacuauauaugauaucauauggccaacuacacacacauccuuauaauguuaagguugguauuugauaccauuacugacugccaaaaccauuuuucacugcacuaaaacugguucugacuuaacacuaagaucaggauuaugaacacugguauuuuauauuaugcaucucuugggaugauccaccuuauuuuauauaguucacauuuuuuuuuaaaaaagaaugcuuucuaccuggcagugguggcccaugccuuuaaucccagcacuugggaggcagaggcagguggauuucugaguugaaggccagccuggucuacagagugaguuaguuccaggacagccagggcuacacagaaaaacccugucucgaaaaccaaaccaaaccaaaccaaaaaaaugcuuuaaaaauuagcaguguguuuccucagcuguacucacccauguuccauuauuacaaugaaauaucuaaggcuaauacuuggugagaagcaccugggguugaguagauggcucagugguuaagaguacuuguugcugucagaacggaccagaucuaguucccagcacccacuguuuggcucaugaguagagagagaagucagaucuaaggccuuuuagugauggccuucuugcugacagauaucugagauagggcagagcauccuacucagcaagaggggaaaaggauacguuuagguauaugcauagucucugucccgaagucacuaggacucagucauaggcacuuuacccuaugaaauuaauuucauucuaauuacuugccaaaguuucuaccuccaaacaccuuugacugauuauauuuccaguuacuuaaugccucacaauaaggauuaagucucaauauuuaaagaguuaaaggacauucaaaucauacagacaacuaagcauuaaguaaacauugugcaacguacccuuaauguuaagaucuggcaaaugccuagagcauaguuacacaacuggcuuguuuggagcaacaugcuuucuaucuaguuagcuagacggcggguuaaaugacagcccuuauaugagcugaggaacuugucuaggaauccaauuuaguuauuuuuuauuauuuuccuacagaggcaaucaugcuauaucauagcacaugacuuauacaagcaaacagaugacaauggccucaaaauuccaggccacauaguauuccaacuacaauaaauaucuaaauagaacauauucuuguuaccucuuuauaaauauuugucaauaacaaaaaauaaauuuaaaauuuuauaauaagcaacauauacuuucugacugcuaauauucuaaccuuucauaacuuuuuaauagaaccuuguauaugaauguagucuaauacuuagaagguuauucaauaccaaauacuaaaguacaauaguauucaaagggacuauucauucuggguaaugaguagaauaauaaucuguuuucucagauuuuuguucaaacauuagacagucaucagucauauuuuucaugcuuguucaugucuauauugcugggcuuacaacuuuucaaucacaaauacguuuuuagugguaggcaucuucacauauuauuaaaaaacuuaauugcuagagauguagcuugguuauagagugcuugcucugaaaacauaaggggucugguccugguuaaugguccugaauuaaugaaccuuuaauuccagcacuagggaagccgaggcaggaagauuucucuugaauuugacgucagacuauucuauauagcagguuuaaagacagccaggagaauguaauaagauucauucuuuguuuuuggagacaguuuuuuuuuuguuuguuuguuuuguuuuuuguuuuuguuuuuuuccuguuucacagccuuggcuauccuggaacucaaacucacagagaucugcuugcuucugccuccggagugcugggauuaaagaaguaugccaccacuccaguaaagaucuaauuuuaaaaaagcaaaacagcaacaaacaagaccucaaguucaaggucaaacugggauagaagggaccuugucucaaaaacaaacaaacaacacaauaacaacaucaaaagcccuaaacccuuuauuuggaagagaaaguucguucugauuuguaaaacaaauacuuuuguacaugcuuuacagauauuacaaucauuuaauuuuucacaaucauuuuuaauuuuaaaagauuugcacccaggcagugagggcucacacuuucaaucauagcacccaggagggagagguaggcagaucucugaguuugaagccauccugaucuacagagcuaauuccaggacagccagggcugcacagagauaucuugccuugaaaaccaaaccaaaccaaaaacaaaacacaaaacaaauaaccaacuaaccaaacaaaaagauuccuaagguuuggggaauucguuaaagucaagauuuaaccugccucugucuuccaacucuguguuccuuuuauuacacuuaaaacagaauuaacccaaagacuuccggaugaaaugcacaaaauacucuguacaguuuaaguacuauaaacaauaauuacaaguggcuaaaagccagggucuugaaaaagaucaacaaaagacuacuuuccaauucucuguuagcuuaagugcuuuaaaacugagccugcuccacacuguccucacuccaaagcuggaggguaagaauugccaaagaccucaguugauuuuguaacauucugaucauuacauagauugucaaauuauuaucuucugaaaaucucugccauaaaacauaacaaagcagaaaaauguaaaaacuaauagguaacuaaacaaacuucaucaauaaaguuccuuaaaacaaguuuuauaaugguuuucauacugcaguaaugccauuaaguguuaaaauuaccaucuaugcagagguauagaccauucuguuauuagaguggacaccagauuuaauaaccagcccaggcucuagagaacugccucaucccuuagaacuaaaccuuccucugggcaugguggcccacaccuuuaaucccagcacuugggaggcagaggcagguggauuucugaguugaaggccagccuggucuauagagcugaauuccaggacagacugggcuauacagagacgcugucucaaacaaacaaagaaacaaacagaacuaaaucuuucuaauaucaauuguagacuauggauuuaaucuauguaaaggcaaaguucacuuuuuuguuagcaacuccauuuuuccacugugaguaaauuuuucuauuugcucaauuuuaugcuugaaagacuucauaauauaaucagauuuuaguccucacccaaguauuacuaucacccauuuuguauuagaaauaaacuaauuuaauaacugugauaaagagcuagagggacaggggccuuccaguuucuuaaagaauuauuuuaacuacaagaauucuuauccaguacuugugacagcuaacauccucaaagaaucaagcauauguuauuuuugauuuucacacugaauacauuuuauaugaauuaagacagagguauagaauuuugcccaaggucacaucuuggugagcgguggaacagaacuguauucauaucugcccacauaaaacacagauauaaccuggucagugauugcauaaugacuggcuuauuauacugggucuauggaaccagguugacauugacugaaccgggaaggggaaggggauggggguggggagcguccaauuuuggggagggcucacuuagcaggccucugccaagaggaacuaaaguaugaccuuuacuccaaacccucugcugagaccagacagacaccuuuucagcucuaccccacgugugcguuagaaauucacggagggagaaaggggaggagaaggaggguuucaugguggcccaagaccccuucguggcucucaggaguuaaguaagguucaagucuggaggagaggucgggagugugagcaguguuuaagggagcgaagacaucaaaagucaacaagggcacugggugcugauacucgguuuuuggaaagagaccuaagaugaaacaaggugaaagacuaggagaauugauggauucccuucaguggcgagaugagggcucugggauuccgguagcaacucaacugucacagggccucuaaugucccgguuucggagggagaggaacgaucuccgugcgagccguucaggauucauuaccugccgggugguuguaaagcggccucaauuucuuuggcagcaacaacuccacuuuauccaugagucggugguagguggcccgcaggccucgggcgccggcagcugccaucgcggcggccuagggaucgacagcagcagggugggagcgccgcuguguccgcguuccuggcugacaacgaagggcggcucgucacuuucucucugcagcgcuggggcguccgccucugcccuagggcgcccuuccccggcucuggcagccagaggugaagcaccuagaggccgagucccgcaaaggcucaggggggcggagcucagcaaaagcccgccccggcccgccuccugcgagcggguuggggagaccgagggggaggagucauggcaacaggugcuacagaggucgccgugcuggggccgcuagagcuaggcgggcgaggcguugcgcaagcuuaacggccugcucuaauuggcuggccucacagagcggaagaggcguggccagaaaucaucuccuuccggcccuggaggccauguuggagaggggaaccugaagccgcacuuccgcccggucccucacuuugacuaauaagcuuucugggcuucccucucccgaacugaagaugacgcuggauaccugucggacuuccucuuauuuacuuauuguuuuugagucggugucuucgcuguguaccccaggcuggcuuggaucucgcuaugguccagccucccgacugcugggauugcaugcaugggucaucacgcccgguuuuuuccuuugacucgagaggcgugagcaagacaaccucagcggcuuccgucaugccucuccaauccauuaaggaguaggcuagagcgcccucaagcuccucuccuagggugagggcaaucgugacgcacagcggcuucuguugcccg

SEQ ID NO: 479 - RNA, 1224 nt, Mus musculus
gggcuaacuacauagaccugaagacucuugcccauuaacaggaauacuacagugaaaguuaagcuaugccacugaaaauaaccauguaucugauaaaaguuuaauaugaaguagcuuauauuuuauaaauauaagcuauuuauauaaaauauacaaaaaucggaauauaaaagagaauauauaaaaacauuuuuugaaacccccaaaaagaaaaagaaaaaaacccaaccucuccuacaauucaacaacacacuaacaacaauaaacccacuaauucaguuuaaaaauagcucgaaggaccugaauggacaucucccuaaagaacgcgugcaagucuaugaaaggaugcucgaugccacuaaucauuagaagaacagcagaaugcccaucaucuaugacuucacacccauuuaagaugucaacugaagaccacaauccaaacuauaaaaaagauaguuagcuguuggggauacaacacgaagguccuugugcccagagaccuccaggaaaaccagcaauauucagcauacaggauuguccucucaaagggauggauguaauucuugcucuuccauccagaaagcggggaauguauguguuugugcaauuaccuacauguauguguguacagcacgcugugccuggugcuagaggaggucagaagagggcacugaaucccgcagacaugcacauacagauaguugugaacugccaacugggugcugggacuggaaccuggguccucucaagaacaacaaguguucuuaacugcuauaccaucucuccagcccaaggggagccuccccagccccaccugcccacccugcccaaugaguauggagucucuguuuagcaaacagaaaaacuugccauuguugaguuuugagacagaguccuauuguucgccaaggcuggacucaaacugauaggcacaagugaaguuucuaccuccauguccugaacagcuaagacuuacaguguugcccuguucgcugugcuuggcuugggggcuaucacacaacagcuuaaagcagagucagugcuacugcucuggaugcuggcugagaaggugaauuuuaugcuggcggugggaggaagguguuaaacugaauucuugaauaguccugaccacagaucguccccauuaaugucacucuucucuccaggcguaugacucacuggguaaaaaauucugagaaaacagauaugauaucgauaacaaca

SEQ ID NO: 480 - RNA, 11585 nt, Mus musculus
caggcaauaguuaccccggcagaguuuggucggugggcagggacuccgcagucagcgucauggcugcccgugcuccugagcucgcgcguucccugcuugcugcccuucuggcgcccgcgcugguggcacuacuggugucgccggccucgggucgcggaggccgggaccacggggacugggacguggacaggcgauugccuccgcugccaccccgcgaagacgggccgcgcguggcccgcuucgugacucacgucucagacuggggcucgcuggccacuaucuccacaauaaaggaggugcgcggcuggcccuucgcggacaucaucucaaucagugacgguccuccgggagaaggcacgggcgagcccuacauguaccugaguccacugcagcaagccgugagcgaccugcaggugagcgggagcgcggcgcgguuucccagacccggcagagcaggaaaccagcgucuccaguuuagcucgcuggggagagcgugggucuuagagauaagacuuuugaacccagcucacaugacugucucuucuggccugcgcuggcuaggcggagguuguagcaucccagauguuggggaacuaccaggaaguuccuacuuacccuguuacuggucuaagcgcuugggguaaauucuuugccaguaccuggagcacuucacacccuucagauagucaggcguccucuuuaggcgcugucucugcauaaacugcacucuugugaucuaaaggcauacagauuguuggauaguuuagcguuuggcuuaugugacuucggagauucucuucccuaccuuuaccuaucagcagugggaaacuacuacacagcauuauaguugacugcggaccuggcucugcuuacagcucagguggaaacagccugggagggaaaggccacacaggagcccagaaaugaagccugacucgguggagggucuguggcaaaacugagaaagcuuggugucgugguaaacagugagccaagagacgccgacgcuuuaaccaagcccuugccaugguaugugccuagggcuuuucgguuccaccuguuuucauucauugucucuuguaguaacucuuagaaacaggcauggcuauuccggguuuacagaugaagacaugagguuaaguaauuugcgcaaagccagggggccaacccuaguucaccucagacccacuugucuucaaagcacaggccacaggacugggacccaugugcuagaauagaagagacccguuuucuucagccuccacagaguucuguauuguucuaaacaaauuuaaauuagcuacugccuuuuaaaacugcaauccuaggggcuagggaaauagcccaguugguaaaauacuugccauguaggcgcgaggaccuguauuugguccucaguacccaucuugacagcuugcacgcacaugugauccuacacuggcucaacggcuugcacacacuugcacacacgugugaucuugcacuggccagguggcuagcucccuggccugccagccaagcggagucagugagcuucagaccgcagggagagagagccuggcucaaaaagccaguuggauggcuccagcuucugaggagugaccuccaaaacugaccucuggccacaccauacacucauuaauacccaaugcaccuguggugcaccugcacucugcacgcgugcgcacacacacgcaggauaaaauuuuagagaacaaagucuauugauuugcucuuuaaguuucuaacucuucuugaaaagguuaaagaccuagcagcacugggaguggggguggggcuauauuuuucugagagacaaaaguaauagaagccgcugucccucccagccagauauauugaccccaacucgccccuuuuuuuaaccagcccguuucacuucucuagaaucugcuauucacccguucucucuaccccagagguggcacucaagugaccugcguagcacuugcagagaaguuuuaaaaugcacuaccaagccacuuuauucuagaacaaugcccccuacucccucaaacccucacuggugauccuaauaggaaggggacagacugagccucgccccgacccaugaucuuauuacuaucugugagguaucuggggugucauuauccacacugccgaaauggggagcacugaggcuuagagaugggggcucacccgugaccaccuagcugauggccaacagguaggccuccagugaaguauuuccugguagaagagaggcagauucgaggagccuccccaggcucucggguuucugggaugguauuauugaaaagacguguggacacguugggaaugucagccuuugucuggauacugacucggccaauuaaccagccgaaacugguuccuauuacgcguuuccucuuccagcaaccaagagucucuucaugaggcuagaaagagccaggcugaggcuugagaccacuugcccgguguaaaaugccggccaucucccucacagacaaggggcggcuugggugugugucccguaagggugucccucuugucuaguuguuuuggugugugauauuuuuguauaaugaaucuuuagaggaagaaucuguuucugcugguugguaauaugguaccaaguuauguuguagagccagcaaguccacaguaaaauuggcagggugcuuaccuaggcugugggaagcccugcguuguauccuggggcuuggugauaaggcccuaaauauacagucucaggauuuggaggcgggggcagaaggaucuucagcucaagguuaguuuucucuguuaucuggugguuuccgaccuggcuggacugucuaauguccucucucaaagcaaacaaaauccuuuuaccucuccguccuucuuggcgcugcucucuugugaucugaccagguuacuccugauuucucuuccccuuugacccauuaaaaacaagucaacuuuguuaugugcacagucaugguucuccuuucaguuaggauuuacuuccgcauuggggugccuguugggucuccucagagucuuguauuucuuucuuuuuaaagauuuauuuauuuauuuuauauauaugacuacacuguggcugucuucagacacaccagaagagagcaucgaaucccauuacagaugguugugagucaccaugugguugcugggauugaacucaggaccucuggaagagcagucacuguucuuaacugcugagccaucucuccagccccgagucuuguauuucugauggccuucauuaaguaucuguccagugaaagucccauuuuccucuuguucuuggaaacccauagccccugaccggcagcauccuggauuguggaauuauuuucacauuagaauucccauugccucuccacaucuccgucuuucuucugcugucuuuguuaucaucccugcucccuccucuucagucacaccaugcuuaggcuaaguccucgacaccucaugcuagaaagugcucauacaacuuuuaaauuaucugucugaaccauccugcucaccagaacuuauaauaacaaaaauacagguugcccucugcacagaggacuuaaacacuccugcuccuccuccuccugcuccagcuccugcuccuccuccugcuucuccuccugcuucagcuccagcuccugcuccuccuccugcuccugcuucuccuccugcuucagcuccagcuccugcucuuccuccugcuccugcuucuccuccugcuccugcuucuccuccugcuccugcuucuccuccuccuccugcuccuccuccugcuccugcuccagcuccugcucuuccuccugcuccugcuucuccuccugcuccugcuuuuccuccugcuccugcuucuccuccugcuccugcuucuccuccuccuccugcuccugcuccuccuccugcuccugcuccagcuccugcucuuccuccugcuccagcuccugcucuuccucuuguuccugcuccuccuccugcuccagcuccugcuccuccuccugcuccugcuucuccuccuacuccuacuccugcuccagcuccugcuccugcuucucuuccugcuccugcuccugcucuuccuccugcuccuccuccugcuccuccugcuccuccuccuccuccuccuccuccugcuccucuuccuccuccugcuccuccugcuccuccuccuccuccugcuccugcuccuccugcuccugcuccugcuccuccuccuccugcuccugcuccugcucuuccuccugcuccugcuccuccuccugcuccugcuccuccugcucuuccuccugcuccugcuccugcuccuccuccugcuccugcuccuccugcuccugcucuuccuccugcuccugcuccuccuccugcuccugcuccugcuccuccugcuccugcucuuccuccugcuccugcucuuccuccugcuccuccugcuccuccugcuccugcuccuccuccugcuccugcuccugcucuuccuccugcuccugcuccugcuccuccugcuccugcuccuccuccugcuccugcuccugcuccugcucuuccuccugcuccugcuccugcuccuccugcuccugcuccuccuccugcuccugcucuuccuccugcuccugcuccuccugcuccugcuccuccucuugcuccugcuccugcuucugccgagcuucaaacccuggugucaggucugaggagaugggucaucaggaaaagagcuugccaugcaaguaucaaggguuuugaucccuagcacccacguagaaaaucagcugaacuuccuguacucccacugcuuggcaaauggaauccccuggggcaaguuaaggaguuccugguucauccacacuuguguaucugcccacauacaugggaacacacacacaaacacacacacacacacacacacacacacacacacacacacucacacucacacacacaggugcacaaguaguaaaauaaguaaaaccuuggguacagauuggugcggggacucagcauuuuaacagacucgguaugggauucuagaaagcacugcuuggguauugccugcagaguucacaguagggaaaccucacccaaggcucccucuuguuuuccuccuuggggagguugaggcgggaggguuccucuucuuaccuaacagcuugcagacagcaaauuccuuagcuggagugaagguguguacuucuuaccuagcagcaugcccagcaagaucgucuuuauuuuugauuauguguguguguguggcuaucucuguguauguauugaugugagugugugggggcccucaaaggccagauauuggauccuuuggagcugaacuuacuuaaaagugaccgugagccacugggcguggguucuggaaggggagcgugggccuuuggaagagcagucacacuccucccugcugagccccuccccuccccgcuucccugagcagcucugagacucaguggguuugaugggccauugugagaugggcgcaugcaguugugagugugcaguagucuggaacaauggugggugcuggagagaaaccaaccaggaaucuuuuugccuuggguuuggaaucugagguaaaaauuuucaugugacagaaagaguaagcaacuugagaccacgugacaauuucugcagccaagugauagccacucagcaugauucagcuacuuucuuguuuaaauugugcaauuaggccgugcgagcaccuguggucauuuuaugcaguuuuucuuuuuucuuuuuucuuuuaauuagagcuuaaucuuguagauauuccagcccuaguuuaggggguacuuuauuuauaauucugauaaguauggaacugauaggacuagcuaugcuaaaacauccucuacaguuuguuaauuuaaaacaugacaccucuccacacacacuuuguggggaugggacagguuuuuacccaugggucaccccacccccaccccaguggguuacaguucacuguuucauggaagugagcugcagucaguuccaggggauaguuugacugcgggcuguaaaguguguaccucuccagaaacuguauuuuacaaugaaggauuuuuauuuuucucucuucaggaaaauccagaggcuacgcugacuaugucuuuagcacagacugucuacuguaggaaucauggauuugauccccagaguccccuguguguucauauaaugaugucgggaacugugaccaagguaaguuccacgaagagagaugggcuuaaaagaaugugguggcauuaaaaaccaagggaggggucuuuggagaauaaaacgcaauugauuugugagugggcagaugguaagaauauguccuaacacagauuucaacaacuaaaggcccugaccagggucugucauauagguguguccaguaggguacuuauggggcaaaggacccuuguccuggagccaaauagauguaacaucuggaaggcuccuuauaaaacacucuggcuaaaaacagcugcucauuccgaaccauugcucucuaguuucagggggcuccuuguccucgugccucugccucccaagugcuacuucuaagcacuuuugcccuucuugcacaugcauugaauagaguaggugugagggcacuuucaggccugggugacagccagugcuucugggccauggacagugcuagcuuggaaugacuguugaacagccaagcuccacccccaucaugguuccugcuuuauuugugugugucauuacaaguuugaaagggcacguuucucuguuuucuuuaggcuuccuguacgcucuugacucuuaagaucagaauuugcaacggaacgaggugccaggcaguuuguggugugagaaccaccccuucuuaguaagauaaaaguguccuuagaacggccuguuuaucuccuguuuguccuucaggugaacaagacagaagaggacuaugcaagggauucgcuguuuguucgacacccugagaugaagcacuggccuuccagccauaacugguucuuugcuaaauuaaaaauaagccguaucugggucuuggacuacuuugguggaccuaaaguagugacaccugaagaauauuuuaacgucacgcugcaguaaguaauuauacauuuuccaccauugccggacuguagcucuucccagcacccccaaggcugagccugcuaggaccaccucucaaaauuacaaaacacaugggauuacaaagacacuaggcauaggaacacacaccuuuaaucccucucaucagugucagaugcagaauuaguaaacucaccuguaacccuagaccuugggagacaagggcaagaggauuagcaauucaaggccagccuggaaggcugaaaaucagcucaaguuacaugaaacuguguuugaaacaaaaacaagcccaacaagggggaccuaguaacgggccuguagcucucagcguagugaagccuagggucuauauuuuaugacauuuucuacacccacaacuauaacacaauuggaagggaucuguggccugcagagguaauggaguugauuccaaaggggcuacuggagagaaaggaaaagaguacgggagguuuaaguucaaguuuagcaguugggcccugggguuugggugugaaucucagcauugcaaaacaauaauaaaauuacuaagggcuggagacauagcucagcccaagggccuggguuugguccccaguacaucuagucuggaaguagaaaagaacaguaucuaaagauggccugggccgggaagaagggaguggucagauguggagugaggucaaaugaggucaagggucagaggacagaaugggagggacuagaguguucccuaagugacacuggauuuugcaauauaggacaucuaucuacaagcccaagaggugcuacagcagcuagagucuguugagcguguuuugcuggucugugcuauccuaaucgcuuccuguucguagcugaaauucucaccacaccccugugaagcgagcgcugauugcuaggcuguaaaacaagggccggccugggaaagggggcgcuugcauaacgccuuucagccagcagguggcagugcugggauucaaacgcugggcguccuagcccugagcccucuucugaccccuaaccccgugcuggacgccagguucaucuuuuaguucacuuccuguuugcaaugacugacaacucuguggagagaugggggaggauaguaggacuuauaagucaagacggaaugaguaugggcgcaguaaagaaaccaaaguagccgaucugugggugaaaagagaaaacuguauuccaauaaacagccaaggcugucgccugggaaagcagggaaggauuuccaggguuagacgagaacaagagaacgggggugggggugggguggggguggagugggggugggggugggggaagacucgagagcugggugggaucugugagccaggacugagggugcccagaggcuagcaccgaccuugacaaguucuuaggugccccagcguaugcuaauggagacacacuuguuccuuuugccagagauaaggagaaagcaagcaggaacuuucuucaagucccaagggaauggcggcuuuuguccaaacgcccaaccuugggaaaagguuauuucuuugugggaccaaggaaucuucagucccggaccuuaaauucuuagugcuuauguguucuuuguuuucaugcuauuagagaacagcucauauuaagcuauguaacccccuaaccaccaccaccccgcucccugccguaaauguacauuuuaacagcaaacucgggguuguugguauuucuguauuccgagcagggucgaggguggugcauggcccaugguagguguuuugggggcaguugcauauagccagcugauggaaacacagacuuucaaauugucuaaagaauccaguugucccaguauugauuuuguggccgugugcgugggaggagaggcgcaggcugcugacccucccggggcugaccgagccuccuccuugauaggauuuaggagguagcgauugucagauuauuaccagcaagcgcguuauggaggagaguggcaguaagaaugaugggcuguucugugaggucagaguuuaccuucccaggacaucacaaucuccgaagagcaguuaucucuguguaaauaacacgcccugggcagugcuuacuuuaauaacaaaauaaaauuaugauuucccauaagucuuugcucugaguguguaaaauagaggcucccguucuguuauguagccggguaagugcuuuucugcagcucaaagauaaggcagagagccuuugcucugauuggggguggggggagugcagggggagagugcaggaggugggagugcgggguggggaggaugaaagaccagggcaaggcaucccaccacaguggcagaguaccagggaaggaggcuccuguccccaaguaccucuggccacucauugccacuucagagucuaugaagacuggggucugcacauugucgggaaccaccaauggggucuuugugguauccuaggcuuuccccaggucaccuugccaggcuugcccacauggaccacagaagauacuguuucucuaauuagcacagugccuucuguagcuaauggccaggacacugaaaugaucccaagaaagcauccacacggggaccgcucagucagggcugccgugagaccuaauuaagugcuuuguguuaauucacuggguugccggacccagcccgugugcgcuuuugcacguggagugaaagugugagcauccucuugguguguuuguugacuuccuggaugcagccaugaucagaguaggcguuacuuccuaucaccauggagccuggacagcagcaggccugguccagggcucacuguaucacucacacgaauccuaccaagacagacacggaaaaagguccccagucucucacuugaacccuuaccuggguguagauuuccugguugaaugguaaucccagcugggaauuaacuuaaaauaguaaacguuucggggcuguguuucucucgucuucucggagaaugaaugacccuuuaagucuggccaguccagcucaugagauaacggucucucuuucccucucuaggugaagcaggauaugguggacugagucacaccagagaagugucuucggaggcucaugcacacuugaaggguuggcccugcuugggacgucuccagcugucagcuuacucugccaccucuuguuuuaaucuuguuugcuuguguuaacagagaguuguccgucagaagaugugguugcuggauuuuuaaaaaagaaaaaaaaauguauuuugaagccauuuucagagaaaaaugccauucauuauaaccaaggaaguuuucuuucagccauucccgguggcuuuuccucaguggugcccacagaagggcaacauagaccagcuguagaucgcccauuggcucuggaggaagagaggugcaggugcuuugugcccgacggccacugugccugaggggugcuguccucacacagcugccucaggagucugucagaggggccuagagucgggaggccugggcagggcgugggucccggauacagagugcuugaaugaauccuucagucgaggacagcaauggccacacacggagcuucccacucacguccacccguacagcugauccaucacaaggcaaaacuggguccucuauaaaacuccauaaacaucauacauccuaaagucauaguuacccaggacaaaauaagacaaaaagauuuuccuguauucauuuuccacccaaguagacuguauauuuauuucucauccuucaaaacacacacacacacaggagcuggggugcagcuuucuugguagagcgauugucuaguaugagaccauagcucucuuccccagcauugaaacaaaaacaaccagcaauaacauuuuuauuugcaugagaaaggaaccgcaggaauuuuacauauguuggguuccuuuuuuugacccaacaccaaccauaaccccagcccuucucgggcacucuguaucuccaggcuccuggcacugcagcccggaguccuccaugggagauaaccacgguaccacggcauagaaacaaacuacaacaacaacacaacaugcuucuggccuagaggguuggcucagcacuuaagaagauugcucuagcagggacccaaguucaggaccuggcgcuggagucagacaggcacacuggccaucacuccaguuccaggaaaucauauaccucuagucuccaaggucaccugcacucaagugcacguacccacgcagacacacaccgacacauaauuguaaaccaugcaucuuuucuucagaagagguacuacuuaguuuuacuacguguauucaugcucuuggaugacguaagaguccuuuuaauugagugugcguaucagacuucuuaaacagcaaaagaguugaacaugagccaucauguuggagaaagagauagaaauccagcaagugacuucucaguaaaaacccacuaagcagcaagaauccaguuuuuuucaaaucaauaauuaaaagcauaauucuaacaaagu

SEQ ID NO: 481 - RNA, 127224 nt, Mus musculus
gggagcgggagcgagggaggguuuaucgaccgggcgauuuugguuaaaauauucaaaauggcggacggaggagcagcgagucaagaugagaguucagccgcggcggcagcagcagcagguaaucauuacagcauuuuacauauucauauucauacucgagccgggcucccgcugccccccccgcgacuuagcauaauuuauuaguacucaggauuauuauaauuaacggcgaggagauggggggccggggaacacagcccccucugggcgccgagcggagggggaaaaggagcucggagcggccgggcggagggggaagaagacccggggcaaagggggcugugagccaccgcgcuccuccugcccccggcccaccccgcggcugccgcgccggcccgcccgccggcaccggcccuccuccuccgccggccgccgccgccuccucgcacggugcccgaaucuaagcggguccacggcaggcggcggggccggggcaccgggagaggacaauaaagacauuuuacauauucauagcugcugggcuggcggggcgcggcggggugcgggcgggagaccuggacgggcggugggggggcguggaggggccagagguggcggcgagcacaaugccggugggcggcggggcccgagcggaccccgguggccggacacccgcgcggcgcccccccaggauugggagccggcgcgggcucgggcuggggaacgcugcucgcugcgggacgcaccggggaguggugcccugcccccggccgugcgggggguccgcguggggccgagcccgggggucacggcccggggccccucagccgcgcccugcucgugcccggggcagcggccugaccccagccaguccgugucucugguuaggggcagcguggcgugggcccugugagcuggccuucggguugugagcucgcucuggggucccccggacccuuuggaggcugggcuaggugggaggaacccucggggaaguuccccuccguggaaauggcuucgguuguccgugugucccgggcccucacccagagguccgcgcugcugugggucgcgcgggacaguuggguuggaggugcucgcggggucugguagcuccuccgcgcacauccccccccccccacgcgcugguagccuuggggacccucucgcucugaggccucggagcucucggaggucacccgagaacuggaccguaaaggauugcccuccugcccucaaagggcuggccugacaaguugaucauauucuagauuucuccuguacugcggggagcgggggugguggcuagacacggagaucccccucccugacugugugugguagugcuuucuagcugcgugcugggucuucucuacuugcuucucauuugaauaaugucuaauucagggagguuuauauucuugaaauggccgccuggcuuuccccgccucucauguuuaguaauucagaccuuuaauaacagccacucacagcccaacgccguguuuauauuuuacauucgccccaugugcuuuugugguucgauaugauucuuuuuuuuuuuuuuuccuucuccuccuccuuggcaauccacaggacucugagaucaaacccagucugugcugggaagacaaggagagaacuaggccuggacugcccuaguugccuaggcccuguucucugcugcuugauuuauuuacuaauaaccaaaaugacucccccaucaacugccacucgaguccccuccuccgcaggcaaaacacauccucuuggggaccuuccagcauaaaaacagcuccgagcuaagcaucagcucugagguuggcuuguuuucuucuaaaaggaguuuaucuuucaguucauaguauguggaccuuauuuccaauuuacagaggcuucugugagcuacugguuuaguacaaauacaggacuuuguugugggaauagucacucucuuccugaguuaacucggucaggcuauguaaagauuuguaguauuuguaaaaccggcagacuucccuuucaggagugauggaguagcgagguauuuuagaaaguccggcugacaacacuuggauacucucucagcagggcugcuuuuccaguuucugcaccaacuugaagggaggccggcauucuugugcuguuacugacauagaccugccuguuuuaauugcagcaguauggaaaacagaaaugggguuauguuuuccuuggucaugguuaaaugagugaaaauagaagauaaacagaggcauuguguccacucugaucuuggaacuugcuuagccugcuggccucuugcuuuaaggugucagaauugauuuuuguuuuuucuaggcuuaggacauuuggccuaugagagccaauuaacuuuuacuguuuagagaaaacaguaauuuugauuucuggucucuccuguaaguuuuguuuuaaaaggauaaaaggguggugcuuucugggggguguuugagguaccuuguuaauggcuaaguccuggugauuacauuaaaccaucauggggaauauaugaagacauuagacuucaguuaauuuguaacaaaauuucagauuuaggugaggaacugcaggcuaauuuaaaauaacuacuucucacaauuuuuauuuuuccuucuuucacauccaaguagguaggcccugaaugcaauagaggguaaagguuuccugagaaugcucagguaaacaaccgauucagcacugaaacaggagguuggauggacaaaaagcaguaauaugguuucaugccuuaaauagcauauguuuuugcacccaguucccaagaaguggucagacugaugaugucauuggacagaggacaaggugcaguuacugugauuuauuguccugaggugaaguauagcaauggaacuucucauagggaaaccauuuaucucuggacaauuuccuuuauagcugcaguuuaaccacuacuggggcucuagguauuuuauccaaaaugcacacuguacuuuacaaacaaagcucacuguuacaguuuuugucauacagaaaaaaauauggguauugugagcuggccuuuuauuucaguuggcuguccuugccauaguaaaaaaucacuuccgauggggaguuuggauuuaaaugaggauacuugugcuacauacaccugcuuauuuuaugugggguuuguuguuauugcuguuuauaaucuuucucuuacaagaaacuacuucugaaucccaguauggcccaggcuuguggaguguucuggagccuauuuuaaugacuaaaacggaguugaagaaaaugagggcacuauauuuuuauguuaaaauuauaguauuuaaaauaauguaaaacacuuauggggaggcuugugcuuugaaguagcuuuuaaagaaucuagaauucuuuuuggauuugucugcacauguuuguacauuuacugugaaugguguuuuaaaaaucuccuuucaaaguagugauuugcauacacaguuuuugacauuaauuuuuguaagcauuucuucuguuucuuaaugggcaucuuaaagacaugguuaagauugggccgugacugggaaggccgccgacucuuggagcugaugcauuaggugcgcucagcucacucagugcucaggucauucugcagcucggcagccuccaaccugccaggcuccuguugaaguugucagacaacuuccuaguacaaguuucuagaaaaucggcugcuacuuucuugaguugccccacccauuaauuauaaugggauuucugaauuaaggucuuugacauucaugacagcugaccaaauguucuucauuucugaaggauuuauguuuccaaguguuuacuguaaaaguaacuuuuagccucuucccccccauuucacuuuugauuuauuuuuguuggggaaaaaagccacaagucaaggaaagcacaaacagugguuguucaguuguaacgguguaaugcuuuuguuccuauuuuaaaucuguuauucucuauaucagucggcacuagauagccaaagaaagaaaauuguuucagugcugcccuacuuugaccuaauugcuaaucacuugaucaguugccuuugagugaguuuagggcucagaaugccaaccuaccuuuaccaggucaccaaagauauguaauagagcccugaauagcacaggcaagugcuuuaaaaugauggaacugagaauacuuucuuaaauguauuucauuuaagaaugaaauauuugaauuguuucuugaaucuguguugcuugaucuugacauguagaagugugggaauuaaaugaagaauuuccuuugcacugagaagacucuauguagucuuguguaggggcauugcuuugcucuucuucuucuucuuccucuuccuccucuuauuuucaguguuggaaaccacagucauuccauguuuuuccugauggacaugauuucauuuggagccauucaaguaacuuuuguuagagaauagaauaaacuagaacagauaacauacacccaguuuuggugauaaaugucuggacggacauaucauuugucauagaaauccaacauuagguguuagagugaaaauugggacuuggcucagugacaugacucucuauuucacuuucuguauucucccugaguuaaucucugcccccgugguggcuuugcuuuuauuuuugguauugggauuuguuauagcccaugcuggccuucaauucuccacuuacuugccuuagccucuugugagcuaaacuucacccuccuuuuguaagaaaacucugggucagaauuuuaaauaauuguuuucccaccaugccaucuaaauagcucuuuuuaagugguuaaaagagguaauaauuauaguucauaaagaauagcaauuucuuuaugcaacuuucagaaaguguauuuuugacaucuucauuuugugaaugaggacaauugagcugauuuuuaaauaagugugguuuauuuuuuacacuaacauacuugugucuuaaacugacagugagcuuuuuauauaagcucuuagagugguaacagcaguggccaggagucuuaucagguggagcccuggccugacugauccugucacaguggauuuagaauuuaaaggaugagaauggcuuugaguuucugaaccuuuggcuugaagaaacuuguugcaugugcaugcugcuuacaaagacucgugucguuacuauuagugcuugagugguugaggacugauaggcugucuuuauauacuuagugacggcugcagcuuauuucuucuuuaauaauuucacuccuagcauucguuguugaguaaauuuuacaaaacuaguaauugagcaaagggagauucaagaguuguuuagcugucuaagauucuccuuugaaauguugucuagaaaauugaauauuuacuuagggaggauauaguguauuaauuuuuuuaaaaaaagauaaaaaagcaccaaauuaagcucugugaaugcuugcaauaguaauaauauugaaagaaaauuacaaguauaguuuaauuugccacaugauuuauuuaauaauucuuuguaacuuuagugguuuuuguuggaaucagaaauaguuaaugaaauuaauucagcacaguaauacauuuagacuuuucuuucuuggugaacuuuguucgaauuagaaaguauugacaggaaugucuggaaaguaaacauuuuguacauacuuggguuuaacauguuaccuuaagcagugcagggcuuaugguagcuuuaagggaguguguuucaaagagacucaucuagguguuuccuuggucuuguauguuuuaaugguuuggcuaaugaaaaaauuguuuuuugcugauuuauacuauagcaaauuauuacaaugaaucuuuaaacauaauuaacauuucuuagcuuauaaaaauauaucuguuguguaccucaucuaacuccauucuuucuugugcgcaacaaaggagguauaagaauguuauaguagggacauaaugauaaugucuuauuuaagcagggaaaauuuaaagcaauguauauaauuacauauuaaaauaugcaacauaaugaagauuaggaaagaaaucaggguguguucacguuugaauuaaucaaaacauccuagaauauuauagccggaagguaauuuagcuguaaucuaugccaaagcuuuugcuucucugugugaaaauauuccucaguuuuuagugacuuguuuaccagccacucagccguugacuagcagggguugggagguggcucaacuaguaagguguuugagcucuaauuccagcacuggggaagucuuggauagagguggggcuagggcuauuccugaaaccugcugcaggaagugggugagcuccaggacaauagaaaucuugucucaaaaagcaaagagagcuacuuccaaagauaguugaugucgaucucuggccuccauacgcacacacaucagcagcacacacacaugaaaauguguaagcaugucagaacauagguuucugacuuugaguguugugcugguuuagugaguaagugagagacaccuguccucuccugggaggcaggcggaggacugacugaggacuggcuaugagcagcugacggugugcaggugauuugaaaagggagaaaucagagucauagaaacaaggauacagaaaccgaaguguuuggcuuauguuaauugcuguacgugcaaucaagaugcuuacaaaguaaagcaauuacuugcccuccgauccuuugagucuaguaguagaguaaugguacaagccagacaugucggagaugguaaguccgguugugcgacacagaagagauucuggcccuaucuuuaagugaggaacuuuuacuucugaguucacuuuuacucuugugaacagagaguugucuacuugcuuucuuuccaaaucaaauacaaugcucaugcucacuuagugaccuaagggaagcaagcgcaugggcaguugugguguacauguucauuuauguucuuguauauguuuugugcuccuuuuauugcuuccaucuuuaaagucuuguuuuguguuuuauaugggcuguuuccucuuaagaaaggcagguguaaauacaguuaccauaaucaugacauaaugauaaugucugcauuuuuauagugucuuaaguuuuauagcagcacccucauuuucauuaccucaguuagccuuacugacaaguaguauuauguccauuuuauaguugaguaaaauaaaggcccgauaaagugacuuccccaagguccauguguuuuuuuuuuuuuuuuuuuuuuuuaaagauuuauuuauuuauuuauuacauguaaguacacuguagcugucuucagacccuccagaagagggagucagaucucauuacggaugguugugagccaccaugugguugcugggauuugaacuucggaccuucggaagagcagucgggugcucuuacccacugagccaucucaccagcccgguccauguguuuuaauaagcacugagcguuguggagacccaggagggguaaggccaggguuggagcuuugucaguaggagcuucacaucugcugagugcuuuacuuugguucaaaaguuaauuuauuuuguuuucuaggcagcaagaagucaguuuguaguuguuuuggauagugcccuuauuuuaaaauguuuccuagccagaaucaaagagugaguuauaaagauuuugaacuuggcuuaucugaaggagauuagaaucaugaacagagagauguaaggagguugggagagggaaaauaagggaagaauucaguuaaaaauauauuuuuguauguaugugugccuacaugaauauaugugcacuauguguggcuagcagcucaucggaggccagagaagagucuuacacaugggucccugcaacuggaguuacaggcauuugugaauugucagguagauugcaggaaaccaaccuggguccuuggcaagagcaguaagugcucuuaaucugcagggucaucucccuacgaauuaacauuucaaacauacuugacacaguuuggggcagaucuuauuuagguuccuuuugaaaauugagaaaaaugugaauuaaauaaauaugaaugugaaggguggugucugugcaugccguguguguguguguguguguguguguguguguguguguguguguauugagcauugacaucucauuuugacuuugccacugacauuugugguuauuucugucaacaauaagauagugauaaugacaguguuagaggaauucuguggggaggaacaaauugauagcagaggcaucuuuaaaguacuguaauaauaguuuuucuuagaggaguaccagaggaguuuuauuaguugugcugcuguagaggaagaguagugguagcagcugauggguucugugcaucugugugcugccagccaguccccugggaaagaaguguguccuuuaguacacugaaaaccuuugcacuggaagugcugcguucugucuuuuagugguaccucuuccuguacacuaucuuuuuacuacuuacuuauugagcuuccaacaaggaguauuuuuuuaaugaaguuuugauuuuagaaaaguugcccuuggggagaaggauggcuguauuuuaucuuaagacuuuccugguuccuucuccagauccauccccuaucccaguccugguguuuggguuguugggaaagccugcacacacagcacugccugugccuggagugccgcagaauguggagcguagacagguucuaggaguugagaugcuuauguuccacaucgcggccuagguguguaauuguguaauuuuaggaugguauuuaacgggcugaaaacauuuugcauguuuuaaaguauuuuaaaauauuugcacauuuuaagaggagugucacacuuuuugguuuauuuuuauuuuuugugaugcuagggaugaagcacacaguauuacugaaguacuguaccacugagcuacauucccagcccaaauuucacacuuuuaaaagccucuggcacuuuuauuuaaaacucaacaguggggcuauucuggucugccugcuauccucugugaacagggagguugggcauuuguccuuuucuuucuguucugguuauggccuuaguccuucagcaagacuuuuaaaagucuuuagggcugggaucuaggaagcauuuccuuuuguuuauaugaagggucugucaccugcuuaucuuuagggaccuaucuauucauagcuugucacuauaaauagcuucuuuuuuguccgagcuccuguccuacuuucaaauccuaauuuaguacuuaauuuguguucauuuagcuaauucagugcuucacuguagacagucucauuuucuucccuaauugauuauauaaguaaaucuugucacauaagaacugaaacucaaagcugucuggguugaagaaauguguguugcuacugaugcauguaugguuuuuuuuuauauugggggggguguuuguuuuuguuuuucuauuaaaagacucaucugucuuaaaaacaaacuaugaaagcaggaaccguaggcaaccggcagcuagcgcuugccuaagguaauggguucuaauucucuaauucuaacugggagaugagaaggccgucaccugagguccuaacacugcugaagucugaaaaccccuaucuuauagaacuuuacagugauuugauaauuuauugcuuagagugucucaaacaaugguucucaguuacugcaccagaaagaauggcuggggguguagcucagccuacuaggauguaaaugaacagggcauaaguauucaguuugagugugaacagggagauaauuaacaaaccugacugauccuucugccucccuccauuuuguuccuuaaauacaguuacuuuuccuuggcuugcacuggagauaaaguaauguuaguguaaacacuaccucaacccucagagcucaucauguuggagaaaucauguaguaacaauguucauagccauucauugauaaaaguaugugggguggugguaccaugggaauauaugguagaugccguagucuggaagagcugguuaagaaaggcuuucugaaaguagugucuaugguaagacauagaacggguagggcgugaucagcucaaggguuguuaguaggaggcugaaaauugggaagagggauugaaaauguucuaaguagaaaacaauacauacacacacaugacugaaaauaacauuuucaguguuuucauggucuuuauauauuuuagucacugaaccugcagucagguuuugugacaauuucuauaccuucugauaaaaaugcauugauuucacuagcaaugauuguaucuauaaaguuuuugccacuuaguuuaccaaaugcaagcaaaaauucacauuaaucacgaaaacccuguuggggaaugaaauggcaccccuggacuugaggugacaaacaggccaaugaggaugaguggcauaccccaguuucaggucucucccgguggugucaggaaguuagugggaacagaguauucccuugggcauugucuucugucucaaacgaguugaggaaggagacauagcaagaauugggggcuuucugaguuucugcuuguaaaaggucuguauuuaauaauuucauuuaguuuccagacccagauccugagguaggaaaaggucaguuugaauuuuuauuuuuauuuuugaggauaaggucuugacauaagacugcccugaagcacaacuuuuagcuuugagucuuugucuugcuguuuggucauggacaccugauuaccaaauauaguacuaacuuagcuuucagaaauuuccagaugaugacuauaaaguaguuggaaggaauuaguaugcauauugcugguucuaguaacccacaaaccuugaguguuuuuuuuaauucuguaagaguuagauaguaaacugauuuuugaugguccaggaagcugaggcuggggaguuggagaguucaaggccagugagaacucacuucaaacauagacagacaaauaaacaaauaaagccagcuauguuauuaacaucuugauaauuuuaauuggggguauagcacgugugucuugugaucugguuguugagaaaaaaauuggacuuuauguuuuuuuuuuaacauuuugaaaucuuuuaauuuuuuuuauauggguuguaguagaaaauugauaugggucaaauucugcuaaggaaaaaaaauacauuucuucucccuuaccaaacugcuacuaagccugggaugucgcucucgcuugcagugcugugaccguugguuauuguuucuggugagaaaucagcuauuuaaucacauuggucccaguugugggacacucuacuuacauucugcauugccuugcuucuuugguaugcuguuuaucucugaaaacuuuccagauagcacacaguauuggauugaauugaauaguuuacuagucuuguucacuuuuuugucuuaauauauauuggauuuuuuccccauugcugagguaaaaauuucauguauaguguuuuguauuuuaggacaaauuuugguagggacaguagcacugaguacuugccugaugugcagcagggccuuggguaccacagaguaacaacagcagugacauucuuagaauaacuugaagacacaauuguaacguaagguaaagauuagaugguuuuuauuugcaguuuuagauuugggaaacauucuuuaggauggggucagucuuccagugagcugagcgaagaggcagaaaagguagagaguggugcagaguuauucauuuccuuuucuuguugccuuggcuaaacuauguuccuuuugauugguugcuauuuaucuucuguuuuaugggggaaacugccuguuugagaguugaguuugaguaagugacucuugguaugaaugacuucauucugauuugaucugauucuuagggacuggucccaaacaauggcuucucauaaguuguguccaguagaaucauacacauuuaaagauguuagugucaggaguuuggggaugguaccaagucauguucucuuuuuuuaacuuuuuaaagccaaaucucucuauguaguucuggccauccuggaacuagcaauguagaccaggauggccucgaacuuacagagaucugccugccacugccucuggaguucaggaauuaaaggccagcacuacugugacuggccagauggcuuaguuacaggauuuaucagugucaguaucuccacucucuagcauaguuaauuauuaguuuucugaauuuuuucuuggaugauagaugaauaucugaguguuuugauuuuugugguuuugcucuaaguuguguguaauaaauuucuauuuuucuguauauuuucaaauguaaaacauuuuuuauuacagaaguuuuaaccuuuucaaaguacuuguaguuucauugaaaaguuuuuaauuuauuuucuuuuguacauaugugugugugcaugaguguagguauauacauccacucuggaaccagaagaaaguguuggaucuccuggaccuuguauuacaagcaauuguaauuaggauggagaugguacaugcccuuuagacaucuuccacaaauacuucuucuauucccaggaagugcagcacuacuggcauaguaaggaucaucaaggaguccuaccagaguaaacacugacucggaaaguguucacuggugcucaucauuaaugguagaaaguuaagauugggcagucggguggcaucgaggugguaucaauacgacuguauuggcaggcucaugggcaggccugauucgcagaaacucaauuauuugucagcauagcugccauacaguauacuugaugaaaggaacagugccuguuuguguuaaccuuaaccuguuaugagaaauauaauugugaaguccacuagacuuuuuauucauugugcaaucuauuauuuugcuuuagaugaaaaagcuaaauaacaaccagaggaguuccauagugacuccuuuaaguugacuguuuugaagaucaggauauccuggucagaguuggcuagagcacagugcuagguacauucugaaaauuguucuuuggcuucuuuuucuuauucuuaaugaaaucaaauucccaccuaaaaacauuccauucaucacugacagcauaaagaguugugguuaaaaagucuacuuaaaauauuuuaagugggcuugagagauggcucagcauuuaagagcacuggcuguucuuccagagguccugaguucaauucccagcaacagcacgauggcuuacaaccaucugugaugggaucugaugcccucuucugguguguuugaagacagugacaguguacucacacauauaaaaaaauaaaucuuuaaaagaauauuuuaaguuaaggauaagguuauuaguuauuugcauuauuuugggccauacaagauggccgaaagaguacugcaguacacacaagacuuagugugaccuguuucaaucugagcuguucucaccaacaaauauuagggaaauauuucuuuuuucauuucuuuuugcugugcuaucaaaaugccauuaacucucaguuauaauaaauaugaaucuuaguguguauuuuuguuguucuaguccagugaaagugcauauguaaaugugcuagccauuuaggcaacaauucaaauguaauucuaucucacacuguaaguacaaauacauaaugaacuauugugaugacucaaugguuaaaauuuagcuuuguacucaaaucugauacucucacucccacacccucuuuuauguucauucuagcaggugcuggaaaugcuagaagcaaauggguagccaccugaaaacaaugucuucugaaaaaugaucacuguaaugcagccaugaaaacgucuuaucaugaaacuagaguuuaggagcccagaauaauugaaauuggcauuaggugaaggaccagguggcugggacaguuggcuucuuauuuggaggggggaaauuauguccauuucacacacugcacacaaauuaguugugaagggauuaaaauuuaaauguucaaaggguaacaacagaguugacgaccacaggagcaggaguaaguuuuacagaucaaaagacuucugacauacaauaccccacaggccauaaaaagaagagauuuagcuguggacaauauuuaagguucucucagauucugcagguaaaauuaacauaauaaaugguagaaaauaauuggcuuaugaaagauugaggauuaauuuauguuaauauacaaguacuguuuaacauugauaggaagugaaacuauuaggagguuuggccuuguuggaguagguguagccuuguugaaggaagugcaucacugugggagugggccuugaagcucugcccaguguggaagagaccuuccuccuagcugccagaagacggucuucucuggguugccuucugaucucuacugcaugaagccaugcuucccaccaugauaauagaaaccucugaaacuguaagcagaggcccaguuaaauguuguccuuuuauaagaguugccuuggucucgucacagcaauaaaaaccuaacuaaggcaguguauaaguaggcauuucacuuagaaugauaacugaaccucagcaccucuaucaagacccucuguagugaagaccaaaaccuuuaggacagauacaaaaggacaaagggccagugacgugcaugguucaucugauaaagcagggaggcacuuuuugcucaagccugagucccauuacauggaagucaagaacuggcuccacaaaguuuccugucaucuccacacgugugccacagcacaggcacaccucuccaguucacaugcacgaguaauacaauuuauuuauaaaaaagggaugaaauugaggcaugacuuuuggugaaauaguggacaaauuaaacuauuaagggaaagaauagugcuggagggcaugcuggguguaauucagagguaauuguauguuuucugcuugugauuuuauuaaaugacagucaucauuuuaaaucacaagauaguuaaggagggauuuuugccauuccuguuucaauacacgggucacaaauaaaugauuauaagcuguuuaagcugguagagaacugugcauuucuucaucgguguuuccuagguaccuguaagcuugcugucaauuuuuguguuccuguacaaauuccuuuuaaaaagcaaacuuccuccauguuuugcuauuuaguuuuugcuuuguuuauaaauaccuuuaauacacuuuugccauguccugcuguuugucuuuugcuuacuuuauugccuucucuagaguucuuuaccauuauuuucauagagauuuguguaguuuagaucuuuugcuuuggauacucuugauucuguaugaaauuguuccaggaaguuuuuaccuaggagguagcaguuagccuaacucuuguuucacuauuuaucucucauuggaugaugucaagcaguaaccuaacaaaacauuuguuauaacuuguuuguguuauugcacacaacuccaaauugucugggauggggguaguugaaauaaccaaguauuuugcuuuaaaagcaaggaaucagaaauguuuauuuuaguuacuacugauuuguacauagugaugucaguaaaaagucacuuaagcagauaaaguaguuaugcuauuuaaaagaaugugaaggcaaccuuuguuauaguaaguugacaacaugaauuuuugcuugguuaaucgacauacaacuucaguuauuagcuuaagguagacugagucuggauaauagaaaaucauguuauguaaugauaucuguguauuuaguuguuuaauaaugguagccauauuccuuuaugcuuaaaaguuucuuuguuuuuaaaacuuauaucaauuaaaacauuaauguuagcaccauauuuaagauuauauguaauuuuuauuuucugcacacuagaaucuucccccucccucucuuuuaaagacaggcuauuacuauguaagucuggcuguccucgaacucaguauagagaccaggcuggccuugaacucacagagauccaccuaccugccucuguuccccaaagugcugggauuaaaggugugcaccaccaugccuagcuuaguuuuguuaaguucuuuaguccccugaaaguauuccuggcauauaaaaugaagcaaaguguucguuuuaugccucauuuugcauauaggcuagcucaugugauaauguguacauauuuacuauuuucucuggggaguuguaagauugacugccuucuuuaugacaugccucauguguuuguauccuaaccacuacaaacauguuaagcuaguagauagcuaucucagcagucacaacacaauaguuuuuuguucugccgugcauaucuaugcauagcugaugguuagaaucaccugcucagagcauguuugugcauguucuuuauaguauugccaguuuccuucucauucuuucugugagaauccuaaguauagagcacuucagagagcuuaaaauccucucugaauaggguaggaacagugugagaaucuuugccacuaaaggauagacauaaaaggaagacacagaucauuguggugaggaaucugcacaugguuuuguuggguccucuauguuaagccuuuuaaaaggcugcaaugcuuuggcccaaacuauagucuuaucugaagguucagaugggagggagcuugccgagcuugcucacaugauuguugauggauggaguucuccuuacuguugcacuuaagaccucaguuucuucuuaucuaguacuugguugaucagaaacugcccucccucccuuccuuugugguuucuacagcuuucuuccuuagaguaggccuugaaggagccaaagagaaugcuagcaaggaaagaacguuagcaagauugaaaccauugucuuguaacugagucaagguagguuaggaagacucaacuccuucuaagaggacauuucccucucagaugguauuugggugaggacuaaguacugggugacauuuuucugagaacaagacuuaauuuuuugguuagucuucauagcuagcaccccucaacguacauauauauuuuugaugacaaaaauugucaggcacagauauuucaacuacuugauugacaguugucagaccuuucuuucucccacacugaccuacuuguggccuuuaucucuguuagagaaggcugaguccaaaauacaaagagccagcaacucagccuucgcugucauagucaguagcagugagcagugcaggagagagauaguagaaggcuggggcguggagcgugaacagcugagauuaaagaggguaaaggacagcagagagugggguguuugaaaaggugcaagcucugucuaacugcuggcagaauuccagaacacuucuaagagcucuggcuucuuaggauccauaauaauaagagcuaaggguccaaacacuugaagcuuggaaguguaacacuaguccuucaguacuaggccacaagaacuuaaaagugcagaggugucacacugaaagcagaccgucuggauauccaaggcucaagaguuacuaacauuaaacaaguguuacuuugcuucugcauucuuuucaucuaucaaagaauccucacuugaucauuaacauaauuuccuaaguaguauguucccuucugccauguuauuagaagcauauuacuugauccauuucacacucaagagcaagcaguaauacuuggagucagguaucaguggaggccauuuuagaaaucuaccaacaccuugcaguaauuuuuaggauccuaaaaggguccugaaacccaaaaauuaguuguuuucaagcugaagaguuggcaggucgguuaagaaaacuugcugcucuuauagaggaucuugguucaauucccagcacuuacauggcugcucaagcaucuguaacucuaguucuaguugauccacuggcuucucugacuucccaggguaccagguacacaugggguacacauagaagcaaauccaugcuuaacacauaaguaacaaaauaaauaagucuaaaaauuguuuaaaguuguucucuagggcuugguuuggggccuuggaaacuugcaugugggguaggggugugaaguugacaugagagucuccccuuuauggacuucauuuucucaaaggaaagaucuuaauaguaccgugacugucgcauagcaacaucuucuauguaguagcacaagcguaaagagugaugaggguuagcaaagcaaacgccgcugaggcuucuguuacagucuucaaagugccaugucguucacgaaaaggagaccguguuggugugguacuugguugcugagugauagaauucuguugagugguaaguuauguuaccuuccugauugcuuagcuucuugugcaccuuuucaaaggauuccagaggccaugcaauacgcuagacagaagagaggaacuagucugaguuuuguuauugucuccuucagugaucuuagucuuuuguuuguuguuuguuuuuagagauggggucucaugcuguagucuagacaguccucaacuugccaaaauccuccugcuuccccagugcugggauuacagauguuagccacaacuucuggcucugguuaugauuugucaguauaaaauuugucuguaaacuagaauuguggauuacauaaugaagagggcucugaaugccuucuuggagcauuuugguuuauugcuuguuuguuuuugauagcuugguuucaaaugggaagaaaaugaaugccuaaaacuaugauaaugguaaccgaaggcaaauguuuggaacaauggcaugacuugucuagucuagaccacagugcuagggauuggaggagaugaacauuaaacucagguugucugguuucagaguuaggacuuuuacuaugcuaggagcuacgcuuggguuaugcuggagauaagcauuccaaagagcucuccauuuuuuuuuuuuuuuguauuacuaaaacuaggacagguugacgccguugagcuuuuuccucccaccucuagaauuucuuacauuuuccaucauuuucucaccucuacccauucauuuguuuccagcacuuuuaaguuucugcacacucaagcuucucuuuuauguuccuucuagauaccagcuuucuccagucccaucuguagacucuauuuaccuguaaugcaccuccucaaaccuguugaaaucgagguuuuaaagacacacauugagaaaacuuaacaggugcuauuggccuauaccuucuauuuuuauuuuuccugggaggcaaagguguagaaagaacagugaagaagaaacagaagauuccagaauucugggcauuauuaauauaugcaguucaacaagauguaauuaaaagggaagugaagugaggaguaaguugucugcacaggaagggaggugugaagggcuaaaaggcugggguugcaguugaagaguucaaaguuuuaaaggaggugaugacaaacaagguauaagauuugugauagauuuaaaacaaaagauaguuauagaguuagagaugaugaccuaccuagagcaacaguggccuuuugugugcaguacuaugaaccgccugacagcauaagcuggaagacucuuuuguuauccuugucccuuguuuagaaucagauaaggagauaaucauuuuauuagcaggggauauguuaauuuuguaauugacauuugcaaacuaccggaaaguagcaccaugugugaugaaauucuuuguguugucuuuugaggguauuuuugagcacuguauuuuauguuagcaguguuuugaccuuuucugucauuuugagcuuuuuuuucugaccaacaaagaagagaaaaggguaugagagaaagaacaaauuaauagauaucugucucagaauguuaaagauaugcuggugguuugguggagaaaugucugccauggaugacacugaaacaaagcuguaaucaugaugugggauauauugcuuguccuuuguuuguuugauugauuuuugcuguuuuaaucauguauaguuaaguuauagguacuucuuagguuuuagauugugagguuuaaauuugggauaaaguggaaaguaaagcuuuguagcauuuaauucuugaugucacuuuaagaauaugaaagggaaaaugcaaucucauuuucagaaacuggguguauugguaacauucaccuaggugaaauggagcugauaugcacaaaugacagcugaaccuugaggcucagggacauauccuuaagagaugcacuaguuaggguuucucuugcuguggagagauaccaugaccaagguaacucguagaaaggacaguguuuaauuggggcugacuuacagggucaguuauuuuauuaguccauuaucaucaugguaggaagcagggcagcaugagggcagacauuaugcuggagaaggaucugcaggcuggccuggcuugagcauuugaaaccucaaaguccacccucagugauacacuuccuccaacaaagucauaccuccugcuaaugacacuuccugguguccaagcuucuaaaccugugagccuguggguaccauucuuauugaaacaaccacaagagacuaucugaagaagccaugugcuuuccaaagugcucugcaaauucucauuccuaaccagcuuuucauguugaagauauucaugcaagaaucauuaaguaaguuuuguaagggagucuaagaccucaaaucugacuuugauguucauuuuuucucuacuggaaaagagaaccagcucuguauuaaacucuguucuugaucauuuaagaauacaaaccaaauuaauauauucugauuaguuaugguuaaguucuagccuuuauuuuauuugguuuucuauauaaauucuuaaguaaagaauauccauaaucaagccacaaauggcaagauaaaccaaauaauucuguuugauagaaaagguuuuaaaaaguuacuuaaaauuguaaccgaauucaauguuucuuauaacaaauuaauauggacaacuaacuuaugccuauuauuugagccaggucuugcuaugaagcucaggcuguccuuggauucccuauagagcccagguaggccuugaccucgagauacucacaccuuagacucggaguacugggauuaaaaguaucaccaacauaccuagcuaauuugugacuugauaaaaaguguauuucucuaaggugauauuucuguuccuccuauugcaaaggcuacaguagcuggcaucuugccagguuuguuccauuaacugauuuguuuacauuuaauuccgguucauuaagguguauauuuuaaaguaaguugacccauugcaaacuuaaugaucaauuugcuaaugggacuaaaaccagggagacuugauuuuucaagaaacaagaggauaagaauuucuguaguucuuauguguaaucgguugaauuguuuuauucucaucaguucaggagcgagaaaccuuucagccucuaaauucuguacugauuuauuaaguagcucuuguaaaauaagacacucucucguccugaccuauuguauucuuucuuucuuuuuuuuuuucuugaguuugaauuagaacuaaguuaaguuuguguucauagcucaucagaggggaaggucauugugguggucaguuccuucccucccugcugucaucuuugccauccuucuuuuugaaucuggugucagaugugccugcuucuguaggcaaaauaguagagguguuggcugaugggaaauuuuccauuuuugcugugcuuccuuugcuuuugauccuuucuccccuuugcuuuucuaaagcaucaaaggggaggaaggaaaaacaaaaucaaaaaccuuuuaaaaaauccauguucugagcuguaucuaggcaguuuuauacauuuuguuuguuuguuuguuuguuuuuacaagaaugcagaguagcuuuuuuuuuuuucuggugugguuggguccuuuaacagaauauaccagaugccugaauaauguauauuaaauuacuuaaauaacacacuucacuucugaaagccuguucgcacauuacuugguuuuuaaagaagaaaaguuuuaaugcuuuuugaaauuaggaaaacaccuugguauuguuuuaauaguuuguauaagauuagauuauuaaucugauuuaaagauuaugauggaggguugaggaaguuagcuuaguuacuguuuuacuugccuagaauauacaagguguugggguuaauccccagcaaaaagguggcacacaccaggaaucucagacuggggaaguggcaacaggaaggucagacagacauucagggucaucauuggcuacauauugaguuuaaggccagcuugaacugugugugacaccaucucuuaaauaaagauuaugauggaauacaaaugaaauauguggcaguaucaguuauguugaauauaagccuggcuuuuguuccagugugcuuuaguugcuacauacgaguucauuucugaacuuugccaagggcaguccugguuacgccagucaaacacuagucaauuaguguuugguucugaagguggauaggaaauagcugauuucucccccuuuugugguuuugagaaucucuguggccagcgcuagccuugaguugacuauccuccugcuagguuucugcagugcuggguucuagaguugcauuacuaauccacuuugcguuggauguggauguggggucauuguguuucuuugugauaguuccugggcuuuacauaggucuugauucuuccgcauagaacauuucugcagaaggcaguauuacuucugagcugguaagaagccacaagugucuuauugucguaaccauagaaaaccugcaagcuaauuggaaugcuuaccccugguuucagcaguugaucaugguguucaguucuuggucaucaauuucaguucuuaauuuagggaauuuucagcuuccaauuccuuaucuagugaagaauauuuuuauuagguagaauguccagaaaaugaguaugauaguucacuuuuuccaucaugugauguguguacaugucugcaaauccauaauuauuugauugccuuuaagcagauuaugguuguuuaguguuuuugccuaagaggggagguacuaucagcuucuugacaguacacgugucuuagcuccaguuuaggaccccggguuagugcgguuggugugguacaaaauugagcuucuguaaucaaguaauuuuaauguacuuuuguuucucaguacuguaagaauaagacaaaucuguaaauaugucaauuagcgauucuuugagaaaucacuguauauuucuaaguucucccucauucaaaauuguuucuuaguuuuaguuacccauuguuaacuuugaucuaacacuauuacauggaaaacucuaugaacaacuuacgcauuuugaguuagaugcugccugaguuacauggugaaauuuuauacaacacuuuguccuguccugcccagguugagagccuauucuuguuacguaugcugcucauauauuagacaguuaguagcugcuuugguugcuagauugacuaucaggguccucuaguccuuguauccaagugauuuuuuuuuaauuuaauaauggacccagauacagacuagugauacuggcaccugggauaugccugagagaguugcagaguguuuccuuuaaaugaaaacauagaaguuauccacuuaagaaaaagaaaaaaaaacuguaguacaauaaaauuauuuuugagagaccauguucacauauuuuuacaguuauaguuguucuauauuacuguaugccuaauuuauaaauuaaaaauuauaauagguuuguguugauaaggaaaaagccagcuuaugcaagcucacuauugucuuuuggccugcuggagauccucgaaccucuuuucugccagcaagugagaacuacaacacugacauuuuaaagggugaauaagguccuuguagagaauaagguccuuguagagagcucaagauuucauaaaaguagaaagaucuuauagcucaaccuuauucuucugggugacuuaauagaaacucccuuaaauccagagauaaauaggaaacagauauccuaauuuuggaaauugcaagugaaacuacaggaaagagaugguagcagauaggaugcucugugaacauggagagugaaauuagauuugaacuucagaaagauaacagguaacagaauaauagagcaugcauuguagugauacaaaacugcaggcaggaaggcuacuggaacaucuucagaauaauccaugugucuuaggguuucuauugcugagacaaacaccacgaccaaaaagaaaguugggggaggaaaggguuuauuuaguggcuuaaacuuucagaucauaguccaucacaggaggaaguuagaacaggaacucaagcuuggcuggaaccuggaggcaggagcugaugcagaggccauggaagagugcuacuuaacuggcuugcuccuaaugacuugcucagucugcuuucuuauagaacgcaggacuaucagccuauggauagcaccacccacagugggcugguuccucccccacugauuacuaauugagaaaaucccuucagcuggaucuuauggaggcuguuccugaucugaggguacuuucucugaugacucugucaaguugacacacaaaaccagcuaguacaccaugugagugauacagagucaggguagagcaccuaaccagcauguucaaagucuggguuugcuugccaaggcuugggcuugggggugacaagacccagauuaagagaguccuaguuggagggugggaaagaggguuuggggaaggaagguagaauaauaucaagggacggauuaguucuuaggaagaagaauaucaguguuuuccacuucaaagaacuucuaucuccaaguuugcuccaaaccaagugggcaaugcagcucagauuucagguucagguuuaccugaagucacucaguugguucagacuggauuugcuacucagauaaagccaucacugcuugcuagaagauggaauggucuuuauuuuacuuggacuggugugaugugauuaucugcucaccaugggaaaccagaaaacgugagaguaaagauagaaggcacaugggaucagguccuggcaggauuucuugagcauuuaaacuguauuaugcuuuacauaaacugugaguuuccuaguuuguuuuguuucauuuguauugaguuuuucaguacuuaaaaaaugauuagcaccacagcugaaaauaaaaacgauaaaguuguuaaaacuagagaacaaauggugggaauagguuuagcugaaucaaagaaaccuugaguucuaaguuaagaaggagggucagugacuugcauuaaugugagaagcagcaccggagaccagcucucagaucuuacacuuggcucaguguuguuuguacuguaugauagcacucaucuccacugaaaaguuaagaaaugguagucuuaggaugaacuguguuggcacuuuuuaaaacuauuuuuuuggggggaguguucuuauauuucugcuucuaacucucuuccagcccuauucuaccccaauccuuuccaacccccagcacuagguaggagagaaagaagaggguaaaggggacgaagaccucuuuugacugcuuucugcugguuaggggcguugaauuucuuggagccaguccaaucuuggucaucaggauaucuccaacaacuucuugucgaaccacagcaacaacagucaggagcagccgucaccacagggcccucccucccucaagggacucucacauuuguuuuuccucucuagagugucuagauuaaaaacugucugcagcuggcaaaagcccaugcccuccuagagcaugagccagucauaggcagcagcugggaacagacugaaccagccccauagcccacacccggggcuaaaacagaagcauucaccuaguauaacuguuuguuuguuuguuuguuuuaaagaaaccaaaauucucacuauggaaccaguuguggauaaagggagagugugugcacaagaaagagcacgagcauauguguguauggaaacacuuugauauagccaugcaaugacuaucuucuugugaaaauccugagugaauaccuauugauguauuagaucuggguacacugguuauagcuacacaaaucuuugagacacuuguaauuuugguugcuuuagggggaaagauacuuagaaagcaguaaaauacugccugaauguggcagucccuuuucacucucuggaugugcuugugaaaaaugucucccagaaccuuuaauuuuguuccuaaauuuauaacagagcaauuucuugaugcucagggugcuuuuggugauaagauuuuuauuaaguuggguaggugaguuguagaccauguccuccagggaaucauuuauuguuuuguucgaggauagguaguauugaggagucaugucucauuuuugggcaucaaguagucucuugcuugaaaaucugacauuggcacuauuuuuuuuuucauuugaacugaaaaaccagugcuuguuugagcauaagcaagauaacuuaaaaaacaacuuauuuuuaaagcauugccucuauuuuugcucuguaaaaaaauaaaaacaagaagacaauagaaacauauacuuguguccaaaugucaggaacugcaugcgauucuuuccuuuaggaaagugucugucuuuugagcacuaacauugauuuccaauugaaacugguagaaauagaccagacuuagaauauauguguguguguauacgcucacucucgcgugugcacacacacacacacacacacacacacacauauauacacacacacacacguauacccacauauauguacacguauauauguguguguguauaguagcuucagauuuaaaggaaauugcugagaggggaaauaagccuuuguuaaaaacacuggaaccaaaauaacauugggaaaaaugggaaauagagugauugcuuuguaggaaauaguaagggcucuauucagacaagacugccugucgguggcauuuauuaacccugauugauacaccagguuaugugcuuagcugcuuagcuaauuaggugugucaggauacacauguuuuauaggguaagaaucuggagguuucaguagagcagcucgucaaagcuucugaggcuaagcucuaggucugacaguugaggucugagcauaggaaagcugauuugugucccagcaguuauugagugagcuguacucuuccuccagaugugauucuaaaaugccauuuucuguuuucucuuuucuauuuuuugguauuuuugagacaguuucucaguguagcccuggcuuuucuggaacucacucuguagaccaggcugaacucacagagauccuccuuccuccgccuccugaauuaugggaucaaaggugugcaucacuacuccuggaguucuguucuuucuuauaguuuaacauuucugucuuuugggagaagugauuuauggguuuaaagaaaaaugaaggaauuccucaccauaguucuuauuuuguauuugccacacuuauuuuugggagacuucuuaguaacuggucaugaagaauucucuguuuucuucacagcuaguauuuauuauuuaaaaaagcaaacagauaaauaaauaaaacuuuaaaggauguaauuuucuuuuaacuuuccuccucacaaauaguauucaguaucuguguaaacacucuuaaaggccaggugugugaucauaaguccacaucaggcacuugcguuaucuuuucucuaaaggaauagcuagucaauguucuggauucuuuaaauugagaagugaaauggguauuauguacaugcuuauagaacgagggaaaacaagucucagcacguagguaauuagcaaaguguuaaguaagacuuugugaucuaagccuugagaagaauucuuuugaagaaguaauauuuuuuaggauccccuguuaguguccuuacgaucagauccuuugcagacauuuuguaaaaccuauucuuaguaguucugugaauagguaaggaccugaguuuggaucucuaaaguucacacagggcugguuggacuugguauauauaccaguccuucuucagugaaaugggaguggagacuggaaucccagggaguucaaagacuagacaccuggucucaaacaagauugaacacaaggaccaacacucaagguugucuuuuaacuuccacacaugccucuacacauguauacaggaacauauaagcauacacauuaaaaaacaaacaaaaaacccaaacaaugcuggacagcuagcucagcagauaagaauacuuuuugcuuuugcagaggaccuggguucagaccugugcacaugggggcccguagccaucccaguuccauaggauucuauacccuuuucucaacccuauuugcugcauauacauacaugcaugcauacauacauaauacauacauacauacauacaggcaggcaaaaauauacauauacaaaucuguacaacaacagaaccuaaacuauucuuagcuugugagccauauaaaagcaggcauugugccagggcuucaucaaagaugauaguucaccaguccuguguuugucacuguucuacugguucacaggaacucuggaggugcucugaauuauaguaauugccagucuuuguucaaggcacugagaaaacaaugaaacaauaaaucacugcauuuacuagcaaguauuaaguaccaaguagagaaagaaaaagcauaggagggaauuauauauaccuguauuauuuucuaaacagggguuuugugguuauguacuuugugacagauuaauguauuuuaauguauucauuuggcuucuuaaaauaguacagaauaaacuaaauuguuguccuuuuagauuucuguuaacugauguccagaggacauucgcuuaguuagaaguauggacacagguuacugggcucugcagccuugacuauaaaaucaugaugcuauauugcuucuuguuuaauaaaaacuuucuuaauuuuacauuuauugaugggugugugcauauguuagugauucugguuaucaaacccaagaccuuuuauaugucagguaaaugcuguauuguugaguuacauccucagccuuaggaugaguuuuguacauaguuuuaaauuaucucuguucucuuuuaacauaguagcuguaguauagauacuuaauaaucccuuuguucuuuuaauguggccuaaugaggaaaacaaaauuuucuuuuuagauuuauuuauuuauuuauuguguaugcaguauucugccagcaagaaugccuacaagucagaagagcauaucagauugcaucauagaugguugugagccaccauuugguugcugggaauugaacucaggaccucuggaagagcagacagugcucuuagccuuugagccaucucuccagccugaaagauaaauuuuguaugugguauuuuuuuuuuuuuugcuguucgauucaagaguuauucaggugcauacuuuguuuuaauuaugagaaacaaaagauaaaucagaaacaauuauugcccucaaagggaauaguuucuggaagcaguuuauaaauuauaaauauggcuguuggcuuaguuuugcucuuucauguauuaggagugaucauuugcacuugaggugagcgggguaguacaccaagauggagcuagggcuguccauucugaguggaaagcuggcgcaagaauacagcagauaggaugucgacagguagauuaugauucuggagaguaagacugcacuuccaaaagaaggaagagcuggggaagcaaggucuaaucgaggagaaaacgccagcuguguuuggagcuaaaguagucuucugacuaguuugugugugaucuuaggcaucagaugaagguagacaguagggagccacugaaguugcauuggguggauuaauccaguagcauaguugguaaugaauaaugagaugauuuuucauugcuguaucuuuuauuuucuguaaaauuaaaauaaauguaaacuuaauuuagcugucaaauaacaguaagaaucuucacugaugaauauggaagcaggaacaugcuuauguucucauacugcaccuuuuuuguuuuuucaacaggguuucucuguguaggcugacugucuuggaacuugaucuguagaccagacuggccuugaacucaagagaucugacucugccucccugccucccugccucugcugagauuaucuugucaauuuaaaagucuauggucuauggcuuaggcaggaaauaggggugggacauugggaggagaaagaauucugggagagaaggaggcagggagaggaaccugaaaugaugggaggagguggacgcaugguaccugagcacaggugaccagccacguggaaaaauguagguuauauggguugucuuugauuuaaucagaguagagccuagcuagauggccaagguauuuguaaauauaaauugagccuaagucuuauuucugggagcguggggcugagaggcaaaaaacagaccuaacuuaaacaucugccuuuguguguaccacugcauaucuaauacuguaccaauuuauaaaacuaauuaaauucaccuuuguugacuugugguuuaaaguucuguauucaggcucuuuugcagauagauuaauauuacaaaaacacauuucugaaugauacuacucaaaaagccuuuuaggcuuuuguguguguuugugggggggugucugcagacuuaauaucccaguaauauaggccuagugagaauuuaggcccuuucucaauuaccuccccaugcauucccuacucuauacauacuauucuuuagcuuucucuugauguuacauuucuuuguaguugaugugaccuucgcagagaaggguguguacuaaagugcugagaacuugggcuacuaggucauauuuggcagagcugagaugagagguacuuaaacuugcugugugccagguauuguggcagaucauggagcucagauaccaauugacacauaaguggucucugcuccuuguagacguagucugcagaauauuuuaaucauuaguaauuaaugcacugcuguaauugcaaacugggugaguccuguugggaaauacucugggguacucugagcaaguauaaugaggagaaggggugaagcugauuuagagaggcauguggggaacaucuuuuggaagugaauuuaaaaugaggauugaaaugggagagcauguagacaaggugccuuaucuguuccuguucuaucuuccaaauaauuaacacaaagaccuguuaaguuuauuaacaaacuguaagccuaggcugggcagcagguucugagcuauucuaacccuuuaaagcuguuaauaucagaaaaaugcccaguuacuugccaaucuggucuugccuuggcuuucucugauccauuuguccccugcuguguccugauauauggaaaccuccuggucucuccaugugguccuucucucacugggaucccugguugggauuagaagaaguccagccuuucuaauuccacugccuuugaccaaucagaagaagauggauauccuagguuuugggcuaauauccacuuaucagugaguacauauugugugaguuccuuugugaauguguuaccucacucaggaugaugcccuccagguccauccauuuggcuaggaauuucauaaauucauucuuuuuaauagcugaguaguacuccauuguguagauguaccacauuuucuguauccauuccucuguugaggggcaucuggguucuuuccagcuucuggcuauuauaaauaaggcugcuaugaacauaguggagcauguguccuucuuaccaguuggggcaucuucuggauauaugcccaggagagguauugcuggauccuccgguaguacuauguccaauuuucugaggaaccgccagacugauuuccagagugguuguacaagccugcaaucccaccaacaauggaggaguguuccucuuucuccacauccacgccagcaucugcugucaccugaauuuuugaucuuagccauucugacuggugugagguggaaucucaggguuguuuugauuugcauuucccugaugauuaaggauguugaacauuuuuucaggugcuucucugccauucgguauuccucaggugagaauucuuuguucaguucugagccccauuuuuuaaugggguuauuugauuuucugaaguccaccuucuugaguucuuuauauauguuggauauuaguccccuaucugauuuaggauagguaaagauccuuucccaaucuguugguggucuuuuugucuuauugacggugucuuuugccuugcagaaacuuuggaguuucauuaggucccauuugucaauucucgaucuuacagcacaagccauugcuguucuguucaggaauuuuuccccugugcccauaucuucaaggcuuuuccccacuuucuccucuauaaguuucagugucucugguuuuaagugaaguuccuugauccacuuagauuugaccuuaguacaaggagauaaguauggaucgauucacauucuucuacaugauaacaaccaguugugccagcaccaauuguugaaaaugcugucuuucuuccacuggaugguuuuagcucccuugucgaagaucaagugaccauagguguguggguucauuucugggucuucaauucuauuccauuggucuacuugucugucucuauaccagaagauggagaagaguguuuacaaaacaaugacacaggugaugcuucauagacauaguaauauacucaacucucugcuaguauagaaaucaugugugaccacaccuaguuagauaaaauaauuuuguugagaguuuuguuaauaguguauucuuaguauguagaaaacugcauguaccaggcagucaguggcucauagcugagugaaugaguggaguaaaagcugaggggacagggaaaacacagucuggauaggaaaggcuugguaguugaaguaguuagaaaagauguggagaagccguggguuuaagacagaauuuguaagaaaaacuaauaggauaguugacagugauaaaguaauuuuguuuaucuguugugccccaagcucaguauuuccuuaaacuaccauguuaguaauuagauaagagaccuuguucaguguagugaaggcuagugagaauuuaguaaguauucagcugcugaaaauauuuguauaagguuuggguuuuuucuguuuuguuguuuuguuuguuugauuuuuguccuggggaggauuguacucacaggcucaagcgugucagggagugcauuacugacugagauauggucuuagcucuugauguauacuguuuuguuuugcauuuuuggagucauggucucaugcuguaggccaggaaaccccuguguaguuaacaggcuggucucagacuuggcagcgcucuccuaaccucagccucuuggguguuaggucucuagcaugagcucucauguugguuuccuugucuacuuaaaaauaggacuaugaugccugucaagguggcucuguguuaagaguguuugcugaaaagacugaugaccugaguucaauuccuuccaccugguggaaggagaaaagugacuguugcaaguugucacaugcaaaggacacacacuaaaugaauaaacaaguaaaauacguuuaaauuuaaaugggguuugugagauagcuuguugaaguacccugugaugugguuccuaccuaggcacaaauuuuguucaucccguucuucccagggagaggcaaugaucagacacucucuuguaaauacccuagagugaacagaccuguccacuuuucuuucccaaagagaauugccuuguucaaaaagucuguagugcugcauuugagaauuagaguuagugguguuaacgucuacacaugugaacccuaaaauaaccauauccauauccauucaaagagugauucgaagugguuguuuucuuucucucaacuuuuguuuuuugaaauuaaaauuacaccauuuucuucccucagacuccucccaugcaccuuuugugcucucccaaauucauggccuuucccuuuaauguuuuuuucauuuguuuuagacaauuuuuggucuauaacugaccuacuuccauguacaugcacauaagucuagcugaaaaacauccuuucaaaauagcuauuuuggaaagggcauacaguguuuuaauuuugccuguuauuacaguugccuuugagauagugcaaaguuuuaaguuuuaagucuacucacugguacuaggaguugauuguggcuucugaauacacuguguaguguaaugugauugggcauuaauuaaauaaguaucaacuauaaaguaagauuuuauaaaauuguagcugacuuuaaaguaguuuaaaaguacuacuuuuacaacaucucagcaaauauugggaauauguacacauguacacauuuucagguaauuuaucagaugucaaauuuuaaaagaguauauaguauuaggaaaacaaaaugauaauauuagaaguuacuuuagcacaacuuugggagaacaguguaauacauugaauuugaaauguuugcacuguuuaacugaaauccguuaucacuagucauuuguuuauagaauuaguuuaagcuaucagggaaagauauauaaacaguacuacuucuugaagcucggauguuaguggaaguagaaauaauucaauagagcauaauauguuguuuuaacacaccagaaaugagagcuauguguaugaugacuucuuuuuuuaaaaaggagauguaaaauacauguauggcauaagaugaaaauuuauguaucuaagucacauguaucaggaaaaccugggaaaguaaauacuaaauguaacaggaauaggacaguuucuuauguuuuagacuuaucugguuguuuuaugcugaguaucuuucaaaaacaguaaccaaaucuauuuuaaagccagacauuauuaucgaaucacuuuauagcugucuuuuuccuuuuuaaaaaaauuauuuuuaguuaaguguauguguguggguuugugccugugagugcaggugugcacagaggucagaggcaguggagcucuuggggcuggaguuuaggugguugugaagucuaugugccaagcuccucauuagccucauacaacuauguuuuuuauugcuuuaagcugacuuuugucguacaaaccagaguuauuuauauuuuugauuagccaacgauuccuaggacuugugauuucuugcucaguuauuuuuucaugccuucaagaugacaaucaguugauguuuuuuagucuguuagccuugacugcacacuucauccuguagguggugcucgugguuuuugguguucuuuugugcuacuucuaucucaacauuuuccuaaucugggaaaucauuuaauacccacuguuguuaauagaaugcuuaucuuuuauguaacucuugaaaaaucaguauuuacuauuuaaagaaauauuuguagcagaaaauaaucuguauuaaauuuuuuuuuguagaguuuauuuugcauuuuacuugucuacuuaacuacuuaguguaauauuggaaauuuuuauuuuaauucugaauuuuacuagccaacuccucaaaauuccccaagucuagcagaacuaaauuaucacaaugaguucuuuuuuaaguccucccuucccuucucuuugugugugacucucacucuucucucucccuuuuuucucaucugucaaguucaagagcagcucagaugccaugaauuaagugaagcacaaaagagagaaaggagacccuuuugaagaacaaaggccucccauuaggcugccauguucuuuucugaccaaaagugcacccugcaugguuccuauuguuguccacaugcccugcacauacgguaaauacaguagauccucauuaccucacguuuuccuccccuuccuccuaugccacacacaaccagugcagcuuuaggucuuugauaucuuuaggcauucuuaauacagaugcuuuauauccuuuuaaaaacuacaggggaagaaauggaaguggagaacaggcacaccaaguaaaaccccacaagaagggaaaauuagcuguuagauaagcugcaacccaagagccagggcagguggaggaaccaaagacuuaugguguuauucugcucugugcuaguuagcauccuggcuuuuaaaguuacaacuuugauuuauauggacuauggauuaguuauucuucucuuuguccaugcgacagaacagacaagcgggacaaauugaguugcugagugcagucuuuaaaugagagcuuguugguaaucugcaugcuugccuuugcugucauguacgugacuuauccauagguucauugcucuguuuucauuggaaaugaacugcauuaccuauagguuacuacucguguucucauuggaauugaacugaauuaucuguagguuuauuauucuuguguuuucauuagaauugaccuaaaucuucuauagguuuguuauucuguauuuucauuggaauugaacuguggacugggggaaaaaaaguuuuaagugguaaauagaguaaacugugcagagcuugguuguuuacauuuuuuugaggcagggucucauguagcucacauuggcuuugaacucacgcuguagcugaggaugacccggauaccugauguaccuuuacuuccuaguugccaagguuauagaugugugcagcaacccuaccuggccagaaguugcugaaaguucauguuguaugcauuugagauuagucuguacaguuguuuuaauguugcuggaaacgcccgugguacuuaacuuacaaaggagugugugguucuugauauuugcucacaguuaacuauggaggaaaagacugucauuaccaagcaugucgaaguagcuaaaggccuccuuauuguacagcaaacauggaguccugacgacuagagguuuggguauugguuuuauuuuuauucuuugaaagaaauuugacaguuuuuugguauuguuaaggagaaaagagauggaaagaaugccagaggagaaaggauguacuuuuacuguaauuuuaaauaaaaacauuuguuuugauguaggaaagagugagaaccgaccuuucggcagcaugugcuuucuuucuguaagacugagcugacgacaagcaguuuguggcagcgcuuacaggcugucuugaacucacuguggauuauggggcugcccuuuuaggauuauagauaugauuuagugagguuaaaaagaacauuaaauaaaccuuuucuagaaauagugacauuuuauuuugaaauuuucaugagaugaaauugauguucuggcuucuuuuucuacuugacauucauauuaaaaauaccuaacauuuaacuuuuuuugcccuaaaauuuuuucacuaauauugaaaccuggcuuaaugcgugugauuguaauuguguguguguguguguguguguguguuugagagagagagagagagagagagagagagagagagagagagagagagagagaaggagagagaaauauuugaaaaaaauguguuugagagagagagagaaauauuugaaaaaaauauuugaccuuacuuagaugcuuuuuaggaauaaugaauaguuucauguuuugaggguacaguagucagcaagaauccuucagauuauauacuugacagcaaaauaaaaggcaaaaaucuucuugcuuuguguuguauagguaauuaccauuucuguugacuguaugcaacgaggacucucaggcaaguaagagacuuguucuaauuuugucuugcuuuugccacuggucacacaauuuuccucuuuuguuuuuugcgggguggcauuugccgucagaagaaaucacugacagucacacccagauugcuaaacuccagugcauucacugauauguucugcugggaucacuggugacagcuuugauacaggugcauugaaacauuugccuuugagagauggaaagugaguucucguucuuuuauugcaugcucuugucuccugccaucacauuucaagaacaguuuuguuccuagcauucggccugucacuagugccccgcuguuucucuuugcuaaucagaauguccccugcacauccagacaguucauacauggagggcuacugcugugaaauaaaugugacuccaggccuccaagguuguggucauaauuuuauaaguuaguauugauuuuuaacauuuuguauauuaugcuguaaaugaaauugaacuuacauuguuuuaaauaguuucuuuuagaaccauuagcuuuagauuuaaagacaugcuaggucuuuaaaauauaccguuguucaauuauaaccauaguacacagaauuagaaaaaucaaguaaacaguaacuuuuaaaaucagaaagaauacccagggaaguggugauagaagcaauuuagagcugugagccagcuuuccucuuugagcuuucuuugaagcuauuugaacaguugcugggguaauuuuaaacauuaaauguauuugugacuaaaaucuuccuucucuagcuacuagcuaccaaagccucacaguggucucauuauauagaauuuaaaugaugguuaaaagagacagggaauaauaagguugguuaaaccuauauuuauuaaaagauagagcaugaaaagauuugaagccuuauaguaguucaagguaguaggauucauaaaaaguugagaugcccucccagaaccccugcucccccccccccccaaggauagauuuugacuuaaaaacauucaucugugcccuggggagagagauggaaugaaacgaagacuucagaaaguuuccuuggaagacuuagaacugggaauggaaaguagaaauuaaugaacuaucaagagagaaacaauuuuuauuuccacaaacacugaugaaaaccggaggacagacagugauccuuaggccacucuccacgugcuccuugugacucacgugcucugucgccacguucugcaacccaugcuaucuguauuuacuuggcccaggggcaaggguugguuuuauguuuucagauguguaaaaaaaaauuagaaugaacaagauuuuaugguauauuaaaauuauuugaaauugaaaugcuaacagauaaaauuaaacuuaaaucaagacacagaaauagccacuuguauauguauugucuuugguauuucuagcuguuccugggcugcaaugauaauauggaguaguuguaucagagacuauauggcucauaaaagcuaaauuucaugcuuauuuccuggcuauuuacccaaauuugcuggucacagaaauguagcauguuuucuaaacuagaaguucuuggccauuaaugaaauuccuuuauaccuuuacccgguaaauaauuuuauuauuauuaugcaguaccugcauagucaguguguuuuuguucuccauaauacucccuugguugaguguuuuguguuuuuuuuuuuuuuuuccccuuuagagauagggucuccauagauaacucagucuacccuugaacucaugaucccccaaugauagccuuccacgcuuggauuauaggggcuugaaggcuagcaaguauuuaauuacuucugguucucucauuugaauuaugaaaaaaaauuauuuuucagaagucagucuaauuugcuguuccaagucuacugaaaacuuuguagcucuaucuuuauucaugcuuacaaaaauuacaagaacuuaaacaucagaauugcuauuugcuauuuggaaaagcuacauugagaugagcaguuagucuuuucuugaagguauuaguacuaacagagguuauguauuggauacuuuaagauacauuagaagugagugcugucaagaugucuuaguagcugaaggugcuugcugucaagccuuucaaacccacauguagaaagacaaaaucaaccccuguaguuguccucugaccuccacauacuggcccugguucacccacacaauaaauaaaugaauaguuuucuaagauguacuaagugaucacauucuaaacauaugcugccaacacuggcuuaucuuucucuuguucucgggucugcuuuguucaucuccugucagacguaggagaagugugguaguuguugggaguaacauggaagucuuguaauauucugaauaaaaauuuaggguaacuucuauuaggaguuuuugaguugccuggguaaagggaguacugugugcaugaggauuugaacuuauacuccauuucucuucuuucuauuaagccucacuugccucagccaauaaaaauaugagauuuaaauacuaaaugagaagcuguagaguuugcuugacaguuaacaguugcugcccuucagaugacccaaguuugguucccaguguccguaucaggcagcgucagaggaucugauacccacuucuggccacccacaaacacuaauaaaaaccuuuuaaaauaaagcagaagaaguuaguaaguuuaccagagguagaaaagcuguaguuaauuuucuugcuuucuuucccuucccgagaaaucgggccugacuggaccaugcugcuuaugauugaauuaacucauagaggaaaaacaaaagccagaaccauugauuaaacauuuauucugagugaacaacugcuacuagauaaagaugagaccucauagcuaaguuuucucagcccuuaucauaucuaagcaguaaugagugauaguuccuucacuucuuagugacuacuucacacaaauguaaggguuauucuauauagaccuuuccugcauguguaaacuauuccguuuguguggugguuucaaagagaaauguuuccugugggcucagguccuugaacgcuuaguccccaguuggugcuguuugggaguugguacagucuugcuggagggauugaccacugguuugugaaguacugugaacuuuuacccagaacuuuccuucuuugacacccuugaccacucacucucucucuugaaacugcccucccuggaagcugaaaucacgccucuguuuccucucuucuaccugguaacucuccuacuuugucuccuuuguuuccuuagauguuggauuccugagggcuugauucuaggauuccauuucuuuucauucuacagccuaauguauucaugcccauggcuucaguuacuguuugcugaugcuaucuggcauuuccuuguguccuguauuucagggagaaauaucaaauuauucaugcccaaggaaaagacaugcuccccuuuacuuuccaaauccauagccugucuuauccuagcauaggcaauccuuaucuucccuccuggagcacagcagguacacugguuccccccaguagguguccguacagaagcaacugcaguguauguucugaaaggacaaauguaaccacucuuaggauuauaacuuaggucauuugggugacacagcccauucuacuuucucagucucuucccuugccugucuauacauaagccacuuaggccuguguccagauucugacaaauauccugcuuugaccuucuaccucucuuuccuagacaguugucauuuuauuauuugcaucucaacacaaagacaguuucuguacaaaaacugcuuggugcaguaauuccacagauguggaaggcacuccaggagucggaacuagagaggagaggucuggcuagaagggaaacagcaggagcgcaaagugguccucagcaguacugagaacaggguuugauguuucuuagacuggccucuaacuccuggccuaaguugauccuuaguccuccugucucagccucuacuuaggaauacuggugcuugguauuggaggaguuuguugugguugguuuguuugcuuguuuguuuuucuuuuuuuaaugacuagucagacaaaagaaggucacugauagcuuuuagaagcuugaaauacuacauucuacagcacaaaacagaauucccucaaaaaaauaugcucaaaaauuucaguagugcuaaguuuaagauauaguggucaaaugcaggguaccguagagagaacuaauggaaacaugcaucuauauuauugccaucgcauccauucuuccaauaaacagagacaugaguacaaauuuaacucaagcauguuuagcucagcaugguacauguaaaugugucccuaaaacagaaguucuaccugcucagcauggucuuucaccaugcaaaauagaugcuaaaugaagccagcuuugcuauaaccucccagcuguguugucucucccuccuggggauaaaaaaaaaagaaaaaagaaaauauaaagaacauuuguuuagaguagauaauaauuuuuuuuuaauaacucugacagugugggaacuaauagggucaggggaaagagaaggaagggaagauagccuacuuccagccagauuuccuccuauacucugggcaggcagaugugggagggcugccagacgcuuuccacuuggcccugggugggcaucuaagccacugaccccacucgauaggggguggacaaggaaggggcagccucugaaaccagggggccccagagcgacacccuguagcccugggguuaugggagagagggcugagggagagagguuuccacgcaggugagaguaagcgcagugggccuugauggacagagacagacagacagacagacacacagagagagagagagagggagagagagagagagagagagagagagagagagagagagagagagagaccccagccauggcuaagaggagagaagggggaaaaggagagagagaagaaaggcuagagaggaagagggaaagagagggagaggagagaagagaagagaguaaggggaguaagagcaagagagugaggaggggccaaguagccccucuuaugguaugcuguuaucuuuauuguugcuagguaacuggggaggaguuuagcaugaaggucagaagcuugggacauugucuacuugacuucuagccaugcuucuuuugugggggcugaggggccaguaacuuccacaggagcccugguuccaggagacaugagagaacuccuuccaucccauguaggugaucugcauauaguucaaugccccauaugacaggaagucuuuaaacuuuuaaaauucacuuuauauccaauugcugcccccccuuucugauccaccacccacacagucccuucccuaucccccuuccccuucuccucugagaggguaaaggccccccuggguaucccuccacccaggcacaucaagucucugcagggcuagagcguccucucccacugaggccagauaaggcagcacaguuaggggaacauauuccacagacaggcugcagcuuuacggacagaucccacuccaguuguugggggacccacuugaagaccaagcugcuacauauguauggggccaauacaguucuuaauagcagccuuauaaauuucuguauaucgugcuagguaacugauacaauaaaauaauaaauuuaagaaagcuuuguauuacuuuacugaagaacaguaaacccaaagacuaagacauuuggggcucucaaggggagacuuaggaguacuauguuacgguuagauuccacugucaggugcugcugagcaguuuaguuuacccaauacccuuuucuuuauuuuucauauguaaaauugaaugauaaaagaacuuacaugauuguucuugugagaagaaacuaguuaaugccugucacacuguggcuauuuaaaaaaaaaacaaaacaacaacaacaacaacaaaaaaccuugagcuaggaauggauuuuauuuuauuuuucuuuuaacaggguuuuuuaguguggccaaggccugaaucucacuauguugauuaagauggccucaaacucucaagugcugggaccagcuuuaguuuuuauauuuaugauauuaaaaaaaugggaaggugagugacagauuagggguccacaaggccuaauguuguugcucuguauaauuauuucccagaaaaugcuaguuucugggaauguuuaugcuauugugaguaugguaguuugccaaugaauguuagaaugaaagauagcuguuagaugagaacuggaguuagaaaagaaugauuguggauacuacugacuagagaaggaagucacaguugugacuacuggugauuacuuacaaggggaaaaaaaacaaagccaaacaaaaugaaagucaguaacauuguagaaguagcaaaaccaguggaauccagaaggacuuccucuuuuggaaaugggguuaggaauguuuuaggguccucuaucuuucugcuguguuuaaaaaguuagacucaagagugauguugagcuuuauaguagcuaguuauuauaguuugcuaggauaaaaaaauuucaaguacugucccauguuuucaagauuaauuuuaaaaaauguuuuaaaaguguguguguguguguguguguguguguguguguguguaauaugaguacaugugcguauguggguuauggaagucagaggacagcuuuuguguugguccucaccuuugaccauguucacugcuuuguauugggggccagcugacccaugagcuucuuggggugcugcugucucugccuuccaucucucuuuaggaauuuugaaauuacagacacauaaaacaugugucaguuuugcagaaguucugagauuugaacucaggucuucaugcuuguuuggcaagccuuuggaccaccuuucuaguuuaauguucuguauuuaagaucagcacaugaauaauaauucuuuaacuuauggguauugcacaugcacauaugcuuguauaucacauuugugccuggggccaauggaagccagaagagagugucagaccccuaggaacaggaguuucauucaguuauuuaugaguuaccaugaaggugcugggaauugaacccaggucuucuaagaagagcagcuagugcucuuaaccacuaaaagacgaccucuuugguccccuaguguuauguaguuaaagaucuuauuuauuuacuuauuuuuuguuuuucuguguaugugagugcaugcacacauuuauacaggcacacaagugaguuugcaaaggccaaaaggagguuagguuccucagaguaaugggcauuuacauuuacagaucacugggcuuauacgcugaugcugggaucugaacuuugguccuccauuugagcagcaagugcucuuaaccacugagucaucucugcagcccuuuucuauaguuugggaaguaguccuccaugcuuuauguuaugaaggagauuuaauaaacaguaagaaaugcauaagugcuuaauuguauuuauuuuuauaauaaucaguaaaugcuuuuaauuaaccaacuucacacauucugccguggaaauuuguggagauaguaaauucuuaguuacuucaaauucaagccagauucuucaguauuuauuccuaucugcccuccaacuauccuguuuuucauuuagggugcuaggguaaguuuucuucuuucauuuuuauuuccuugauuaaugauuucacauuucuacugguuuuaaacuguauacaucucuaagcuaauaucugaauuguaguaaauaaugauacuuucuguaguaauugaaaguugcuugaauguuucuaauccgaagcgguccuaaucugaagcagucccuggaguguuuaaagcaauucuuuuauuucauaaauugguuguuuacuuaaaagugauggaaauuauuauugguuaagugagaaauggcucaaugcucugacuucugcuccuuuucuucuacauagacccuguugcaucuccuguaagcaguguguaaacucuccaucuucuggggacagaguaggaaauccuguuccuauagaauacaccuugugaagauuauacaucaauaauaauagggucaucuaauuuugaagagcuuuauagaaaagaaaaaauggagacuacugugcuauuuuaguuuuguauaguuuucuuucuucaccgugcauucuuauuauaugcaguaguugaccuuccauuuuaauauuacuacuagcugguguuuguuuuguuuuacuuucuauuggucucuuucacaguaagagcaaguaguugcaagguauuuaaucuauugaauaaauaaauuguugggcuuuguugaaaguuuuuuuguguguugcagggauaaaugaguaguucuuaucugucuuauauucaauucaugcucacauuuuuuucuuuauucagaggugguaauuaagcuauucuaaauaaucuggcagcuaugguguugguauaagaaauaguagcguuaaguuaaagaugauguaucuuuauucugccacuaauguauaacaucuuuaugauaguaauaugccagaauaucauuuuuucaucuauaaaacaacgaaugacuucuuuauaggauuuuguuaguauuaaaaagguaauauuuaagcauguccagcauggugucugguacaccuaauguucaauaaaugguugucauauuaaaaaccagauagcaguguauuuuagcugccucccuaguucuccgauuaaaggcgugugccauuaccucccaguuuuagggugaucuuaauaaaacucuugagucacaaaaacuuagaauaagaguuaggauaucacaauuuaaggcucacuccccuuacaaaguuuaucuuauucucuagugcccuugucagguguuuauaucucagcugcuguggagcuuuuuucuuuggacaagacauuaugauagguuuucaggggacuucugaguugaauaagguucuucagucuagugccugugagaaauggcaguggagauagaucgugaaggaugacauagaauaugaauauuuacagaguuucugauaacaggaaccaggugggacaaaggagaggagcugauuuguugcaggaagucaugaauauggauacucccaugagacuggaugaaggaaaguacaggaguaaugaagugaaaguuuccuacagugugacuuucuguauccaucaaaugaauuguuaaauaucuaacugugauaugaucaaauuugcaucagaaaauuauaggaaaaaaacagcaauagaaugaaacuucuuuucccaugaacuucagauuguaguaagaauguaauuuaguauuuaaaucaacuuaaaaauacuuuaaaaguggauuggggcuggggguggugccgcaugccuuuaaucccagcgcuugggaggcagaggggcaggcgaauuucugaguucaaggccaaccuggucuacagagugaguuccaggacagccagggcuacacagagaaacccugucucaaaaaacaaacaaacaaaaaguggauuggaacacaggcacagaacaaguugcaaaaaugacuaggcagauuuggcagaguaauuucuaaacaggaaaaagugguccuugaaauuuacauuucaaaugcauuugaaaaagaaauuuugaagaaacuaauaguaggucuugggaaauuaaucagauuacuacuaguguucuagagguagauaugaagagaaaguaagauacagagaacagaaugagaagugcagugcaguugguguucuagagaagacaguucuuaaucaucauuucuaguguacauccucugagaacaccauccagggauauggaaaggcguucacuagaaacaguggaaagcuaaggacacugggagaaagcaaccuuugagcguauauaaagaugaaaugaugguuuuagauagauaaacugaguugcuuaccaccauauccuuuacuaaaggagcuucuaagaaacauuucuuaagauugaaggaagcugaacucagaaagacugaaguacaagaaggauaaacgaaaaaauggaaauauaugaguaacuauuaguaaacuauauucaauuuauuuuauauuaacagagcaguuaccaacuuucaucgucaaccguugcagauaguacaauaagaauuuuucaagagaagcuguaaucuuagcucucucucaagauuauuuucaucuuacaaaugucucugauauaauuugaaaugaaugaaugucuuuuuaaaaaaugugucuacuugcaggcugcugagcuaauuuuaaauuugaauaagaaaauuuaaaaugaaucuaauggaacuauguuaacugaucuugcuccuuaguuaucagucuuuacugucaguguuuuaccauuugaaucuggaauugacuggugagaaugcucagcuuucauuguacgcauuagaagcccguuccaagugcauuguuccaagugcauauccuaauccuggagaagcacagacauaauaaaauggagcuugauguucuucauauggccaagggcauugcagcagaauauauaucauguccuuuauagcuuuagccucagagaggggaaguugcuagagaguguucuguuugcuugcuuguuuaacugcugagcccuugguauucugugagaacaauauauagaauuuuauuaguugccuuuauucaaaaucaacagugaguguucuacucauauucuaaucuuuuuaaacaaaccuuuaauugugaacuaagucucaugcuugauuuaacauuuguugacuuucccagaaccauuuuuucauucauguacaaguauuugguugagccucucucagguucuaccacauaugugaaauugcuguuaaguaaauaagacauaauaucuuguguucagaaaauuuucuuucuagugaaaagcagaaaucaaacaaguauacaaauuuuaaaauuaugaguuuucagagaaaacaaggugaagugauagauuaauugauuuaaaagauuaauugauuguccucaccugaaugaacauaaauugcgaaggccacggggcauauuugacugaauguggcauccuuuuccauaugagaggauauaauauuaaaaugauggggauuuucauuuuauaaugauauaaaaacuacaacagcucuucacaauuuaaaugcuuaucuuccuuaacucagggaaauaugugagaggcccuauccuaauuuuuauuuuauauuuggcucuauaauguggagaacucagccccacauuaaaacacuuggucacagauguuugauucaucagcuguguuaugugcucuguccuuauguauuuagacaguggugccacuguauguaaaagcaguacuuguuaacuuuagcaagaucuuuacauaagacaaaagauaauaccaaagaaucuugguguuuuagauauacaagauaauauaaagacaguagcuauagccccaagccauguuagagaauuuaaacauaauaauuucuuuagaauaaacuguauuuuauugaugagcugauuauuuauauagguuuucuacacaguaaauucuuuuuuccacaaugaauucuuuaaaaauguaugaaaacauuguuuguuguugaaacuuuaguguacauauauucuuuucgcggaauuuuuacuccuggcuucuuugagaguaaagcuguagaaaucucugccaugguuuuuguggauugugaaaacaauugagaagcuguaauuacaauagauggguucucuaacugucuuguggagucuuuuccucagugucaccauagguaguaaaaugugauugcaauguagaagacuuuucucucuaaagaagaccagugaucccuuuaagaagggucauugugaauuucuuguuguaauugcagaaugagugaguuugaauaugaaggaagaagagccuaaauaggagagaugcucuggggcugccuuucucuacaaaagguaaaucagaaagcaucugcuguggcuguuuuaccauuuuuauuuuguuuaagaacaaacauaguaggcaguuuuccuuauuugaugagcaaugauaucaguuugaccggauuuaugauacugaaagauuauugguaggaacucauuaaagggcaacauuuuggaaauuuauccaacuguucuuuucgaauucacacaaaaugacacaaacugaggccaaauagauagucagcauuauuucuaagcaaucuagccuuucacugaaaaaaaaaaucuuccuguauuuauccauuuccuuuuaacugaaagccuuuuuguuaacaagucuuuaagcuuaaaccaaaauuguccuuccuugucuaagucuucucugucuugaauuuuucuuauagaucucuauuaaaccaagcuuuaauagagaccacaacugcuuuguucuuuugaguuucuuucuuuguaucaauaucaagguuacaaaacugauuguauaggauuucacucauuuaguuauagguuugauuaauaagguaaaaaauauuuagccagacacugggagccaaccaaauauacaaauaaauaaauaaauaaauaaacaaacaaacaaauaguucagcuaaaaaucuuauacucaaaaaauagaaauuuguaacauuucauguguuuaguuaggaaaaaauacuccaccaacagguagauaaugaaaaugugguauauauauacauaguaaaauucuacucaguuguaaguagaauuuauaaaaagggcuugaucugaaaaguauauuagaugaaguaacccagacucagacaaaaauuacauauucucucucaugaaguuccaaacuuuaaauguuugcauguauagaaagaaaggaacgaggaagaguuggcuuagccaugaaacuagauaggcggcagucucagguagggcuuuacugcugugagcagacaccaugaccaaggcaacucuuagaaguacaacauauaauugggacagucuuauagguucagagguucaguccgcuauuaucaaggcaggagcauggcagcauccaggcaggcaugguacaggaggaaccccaugcccaugcccacaaugacacacuuacucuaacaaggccauacuuccuaauagugccacucccuggaccaagcauauucaaaccauuacagaggcuacaaggugggaagaagugcugagcaaaggggauaggacaaaagacagaagugacaggaggcaagugggaaggaggcuacuggagguggagggggcagaagaggagaugggagagaagagaaauagcacaguuuguuggaaaacauauaaggaaaccagauucuuuauaggcuaauaaaucuuuuucaaaagcagaaauauaggccuguggaaacagcacaucaagugaacaccguuaauacauaggcugaaauggcucuaugugaggugauuagucugaagcgcauucugaauccauuucuuauugauucuuuauugcugucuuugaagaccuagguaggguucauucuuucacaguucuuuucccauaagaguggaguaaaugcugacaguacauuaaguugauuccuuaggaaaacauucuuugaauaagguacaccugugguacaacuaucccagcuuuaaaaaaacaacaugguggcugggcagugguugcgcacgucuuuaauccgagcacuugggaggcagaggcagguggauuucugaguucgaagccagccuggucuacagagugaguuccaggacagccagagaaacccugucuugaaaaacaaacaaacaaacaaaaaacauggcaagcaaaggaaaggaaacaaguguguauuuuuuucuuucuccuguugucugauuuguauguuaagucaccugucugaggcuugauauguguagcucagggaaccauuuaccuagugucauaugagaccuuagguuccaucuccaguggcaucuucccucaaacaaaaaguaugcaugcauauaugaccuaagaaaauuucaccauauuacuuacacaaacagauccugauaauaaggaaacacuucauuugaaugucuuugucuuucugauuuguuuugguuuuuuucucauaaauugugaccaaucuuuagauuuacuuaaaguaguuaauugucaugcuggaguugaacccaagacuuguacauaauaggcaagugcuuuacuauugagcguacaucuuuaguccccaaauuuuuaaaguacauuuuaugggauaguacugaaagcacuuagcaauuucacaaaaugaccucguuggugucuuaauuaggguuauucuugguguaaugaaacaccaugaccaaaagcaaguuggggaagauaggggcucacccuuccacaucauaguccaucacugaagaaacucaaacugaugcagaaggggugcugcuuagugacuuacucaucaugguuuucccagucauuuuuauagaacccaggaaugagaccgcccacaaugggucaggcccucccuuaucaaucauuaauuaagaaaaugaccuucagcaggguguuauggacgcauuuucucaacugagguucccuccuucagauaauucuguaugucaaguugacauaaaacuagccagcgcagcuuguugaguccaucauuuuuaacaucugauguguuugagcuaacuagaggcuuuuuucuccauuaacuauuuuaguaugucuaugauagcuuucaugcugcuagccuaguucuuugaaauguuacccauuagaaauauguuuuuaaaaaguuuuaguacaucaagacaguaucuaauaaauuagauacuaaagaaaugcauacuuuuauguuuuuaaagaauucagcagugaaggauguuaaaguuuguggcucagacuuuauacucuuccccauauaaacauuuucugucuuggaaaauuuguuuuuaugaaaggauaaaugguuaaauuuucugcccugggugugaagaccuagaugguuggaaaugaauaugaaugauagugagugaguuagccuggguucaagacucuccucuccuuguauaauaaagacucuugguuaccccuugguaauguugcauguaacagaaacagaccugcccaacuugauacucugcaucuucuuuagacagaggauaccagccagcagacuccuuucagaaggcuaguaagcuccuuagauuuuauucuauuacucucacucggauuccaaagaguagaauaaaucccugcaguuuuucacauaucucucugaaguuugacgcuguaaaucaguguucacacuuuacacuguucagaaucuuauagagaauugauuucagaacauauuucuggaaccuccgcccuuagaguuucuaauuuaguagaucugauguaggacccaagaauuuauauucuaaguugguguugaugauagugcugacccagcuacuaucucuaugacuacaaacacuuuaauuaggccaaagaacagccauagcacauuaauuuaaggaaacgaggcacauucuuuaauucagaacuuuaauaaacuguuagucucucugggugcuguuuacuacauuaagggaaccccacccuuacucccauaaauauugacuuaauuuuuuuucucuuuucaacuucuuuauguauguguguguguauauauauauauauauauauauauuagguauuuuccucauuuacauuuccaaugcuaucccaaaagucccccauaccccccccccacuccccuacccacccacucccacuuuuuggcccuggcauuccacuguacuggggcauauaaaguuugcaaguccaaugggccucucuuuccagugauggccaacuaggccaucuuuugauacauaugcagcucugggguacugguuaguucauauuguuguugcaccuauaggguugcagaucccuucagcuccuuggguacuuucucuaacuccuccauugggggcccugugauccauccaauaguugacugugagcauccacuucuguguuugcuaggccccggccuagucucacaagaaagagcucaacuucuuuagucaaaacauuuuuccuaaauuugaugauugccuuccucuaauuuaacagacacacuagccccugcuguuaggcuggaggucacuuuuggauuaguagaaauuuauuuuacuugaaacuucaagcaaagauagauuuuuaaaaacaauuguguuuuuuuuuuuuuuuuuuuuuuuuuuuuuuuuuacuaagauaccacaauugcuugcacaauugaaacuuuuuaaauccgucugaggucaguacaacuuuuggugagccauuaccagcugugucuguugcuauggaaacucagcagggacuagcaguguuauaguuguaaggaccacaccuggcuuauuugcauccaauuuaaguugagaaaauuucuaaaagaauaaaaggucucuccugugccaguggauagcagaaggagcuugucaguuuguagccuucagggugaguggguuuuucucuuccuggaggcuuuuagugaauauguuaaagcucauguuuguucuguguguucacaugugucaauguuuugcuacccuuuuuguguaaagugaucuuuuuuguuuaggauuuuaucuuugguuuauacuuuuaaauuuuuaaaguguuuuccauuuucauagagaacugaaaaaagaaaucacauuuucaaaaagaaaaaucuaauuucucauuugugcucaaccuguaauaacauuuuagugaguucuugcugcuauacaggcuuacaggugaucauaagcugauaucucucuuucagcauuaaacaacacacaccaacaccaaaucucucauacucaccauucucaccaaaugaccaaaauuccaauuaaauuuuggacuuaaaaaaacuagaaaacuacuuauuuuuaugcguuuccagccacacuuggggaauucuuacacuugacuagaaggacacuacaggauaaaacucuggaaaacauucuagagaguaugauaauuaaauccagucuucaugauucaagcuugaggcucuuaccacaugaaaaaauaacaaguauucagacuuaauugcucaguuuaguguagccugaguucuuuauuuuuaguuucauuggcuuuuauaacuguuagugccuuggccuccccaagucaccauguagcuaccuugguagugugagacauuguuuacauaaugagaacauuaccuagcuauagagauuuuauaagaagcaaugaaauaacucaucuuaaaauauucugaaauauauacacauauguaacugucagacauacucuagacagauaggcaacucaaguagccauauuguucuucuuauugcuauaacauaauaccugauagaagcaacuuuagcaaaaaaagcuguguuuuaguucacagucuaaguauaucauggugaugaugaacagugaaacuagcucuaacuauggcaagaguaugugagcucauguaucacacuguguccaaagucaggaggcagaaaggcgggcugcuaccugcucaguuugcuuuccuuuuccuuuaguacucaguccaugauaccuucacagauaugcucagagauacagguguuuccuagguaacuauaaguccagucaaauugguaauuaaaaaauaacuaucauguagaagcauaauuaguaggauguaucuaaguaauuuuuauugaacauucuaagcuacaaaauaaggaagguaguuugaacuaauuacauauuuggcuuuuaaauuuuuuagaauaaacaugugugugacuguagaguauguauaaaugcauguuuguguaugugugugcguguccaugccuauggaggccggaggaugauauugaguaucuuccucagucacuuuccccucauuuuuugaaacagugccucacuaauuuguuagacuggcuuacuagccauugaguuccaaauucauccgucuucauccaccuaggucacaaacggagcuaccauuuauguuugguuuuugcuuuuuuuaugcaggcacuagcaaucugaauucagcugccacacuugauuuugugugcaccauuaaacuagauuuauucagaauuucaugaacuaggaauauauguaaacauauaguuaaacuaauuaugaaagagcuugacauuaaaauacauggcaagugaaagucagugccuguacuaaucccuugcugguugaggcuguuggugcucucugcugaugaagauucuugacacuugaagacaguguaacagucaaccagcagugcagagucacccacuaugugugccuauuacugaccuucccuauuuucccaauacaaaaugugaucuguuuuuuuuaaagacuauuuuuaaauuaguaaaaacuugcauugacuuauuuguaucauuucuaaacaguuugauguuugcaguuugggagcggugaaugcuaaaaugaaaaugaguuuuugguuuugguuaggagaaugcgccuauuaaagaaaaucuuuaggcaauuuuuauccagcuucaugaaaguacaccuuaaaauauauacuccaaggacuuucucuuuaacuucauguucuucaguaaggucagauuauaaaauuuguuuuguaaaggaaggaaugggcauaagagagaugccuaccuaaaagagcuaaaugugcccuggugacuagucuagaguucccuauuguaugugacuuuauucccuuaaaguguuaguuauuuuauacaguuuacucaguuuugccuuuuucucuuuuuguauucuuagacuggaaaaguaagaagagcuuuccugccuuuuuaauuaccaaacuacucucaauuuucauugaaacaauucaaagaaagaaugcagucuuucuauaccugguaaauauuuucuacuaaguaaaacuauuccuuuaguagccacugauaaacccagguguuauggugauugccuuuuauuuuauggauugucuauuaaaaugacuuaucaaauaaauaauuuuucauuuuaguucugaagucuguuuaagauuuggugauguuuuggaauguuacuugggaugccugugaccuagugagcaauagaaauggagucguuagguuuagcauuuaguauaucauuuguauuuuauuauaaugagagaguagcaguaauccuugaugguaguuuaauagaagcacuuuguuacuaauaguuuuauaaaaauaaaucuaauggccaggcgugguggcacacacuuuuaaucccagcacucuggaggcagaggcagguggauuucugaguucgaggacagccuggucuacaaaaugaguuccaggccagccagggcuauacagagaaauccugucucaaaaaccaaaaaauaaaauuaaauaaauaaaccuaaugaguaaacuguuauuuaacauucauuuaaacaaugaucuaagauuagagagaacaagugacuuguuuaaagauggucagcuaaguaguagagaacugaaacagacuccagaucagaaucuguuauugguuuuuuauuuuuacgauuuuuuuuuuacuuuuuucaguuuccuuaaauaugaaguaauaugucuaaagaauaaaaaauuuguaguaacauuucauguguuuuuauuuucuuuuguuauaacuuagagucuauaggaguagagaagacacuaguuucauguguuccuuguaaaauauuucacuuacgcuaacaacacuguuggcaacucuuugcugccugguguguguguguauguguguguguguauuuaaaacuuaccuacaaacuuuugagaguauuuugugccuguuuacugacaacauucccacuauauauauaaaaaguguaagauuagaggaaauagggagaaagaagagaacguauauaaauuauuugguccuuuuuacaaguuacagucuucaucaguguuugguaacuacauauuugcugauuguugugauacucugaaaugugucuuccugggauugucauagagugcacacauggacagagagagaucuuugucuuuauuuauaguuuaagucuucuggagaaaauauuauuucaguauuaaaacguggagaaaaggaaaagaacagcaccuuguucuucagugauguguuucauuaguucuagcaaucuguagauauuuuaccauguacaacaaacauugcuuuuuugcuaugguuaaagccuaguuggaagacagaaauauccaugaguaucuacucuuauucuuuucaugcauuaagaguagcauuuauugaauguuuaucaagagauuauaauaauacccgaauuauuuuuauaaacccugguuauuuuaaaauaccauucucacuuuaggaauacccuuggauacaaucucccuuucuuacacgggcaagcuuaaguucacaagccauauuaguuccuagggaugccacauggaacaccacagcugcaguaucuuaagcagcaggaacuuacugcuucauagcucuagagaaguggcucuugacccuucugacugagacucuuuaguacaguuccucauguugucgugacccccccaaguauaaaauaacuauuuuuaaaauuaauguuuucauugcugcuucauaacuaacuucgcuaccguuaugaauuucuauguuuuguuuuuuuggaaauagaaguuugccaaagggaucaugacccacauguugagaaccacugccccagaggcugucacucuaacauaagguguucucaggguugguucuucugagggcuaugagaaagaaucuauccauguuucuuaccuuccuucuguguuggcucuguucagauuuccuuguuuuauaaggacagaaacacuaaugacuucaucuuauuuaguugguuuuaguauaguacuaaguucaugcauucuaggcaaucucuguagcacugaacaaccuccccaacccaaucauaucaucuuaauaucauuuccaaaagccauaugucuaaaauuaggucauguuugcugccagaaauaacaaucauuccauagcagauaguaagccuuccauucagcauuuccccccacccugccuauggugcccauuuuaguuuuauuuaaggcauugcuuuucuacugaggaaacagugcuguacaugcaaugcucuuucuucucccuguguuuuaugguaaaguauggaggguacccaaaaacuuacuguaguagcucuaaauuuaaaacugccacagaacuugcuaaauuuaggcccuucauagcuuuuucuguggaauguugugucucuuuuuggacugacuuaacucagugaugggcccugagaagugccacagagggagaagcucccaacucaggaagcgccaggcauuccuccuggcaugcagcuaaacccucuguuacagcuuggaagugauggggaaguugugaguugcauacuuucuccugguguucagcuucuuucucugcagucugauucuuaccuugcuaacugaugguuucauuguauuugucuagaaucuguuguuuguccucaucauugaucuugcuuggaagaaucucauuuucaacuuuugcugucauauugaaagcauagaauuccagugaauucuuugguaauacguuauuucucugcuucucuucaagcuuguacuuccaagcuuccuggaccauucaugcauuaucuuucuuacucaagaggcccuuguaaguggugauggugaucuuguucuccuuugugcucuugucuacauuagaaacauugagggugccaauggcaucaaugucaaaagugacuucagucugauaaauaucacaggcuacacaagguaggccuaugaguuaaaauuuuccauguagguuguuuuuggucauggcucuuuuaccuucauauacuggaaugagcauagcugcagguuguaagaacaaguggugaagaucugugucuaguugguaggaaugauaauauuaugcuuggugaggagagucacgacucuaccagcaguuucaguacaaaggagaagagaagugucauccaagaggagcaaauccuuaaccuucucagaauuguuuccagauagaguugucuccaguuggccaccuggacagcguauuauaagcaacagcuucaucagggcuaaugcucaaucaaguucaguuuuuuuuuuuuuuccauugaagaaaucucauggaagcuucugaauccuggggauuaugguagaaccauccaccaggacauugugacuugucuagcuugacaucucaaaggggcuuuucuacagaguccacagugccacagaaauaagucagcauucaguucuugagcaaagguaaggguaauggaguuaaugaagucaguuccucagagaaagaaucaaucucccucccagcuuaggugcuagaggagagcgugccccuuugccagcaguacauagacauuagauagcucucuuguuuuuacugauguucuagugcuugcauuuaaacagagcaauaaaaugguuaccauccaguugucagucuucucuacccaagugggugcuucuagcuguaaauuagaccucaaaagugaggguugacauguuaaaaaugucaccuaaauaucucggcacauuucuuucaacuccagccuuccuaucuaagcuauaagcaguagcaguaguaguuggcuaguugauaauuuuaaguacauugagcccggcaucuacaucuuugguugccuacuucugagagucauugaagucaacuggcaccgugaucauagcauugguaaucuuuccaacauaggcuucuccaguuuucuucaucuuugucagaaccauagagcacaccuccucuggguagaaagaaacuuuuugacuccccuuuguauucuacuuggacauuagaccugugugcaucauucaccaccaugaaggaccaaugcuucagaugagacugaacaacagugucauuaaaccuacacccaaucagacauuuggguguuuuguuuuguuuguuuguuuguuuguuuuaaauaaaacaaaacuguaguugagguucuucacaauccaguucuucacaguguccuagguucaucacugugucagugauucaguaaccauggucaauggcaauuccacuuuccuugcuugaagacaccuacacacgggaggcaaugcuaagaucaaugccaacugcagguccuuuagauauguuugcuuccauguugguccagcuguacugacaagaaggccacacaacccugaaaauugcugauauauucagugagucaguuucauaaacaggacaguuugagauaguacauugcagugcaaauaaauaguauuuuuaaauaaugugacauaucuaaaauacagauuuauaauuaauuuucuuuuuuuuucuuuuuuuuaauuagguauuuucuuuauauacauuucaaauuucaaaugcuaucccgaaaguucccuauacccuccccccgcccugcucuccuacccacccacuuccguuucuuggcccugguguuccccuguacugggcauauaaaguuugcaagacaaaggggcuucucuucccagugauggccgacuaggccaucuucugcuacauaugcagcuagagacaugagcucugggguacugguuacuucauauuguuguuccaccuauaggguuacagaccccuucagcuccuugggugcuucaacauccuuaaucaccagggaaaugcaaaucaaaacaaccuugagauuccaccucacaccagucagaauggcuaagaucagaaacucaggcgacagcagaugcuggcaaggauguggaaaaagaacacuccuccauugcuggugggauugcaagcuuguauaauuaauuuucuaauacugucuaaugucuguggagauuuuauuuuaaauuaacugaguuucuaacauaauagacuuuggagcuauaauaugauguuuucagcaacucuuucuucagacaauaaaugaugacacagaagcugagacugacuuaggucuaagcuuaaauaugaacuuuaauacaauucagaggggcuaauguggacuucucuuccauaagauacugaaaaguccaucagaauucuguguaacugauuauaaguacacucuugacaguaaguaaucacucuuucauaacucuagauuucuauuauuaucauguuccuaugauuagacauuuuugagaguuugggauagcaaaacuacacugguauaaaaaccaccaggguaugacaguacucaugaaguuuuguuaauaguagauauauuucauucauuauuguugcuuuaguuuauggguauggguauuuugccugcauauaugugugugcaccuuacuuugugccugcagaagucacaggacaguguuggguccccugagcuggaguuauggaugguugugaaacaucguguggguucuaggaauugagccuguauccucugcaagagcagccaaugcucuuauccacugaaccaucucuccagccucucauucauugucauuuuuauuuaguuugucuaaauuaugcaaaauuugguaaggaaucuuuuaagucuaugucugucuuuuucaccuucuuuccuagugcaggacuuuguuaggcaagcauucugccauugagcuacauccucagaguuuuucuucaaguuuaaaaacauuucaacaaguuucuuuggugcccuagauucuuuuuuggaugguagugacguuaaaaaacaacaacaacaacuaauaucugaugucauaugucuucauugcuguuccaugugccuaaaaaauacagugacagaggguggagagagucuuaaaguuauacuuaucuuuauguuucuagauuuauuuuuauguguaugagugguuuugccuguauuaugugggugucuggugaaggccagaaaagggcaucggauccccauggugguuguaagcugcugugaugaacaguucuuccuaacuacugagccaucucucuagauguuaacuauugagccaucucucuagacucuaaugccuuuuuuuuaagacuuauuuacuuauuuuacguaugugaguacacugcaacuguuuucagacauaccagaagagggcauuagauccuacuacagaugguuguaagccacugugugguugcugggaauugaacucaggaccucuggaagagcagucagugcucuuaacagcugagccaucucuccagccuauacuguaauucuaauauaguauuuuauaguuuauuuuguuuuguuccuuuguuuacaggauuuaaauucucuuuucaacagugauaaaccuagcucaguuuauuagauuuaaccuuccuuauguaaccaauuuccugauacccgccuuguuuuugggcugaauugugaaugcuaucauuauuuuuaugacaaauguuaaacuggucagauuggcucuaccauuguuucauuugaccccucuacuguguuuaauuugaaaaaagaaguugguuucuuggugggagcucucugcuauugaugguuucccuagaacaugaacaguuggccauaaaugaauuagucaggaagaauauaacauaaccuuaguucauucaaaccagacaaagguuauuuaaaauguauauuauaauuugguuauuauugcuuuuaauuucuuuucugaugaaacuuauaaggugucuuuguaaucaugcuuaacuuaaacuuuaaaucaugaaaguuguucugugagugaaaagaugggaaacuaagcauuguauuaguuucuuuucuauuuccaugaauacaguacccugacuugggaggagggaggauacaguccaucucuggcaaggcaagcaugaugucagaacuugagguuguccagaagucaggaagcagagcaagaacaagauguagggauugacuauaaaaccuccccaagugacacguagcaaagcuccaacccucuagauguuucacagccuuuccagacagugcggccaguuggagagucaacacaugaucauacuuuucacauucaaauccccaagacaccauaccuaauccuucccaaacuguuucacuaaaugggaauuaagcacucaaacauauaaacucauucucauuuaaaaccacaacaggcauaauuuugaaauguauaauuuuaauguuaccuugcuaccauaugauaaauacuauuuccuguccuuuccauaaauguguuaccccaucucauaucuccagucuagcuuaaaucuagaaaagaauuauugaaguacuuauuggccucuucugucaggguaucuauaggccacuaaucaaauccuaacccagguguuaaaagaaggagauauaguugaauuaacucuugcugaucuuacagauuuuuaaggugcucuuuuuugguugaguuuuauaguauguacauuuaacucuguuauagaacuuaucugaccuuuccuuuuggauauaaaugguccauaguugggaaguauaagggaaggguguuuccucucauucuuugcuacuauuuguagaagucugaacauucuuaagaguauuuaaaccuguuguuuaaaguguuuauuucaaagauggccaaaaggacugccuucuuauugcccuuuucacuguagcccagucaccugcccaggugagauuuguaguagaagggaauauuaaccuggcaagcuaagaccuuccuucucuacagaggcaacuugggacuaucuuggccuaaggcaaaugauacuaacacugcuuagguagaaccaacaaagauugcuugucugaggcuaaaggucuuacuugcuuggauagaaaacaccaaauuaucaaagaaaaagguaucuuaaagauguuauuguauagagguuuuguauuuguuguuuuguuuuguuuuuuuuuaaggcaaauuacagagcugguauaaaagggaaaacaaaauuucuaugaaugccgaagaggagaggaugaaccauuuuauuaauaccaaguguauucuagucaaauaaguacuaaguaugucaugggaaauggagauguagauuuagguccauuucaucauugcuucucauccuucccaccuauaguagaacuuguccaguccaacacauuguucuuaaacauucauuuggaauuagcaucccauaccauauucuugcuuauuuuaauacaaaguguaguauaaaauugauauuuuuaaugaugugcuguuuaucugaugacuccauguuuguguggcaucuguggucucucauuccuguuucugcuucaggucaaacuuucuacucuugauccauugugcccgagauaauuuaggcaaccauagguauauaaaugcauaaaauacaugucaaauauugacugauaguaaaucauaauguuacuuuagaauauuuucuugguauguauauuuuaccauguuaaaauuaaagacuaauauaaauuugcacacuaauaagauggaccugcuuauuuauuuuacauaaaugucuuacuuaguugaauauuuaauacugcaaaauauagugccuuuuaacaacuuuuaggguugauugauauuuuuauuuuuccagucaucaguguugagaauaccacuucacacuuucacaucguggaaaauggcagaaguaaguuuaggcccauuuuagcuauuauuggaaauaauguucuaaugccaagcuaaaacucauuuaacaaauuuuuuaauaaaacuuggaucauaaagcuacacagccauucuuaaaauaaaaccuuuuuuaauacaaucaaagauacagggugugugugugugcgcgcgcgcacgugcuuacauauauuuauauacaccauguguauacaggugucugagaagaccagaagaggacauuugauccucuugaacuggauuuauagauaauuacgagccacaugaugcagauucuuagaccagaaccuggcuccuuugucagagcagcaucugcuauuaacugcuaaguuaucucuuuagccauaaagaugcuguaguuugauacuuauguacucggaaugauaggaaaauaccaguccuauaugucucuauaagagcagaaaaccuuguuuguaaguacaguuaucauacuuuauaacacacagugauguugagucugaacugagggaccugaagcagcauggcuggcagcgggaaguauggcagcauguaagguucauauuguauguucagaccccgggcugcagggaagggcauaguauaacacuggacaaauacugacuggagcacccuguuuauuacauguauauuuauugcacacauuuuauuucauaaccuauuuuaaaaaucagacauuggaaugcuugaagacaaguauaaguaaaagguuauuaaugagaggguggguacccuacuuucagcaacuguauuaucuguaugcacuuuaaacaugaugccuuugcuaccaauuauuagucucuuuccucaguacugaaacaugccugccugcuugcuuuagucucuuccccccucacucucacucucuuccuaacccucccuccucccuucccacccucuaguucucugacaguguaacuuagccuuaaguuguguaggucuugcaagaacuuggaucuugaugucaguaaaaucuccuuugaaauccugaccuggaauuauuaauaugccauugaguggaaggugcuuuaguuuucuguacuuugguuucuuuauuccuaagaacuuaauaauguuuguauaaguguccugaauucuuuauaauaucugaaacguuauaacuuaauuucaaacuuuaauaaacauguuuaaugaggcuauauauguacagaacguuuuucucaaacacgcagagguccauuaagugguauugcuugaaaaaauaguuauuuggcauuuccguggcccauuugaggacgaugcacauucuaaguaagaaacugucuuccucgagagucugauguugaugggagcauguuguauaauaggcagcagucagcuaaucuucuguuaauuugguaguauaaaaagauucacauauaaugaauaucugcucucaaagaugcuuuuguacacucuugccugcuucugcauuuauacaguugucuuguuuuaaguaggacuuucucuugacggugugcguuaauaacuggaaaauucccuaucaguagacuagcaccaucuugacaagccuguguucugcuccuaccuugcuaauuguuuccuugggauuauuuggauuguguagaaagccuuuugcaaauccucuuauuacugaagucauuguugccagcaggaauaagauuaaaggugcuuaagucuguagaguuguuucuaauuuguccaugucauuucaguggcauuuuaacagaacucugccucuugccccucccuucuccccugguacuaucucaaguuagguccaagaugccaggccauuggaagaaaucucauuuuauccuccuaauuauuaugcuggcacucaggagauaauuuuucccuucaugcacugccaauuaauaugcaaaugugcugauaaauauuuauguauucauuuaaauuaugcagggagugcuuucaguguauucuguaaaugaauuguuccuggacuucaaagugcuggcugcugugcuaacgaggagagauuugcauaaggcccuaaucacacgcauacugauuaagcuucauuauggaaacugccagcugcaaucuuuguuucuauuuuauuacaaaaagaggaacuuuucaugcuucaguugccuugacaaugucaguccucgcugguagaagagacuaaaacuccucagagcaacugaaguuuccuuauucaguugaagauugcuaugguguaacugaaguuguaguuugcuucucuuguuaauucacuuuccacucuucccacccuuguucucuuaagaacauaguacagauuuguuagaaauaguaguuuuucccccuccccaaacgcuaccuguuccuucuugcuuuggacugucugcaccucuugaagauuuuacagccaugcuggacugcagugacuguguucuagguggguaccagcacaguucuguuuuacagcguuaauauggaaauagcaugugugggauugacuaugcauaaacgcucaaucauauaugcgaccaacaugggggaggggagggcuugaacagagaaggaggaaagcauuugcaaggcaacagcaugcuugaguuugcuguaggucccuccuuaggaccagcucuucugguucagaguguauuuucagcaaauaauguauuugaauuugccuugcauggaggaaauuuuugcuuuugggaaauuuccagcucuucaaguguauuuucagcaaauaguguauuugaauuugucuugcauggaggaaauuuuugcuuuuuggaaauuucuauagaaaguaguauauauaauuuaaaauacauuuuaaaucagaaacaaaauaaaugcuauaucaaaauaauauauacauauuaauaaaauaguuuaccuaucuaauaagaaucccucauacaaaaccaaaaauccuaaaugaaaaauuaaggugguucaugguacagaauuaauauuauaacuacuacuauugugggaaauuacagagguuccugaucaguuuacaaaguuacuggccauucucaaaauuugucacuuugauuucuuaaauccagcuuuaucuuaggaaauuacaguuuuauguguuuuugcaaggcuguuaauaguaaguuuccuacagacccaggagccuuugggagguagaggcucugcuugaguaagugaagcguuuugggugacuaaagaugggucgaauaaaucauggcuuagauaagucaugccgcacgguggccauauuuugugaggccuuccucuguuuacaugaggaugacugcagccuuuuuaagucgucugauacaaaguacaagaauuggauaucuuaaacuuagaacuucagcagaugaguuuuauuuccuguguguuauuuucuauuuuggaaauuaaagcaguuaaugaaaaaguaaauugguacauccaaaauaucugaauucuuauacagaaaacaugguuaaacucaaguuaaccauauacuuguccaucagagugaaaacugcuaugucaggggugcacaugauacaaacaacaaacugauguuagaaguucagcccagcaguaauuuauagacugcaaauuagacucaugaucaguuaagugacacaugcuucuguuuuuucuauuacuaauaaacaaaaguaucagugaauaacuacuuguauauuuucuucuaacuuaccaaguuugaaauuccagaaaugaaagaaaaaugucuuuucagcuauauuuaccauuuauuuuugaauaucagaaauuaaauaacuacuuagagucauuaaaacagacuucccaucguuaaaucagaauuuuaucuauucauauuuuauuuauuuauaaaagauuauucuguuuguguuugaaguaauuuuguaaaaugccuuugaaggucuugacaguucaauaaagguccuuagaaaagucauguaaaauaccuguggcauaauuuucaaauucauagguguggaaauuagguauugacugcaaggccaggcucaugauuugccgagacuugggguuuuugguuacuguagugucugugcaugagaaaauuguuaauucuguuuauauguguuuacugauuguuuuuugcacuuugcuuuaaaauaaauccuuuuuaaggaaaacauugaguguacauacaaugauauguuuugaguuuugugauacguuaacuuuucuaagauuuuaguuaagucauacagaaagcugauuuuuacuaaguugugcaccugguucuuucaaaccuuagugugcuuucaggugguauuuaaaauuuucuggacagugaggaaggaaguuguagaacaaccucauuuaugaccacaaacauacaugucuaagacccauaagauauguaucaguuacaaaaauuuacuauauuagaaaagauauuguucagagucuagaaaacaagcugcccaauuucuagguuaugaaauaugaaaaguuccuaauauuuuuccccauuucuuauacauguagguaaugcaacuaugggcaauaugguugggacuuacaaugauugucuugucuucuuaauuaaacauuuucugcagaugauuuuucaaaguuguuauaauaugguuugauuuguucgcuuauaauaacuugguuaaugguccuuuauaauggaguagagauagaacuuacuugguaauagucuuauuuuauaacaaacauuaagucuguagugaauguagagccaagugucuauuuugucuauucuguugacccuugggaagaaguagcagggcauaaguuguucuugucuccuuuccuacauaauuuuuggaauugcuaauagugguugacaauauuuuacuauggaaaccacaacuuaauaaacuagaaauaauaacccuaaauuaacugguucauuuguaggugguugugacucuuagaacuauagagauuccuguuagaccuucuggugcaguuuguuaugcuuguuuuuaaugaggcauauguuuggccuaccaccuuauuggcucuaguuuggcuaaggaagucaaauggauguguucagacaaguuucuuuucaucuguuagauuauuauuuacugaauuugucuuaguuguaguuaacuaauaucuuugcuuuuagaaaaacaaucauuugagaauaacaguucuuacuuucugagauacuuccagcuucccaguuuauuuuaaaaguguauuacacaugccucuuauaaagaauugauuuuuuagcaugucagacuguaauauaauauuuuuuuaccuuaaauuuuucucuuagaagaaucuuaaauuuuauuaauuuauuuaugaguuccucuaugauuuaggaacuccugaauauuugucagguaaccuuuuuacucaauuuguaauguuguagccugccguaugcuaugcauggccuucuugaaaugaaccacugugauauuagcuaacccuggccuuggccaucguuuugccuccuuaacuuaaccuuaaccgcuguuuuuuuaaacaccuucuuuaccuuugucuuauugcagacucaagaaugaauaauccaucagaaaccaauaaaucaucuauggagagugaagaugccagcacagguaagaaaacauucucuuauccaucuuuugcauuuguucauagagcugaaaugagaauguccacuuagcuuggauacauaguugacaaauacagagaaauuuguguaucugcuuaugaaguaugauguaguacuuguagggacugcaauuguauuuaacauuaucuaacuccugaggagugcauccuuuuucagauucuauccaucagagaaacuagagguaguuaugggaaugguccuuugggacacauaguccuaggucuggauuauggaucuucauuuacugugucauaugugccagaagcugucagauucuugguuauagguauaaucagaauaguagauguggucuacccugcauuugauauaaauuaugcuaaaguuuugauugugucagaaguuauaaacuugucuaguauauccuuucauuuuauuuuaauaaaauguauacuuaacccaaaccuuuuaacaagagaaaaacuaaguaccauauaaauuuaaaaaaugaaacucuuugagagaaagguaaaucuauaaauauauauucagcccauccuuguaagucagucagcucauaggacauuugacagucuaacuaucaucugacagauacgauacaaaauuuccucaguuucugcuagaggcaaaaaucaaaacaauaaaccauaugaaggaaauuaugggcaaggaguuauagaaagucauuaucagguaaacuagacucugcuuacuaaaggguuuaacuucucugacuaacauuucacgacaugucuaccuaugggagguaguaagaaggacagucucucuugaaccuuuguuuuccacuacuccugaucauagguagaaacuuuaauuacaguagaagauuggguugacucaguggaagucuugugucugcaccugugucauuguaaacuguccuguauuuggaaaaacacggaaguacuuuuuaaaaauagguacuucuuuacgggagacuaaggcuuucauguucagcuuugcauauucaguaugucccugcuugucuuguugaagcuugcugaauagcuacaguggcaucucuuccccaagaugagggaaaggagcauugcauucuguccagccagcuuucuuguuucucuucccugucuggaccccuuguuuaucuuaucacugccuuaugcugauauaaguggccuuucuaaaggagugggauuuguuugcagagaguaacuaggcaaucagaccuaugaauaggcucggaaguauggguaggacucccacaucuaaagaguaccucccaaauuucucgaaaggaaaaaaaaaaaacucagaaugauuacagaauguugaaaauauccaugaugucagaccccuugaaaaucuauauuuacuuuuaauacuacaauuucucuacuauuuauugggugccuacaauauuuaauuucaaccuuuguuuuuuuuuuuuuuguaaacguuagugcuaugcauauuaucugauuucauuuaaauucauaugacaaguuagauauuauuucaaagacuagggaguuaaaguauaaaaccagagaagaaauaaaggcaaguuuagacuagcaccuguguaagguuuuucucaugaacuauaauacauaaaauugaaaauuuaagcaacauauuauguguucaaacccaaagucauuucuagaacuguauaaaauacauucuugcugggacacuuggugaacuuugugaauuacucgccuugugagaauaugggauguguaauagauccuucucauagagcugagaacugucaguuuacacagucacuuucuguguuguguccuuguuuguuuuaagaaacagugauuggccuggaacacuuuauauaaauuuaaaaaaaaaaaaaaaaaaagcuggccuugaacuccuaaagauccuggggcuucucccugaauucagaggcgcggugacaauucagauagauacuuauuacgaccaguaacucauuuuccuagacuucuuugcuucuccaucaccagugguagugauuaauauucucuuuucucuacaaagagaaaauuaauugcuuuucuguaagaucucugcuaauauaguaccaucuagcuagaucaaauaugagcagguuacuacccugagaggcauagagcucacuucuuguuuauuugcugcaaugugcccuaucuucauagacacagauuguuuccacauuuuggaccauuucagaaucaaagcacacuuuauugauuucuuaguguuaaggguaugccgcuaugcucuuagcgcucucugcugguauuaauuuauuaguuuagaaauauagauauguuugaguucuguguuguacauuagauuauuacuauuauauauauuagaaauaaaauuacggguuuuuguucuguuuuguuuucuuuuguuuuguuuuaaaguaggauguaauggguuaugcccagcaguuggaaaauuaaagcaggaagauuaucuugaguuucaggccaggcuagacuacauaacaagaccuugcuugccucaagaaaagaaaacgugaaacacagugacaccauuugugccaugauaaagaaaauaguagcuuauuuagaucauguuaugccuguuuuaguuuucauuuuaaaauucagugaacuauauagacuguuugcucuuuuucauuuguuuaguaauuuguguguguggggggguuguuuguuuguuuuuguaguucaugaaaaaguccagauuuuaaagaaaggagcccugaauauuauauaaaaccaaagucuaaaacuuuauagguucaggagacaguugugucgaccucuuuuuccuaaaaugaucacagcuaagaguuugcuuuauaagauuuuaaggguaaugagagguaugaaggucaggcauucugaccaugcauuuuagacagacaaucuucauaugcacacagaaaauuugugauucagguuuguucaggauucugucuuauauguaaaauguuauagguguuauuacuagauuugguacaaacagaugagacucacagucuucuuaacaaucuaccaaaagccaagacauuaacaaaacugguucuggauaguuuauggugaguuauccaagaucaagcauagaagagcaacauaauguuauuaaauggccugccuaccugucucccucccucccucccucccuuccuuccuuccuuccuucguaaauuauuuuuuaagugggguauagugugguacaugacuuuagaaucagcacuugggaggaguugcaaagaaauaaauacaacacaccaaaauagauucaaaagacuguacaacucaaggaacuucuuucuaucccauuagauuauacauucagaacagaagcuauuaagcuuccuucacguugaauuuuauacuucacuaucuaauauauuuuuaugcgguaucagcuaucaaaaccaaaaaaaaauccguggcagaguuagaaaagaaauuagcuucguaucccuuguauuuguaucuguuuccuacauucagucaguccuucccucacccccauaaccuuucuucuucuuuuuucuacaugugguaucauggcccauguacauuuauuugcauauaacuggcuaguuuccacaugagggagaugauguauuuuuuucuuucugagguuagguaacgucauuuaauauuacacaaucaaaguccaucaauuuuucugcacauuuugugauuacauuuuucguuagaacuuuauagaauuucguuuuauauaucauauuuucauuggccauucaucuguugacagaccagauuccaauuucuugcuuuagugaauaaagcagcaagggguguaaauaucucuaugauagauuguggaguuguggguaugggcccaggagugacagaguaagaucauguaguaguucuauuuuuaauuauuugagaaauuuccaagcugauuuccacaaugacuacacuaauuugcauaucucccaacaguagugucaccacaucuucuaucacauuugucguacuuacugauggcagccauucucacuggggugaggucuuaucucagaguaguuuaaauucuuauuucccuguuggcuagggauauuaacacauuaaaaauaguuauuggccauuuuuguuuguuuguuucuuuucuuaaguuaucuauuuagcuuaucugcccauuuguuaauuggcaguuuuauuuccuugguauuugacuucugcagcucuuuguaaauucugaacauuagcccucugucugaagugugauauaaagauguucugccauucuguauguagggugucaguuuguucuguugauuauuucuuuuaaugaauuuuuaaauacacuuauaggcaagguaaaaugaaccaccauugagggagaaaguguacaaauuaaaacaaguggguugggggagaaaccagaguucucauuucaagaagccacaugaauguugaugguuguuguggcuugccuguaaguccagccuugaaaagcagugguagagcuuucucuaagcaagcuggcuagcaagacuacucagugaauauggaggaagugaucaaguaugauuccuaacaucaaucucaugugcagugaacuaugcacauauagaaacaugcauacacaccacacacaugauggcagcaguacacagaacagaugguuagcuuuguaagaaaguugagaagaagacaggagaacugcauuuguggucuccaguacuccaggugccuacugcacccagaggacucacugcagugcaguaagauaaugauuuugauaucaaauucauuuuacagaaaaauacauauaaaaaauaagcagucaacauugagacuauuccuuaagaaguaugugauucaugagaauucaguauaaggaaaaauguauuuccaaguuggaaagaaaguguuauggaagacaucauuagaggagguagaguuuaugcugcccauugaagaauggguuacaguuaaacauaauggugguuggcauuuuacccucagcaugaagaagcaauaaaagcuaagaugaaguuaaagaaagauguaccaagucucucucucucucucucucucucucucucucucucucucucucucucucucucucucucucucucaaauuaugguauguuguaugaucuccagacccuuuucuguuuagucauucccaaaauuacagaauuacauucuuguagagacuuuaauuuagccaguauuacuacauuggcuuucuuuuucauuggaauuggaauugaucuucuaucuugcuuuguguguugcaugcacacuagugugaugugggauucucauacaugcucauguaaagaucagagcaggacaucagguuucuuccucagcugcuuucccccuuguuacaaugggaaaggcuucucacugcacuuguuguuuuggccagguuggcuguccagccaacucuccugaucuaucuaccucuaccuucagugcuaagguuuuaagcacacagaaggcuuuaacacuuaugucauguuuaugucauggcucuugccuguaauuccaacccuucagaaguagaggcuagaaggaauucaagggcauccucaacuguagcaggcuucaggacagccugaacuacaagagacuuuguuucacaaacaaaccagaaagccacuuuauuuuuuuaguacuuguaguuggcauaguuuuucuugcugugaguuguuuuauuucaguuuuaucagauaagacacaauaaauuacuuuagucuccuuuuuuuauuuguuaaggcuuacuuuuuugaccuaaggcuacuguuggaauauucuguacauauuuguuaagcccauucgauuuaugauguaguuuaagucuguuugaccuuuuagauuagacaaccuauuuaaagaugagaauugucuuauuuauguggguuugauuacaaaaacuaauaaaguauucucuaaauuaaaaaaaaauaaagaugagaauugaguauuaaaguaaccaauauuuauuuugucauagccaaucagcccuuuuauacccauuaguguuuauuugauacauuugggaguuccuuuauucuaugcauguauguuuacaauuguuguaucuucuugguggaauguuccuuuaacuagcauguaauggcccuauuuggaauucuggcuugaagucuacuuuaucagaugucagaacagcuccaccaagcuuaguuuuuuauucugacuaguuaacuucccuccuauaacucucagucucuaucuagguauaccaggaugcuucuuggcaacaaaaguuagucuggucuauuuuuauaaucagccagucaguuggcgaguugaggccauuuacauguaagguugauacauguuuacuaauuuaauugguuguuuuucuaguugguuggauuguuugccuugucuugucuuucuuccacgcuaguagggguuuucuggauuauuguguauuuuucuuccuucucuguauaacauuccucuaaguaucuucuacagugcuagcuugguugacacugccuuagcuucugcuuaaacuaaaauguccuuauaguuugccugucuuaaagaauagcuugcucuacagaacagucucagcugcaguucauggacucucaguaguugugccauuccauccuucccugaauuuuagguugcugacaagaugucagauauuauucugaugucuuugacuuuguagguaaguuagcauuuucacgcuuaauuuugaaauacuguuuguuuucuugguauucuagacaucugacuauaaaaguuguguauuucuucauuucuguuucagauucuaaguaucucaacaucugagggcuucuuucuuucucuugauuugagaaauuuccgcuauaauuuuguagaugagauucucugccuuuauuuuuuuaauuuaauuuuauuuuauuuuuuguuuuucaagacaggguuucucuguguaguccuggcuguccugggacucauucuguagaccaggcuggccuugaacucagaaauccgccugccuccugagugcugggaucaaaggcgugcaccaccaauucugccuuuaauuuuuaaucucaguuccucccucuaaauuuggugucuuacuaguugcccaggguuguuggcuauuggauuauuguguggggucugucuguccaucauucuguuuugucacccuccuccaaccccugccucccacauacacacgccacauugguguuuaaacauaguguuucuucagucuuguccuucauuccuugucuuccuucuacuugguugagucuacugguaauguuugguucauuggguuuuucacuuuugacauuuuuuuuucucucgauuuuuuuuuuccugaacuguuucccacacacucccuuucucuccugugcuacucaccuucuacuguguuuuguugagguuuuaugucgccagcucucuggagaugggacuugauugugucuuccuugaagucauggcaauuuaacuagugaacuuuugaaauuguacuuauuucacuaucuuugaauucagucauugaguuaguuaagauguuuuagaggaguaauauugccuugcuuuuuucuacuuuuuguguuucuagguugugauuuauguauguuguuuuagacaucucuucaaguuuuauuacagagucuugcugugcagcccacucuuagaaaugaauccccagugucguucaguaaggagaaaacugacuuguaauagcaacagcaucagacuguauaaaacacagaaauacucucaaaacucaguuaaagcccaccagucuguaaccuauguacuaagaauuauucaggauaaauguggggaugauuaagauaaggaaaggggaaaaagaauugaagaagaauguugugggcagggaagaucagaaaagauaaaaugagaaaugaacaacaaaaauccccaaaauaaaaaauucgacuuaaaguguaguaaagagagggaaauggaaacuugggacaaaggaagaaggaauuaaguuaaagaaaaauguugucuuuuaagugcucaccuuucuuacucucuagccuucuuuuucucucucccuucccccuucucuccacguagcuauggcuggucucccucuuucuaccuucucucuuucucuuagccuuucuacaauaaagcucuaaaaccaaaaaaaaaaaaaaaaaaaaaaaaaagaaagaaagaaagaaaaaaagaagaaagagaaaaaagaaaacuguuuacccagcagugaaagaaaccauaaagaaaauauuagaagagcgugcaauguaaaauacaaauuaaaacauucagaauucgauaacauaaagaguguaauaaaaugaagguacuagguccucuaaaauugaaggugacugauuauauggggggggugcuguggaggggucagucaugacgugguuuguccuuaucuucuguuuggcuuacacuggugcugagcaggcuggaagcuaucugcuagaguaccuucucuuccauacuuucccuucuuucuuacccauguccccauaggguucauacuuagcuuuguaaucugugggcugggcgaguucuaccaccuucuagaaacuuagcaguucauacucccaggugagcacugcucuguucugaagcaucucccaguugauguggugguguggaaagccuuaacagaaaugaaccugccuuuauacuuugaagaccuagguaguaaucacuugcucgaagcaugcaguuguggauaucagguaaaaccucuagaacuuuagaguuuuggggauguacaauaaugacuggaggauggguggccccagaaauuggacacauccccuuguggaccucaggcucagggcuguguuaagauaugugauggacuuuaaacaguggaggucagcauuaccuuucccaggcacuuugcugucugagcugagccuccuuccaccuacaucuuuuggcuuguuaguauugcuucuuuccacuaaugccccacagggaugugucuggcccugggaguuguggcagauuacaucuuugucccaaugccaggcaccugguuuaucuuuugaagaagccaugcguuuucccuccucuucaagggauuaacauuuaaugaugguuaagauuuuaggaaaauagcugaauaauucucuugucaguauuuguuacauuuagcccucauuacauuauuaaccucuauuaaauaaagauuaauauagcauuuuagguggccuccaauuucacauaaaaaagagaucucauaacugaaagguagauuaaauuuccaauuuuaaaacuauauuuuuguuacuagaagcaaagaaguuucuauguauaauaugcucaauauauacccauauguuccuagaguuucugacaggauggggugggaacaagcagcugcacugcaccuguagcaccuuuaguccugagaauaggaagggcgucuuguucuuaauagauacuuuuucccagggcuugggccuuuugaacaaauuauuuuuggucuauugaaaauggagaauuuuuucaaauauuucuagguuugugugauucugauguugcaucugacacaguaacaaaugcauuuuuauauuuguagaaaaauaaucuggggccccuaacuuugugggaaaaaaacaaaacaaaacaaaaaugaauugaauuagagucuaauuucucaaaggacugaucaguuuggaagcuacugauguugucugguaagugguaauugugugcuaagacaaaacagguuuaaauguaguuagaauuuggaaaagauuauuuauaguuagucaggcccuuaaguuaucccagagaaaguaaaucccacuauuuaauaguaacugacuuugagagcuagagaagaugguagcauuuaccaucuguuccuaguuaagguucucucaagcauggcuuuuaucucacccacauauauggcaugcugauauucugauucacacaguuuuaggucauguucauaggcuacagauuuucauucuaguggagaaauggcaacaggaguggaauaaacaagaguguugucugccuccuaccaaaaaaaaauaauaguaauaauaauaaguggggaaaaguaaaucuccuuuaaaaaguggauuugagcaggaggaaaaaagugaaaggaaauacaugucaggcagaccaacacugaacaaaaauuuaagugaucucugaauauaauacucaugauagagaugugaaaauacugaauaaucuuuccuuuagagacaauuugccaaaguuugucauuauuaaauuaauauuucucaauacaguuauaaaauuugauucuuucuuuacaaauuuguuuugauuuaaaagaaauagugaaugagggcuggagagcugcucagugguuaagagcacaugcuguucuugcagaggcccugaguuggguucccagcacucaaauaacaguucacggcuaucuguagcuccaguuucagggcuccagcgcccucuucuggccuguaugggcacuauaugcacauaguaccguauauacaugcagucaagcacuccuagacauaacaugaaaaauaaauaaaucuucaaguaguguaacugggauaaccucugacacagaauccaaaagccccuauuucucauaccuuaugucuccuugugaccccaguuugcucugguuacugauuaaucacuuagauaauauuuugcaaauaagcauugacuuggauuccuugguaauuggauauaggaggcuuaguuacuaugcaguuauccaguugaaauguuucuauacauuuuccgcucauuucuacagcaagaucagucagguucagguucuuuuuuuuuuuuuuuuuuuuuuuuuuccuuuaaugaucccuuuccauuuuacuuuuaucuaaaauguugcauaaaugaaaucauccuaauguagcuagccuuggagucucucuuugaccaagcauagcagaguugagaaucagcuguauuguguguuuguugguucaguuucauuucuuguguugcccaccaaauguuagagacauauaaaauauaguuuuguaguaaagaggagguauagauuuauugguucuaugcuuaaaugcagucagagcuuaguacugaagucuggggaggaauccauuguauauugaucuuccccuugcugccucugaagggaaaaacagaacuuuguaugagaccacucuucgauccuuaaaccucacaaaaauucaaaucuuucuuagcugggccuguaccuuguaacuggugcuguccuugggcucaucucucauggucuucauucuguacccaaaaauauuuuuuccuuuucccgucuuuuuuuuuuaagguaacuguguuuaugaaugaagcuugcuuguauuuuuuuauacuuaucuuugucagguuaugguaucaaaguuaugcugacuuuacuuaaugagauaggaaguuuuguuuuguuaguacuguucucuggggaaauauguaaaugauuugaauuaauuguucauugaaauuuuggaagcauuucuugguaaaguuaucuagggagaagcauucucuuugggagagauuuuuuuuuuaaaucuacuaauccaauuucuuuaaauguuguaagacucuuguauuuucuauuucuucuugagucagucuugaaaaaugcuguuuuuuagagaguuuucucaauuucauuaaguuuuggucuuuuaucacuguuuucuuuuucuucagauuaauuuuucagugguuugauauuuuccuauagaauuugacagauuaaacuacccuguucuucccuuagcucuuggaaauacuagaaucaagaguuuccugcccacuugcuucucuaugcauuauuucucuguaugcauuguuucucuguauguauuuggauacaagauuccagagauccgaccugguagugcuagucugcagagucuuuggcucuggccagccauuucuugauguacucuagacuccuuuggugcuuuucagggucuuuagaccuucaugugucuaauauuaaucuucuuacaugauucauuggccaagagcccagugaauaaacuccugguuccuuuuuccgauguuccaguucuucaagcauguaaacugaaguauuauuuugccucugaacaucgcucucuccucauaacagcucauaucaaguucaguuggguuguuugugucagaccaccuuuguuuguuagccuaguuuagcaauaguuugucuguguaauauauuucugcucucaucucacaaugucucaaauaucuuauuaagagaaauuaucugcuuuugcaucuuacauuuuguauauaucuuagugguuaucuuaguguucuuuguacacuaguggucagucaguuauagguacaaaaauccacaaguugaaggcucaggaaagccaaguuuguuauacucacagguccaggagacagggaacauuugugacaccccuggaaaaagcggauaguuagaaguuaaaaaaaaaacuaacagacaaaaaaccaggagggaaaagcuuagaccacagaguauucacugauccuaggagaggcugucgcuccucagccagaggggguuuugaggugccaauauaucauaauauuuuuauggauucagauauuuacaguauaacuacuauccuacaucccaaccccuaaaagacagagucauaucaauuagacaguauuaagugcugauacuauuaacaguagucaacuguacucagaugcuggaacucaguucucguuauuuuagugccuuguaauuuauaaggagcuugcuaucauuuuauauggaaacugaauguagaaucaauaugugaauuugaauggacucuaugcaaauuggauauguaauguuaaacacuggcacuguuuuagaaauacuguagcugguucugauggcacacauuuguuauccuagcacuugggaaacuaaggaaggagagucaugaguuugaggccagucuggguucuuugugagacccugucagggguugggcguggagugaaagauaugaaucucuacuuuuauauugaggaaaucauuacaacaaaaaaaaacagaauuuuuuaauauaaagugugauuuaacuaucagacagccucuuauuaaaguguuuccaucaguaguaaguccuucuugcuccucacaaagucaccagugaauuucuucugugcaaguaaaauacucaacuaaguagaacaagaguagaagacagccugagacccucucucgggauagucuguaucauccuuuccaacauuaaaaaugaucucuuccuaaaaaccaccauaaaugccaugccaguuuuaaccugcuuguuccaaucacuguaucucauacugugaucaguaacacuucucucccacccauccccaucucaaacaagguuucuuuguauagccuuggcuguacuagaagucacuuuguaaaccaggcuggccuuaaacucacagaggucugccugacaaaguccuccaaagcacuaggcgugugacauugcugcccagcucagaaacucuuagaguggccacuguuucaguuuugaccugcuuuuaaagcauuguugguguucuacuuguucuaccuuuugaagagaaaucacuugucuuaguuacuucucuacugccaugcuaagacacuacggccaagacaacuuacuggagaaaguuuaucggggucuuauaguuucagaauaugaguuguggccauugugagcagacaggcaugaugcuguagaagcggagagcucacaucuugaaacaauaacaauaaccaugagcugaagggcuaaaagagacuggcaugggauuuugaaacuucagagcucaccccagugggucacauaucuccuccaaaaaggccauacuuccuaaaagaguuuucaccaacuagggaccaaguauucaaauacauaggccuauggggcccuucucauccaaacuagcacucucuuuacuguaucuccuuuuuaguuaaaauuuuucuuuauucuagagaaauaauacauguauauuauaaaauaucaucauauccacuuccuauuuuccuccgucuacuccucuccuaacuccauggcuucuuggcagguguauguguguguguguguguguaaagguggugguggugguggugguggugguggugguggugguggugguggugguggugguuuugguaaguacaauuaguguugcccauauguauauggguuuggggcacagaaaauuuacuaguaggcacacccucaaaauagauugauccucccuccuacagcaacuaucaacuaccaguggcuccucauuagagggauggagccugaauaauucuucucuauugugcuagaauuuugacuggcuugaccuuguggaucuuaagcaggucacuacagguacaaguucauggccauuucacacacggaaaaccuuucauagcacuucuccccaucuucuaucucuucuguucuuucugucuccugcccucagaguuucuggauccccucccaugguguccaguuuccauuuuuccaaaucucuucaucucuuugaagauuuagaaaaguaauuguucaagacaaguuccuacugauguugguaacuguaguugaauacuuuacuucauuugaauguacuuuauuuaauaguuauuuugcuugcuuuccaggcacacaaaccaauggucuggacuuucagaaacagcccgugcccguuggaggagcgaucuccacagcccaggcccaggccuuccucggacaucuucaccagguagacuguugaccagcagccauaacugagaaugcuguuaaacaaggaggcaugacaugcuagggagguuauuucaaauccuguguaacucuucugcucaaugauucauguggaauuaauacguucugcauaacuagcuauugauucuauaacugugugaacaaaagauuuuuuuguugcaugggacauaauauaacagcgaggucacuuuuuccuaugagcaugagcuugagucugugauggcuuagugcggcuaguaaaacaccagagucacuugaaauuaaguggugacuaccacuaccaugaaacuauugucauuuagguagcuacugauaccgaccacaugcccccccucccccagucuaaaucagagcaugaauucuguucauuuauguuuucacucuuuucacaaaaaugucauuagacuaccuuuuuuuuuuuuggaaaaaaauuuuauuuuuuauuuuuuuguucuucuugaaaauaggugaaauucuaggaaacuauccucaaauuuguuuuuuaagcgaagucaaauuggaaugaagaauguaguuucauuuuaaucccaggcacgggaauguggggcugcuucagacugucugcagcaggugauuaugauuugccuugugcuugaacagaggcgugguuuugccagcugcaaauaguuguauagacuguaugauguuugaaauccuggaaauuuuucagaggauauaugaauguuagaaucccuauagguggguuggugguuguuguucagggggguugauuguggcuuguuaauaguucugcucaaagaagaaacaagaggaaagauauuaaauucaggaaucaaucucuuugucucucucucucucucucucucucucucucucucucucucucucucucucucaucuugugauugggguaaaaccacgaggguaggcaaagggugggaaaaagaacccacaaagcaacaaagaccaaccacaccauuuuguuucaccuuccauuuauucuaguuuauagucuucucccuuuuuagucuuucaagacauuaaccuuugaggggcugcaagauagaagaaaacaaacucccucaauaaauaaauaaacgaaugaauaaauauuuaauuuuuaaaaagacuaacaaucucagcaucuguggagagagaguggugcacauguaaauucuuauucucauuuuguccuuacuuagaugaucugauggugacucuuuucuaaaucagguugcuaucaugauugcaaaaugauaguuuucuaauugccugucugucccuuaauaugaccaugauuugaacuuuuaaaaauaugcauuaaauauugagacagauuuuuuuuuccccuguggcucauaggauaaauucucuuaacuaauucuuuuguucauaauaauaaaaaacaugcacgggcauaguuuguuugggagauauguuauguuuuagacccuaagcaacuuuuaacuacgaauagaguguaaaauaaagagcagccacccggagagaauggcaugcugacugauggugcgcguuuagugauggugcuaauucaaaagaaguuccugugguuuucaguuggaggggaauuaugagcuuguauguaaaguuuuaaccccauaaaauaauaucuuucaauguucaauucuaaguuggugguauaucuuaguaucuaaaguauuucuugauaacaccucuagugauaaaugagaauacuuuaguuuauuagguucauuauuaacuacuuuccucuuagguccagcuagcugggacaaguuuacaggcugcugcucagucuuuaaauguacagguaaguuggaauaugagcaaauaggucauauuuucuauuuauuuuuccauaauuuccuguaaugagcacauaauuuagaaaagaaacuacuugcaauuguuacuuuuuauuaauuuuauuguuuuuacaauuuuuauugcuaaauccaggugguaauaguuauuaauggaaaucaguuuaaucugcugugugugugagccaaagguggacaaagaaguugagaaugaaguucaggaacacacacuaaacccaaaaugaaacagcuucucaaguauuacucuauuuucccagacuguguaucauuauucaggaaacacuggcuagagaaucagggaccuugaguucaagucucaauaaccuuuggcaaguuacagccugcuggaggcuuuguguaccuguauuuaaauaaagacagcaauagcaucuucucugcucugaacagaaguaaaguuaaagggcacuggagucaucacccagugguuaagagcaguguacauugauugaucuuacggaggacuccaauucaguucucacgucaggguaauuugcacaacuccauaacacuucagucagcuuuuccuuauaguguuugggaaacuaacugucaagaaggaaacacaguauucuagaagauugaucucagugaugcugaugacuaaagauuugggguugaacauucucugaaaucuuguggaauauggaccuaguaacacauggaaacaaggagagaaaaagagauaauguggucuuccuuucugagagagaggaggcagaaaauugccuugguugccaugguaaacuuaacaucccuuagagagauguuggcaaacaggcuauaucuccagugcagaauguuuacaguccugcacuguaauuaucuuucagugacuggcagaauuaaucagagcuuuuauguuaauuagcuucgcuguaguuccccaaacaggugguggaaaauaugcaaaucuaugcagaauuuugauacucugcauaaccaguuuuaauuaccauaaaaaauuucuuucuagcccuuuaagaccuauauuucuugacuguauuguuuuauuuuguuuuguuuuuauuuuguuuguuuguuuguuugcuuguuuuuugagaaaggauuucuuuagccugacuguccuggaacucaaaaacucuguagaccaggcuggccuugaacucgagugauuagcugccucugccugggucuucccagugcugagauuaaaagaaugcaucaccacuguguuuguauuauuuucuuucaaucuuguacauuacuuggugggaaauguugcacuuaagaguucuuuaaaauaaaauuuaaaaguucugugggucaaguaauugaauuguaagaugguauauaaaaagguuugagacuugccacaaaguauauucaaaguguuaguuugaagggucuaauaauagaaaugaauugaaaaugcacccuuucuuuuauucuuauugcuugaacuagggauuuugagguuauuaaagguuuuuuuaauuuguguaggaccaauuuaguuuuucuuuuaaaaauuuauaauugcaauuuuucugagguuagaauaaaauuuaagagugcaccaguagacaaaaaggcauaggagagagaaaggaaaaagagaaaaccccaaacucaaaauugaauagcacauauuuaaauaauuuuuuaauaacagaguuagaaguacauuucuuuuaaucaccuauuugagauacuuuauuucauuuccuacccaacuccauuucagucuaaauccagugaagagucgggagauucgcagcagucgagccagccuucuucccagccgccuucagugcagucagccauuccccagacccagcuaaugcuggcugggggacagauaacugggguaaguuuuccuugagaauguuguaaugaacuuccuaugucugaacagccacugguugcaucucauuaaaaugguucacuacauccggcccuagcaugcacuacuguccauaaggagcugacggcuagauguggagugcuccucuggaagaggaguuacuuuugccauucuuuacaagaugucuuuuuguuacagcugcaggcauucaaaauaaacuacuaacuuuuuaacccacauuaaaaaauaguguugcuucauugugcaagggaguuguugccauacgcagggugaaauuccaguugugucauggcaggacaauuaaagaguggauucauaaagaaacaugucuugaacuacccugaaauagaauauccuguguguguaaucacuaaucacucagggugaguuacuuucucucuccauaccucacuuuccccuuuucuaaguggagguauuaauaauaucucuuuuaaguaccauuguaauuuaugcaaagcucuuaaaacagugcuuggcauguagccuucaguaaaugguaguuauuuugacuuguaacaaauuguccuccaugacuguuaagcuuuuacauguuuagcgauuucuguucuagacuauuauuugggaugguguuucaguguugaacgcguaugugacgaggagaagggagagaaggaaggagcuaaucaggucccagcgcaccaaccuuccgagcuuccguaguuaauuucagcugcugugacugcgcugucgaugcuucuucuaagagugaugcacacuuaugugcaguauuucaucacuagagauuauuaauauauguacuuauuuaaaaauauaaauauacauacacacauuuuaaagaguagggaauuuuuuaauaguuuugcucagguucguguguuucuaauaaaauugauugguuaaauuagacccuguuaguuuagagggcaggcugugaugcuaaaugauuguucaugagacuagauauauaacaugguccuuuccuguuugaucagaccaugucaccaaaagaaaggcccagcacacuuacuacuuugauguaagcauauuugaaaugauguguuauggaaguuuauguuuguucuaaauacauuucuugcuuuauuguuaggguuuggguuuuggugauuagugucuaggauagauagauagaugggcacuuggaauuccagguucauguaccuugaagacuauuaauucuggguguuuagauucauuuguguuuaagaggguggcucuuaccaccuguuuccuagagauaauaaguuggaaaaaaauguaaacuugcaaaccaaugcuuuucaagggcaggagauuggguaagggaggguccuggaggaggauuuuuaaaggaaacaaguguggcuccugauuuuuagucacaugugaagaugugauggaaguagugaaauacgauggggauucaagcagcugggccuuaccaguucucuuccugcaccugccagcauccuuuugucccucauucaucaccugcuguuggauauaaaugucuuugcauccugucagcaucaguccuuuguuuucauuccuugucuaaaugauuguucaagucugaagugcagacuacuuuaaguuaaaugcugugguagaacagguaguuuguucauugguggacagguuagcuguacauugaccaguagugagaaccuaaucccacuugaguuaccuauuuaaaggcacucaaucuuucccuucauuguucuuacucuagcucacguugaccccagcccagcaacaguuacugcuacagcaggcgcaggcccaggcccagcuccuggccgcugcagugcagcaacacuccgccagccaacagcacagugcugcuggggccaccaucucagccuccgccgccacacccaugacgcagaucccccugucucagcccauacagauugcacaggugaggaagggaagagcaagguuacugggacagcaaacagccaauaaaaugggaaauucucuuccauauuguuagccuucugguugcugcugugggucuuuaaacacccaaggaacucugguucaagguggcauuaucgcuucuucccuuuugcuuauuugaguugauauuauaaacaucuagcugguuauuugaauaagugaauguuuauguuaaaugaaauucuugaguaaguagcuggcauauuucugaggcaagggguuucaguauucaucuuaauucaucuuauuagccaaucauagcaggcaaaaauucuuccaugugcucuauaguaaguguugccaccuuguaaaaaaagacagcaagucaucuuucugcuguggagugacuaggaccauggagaacugcauuaaaauguuacaggguuucaguuuuuacguuuucaaauaaaauauccaaagguaguuuaaaaauuacuuagagucauaaagaauuauaacaaaagagaaaauaugugaccuuguuucucucaagggagggacagggagccugagaaguugauguagcagaagcaggguaacagucuaagcagaguaacuccuccuucuguccccagggagggggugcugaaggugugacacaguuugacgagauacuugaaauagacucagacugauuuuuauuauuacuguguggacaucuguaucaagauaguguuuugauuugggccauuuucuucaucaaauaaauuauguuagugccuaaacuuugagacuuuaccugaaauuaauauaaauagaaugauuuauaugaaggcauugaaaaauguaagauacuagagccaauauaaagcuguauuguuuuguuauaucugacuuuuaugugaauuuuuaaaauaacuuaacaucaauuccuaaauugaauuggauaagcuggugucaaauuucaggaaucaaaucuuuuauuuuauugauggaaauuuuguuauaucacucaauuuuuacuuuagaaaaaaaaauggaagccagguggcacacgccuuuaaucccagcacuugggaggcagagacaggcggauuucugaguuugaggccagccuggucuacagagugaguuccagggcagccagggcuacacagagaaacccugucuugaaaaaauaaacaaaaacaaaauaaaaaacaaaauaaaaaaaaaugggucaaauauucaaaucccuuuuuccucacuuaauuuuucaggaacauuuagucuuuguuuagaucagagcuaaaugaacagaacuuauagaaugaaugcauauuaauuuauuagcauuuauuagaguaguuuacaggcuauggucuggcuaguccaaugaugguggucuuucaguucaugcagcuggaugucuuagcuagucuuuauuccgucuugaacucuucuauuaccagcagaggaauuccucagcaacaggauagaugaauauaaccagagggaaagagcacagagacaggaagcaaaaggguccuucuucccuguuccuuuaugugggcuaucagcagaaggcacaggccagauugagcaugggucuucccagcucagaugagccgaucaagaagagcucucagaggcaugcacagaugcucgcauuuuaguugaugccagaggcgggcagguugccauccaagguuaccuaucucagugguggcagguggaaguagagaguuaacuccagacuugucuucugaucuccacaugcauguguggcuuacacaaaccucaucacacacuaauaacaauaaaacuaaaauugaaaacugccucccccagaacauuuauucucuauucauuuauucugaaaguauuuuagguaaccauugaaaauugggcuuaacacaaucaugauucuauauaauauacaucauaaccucaaaaauaacuucuugcagaggcccuaaguuuuuucaguuuuguuuuugauaauugcuguuuguguguguaaaucaaaacaauucucaggagucaguucucuccuuccaccgugggucugaagaucacacuuaggucuucagucuugcacagcgagcacuccuaccuacugagccuucucuggccugaggccugagcauuucucacacacugacacuguuggaagccacacuguugggacaugaaaaaaagcugaguauugucucauuguuauuugaugugacacaagucuuugccuaggaaccuuacgacuaauccagcuuucauuucaggaucucucucuaaucuguguuuugcuucugagccuuuaggaucuucaacaauugcaacagcuucagcagcaaaaucucaacuugcaacaguuuguguuggugcacccaaccaccaaccugcaaccagcacaguuuaucaucucacagaccccccagggccagcaggguaagcgucucucuaaagcuccucaguggugcaacagggcugugcacuuugaccuaacaguguccauucgagcagugcuuucauucagugugguuucaaacuaccaguauugaugagaacuauaacagugccuuaaaucaggaacaugguuacauauaagaauaaaagaccugaaaaaccaguaaaggcuagcuuacuaaaggaaauuuccaggacuuuaaccugaaaucaugcaacuuaauuguuuccaaggcucaguuuauuugcaaaucacuggauaaaugagaaagguaguuuucugagucucauuccaaaauuuuaacuaguucuuugugaagaugcauuugaaugucugauaucuuccaauguuuucugugggauauuugaaaacaaaacacuaaaguaaaaaaguggcauuagccauuuguauuaagaaagcuuguuuacacuggaacuuggggagguuagaauagucaagaguagauuuaguaauacuugucagcagaguuuugcaaggucguguugagaugcugagcuaugauuaugagagcaggagagagaagaugauaucgcagauagacaagacuugggcaaggcaugguagaacuggccuuuaauccuagcauuuggaagucaaucagaggcaggaggaucucugagcuuaaggccagcuugguuuauauagugaaagccuaucucaaaauaaacaaaauaauauaagaaaggacuugguggccaguuacguuuggucaaugguaaggacugggugucuaggugauuaaguuuuuaggaaacuauaaguguugguaggucauagaaagauguauucaugauaaugagcaagcuucaguaagcccagcacuuugaaauagcagggauacauagagucugaagauaauacuguuuugguuuguggaucagaaccaauaaauuguuuugucuugucacaagcucauaugcaauguuucaacaacauuugaaacuaaguacauagauuaaguucuucaaugcaaauauauucuggguugccccuguuuuuauaacauugcaaaaaaaaaaccaaacuagacaauagcaaaacccuauagaguucaaacaucaacugaguacauacuacaaaugcuuccagggcucaagacaaagucucacuauguuguccagccugaccucuaacuuuggggcucgaguaacccucaugccucagagcagcugggacuguagguguaugccuuuacauccauuuuacuuauugaaaacuuuuaaacuaggauuguccaguauggagaguugcuaacaugucaacuuucaucaaugaagagacauguccuaaaaacuugaaaauagcaucucccacuuagaggauugccugcuucuuucagaaaugguuucucuuauucccagauucauuaaagcaguaguucucaaccugugggucguggccccuuuggguuucaaaugaccuuuucacaggguucacacauuagauaugcuguauaucagauauuuacauuacagcucuuuuuuuuuugggggggguguuugagacaggguuucucuguauagucuuggcuguccuggaacucacuuuguagaccaggcuggccucaaacucagaaaucugccugccucugccucccaagugcugggauuaaaggcgugcgccaccacgcccggcauuacagcucauaacagaagcaaaauuacaguuaugagguaggaacaaaauaauuuuauggcuggggucacagcuuugggaaggcugagaagcaugucuuagaggauuucagugaguucuggguuaagaaguugaacucaucuugaaauuuccagaugcuuugauuucaaguaguuccucacauucuuccucuccuugggaaauaagggccuuucaaagaguuuauucagauuauacuaaagacacacaagcuuugauuuaauguuauggauuuucaugccauguuguauuuaacacaauuaacaauauuaaauuuuaggaaaagaaacuagacaauucggaagacaaacaaaacuaccaggaaauugguugggaacuguuuauauucuuuuuuuuaaucccccugaaauguuugauuuucacaggucuccugcaagcgcaaaaucuuuuaacgcaacuaccucagcaaagccaagccaaccuccuacagccacagccaagcaucacccucacgucccagguccguguucuuacucaauuguuuugcuaauugaaaaaugauacaaaaacaccccagcaauaacaaucuccaguguucagaaacugacccaaaacccaauguugggcuuauuagcuucauaacacagcauugccaaauugauggaaacgaaauuuuucauaauucuuuuuaaguuaaaacaaaaaccuauguuaguaauaaguggggaugaauuaaagcucucugaugcugauagauaguaacacugaaauggaagaccuaggaaaugaguuaaaaccugccauugauccuuugcccuugcuaaaacaguacaggagcuuggauuucugugucaccucaguacuuaaaugugguguugugucauuuccucuacaagacauaacagucauaauccacagaaagcacaauucuuaggcauuugaaauuuuuaaguugcauauuuguguucuuaaggagugauaauugugacuaugcauaucaguuugcagcuccgguuuucagucuggucauccuuacugucugaccuugauuccucacuugcuuuuuacacuuucuaaauagaaagaaguuggggaugaagaagugaauggcuuagugguucuugccacgcaugcaauaggaccagaauuuauauccuaagaacccguuuaaauaccuggguggacauggcggcucaucuguacuuuuaauugcaggaucuccuagccuauuggcaggcucugggaagagagugaucaaggcaggugaauuuccuacaucaaccucugcccucugcaugcacauguauacacaugcguguauauauauguauacacaugcacaaacaugaaaagaauguguaguaauuaaaacuuaauucuuaauauauuacuacauuucuuaggcugaaaauacagaaggucugcuuugauuggcagcuguaguaacuauaguuacuugcccuuugccacugagcccuccgucuaggccccgguaaccaaagaagagaguauagguagaaaacuagaaggaccagcuaauggcaagaauuaguaccaaacuauaauaaugaauaugugguauugucauauagagaaaaauguuggccaaugggauaagagaaaauccaauagacagaaauguaaauagccagcuaauuuuucaaagggaccaaaggauuccaaugggaaaaaucuuuuuaacuaccugauaacuaacaauuggcuauucauuagcaaaaggggaugcagaacacccguauuucauacuuuacacaaagauuaauuugaaaugagucauaaaccuaaacauccaggaagaaaugcauauccauuggguuucuuaaacaggacacaagaagccuuaacugucaaagaaacaaugaacuucaggaaaauuuaaagcucauuuuaauaggaagaaaaaccacaguuaagaagaaaacagucuuuuuuuuuuuuaauugauaaaugauuuuguuuuaagauuuauuuuuaauugauguggggaaggggaauauuugugcagguacucugggaaaccagaagaacacauugaaucgcuuggugggugcucuccacuagcagaauacacucagucacugagcuaucucuccugccaggguaagagaauuguaacuagaauaaagagcaauacagcucagccgugagacaaccagauaagcuaaugagaggcaagaaaacuuaauugccagugaagauauguuaauacccaguaagcaagugaaaccaugcucggagcauuaguuauuaggaaauaucaguguccguucacuggagugggugcaguucugaagaagcaucugauacaaguauugauaagaaagcagcagauagcuccgaaauuacuaguaguaaaaaguugcaaaaagguacucacacuuuguaaauuaguuugacauugacuuagaaauuaaauauaacuacauaguacagcucaguaguuuugcucuuuaaaaggaaagcacaaagauaugucuaugaaugcuuauaaaagauuaucaccgcaaacuaucagauaguaaguuacauaaauuucugaauagucaugugacagacuuacucugcaguaagaaguaauguccuucugauaccugcagugacaugaaugacuuucaaaagccucacacuaagugacagaagcugggcuuaaaagauugaguaucaaaugauuucaguuugcauaacauuccagaaaggacagaacuguacacauagaaauccuauuaguccuugucaggaaguaaggauuaaugaugaagaggaggaggacaggacaaggaggaagaaguggagugaguggcaaaggguucagaagaaauucggggaggauuaguaaagauauacuauuucuuguguuaguaauuacacaacuauauacaguugcaaaagcaucaaacuauacugcaguuuuaaguuuaguuuuuuuaauaugcugacuguaaaauaaauaaaauugguguuuugauauauauaccacagaccucuuucuggccuacgugcuaugcacauggaggacuucauccuuucuccugcuaauuaaaugcuauacuaccauuagcucugucccagcucagacagguauuuuagaguaagauaccagcugucuaaagguacccaggcuauuuuuaguccauuauuauuugacaaagagucuacuugaugcugaagaugaaguaacagauugauaguugaaacugaccuccaccuaucagccauggucacuuugguaaguuuucagcaacacaggauucuaauauaguugguacccuggguagcuccuccaaaagcugaaguuaaaauugcucaaugucaggaugucauagagaccugcuuuauugucuuuauugaagcaggauagcagaaggauuugccccaauuaugaugucacgccuauuauguacuuuucugggucaguuaguucccuaggagcaagccuuauuaaugagaugaaggucagguuaggauuuucuuuuuaaaaaaaagaaagggggcuggaggaauggcucaguggcuagaacuucugacugccuuguaaaggaccuggguuuguuuucuaauauaacuugucucuaacuccaguuccaggagauccaauccccuuuucuggacucugcaggcacugcacacacauggugcacagacaugcauuuuauggacauacauaaaguaaaauuuuaaacaagaaaggagagcccugggcucagucuuuaguauaaggaauaguguggugggguguuuaaaaaagguuucacaauaaaacucuagauagauuuaaaguuaaaaugcagaaaauaagguaucaccaggaaggacuuuucucuuuuuuccagaaggaauuugauuacuaagaaauaacuaaaguuuucuuucucaaagauauaauagaaauggggggaaauucauaaaaauauaguuuaaaguuuauauauacugaaaaaauguuuaaagacugguuaaaaaaaauuauuuguacuacuaugauaagaaaauaguuuauauaccauaauauugaagaaaugauaaggaugagaauaaagauauuauuaauguauaauugugaucugaaucugguacaaggaaauauaggcaauaagugacacauaggaagucucuugcuuugaguaguaagaaaaguauuaugucaaaaugauauaccacuugcucccugguauaguggggcacagcauagcuuauuagaagcaugacacuguuuauuaaguugcuagaaaaagacuuugugaauuuaucuuaacuuuuugcugguguugguggcaccuauuuacccuaaguucugugaaaguugaggcagugggauuauauacugaauuaaaaacuaaucugggcuacagaguaagaacuucucuuuuaagaaaaagaaaauggcgguaguuggggaacggguauuucuuuguccugguuuucuugagacguucuucuucuaaaugcauuuauuuaucauacgguguauuuuuaucaucuuccccaucauccucccagaccccuccccaggucaugucuccagugcacccugcuugugaucucacccaccuagucucuugcucuuugucucucguccuugcuuguuuuuuaauuaaaaaaucucauggagcccaacuuguauuggcugauccaggggccuccccuggaaugugacuaguauaccaggugucaccucauugaagaaaagggauuuuuccuuuccuggcauuaaaugccuguaacuccucagcuagggguggaccucauacccaccuucucuccuccgugcuagaguuuugucugacuugagcucgugugagucuguuuccuuaagacgccagcacguuacauuagaaacuaaagugucugcucucugucccuucuccaacagccuaccaccccaacucgcacaauagcagcagccucaguucagacacuuccacagagccagucaacaccaaagcgaauugacacucccagcuuggaggagcccagugaccuugaggagcuugagcaguuugccaagacuuucaaacaaagacgaaucaaacuuggauucacucagguaggaugaaguucacuuucuuuuacugugauaaaacacugacuaaaaccaacuugugaagaaacaggcuuuauucagcucacaaguucuagccucuugcugagggagucaaagaaggaacuugguggaaggcacugaaguggaagcauagaagaacucugcuucuuggcuuguuccaauauucuuaacagccuggguccuccaccaucaaucagcaauuaagaaguacucacccgcagacauacccacaagccauccugacaggugacaacucaauuaagauucucucuuuccaggccugucaacaaguguagccaucacgauguuuguucucuuacauauccuuucuuggcuagcuauggaugcuuuguaaauacuuuguaaggaacagaauguuucuuggucauauugacuuuggguuuagcuauaguuguuuuucuuuuucuuuuuucuuuuuuuuaagauuuauuuuauuuauaugagucuacuguagcuguuuccagacacaucagaagagggcaucaaauaccuuuacagaugguugugagccaccaugugguugcugggaauugaacucagaaccuuuggaagagcagucagugcuuuccaccucuccagcuccuguaguugauuuucuuauagucauuuagcacuuaaaauuuuggaauauugugcauucacuuacgcuaugcucauacauuuacucaugauauaauauuagguuaaaaacuugcaaauauguuucacaaaacaggccucugaaaaucugucaguaagcuguguuuuaguagauuguguuggugacaggacugcuaaagagcauguggaagagcuaacuacugcaggugaaagucgagaaaauaugaaucccagagucuguuggagacugacuugaagcuuguuugcaagagacugugcucccuccuuucuuagucuacugagauuagucaaguaaggauuuagugaagauuuuuuaaguaaauuaaucaaaaucaaaucuuuuaaugucagcuaccagagggcuugaaaagugaaaugaauaugcuugcugguuuaagcaagcauuugggugcacagcaugguuuuuuuccuaagcacugccacuggcuguacucccugauuagccugucaaaaauaaugcuuugaaagcaggaaaggaauuaaacuuauaauggcaaaagaucauuagcugaaagagaaaaaacugaaguauggauugaguuguguauuuauagaauaagggaaaaaaaccaaucugauguuuucuuuccagaaacgcucgcacucacagaguuuccaaaguagguuguguugaaagugcacagcgcaccuccugcacuuccuguggaucagaggcaaggucccaucgcugucugcuguauucugcaugucauuagggacuucaauuuauuuuauuccuuauaucugaggauuuauuuuugcucaaagaaacuccauauuaggaauuuacaauagauacaauuauagaugaauugcaguuacauuuugaggaguuucagauauaaagaaacaaauuaaggagcugaugcuuaccaccaagccugauaaucugagcuugauccuccagaaccugcauaguguauccacacauagaugcagcugcauauauacacauacaaaguaaauuaauguaaaaaauuuaauuacaguccagaaauauuuuaguaauuuugaaagaaauaauaugauuuguuuuaaacauaaaaauaaagauaaacuagauugauacagauaaguuaauagacuaagaagacaguuuaaggcuagcacauuaacagugcuagguuuugguuggcuguuagcacauuaugcucuggaguucucugguaaaugguuucauaaaugcuaagucaaagguguuagccuuucaaaguccaccuuuuaaccaaacauugguucccuuucccuuucuuuugcauuugauccaaaauauuaccaauguggauaaucauuuccucucuccuccucuuccucccuccuccccucccuuuuucucuuguccccacuucucacccuucucuuccaccucccucauacacaucacaccuucaucccagcaucuuauucuacuuuaugauuuauuuuguuuuguucuuggcaugacugcuauguauucuucaaaauggccagacagaucuggaaugguuuguaaaucuuaccuaucuggaucaaaguauuuacuacugguacaggaugggaaaaucagcuaucuuuuuuuaaauucauuugugaaaauuuuuuaaugaauugugcaguuccaaugucaguaaacauuuauugccacguaauaucauaugcucaaaaaauguuuuauuuggauucagauuucuagaaagcuauagucuaaacgaauaaaauggugccaugauuaugugugguuuguaaaaccugaguggagucccuggugugcgguggcggugauagaaaggggaagguuagugcuccugccucgccauagcuuuaggcacauuuguauaaagcauaauaauccacaucagucuuaguuagaggucauucauuugcuuuucugcaauuuaaauauaagucuucacaugaggggcaacuaaugagaggcauaguguauaucucucuugucuugggguuaaauauuuaguauauuucauuuuauuuuguaguuccacauuuguucuauuuucaacuucuuagugagaguuguucauaguuggcaucuuggcacaugcuuagauucuuagcacuugagaagccagguuuucacaaguucaagaccaggcacaacuacauaacaaauuugagaccauucugggcuacaugagacccucuauauccucauaauaguaaauuaaaaugagcaaaacauguuuacacauacuuuuaaauauaucuuuuucaugaccccacauauaauagacaauguaaucucaaaaagaugaaccuguggaauuaaaaaaaacucagauaaucccaacucaaaauuguguuccuaaagcagggcauaauaggcacaaacucagaguccuggcccuugggaaauagagacaggaagaugacaaauucaaaguaagucugggcugcauaaugaauccuggucucaacagauuggagcuagagaaaugaccacuugcucuucuugcagagggucuggguucaguucccagguucuuuaugcugacccacagggauuauaacucuaguuccaagggaugcaaugcccucuucuguggacauuauacacauguguuguuuauacaugcauauaggcaaaacauucuuauacaugaaauaaauaaaaaucuaaaaauaauaauaaaauaacauugccagguuuguugagaauugacucucacaauagauagagaauuuuggaaucuguggaauuuugaaggagaaaugcuauacuuuucugucgugucacuaaucuaguugaagugagugugaaccauuuaaacuccaggaguuccuccuguuaucuauaaaauaacuauuaagauacaucuuuuucaaacuagaacaaaagcgauccagcuggaagaaaagcacuguguacauuucaaaggugauaggcucguggagaaaggcaucuuuuguaauauauucagaggaucauuguucuguuucaguaagguuaccaacuuuccagugcccaugaagguuuuacuaagugggucaaaccucucuacugugaauuucuacucuauaauggcuauaaaugugguccuuuagaauaccugguuuugugaucaacuuugaaaucaaaacuaagggugaaaauagauuuuuuuuucacagcuuccagaaauacuuaugagaaaaacuauaaagaaugugggagcauucuaaaguuuaacguaauuuaugugaaauuugguugguucagaaguccuugauuuaggggcacuugccacuaagccugaugauuuggggcucaauccccagaaccuacaucuaccuacaguuaagggagagagagccagcucccucaguuguccucggaccgccacuuaggcaccauggcccuccuggauucucauacacauuaaauaaauaaauaaacaaacaaauaaauaaaggugaaaugauaaauaaauugcugggcuuucugaacaucuauguugcuuguauuacuggaagggcuuuagcguaucagcacuaucuuugaagacuuagaaauguugguaugauggcugagcucucccuaugguccuaggcucuacuuguaggugaaguuggugggagaauggaguaaauagaacgacagccaguuuucugucuagagcaacacuuacugaaguagccuuucaaaauagaaguuagagacauuaauaacaugagucucuuuuccucauuccccuuuccuguucuauauuauucagggugauguugggcucgcuauggggaaauuauauggaaaugacuucagccaaaccaccaucucucgcuuugaagccuugaaccucagcuuuaagaacaugugcaaguuaaagccccuuuuagagaaguggcuaaaugaugcaggugagugaacauagaaagaaaucucuucauuguccaugggguuuccuaggagggauuagucugcaaacugggugcuuacuguauugcugauacuacaaaguguuggauccacuaaaucuauggaaaucauuugagcuaggucuaaggauggacauagauuuuuuuuuugaggauaaggguuagaaggccuguguguguguagaaaaucuuaaaggacagacagauuauuccuuccuugaguagauugccauagaauuuguuccugguaauauuucugcuuuuguuaaaaaugaccagcuauuucauacaaaauuagauuucuggucuugaauuauuuauuuaacuuugagacauccuuuuaaaaacuuugaauuuugagccacaaaaucagacuucaggagcuaaaaggaaccacaaagaugccuaaccauguacuuuccuuuguagauagaaacaaaaauuaggccuucagaaaggaagaucuuagacacacccucacccuuggcauauugauucaguaacugggggaaguuuagccaucuguuaucuuuuuugcagucacaggcaagaaccacuggucuguuccaucuuguuuucauacaguagaaagaaagccauugaaacaugcccaggcuuauucaguguuuccuaagcuuaaagaauuccaaaguacccucucucaacucuugugcuaagaaacugaaaagccaucuuuaaauuaaacauuaaauaauccaaugaauuuuaagaaacauuguuccuuuuuauccucagcuuauaaacaagcaaauguaccgaacugagggaaguguaaguggaggaauagaaccuuuguauucucagaaacaaaccaaaaaugaguggugacaaaguuaaccgcccugggauaaagguugccaguaaggacagugggaagucaacaguccugagcaaugcuuccauggaaucucacauuacuaaacauuuuaccaguuuucuuguucuuauguauucugauaugaauccuuaagcucagcuguuuguguuuucuucauuucuguagagaaccucucaucugauucuacagcaucuagcccaagugcuuugaauucuccaggauugggggcugagggcuugaaucguaggaggaaaaaacgcaccagcauagagaccaacauccguguggccuuagagaagaguuucauggaggugggugugacuuuucauguguacggcacuguuggggacugcagagauuaaagcauauccuugucuuccuccgcccugugggcauuuaacagggagaaaggaggauaccaggugcuacugcacuucagcgcugcagaacucgagagagacaaugguuugaaucaugugagcuuuugggagggagcuaaucuugcagacuggaaaagauagaagaguaccucacacagagccaucucauaagcauaggccuccagaggaaaccaugccuguucagacgaaacacuggugguuuggcuggcuaaauuuuagugucuuuaugccuagaaugguaguuugggggcacaacacuagagaccucgaauauccuauucuggaguucaaauuaauucaacagauauuuggcuuuaaaacaaaugaacuuucuacuuaaggaaacauugaaucaggagucuuucuugucuuugccucuuauuaaaggcacaucacgucucuugauuucaagauguuccugcgccuauaaaacugccuuccauuccugucucagaagcauagugugagguccgaguuaguaugaaugaagcacugaaaacucaggcauuccuaguaguccauaaaguuguaucacuuugauaacuuucagauuaauagacuuuagccaggcaugagacagcuaaucccagugccugggaagcaaagguagguggaucuuuguaauuuugaggccaaccuggucuacaugcagagucccagggcagccagagcgacacacuaagacccugucuuuaaaaaaaaaauagaccuuuacaguaaggaucacuuauucuguucauaaaauuuuagauaaguguaguauguauuaaaacacuuuuguagaaguuguugcuaaagucuuaauguggucauaaauauucuaccaugcuuuucuagcuggcuucuuccuauggguauacuaguucauaaaguuauuucauaaaguugguuaugguggcacgugccuuuaauugcaguacucaggaggcagaggcaggcagaucucuguaacuugaggucauccuggucuacauagacugagguuugauuccuaaaaccccacauaguggcucagaaccaucuguaauucuagguccaggagauugaacacuaugucuucugaccucuggggucaguguacauacaugcaggcaaaauacacauacacguaauaaauaaaucuuaaaagaaacaaaguguucuaaagcuaggauauaauucaaauguagagccauuaucccuggauucaaucuccagcauggcaaauauauaacaugaaauuuuuaaaauuuuaaaagaugggcuuuuuuucccucucuuagaaucaaaagccuaccucggaagacaucaccuugauugcugaacagcucaauauggaaaaggaggugauucguguuugguuuuguaaccgccgccagaaggagaaaagaaucaacccgcccagcaguggugggaccagcagcucaccuaucaaagcaauuuuccccagcccagccucauugguaagaguggauguggaagagauacacacuucaaggacucauuuuuaguguuacagauguccuggaaguaaauucacuuccuaacaguugucuuaguuacuguucuauugcugugauaaaguaccaugaaugaucacaguaacuuagaaaagaacacauuucauuucagcuuaggguuucagaggcuggguucaugguagugaugcaaaggaacagcagcgagcucacauuuagaucuucaagugguagcaaaaauucugggaauggaauaagcuuuugaauucucaaagcccaccccccagugacacaccuccuccaacaaggccacaccuccucauccuucccaaccguccaucaacuggauuuaaacauauaugccuuugcaauuauccugauucaagcuacaacuuugaaggaagugugugugugugugugugugugugugugugugagagagagagagagagagagauacauguuaaauaaauacauaaaaaugucuacuuuaaauauuuucaaaauuauaaaaucugucauugugaacugaagaauuuacugcuuuccuuuauuucuggaaguaaacaauuugaagucuuuuguguucuuuuggauuuucaucuguggcuaauaagguuccacuguagcuauaaugacuccugaaaauaaugugucccuuuauuaccguucaguccugaaacccauuuuaguaaacuuacaugauuaagugacaguaaauuuucaaggaugaauagucaaucucaaaucuucacucuuggacaguaggucagccuucauauagacccuuauuuagucacuucugccauuugcauuagaacauuauuccuacauggaagagacaugcuguggucaugggacuuaacuuuucuuccuuuuagaauaauuguagaucacugucaugcugccagacaggcuucaaaagaaggcuaauaaugcacuuauguuccuuuuguucuuguugcucugcuucuauuuuauuuuaauguuauuccaugcugcaaccucuuucccuuuccacuuaguucuuugagaaagguuuucucuguguauccuuagcugaucugaaacucacuauguacacccaacuagucuggaacucacagaaaucucauggccucugcuucccaagugcuggaauuagaggcauguagugccauaccuggcucuacaaaguuguuuauuuuuaauaauuaauuuuauuuuauguacauuaguagucuaccuacugcaugucugucugugugagggugucagaacccuugauacuagaauuacaguugugagcugccuugugagugcugggaauugaacccagguccuuugguuaagaauauucagugcucuucaucaccgagccaucucucuagccccucacaaagguuuucuuuaaacuaaaagguuauggguuauuaagugggaaugcuuuaaucauaaaauuuaugucguaacaaaucauagccauuagauaacaguucuguguaggugauuguuuuguuuuggaggcuuaacugucauagaaagagggcagggucuuauaaaacuguaaaauauuuauuacaauaguucaaaaaaugcaagauuguuuuuaaaaucuuuuucacuagagcuuggaaguauuggggcacauacucucuuuuuuauuaguucuuugagaacgugaauauauuuuaguuguauuuuccccuuucccaacuccugcagcuccaaguacacacguacacacacacacacacacacacacacacacacuugucccuuuuuuauuuuuuacccaucaagcccacauuccugcauguguggccauccacuaaggugugacugacuuaccaauggccacaaccuaaaacugacucuccugcucccagcagguuccagugccaauaauuccacagcuaggacgugaacaccaccuccccgcuucaugcugggauucugacuggcuggagcuuguguggguuaugcguacugucauaaucacugucagguccuaugugcgugcucugcugggucagaaaaacugcucaucuaccuucccuagcucuuaaaaccauuccuccccaucuucugcagugauuccuaaaccugagggaaaauggguaugauagagaguccccuuuuagggcugagcauuccuuaguccccuguucuaugcaccauaaacaguugugagccuauguuaaccgcuucaaaaaggagcuucucugaugaaagucgagaggugcacuaaucuacaauguugaaucuuuagagcuaguuuaacauguccauuuagcagaguaauacuaaguucucgccuugggcuuaugaucugucuagccacaggucccuggccccaguaacgguacacacuuuuaaucucaggucucaggaggaagaagcagguagauguuuguauuggagaccagccugguuaaaacugaguucuagaccggccauagcuacauaguaagguugucuuuuuguuugguuugguuugguuuucgaaacaguuucucuguguagcacuggcuuuccugaaacgcucuguagaccaggcugcccuuaaguucaaagauugucugccuuugccucccaaguguuaggauuaaaugguaguaccacuacaccuagcuauaagaguguaagucagccaguuggugguggcacacaaccaccagcacuugggaggcugaggcaggcagaucucugaacucaaggauauccagggcuacccagagcagcccuguuucuaaaaaaccaauaaauaaauggauggguggguggguggguagguggguagauucucccacaaaaucaaaaauaaaaacaauauaagcucuaaugcuaucagauaguugucuuguuuaggugauauuuauguuuagguauuguucuagcuuauuuauagucugucugacuaaacauuauucaaauuuaaaaacuauucaaguucugauuaugcuauguacauuuuuucuugucucaccucuagguggcaaccacuccaagccuugugacaagcaguacggcaacuacccucacagucaacccuguccucccuuuaaccagugcugcugugacuaaucucucucuuacagguaagcagcaaccagcuuacaggcuaguaagcacagugccagucagguuucuguggagaacugcuaggucaugaagguucuacgaccuaagaugugaguugguugugggguguuguuuguuuguuuguuugcuuacuguaugacuauggcucuagggagguugcugugugaacauaaucauaaggacuagaguucauauacaaaguacacauuuagacccaagugggcuuagcagcccauccauaacccagugcuagggaagcagaggaaggggcuccccagaacaaacugggcuaaccagauuggcauguuccagauucaguaagagacccugccuugauaacagggaauaagcaaggaggacacuuauaucaauuucaggccuccacauggaccuuacuacauacauggcaacauauaugcuccaacuccaucacuucguguucauucguucucucucucucucucucucucucucucucucucucucucucucucucucucuccccuccccccuccccccucccccuucguguguguguguguguguguguguguguguguguguguguguguguaccugaccuugagcugggcacguuaguauucacuuuuuuuuuuuuuuaagacugagcccuggcugaccuccugaguggaccacucacuaugcagaccagccuggcuuugaacuuagaucccaucugcuucuaccuucugagugcuaggauuaaaggugugugucacaacacccaaacccagcuaaaaaaaaaguauaaaaaguuuuaaaucuguuaccaaacuuuuaaaacaccuccuuggggcuggagagcuggcucagcaguuaagagcucuagcugcucuuuagaggaccugaguucaauucccagcaaccaugugguggcucacaaccaucuauaaggggaucugaugcccucuucugcccugcggauguauaugcagcagagcacucauacauuaaauaaaguagagaacuucagaccaauuucccuuaugaauaucgaugcaaaaauccucacuaaaguucucgcuaacugaauccaagaacacaucaaaacaaucauccauccuaaccaaguagguuucaucucagggaugcagagaugguucaauauauggaaauccaucaacguaauccaguauauaaacaaacucaaagacaaaaaccacaugaucaucucguuagaugcugagaaaaacauuugacaaaauccaacacccauucaugauaaaagucuuggaaagaucaggaauucaaggcccauaccuaaacaugauaaaagcaaucuacagcaaaccaguagccaacaucaaaguaaauggugagaagcuggaagcaaucccacuaaaaucagggacuagacaaggcugcccacuuucucccuaccuauucaacauuguacuugaaguccuagccagagagcaauuagacaacaaaaggagaucagggggauacaaauuggaaaggaagaagucaaaauaucacuuuuugcagauaauaugauaguauauauaagugacccuaaaaauuccaccaaagaacuccuaagccugauaaacagcuucaaugaaguagcuggauauaaaauuaacucaaacaagucaauggccuuucuguacacaaaggauaaacaggcugagaaagaaauuagggaaacaacacccuucucaauagucagucacaaauaauauaaaauaccuuggcaagacucuaaggaagugaaagaucuguaugauaagaacuucaagucucugaagaaagaaauuaaagaagaucucagaagauggaaagaucucccauguucaugaauuggcaggaucaacauuguaaaaauggcuaucuugccaaaagcaaucuacagauucaaugcaauccccaucaaaauuccaacucaauucuucaacgaauuagaaagagcaaucugcaaauucuucuggaauaacaaaaaaccuaggauagcaaaaacucuucucaaggauaaaagaaccucugguggaaucaccaugccugaccuaaagcuguacuacagagcaauuguuuuuguuuuuguuuuuguuuuuuuaaaaaaaaacuauucacaugacuuuuuucuucacaaaacuugaauaguggcuuuuuacauucauagaaacauacagauuugucagguacauugaguacuuuuuaugcuagaccauugccaccccacccaacacaugggcaagcucuauccaugucauuguaaauaauaccauuauagugcucgguucuuagucugauaguucuuggugugauauugauaagccacuccacauuguauaucuguuccucuugggaauauuuuaacuucuccaggaaguuaagguugccauuuacucauauuauaaaucuauuuuuauaauucuaucuuucccaauagccuuuguacuuauaaaaagcuaaauacuauauucuuucugaugugcagcuuauugccugauacacucauuauaaaauuaauaaauaagagccagacauggcauacaccuuuaaucccagcacuucagaggcagaggcagguuauacccgaugucugccuuuggacaucuauuauuuuucugugugucuuuccugccauuuggaaugggguuucagaaacaaggaaauauauuuucucagucuauugucuuauaauaaaauacuugauaauugacauguuugucuucguuuucuccugugcuuggcacauauaggguccuggcaaacauuucuagagggccuagaaauacacuccuccaggagacacggugcucuuaaacgccuuggagccgugcucaaccacaggguucugucuccacuuugccaaaaugaugcagauguauuucucagaaagacaauagcaauuugaauuaguuaucaaacaauggaagcucgagauucagguaggaaaaaaugagcagaaaaagagaaauaguucaacaauaguaagacacaauacucuacuuuugaacuauaucaguaauguugucagagauacacagacauugaacaguaucaaccaaagauuguuuuucaagguugaccuggcuugaaaagcaaucuuuucaagcauaccugggacauuaaauuaaagguuaaaaguguauguucauuauuuuaacucauuuuuauuuuaugugcauugcuauuuugcccacagauaugucucugugagggacuuggauccuuuggaacuggagucagagacaguugugagcugcuguguaggugcuaggaauugaacccaaguccucuugaagaacagccagugcuuuuaacuucugaaccaucucuccagccuauuguuugucauguuuuguuaagacagggucuuacuauauaacccugaugacuuggauucgcugugaagauccuacuggucuuaaaauuacagaaauccaccugccucugccucaugagugcugggauuaaagauacgugccaucaugcccugccauauuguguuuacagaaaucaacaacggaaaaaaacuugaauccuuuaauguuugaaaauuaacauguggccaagauccagugaauuuaaaggauuaaaaccauacaaaauaugucuuuuuagaaaugaacaacagauauuuggggauccucagauauuuggaaauuaaaucagaaguuuaugcuaaaggaaaaaaacaagaaauugagaaaauguuuaaaauugaaaauaaagcaucucagaagacaguaguuauggcacaguauuuccccagcagggagggcagaggccaccaggacagccugugugcaguaauagagaucagagaaacaacaccaugggccagcagccugcagcucagauuuaaacuucugggaguguaggaagugggggauugcaaaacauagcaagaggagaguggcuacaaggcuagccuaggaacauaguaagacucugucuugaaggaagggaaggacagaaggaagaaagaaaggaaagaagaauggaucauaaucauauuuuuaaaaagaagaaaaaauuagucccaaagcagucagaaaaaaaaaaaauaacaaggauuauagcaaaaaaaaaaaaacaaaaacaaaaaauaguaauaaaaugaaggcaguagagaaauagugcaacugaaaaaugacaaauuuagccgggugugguggcgcaugccuuuaaucccagcacucgggaggcagaggcaggcggauuucugaguucgaggccaggcuggucuacagagugaguuccaguacgccagggcuauacagggaaacccugucucgaaaaacaaaauaaauuaaaaauuaaagaaaaaugacaaauuaaucugcagccaagaaaaaagagacacauauuaccagaaucagaguggagcagugcugugucugcgcuuuaucccugcagucaagaauagagacugggggaucucuaaauucuuggccagccuguucugcauagugaguuccaggacacccaaggcuacacagaaccuaccuugguauguagguaggcaggcaggcaagcagguagguagaugauugauagauagauagauagauagauagauagauagauagauagauagauagauagauagauauugaaauauuaauucuuuuuguuuaguuuugagguggucccgcccuuggccuuccaaauaacuagaauuaaaggcgcauguucagcuuauaguucaccuuuuucuguauacaauuuuaaagugcucaguucaguaaguuuugguacaguuacaguauguggaacugcaacaacuaucuaaauauuggaauaagcccaugaguuacuggugcucccucacccaggcauuccucuuguacucguuuuggauugcuuacuuuuaauauuuuagagaaauggauucguacaaaugacccuuugaauaugccagguuucuuuccuauauauguacuuuucucucauggcugaaugguauuccacucuugggcuguacagcauugcuuacugucuuaguuaggguuuuacugcugugaacagacaccaugaccaaggcaagucuuauuuaaaaaaaaaaaaacacacaacaacauugaauuggggcuggcuuacagguucagagguucaguccauuaucaucaagguaggagcauggcaguauccaggcagacauggugcaggcagagcugagaguucuacaucuucauccaaaagcugcuaguggaagacugacuuccaggcaacuggggugagagucuuaagcccauguccacagugacacaccuacuccaacaaggccacaccuccaaauggugccacacccugguccaggaauauacaaaccaucacacuuaccauucacaagccauagcagcgguguagcagcagguucgggcuauaguuaaugcugcuacugugauuuucaaauucaaguuuguaugugagcauacauuuucaggucuuuggaguuuaacuuagaacugcugcauaauguggcaaacuggaguacuagaaacaauuucacucuaaacaaagauaguguagaguaaaauggacaauagaaacuaacagauugucaaaacugauuaaaaaauggaaaaucuaauagacuaaaagcaguugagcaauuauuaauuaaaaguuuaacaaauaaaagcccaggcccuagagguuuuaauaguguucugugggauuuguuguugauuuuuuguuuuauuuaaucagauuuuuucuaaaaauauaaaauuucagaaaauagggauuuuuuuuuuuuuuuggacaaggcaagcaggguucuguuacaaaagcuagauaaauacauuggaaaaaaaauacaggcucauagcccucaugaaaaauagauauuuggaacacucagcuaagucauagccaguccaacugaguguuguugaccacuugccucgcauguggaagucaaaacugacaaaauauauaaaagaauauucauuuugauugggggacuuaccucaagaauauacaguagauuuaauaucugaacaccaguuaauauauuauacaauaaaaauagaaauugagacaagaccugagcaguuggauaaaauguauuugacaaauccaaauccauucgugauaaaaggcccuuugaccugaaaccgaaggugcugcuuccacaggucaagagcagcuacucaagacccacagcaaagaacaugcuuaaaaggccaggccagccacuucuccucgaugguugggaggcauguguaugcuggcgcacauacauguggagacuaggaaccagcccgcagauuuuccucagggacaacuaauugcuugguuuuuuugagacaaggucucuuauugggaccuggugcucacuaauguguguacccagcuggccagcaaagccagagcuuugucuccaccuccccagcacuagaauuagaagccuacuccgccauaccugccuuucuuguacuuucuggggaugaaacuuggggguucauguuuguauggcgaauacuuuccuguuuucccuccaaccugaaauuaaauucuaaaaggcaucuuauauuccagcauucuuaaaaugacacuugucuguuucuagcuuauuuuauuauuuauuucugauucaacagucauaauuccaacacauaaacugauagcucauucuaaauaauuaugaaagggauguauuuaaaauuuuauaugaaaaggacuugaaaagaaugaacuuagaggcuauaucgagagccagguuucaaagcugauuauaaagauaaaaguaaugaaggcaagauuaagcucuucauaaaauagauuacaugaaacaaagcugucaguccaguggaggagggggguuuguuuguucucuauugauuuuugacaaauagcuaagacaauucaauaggaaagaagagucccuaacaaaugcuucuggaacaguuggcugucaaaauucacaagaccauuuuagguucuugugucaagcaaaaagcuaacuaaaauggaucagaugccugaauuuauucauagaauuucuagaaaauaguaggagacggucugcgugucuuuguacugcaaaggguucaacacccaaaguauaagcuuuaaaaaacaaaacaaaaaaagaggagggggaggggaagagaugguucagcagucaaaaucacuuguuggauuugcagagucugaguucaguucccagcaaccaccugugacuuuaccucuagcucuagggaauccaauguccucuucuggcccuguggaaagcacguaagugcacacauuuuuguuuuguuuuguuuuuuaauuugacagaugauaaguuagauuuuaucaaaagugaagucuuuugugcuguagaagagaucuugaggaaaauggaaacaaaagacaaggacuaaaaaaaagauuuauaauagaguauguaucuuuuuuaaaaaguaguugcauauggaauauacuagaaacucugaaagcucaauaguaaagauucagcccagaacauuuaaguagauacucuacugaagaagguacacaagugaagaaacuccauagggaaagaugcucagcaauauugcuuguuagggaaauucaaagcauacuucacaggacguguguacccuaagaugggugaggaauuagggucauaaaaacugcugcuccugccaagugguaguggggauauaagugaugcaggcacuguggagaucacuugagcauggucuuuguaaauuaaaaacauuaauauaucauccaaugaagcaauuuccucaaggaaaaugaaaacagucacaccuuaacacuuacauguguguguguguguguguguguguguguguguguguguguauuuauaacagucccacucuaaacaagccaaagcucacccagcauaucugcaccauugaguagaccuggaaaagcaaagugcuuguaugugaaauggccaggaaaaaaggcaaaucaguggagacaggguagguuugggaagugacuauacacaggccugggggaucuuuucuugauugugcaagugcuccagucugauagugugacacuuaaagaauuugaaaauugauaaaaaguuauuaacuuuacacuuaagucauacuucaguagguuagaaaagggugggaaacaagaggaagugcuagguacccuacguguucuugaaucuaacaucuaaggcugcuguggggugggugauaguauuuuguuaaggaugcugaggcucugaaagccugugcuuccauggagugcauugccaaggauucaaaucauaaaggagguauaugaguuggaacagaauuccauggcuaggaggauguauuuaaagaucaugcugauguuuuaugucauagugguugaaugaugcugaaauuggagaugccuagaauauggauaguauauuacaaccaggaaaaaaaaaaaaaaaaacuaaguuguuuuuuaacucaucccuuucuagccuagauuaaauccacugauuugacugggauuuucuucguaagccuacaagaagaguuaauagguugcagugaggaggaaagaauaauaaucaauuuaagcuuuuuuacuucaagauuuaagguguuguuaaaaaaaaggacaguuucagaauuuaauauuacacguaaaauuagguuucaugaaaugaaaacuuugucgggagauugaaaguacauugaaacuuuuugccuguagaagagaaauaagaaagcacacuuaucuuccuguagaucaagaucuuagaagaggaugcagcugggaagugcuuaggagucuaccagacagagucaccaccacagcagguacacagugcagggcucgggcugguaccuuuagaacugaggaaguacucaagggguaggcuuaauaauauccacacugguguaauuuuauuuagcuagaggcagcuauaguauauggaaagcauuuuaguuuuguguuugagaaggacaaagggggggaugaauuauuuuuuauaguauuucuuaauuagcaauaaaaagaagguaagcaagguuaccucauucagagaccacaagucacuuugauaccauugugaagguauagggagcagguggugcccauugcagaugguguaaguuccucccagugccuuaggaggaaaacugggaguuguaccccucccuucucggaggcuguuggccaucagcccuggaggauaaagguagcagaggcuacacgcaggguuugaauagccgugaguaugauggaagagcuucggaagacugcugcagcuacacaagccuacucucuuguuccagggauaggguguauagggcucuuguagggguacaggcagaaaggacaaauuggucauagcaucaaacaggcagcaagggcugauugguuauaauacaacaccuacuuaugcugacaggaagccagaacaggacuugugugcugaguuaugcagccuuacacggaacucuauacaaggucauuuuucaaacaagaucagccaccuguguucaggcacgcucacccccauagggaagcccugcugagaaaggcauccggccauggggaacugcaaccuucacagcaggguucuccauauuagugcagcagagguacuuacaugugagcugagacucuugcaggggaagggucuucuguaccacaaaguguuucuuacgcaagauuuuucugacuguuucacaaguuugagauauuucuuuggcuugggcuguuuauauacuacuuugggaaucuuguauacuuugguagcauugcuguauggaaauuuuaaaggguuguguuguguauguuuguccuuucugaguucucccuagugagaauaucacaugaguuuuguuuucuauuuauguaugguuaauuauauccuggggcaugcugagcuucacugaguucaauucuagcuaccucuguuuuguuuugguggaguuuguuguuuuuauuuuuguuuuuguuuuguaaugcagcauugucguaggugggguuucuauugcuguuauaaaacaccauaaccaaaaacaaacuugaggaggaaaugauuuauuucagcuuccaguccaucacugagggaaguuagugcaggaacuugagauggggacuaaugcagagaccaugaaggaacacugcguacuagcuugcuccucaucucauggcuugcuuucucagcuugcuuuuauaccauccagagccaccugcccagggguggcaacagccucagugaguggggccuuccuacaucaagcacuaauuaagaaaaugucccacagacuuauuaacccacagguccgucagguaagggcauuuucucaguugaggcuccgucuuccaaaugacugguaacuuguaucaguuuaacuaaaaaagguagaggaggaagagggaaggaaaaacaugauaagcauuuacugacaacuagaauuagagggccugcucuauauguuuacuauaguagauaccuuacugggucaugaauggacacauucuuuuaagauacuuuugccucuagacucuagcauaccaacuuccacacauuuuaaaucuguacuaugcacuauggcauucacuaaaguuuaacauguggcuuuugaauauuugaaacauggcuauuucaaauuuaggugugcuguuauaaugaguguacugaaaaucuacagaaugauaggaaauacuaaaaugauuuugguuuugucauuuuuguucauuguuuuuguuuuaggugaggucuuacuuuguagaucugacuggcuuccaacucuauauagaccaggcuggccucaaacucacagagaucugucucugccucucaggugcuagaauuaaaggugugaaccaccaugccuggcuugauagcuuuuuaaaaaagauuuguuugaagguuuucuuguuuuuguuuuuaacguauaugaguguuuuuccuacauguacaucugugcaccaucugugugucugaugucugucgaggccagaaaaaggcagcagauccucuggagcuggaguuaaaaugguugugagcaucccucugcaagagcagcccaugcuccgaaccacugaaccaucucucuagccccucauuugcucuuuuuuuaauagaaaauugaggcuggugguggagacagggauggcacacuguuauuucuuucagaguuaugugguuacucuuucucuuaaaguaggacucauagcuuuggcucuaaauuguuuaucauuaauuuguuaaaaugcuaagcuaguuuacuaaaaaaaaaaaaaaaacaaaacaaauuaaggauuaaugaguaguagguuaaccauucucuugauucuagauacuaauggaagugacuaguuuuccaaacccauuuacaggaggccaucuucuaacucaguucucuucucaggcacuacagacucgacguccaacaacaacacggccacggugauuuccacagcacccccugcuuccucagcagucacauccccuuccuugagucccucucccucugccucggccuccaccucagaggccuccagugccagugagaccaacacgacacagaccaccuccacgccucuucccuccccucucggagccagccaggugauggugaccacgcccggcuuacagacagcagccgccgcucuccaaggagcggcacaguugccagcaaacgccagucuugcugcuauggcugcugcugcgggacucagcccaggccucauggcacccucacaguuugcugcuggguaaggagcuuucccauuccguuugcauccagaacagaacuaggaucucauuccugcagcucccggggaaaauuuguuaucgcugucuuagguggaaaguauaucugagauggguuugcacuuaaguuucuaaguagccacauugucauuuccacaugaugacacagaacugagucacugaguaacucagugagagaaccaggaaaaugcucagaauucaucauuauuaagcuuucuucagucaaguauauuuaucuacuuuuuaauucccccaaaacagguaaaacuuggaauaaagugauaucugauuuuauguguuuuucaguuuuucucugauaauuucauacauguaugcaauguauuuuggucauauccauccccaacuccucccaaacugcccugaacucacccccacccacacguacgacuucauuuuucauguuuuuuguuguuguuuuguuuuuuuucuucaaguagccagucuaguuaguuagugcugccuguguauaugugacuguagaccugcccacugggacacgagugacccaccagugagcucucaacugccaauagcucuucagcuaggggcggaauaagagcccuugcccugucuauaccagaaugugucuggcuugaucuuguucagagaaccuacucugcauucaaugagugcaaauuucauguccgggucuacaagacaucaguucacaaaacucccagccuccaacucuuacaucuuuucuacugaggaacauuuucauuaauguucccuaagucuugauguuagggagauacgguugauagugauguccuauuuagggcugcauacccaacaguuguuuauucuuaucaguuugaccaguugacugcauuaauuauuauccacugcaguaagaguugagagcaucauacaucuggguauuaacauaaguucuuagagagcaguucgccauaaccauuuaacaaaacaauagucaguaucugccccugcccuacucuuggcccaugagcuccccauccaaugggcuuuugacuacauuuacaguaccaggcaggaacuuccugcuaugaauaggccucagaucaaaccagaaaccaguuguuuaccacuagagcagucaucccacuguuccaccaaugccacaucuugccugauugguuaguauugcaacauacagggucuaguauugcguaagaguguugaugcuuuuucucucccaggugccuguauagcaccucuggcacugggaaaguuagccgcaguuccagauuuucuauguccuguaacugaagugcauuugucuucaguaaucagauauagcaucuaguuaugauguacccccaagaucaguggcaauagccuguaaugaguuggguuuuuuguugguuuuuauuucuaggggguuggccuuuauagcuuuccaaaccaauaacuuguuauaaauguaauguuuauucuccugauguaguugccaucuucaaggcuuacugccucugucugcuaagcuaggccuaguccuggaaccuuccagcagucacacaagcuaaucuaggccuagaauguggucagccuccgagacucaccacugacugcgcuuacacuuucuagaucuuucugagcucuguuggcuggucuguuggccagcuguucuggcucaagcuccucuccacguggacuaagucagucuggcuucuccagacucugacucuugcccacacuaccccuagcgaucuguucuaaucuuguagcuccucauucaauggcugaucuugccuuuccuuguaucuagcuuguucucucaaugcagcuugucucuguacaagggucccaguagaacugccucccaccucucucuucucucacccccacccugugcugcucucuaaaguagcuucccuuucccuucuucucgugagaguugggcauauucuauucugucagaucuuucucugauucaucucuuuuucugccacucaauuagacaucacuuuugaacauaggugcuuccuucuacaaacuaacuuuauucucauuguuuggaauuaaaggugcguacuaagggcugagccacaccacaacuagagaaaguuuuuuuuucaguaaauaauauaaucuggggguucggagugugaucaaauacccugcggcaacuuggacauauguacccauggguagcacugagauuuuuauucaguauucuguaccuucugggaauaauagugucuacccaucugggcacucuguucaaacuccuuuucuuauuuuuuuauuauggguuuuaauuagcuuacacauagaagguuuccacaggcuuuuucauacauuauuaguuuuuguugaccuaccuuccuucucugcuuccaucccucacugcugucucugcuuaaaccuuuaaauauccccguuauucccuccucuugucgucccaauacauucuacuaugucccuaccccauuaagaccucuguccuccucucaaggacccauccauguuuucugaugaaagugcagaugcuccaaguuaaacauaaaagacucaaagcuaggagucacugugaaggagacuugcagccuuuguaauugugggcccagguuagucacuuaguguaauguuuuccacuucuauccauguaucugcagacuucuuuacagcugaguaaaucccauuguguguuuguaucagucucaucuguccaucagucaauguuaauuucguuuuuccuagcuauugggaauagagcagcaaugaauguuguguggugauuuuauaucuuuacugucaaauguaaggauuaucccuucaaguuuuuucuuuuagaaaagaaaugaagcaauucaaagaaaagucagaaugauucgaguuucauauuuuaugcagagcauaaccuuguuguacaagaaagcaguaacugggaagcacuaacugaaccauauaaaaugauacagaaagugacaaggauccuauacauuuccuaaguugagguuuucuauuuuaucaguuuggguaugucagauugaugucuguugacauggcaguagagugacuccucuuuugcacuuacagaggugccuuacucagucucaguccggggacucugggcagugcucucagcccagcccuaaugagcaacaguacacuggcaacgauucaaggucagcagcacauuugucuugcuuggugcaccugaggguauuggaggcagggggcggaggggggcagcuagaggaagcuuccugcuuugcuaaagauaaaggugaagaggagaguugaaugcugauuaagcuguucuugggggucaagaagauauuccuguaaaaaaguuuuguagaagagcauacggguuaguuugugagaacagcaaaugcauaguuugguauauauauccaagaaaucuaaacuuuauuaugugauuagaguuggaaguagauuuauuuuccuccugauguuaaccuaucucaaggcuagcuucuucaaguaaaacugcccaguuccauccccacuaagagccaaguguucggccuauagaaguaaaacacaacguuuuaaaaucaugcccuuuucuuuauuuggugaugugugaauguucucuugauuaaaggcuucucaaagauagcuuucaucuuauaugaaauuuauucucaaauuugucaaauaaugucaguugaguugauaaaacuaaacauauuuuuaauucuucaaucacuaaaaguagucuucuugaauggagguaguuuuaaguaaacuccauugaaaggauaauauuauuggauuuaacaaauacuuguaaguaaaugucaaaaacuugacacuuaaaagauagaaauaugacugacuggucugcaacucucaugauuccucccuguugauuuguccuacucauaucauuaaguugacuuucaacucuuugcaucagacguauaaacuugagcugaugucaguacagcaucacaguggaggggagagucagcaaagaggcacacucugcuacugaguaggaguuagcugguguguuaucuguguuaucuggcuucuccaggaugaaauuuaauguucuuccuguucugggcucuuugucuauagcucuugcuucuaguggcucucuuccaauaacgucucuggaugcaacugggaaccugguauuugccaaugcaggaggagccccgaacaucgugacugcaccucuguuccugaacccucagaaccucucucugcucaccagcaacccaguaagcuugguuucugccgcugcagccuccacagggaacucugcaccuacagccagccuucaugccuccuccaccucaacugaguccauccagagcucucuguucacagucgccucugccagugggccugcuuccaccaccacagcugccuccaaggcacagugagcugagugcagagcuggguugccacaggcuuuccucacuacagggugauaggcuggcuaccagcugcuuaagaaaaugacaccugucauuggcuuccucccaccauguugugaggaggaagaagacauggagagaagaaaaaauuacacauaccagaaaaaggaaagaauggagacaggacagcauuugccuaauuuuauaauaaaacaaugucuuuucaggauugcuucauggauuggagaacuuucuaaccaaaaauuuuaaaagaaaaaaaaaaaaaaa

SEQ ID NO: 482 - RNA, 36275 nt, Mus musculus
gugaauuuccaccaguaacuuuauugauaaagaaacauuuugauugaaacaaagaauuuagccaaguauauaaaauauauguguacauaaaaucagaggagggaagggauugauacaguugcuuuucuggugauccagaaagguuuauccaguaguaaaacacauuuggagcagcccaucuggccugaguccuggauaguaauggaaaggggaggcugcggcaggcagggcagcuggcaggugcgagggaaguaagcuuuugucuguguucauuguaaaucagucugcccaccuagccagacuaacacggggcuuggguggagucaccaggugucccaagucacacccaggaggcaaagcacuguccaugagagcaaguccccaguugaggcugccaggcuccaagauccagaccuugcuccagggcaccuacucuaacacagcaggaaguguagcucugauggccuugcaugcagcccaggucuaggugugggacaaagugacuucauugccuccugguguguuagcagucacaggauuaagaaagauuuggggauccaagacuagugaguucuaaggacaggcaggcccuugacaggcagagauggaacuguguuuggagaaguccuaagaagguguguguccaggaacagaaacgccauggugggagauggagcagagggggacgcuggaggccaccguggccccucagcauggggggggggggggcgcaauuaagcuggguaaaucacagaaacuacaccuuaucguugauuucuucccuucauucaacaaaauauugcgugcaggcccaucacugguucuccucugagugucgggcauggugaggcagggcagacucccaccuucugaaacuggugcugaagcuggcgcuugccuguauggcgagcuuggaacagaagcagcccugcaucgugccgagauucuaggaggcccugccagccguaagagaggcagaggaugcugucuggucuagggagaaggccagacccugagucagauuuagcaaugaggaaggguccuuucaguggucaucagguaggacgucaguagccaggccagugaugcgccccugaggcagauacacagaaagaagugcuccaccaaugccuggggggaggagcaggacuauggggcuggggagaaggguggccagagcaggagccugggcccuagaccuccccccucuccccgcugggcagaaggcuccuucauuggaaaggcuggucuggagugcuacgccccgagcuccaccgauccucaugucuguggucaucuucgucuucccgcccucuggaaauuucuuucugcuccuuuuuaggcacuugguaagcugcucgguuccuauagggcaauaaagaaacaaagaaaguuagcccucccucgugagggggcaggggggugaacuguuccuacucccaucuccacucguaaacugccaagggacucugcugcaagcugguuacccagcccacagugagaucucccaacucgugagcugaggagaucgagguggaaagagugugcguguguuccagucucugucugauccucggcuggccaugagaagagaggcugcaaaccacaggcccagaggacaaaggcaggaccucaguccacccuugacuuggaugcgucauucauuccucaacugcaacugggaaagauugaaacucguuggugucucccaaggugcuaaugcgcaugcccgaggggcugggcuauacaucucuaucugcccuccuccaagggaucaaccaucccagcacacuuacggccgcgcauccucccugucuugaucuuugucauccuuuucccggcagcagcagcaguagacaaugacaccgaugaugaugagggccacaaagacacuccccgcaaugcccgcauacagcgcaauguucauggaggcuguaagaggauggaacagccguacuuuccgaugcccaacucuacuccucuccccagcucuacccuucccccccuccaagucaaucacggguauagaauagaaagucaggcaggagguggggaaccauuguucugguacaaggcgcagcaggcuaaucccaucccagccucugggcaacuucaguucuucugccugaccagggagccauggcuggaagcuccugguaacacacuacaacagucaagcacuggagcauugugaucaggcagaucugaggacauucuuuagguuagaagcgcagacaaggagagacagaccagagcauccugccucggggcucccugggcucuccaaacacaccgcguguuagcuucgccugcuucuggcuaaugcuauggucucucucuccccaccaaaagagaauaggguuuaaaccaagacaacugguucaagaaacuccugucacacucucugaguggccacaaggcaggcauggcugaagaggucuccagaaauaugucccaggcucuauuuccaaagaaccagaggaucugggcuucucagggugagagaaacggggccagaagucaucuuuccagggucacagcggccacucauucaccuccaguauccucaaacagccaucucuggaccuuguagcccuccccuccccacccugcucuuacgaggucugggugccacggugauguugcaggacucuauccccacgucauugcuggaggugcagauguaguaacccgcugucuccguggagauguucuucagcaacaauggcucgccugagacugaacgcagaacagcauggugaaaagacagcauuugguggagugugcacagcccagggcugggaggccugggcccugggagcugcaaacucugagccucucugagccgguccaucggugauggaaggaaaaucaccucuaaggaugcugggagaucaacauggcagaugggacaacagugaggagcuucaaacacagcaaaaccccugggagccaacucuggcuuugccuacuuauuugauguguuuugcaaauaacuuguccuauggaaucuauuucuucaucuauaacuagaaaugaugguaccuguaugacaaggaacuugugagucuaagaugagauaucaauaauaaauauaaguguccaguagaaugccugauugcaguaaguacuugggaaacacgcacgcgcgcgcgcacacacacacacacacacacacacacacacacagggacucuugucagcucaagcauggcgaacaugacucuggcaggccuugcccuucuccccaguucuucccaaagcuagccacagggucuauccuuuucuuuggcugcuaccuccuccuaaggcuuauuuccaagggccagcucucaaaguacuaaaguccagcaaucaaaagcccuuuuggguucacugccaguuaaaauuaagcacugcauccuaacacagguuccccauuuaccuuuauaaacagccauuugccuauuggccacaucugucuccuuucuauccagagacagucauuguucccuugcaggacaaauaccacuuucuccucucccucccucccuccuccuuccccuucucccucuuccucuaucuccuguucuggccccuuaucccugcccuuugucccucuggggcagauaaaucuccuuugugcugaaaauuuggucuuggugguccugggcugaaacuuguccuauauacagaacaggaaauguacauaugugaugugugugguguaugguauggauacgcuaugggagaauguuugugaguugagggacgugucaguuuaaacucuuccuccauccaguccuucagcaguggcugaacccaugacagcccauguguauguccuguucucagagaugcuccaucaucacugcuauuucaagagaagaaacccacauccccuaacuacagcgccagccucaucagaaccuugugccaccagguuucacaaucugucacaaggacacgcuccaaguuaucaagagggaccuguugcagucuuuagaaauuucagaagcuaucuuuaaucuucaauaggcaguucaguguguguguauguguguguguguguguguguguguguguguguacaugcacauauguguacacauguggagaccagaaguuagcuucagguguuucggucucuuuucucucuugcuuuuugagguggagucucucgaugacucuggaacucacugauucugcugugcagaggaugcacggugagcccugggguccuccugucucugcccaucgcccacgcccggugcugcaauuacgggcagguguggguugcuccugaucaaaccaagguccucacaauuucaugccaagcaguuugcugauugaaccaccccccuaaggucugcguucugggcuuuuaauacagugacaaaacugcagucuggaccugcagucacaccagccuuauguccggcuccuuccccaugugccaaaccagggaacaguccacacgagcuccugccuccacacucugggguuguuggucucucaguauccucaaugguguugcauccuuccaacauucuuguauggaagguggaccacguguucccaacuccaguuucacaggagaguccucugaguuuuauguugguaucugugcacgcgggugcacacaugcacacacacacuaauaauaaguaaauaaauguuuaaaaagcaaaauaccuuugcacuauaaaagcaauguaugccuaugauaaaaaauuuauguaugacauaaagcuaucacaccaacucccuucaaacuaaaaccaucuccauuccaaucacagcuacaaacaaaacgaggagagcgccugucuuccucccauuuccaaucuaugaaggaagacacacaugaaacagugguaacuucaugagcaguuacgguucaaagugggguuguaucugaacucauggugaagggguuuacucuugucugagggccagaaggagccucuaaaagaagagaaaauaaaauaaaaucaccuuagucacacuacauugauuuuauuuucuucucuucuuaucauaauuaugcuacuuucuucacauucuuucccuaaaacucaaagcacauuuuuuuguaaaauguggcagccuuggauucuaguaccccacaccugaguguuucaugguauaccauuuucaggugguauucguauaugauaauggaaaggggaccacaggcaaagcaaggauguaaaucacuauggugaugaagcuucaggggcguggccuacuuugggggcguggccuacggguguuuugauaaugccaguggaaaccaugauggggauucagagucccauuuucuaacccaaccggauuugguuaaucuuaagaauauuuuaaaggaacacacuuuacagaaugcucucugucuccagguacagguguguuuaggacgccuagcgcuggcaucagagcccccaccugagaguguacugagagucaaguguccacagcaccccagggcagcuccuaggccuccuuuaggggugggaucaugaggguucuugcugcaccauccuuccccuagucucuaaagcaaacgauauguucuagaaacuuaucugggauaaaagugggcucaucccacgucacugauggacuuugauugaccugagaaaucucagccuccuuuccuucuggaagagcccacgacugucugaaacccgguuucccguuguuguggcgccaucuuguggucaggaaaggguaugcauauggcugucaucugucccgccgaagcgcuaagaagcccugauaaccccaagauauugauguugaaugaacaggauccgcucuuucuguccccucccaccaacgccggucaguaagcucuggcugccacgucucaccccaggcucuggggcggaccccugaaguauuccuguucgguccacuccugagcucaccggcauuuucacaggucgccuaugggaaacugccucuuacuucaaggaagguaacauuagcaccaucucagccuuuauugugguuuuugaaggaccagggagcuuguaagugacuuacagcuacaaaguuaaaauaggacuccccggcucugcagggaacucugggagcaagagucugagaacagcaccccuaccucauuacaacauccagacacaaaaccgcaucgcuuccagaguuaauacugucagucugaaucgaaaucaccuacaggagaagccucugggcacgccuaguggaauuccagaucaaauccaccuugggagugguuggguggggcagucuagauuagguuaauuaaggugggaagacccucccccaugccccaucccccauccccccagcccagcuguagacugcaccaucccuuggaguggaauauuggacugaauaaaaaguagaaagugaguugugcaccagaauuccucccucuaugccugcccccucccuccucucucucucugucucucugucucucucuggcucugugugugucugucugucugucugucuguuucuuucuguguugucugucugugugucucucucugugucucuccucucccccucucuuuaucccucugugugugucugucugucucucugucucucugugugugucucccucucccuuucucccucucccucucucccucucucucccucuccccucccucucucccugcccccccccuuuuccaguggccaggggcauugagagcugcagcugccacagcucccccaccuuggaggacugugcucuuaaacugugaggagcccagugcuuacagggaaaaguccaaccuccuaggcugguacacaggccccucuccaucuucccccauuguccuucccaugaacaacauuggccaucauggacauguacccuaccccucagccacacggacaucaugacucucaugcuguuuucccguucugaugggucugcuggccaggcacuaaucuccguguuuuacauacuuugguucacccuuucccguaacagcaugagaugaacacugguguugugcccauucuacagauguacagaccaaggcagagacaggcuaaguaucuugccuuacuugcuggcaaggagcacagcuaggauuaaagcccguggcuacucuucagcaccuggucuugcugcaacuccaacaucccucuugugaagaaagccuccaggaucccucacacagucugcaucacaucacugugucagccccccaccccccaccgaagcucaugaccacgugaccuucagcccuggcccccacggugcaaacuuugcaagaggaaagucacgaaaucacuguguucuuagaucgggagcaggcaacagcggguagacagaacaccacagguuuuaagcacagcugccaggugagcucaacagaaaucucagacauucaaacacuggcaggccgggagcuggugagaugacccugugggugaaggcacuuggugccaagccugauaagugaguucaagcccuggggcucacgugguggagagaggaggcucccaacuaguuguccucuggccucucacugggcaguucucccacauacauacacaccucacaaaggcaguuuuagaaacguguuuuaacuuggccauccgggcuggagggauggcuccgugguuaagagcacucaaugacugcucugccagagaugaguucaguucccagcaaccacaugguggcucacgaccauccguaaugggauccgaugcccucuucuggugucuuugaagagaacaacuguguacucacaugcauaauauaaauaaagaaaccuuuuaaaaauaaaacugguaaaccagaaacauaccagcaaaacuggacgcuugugggaauccauaucuaguacaucgucccuuuuacuuuaagucgagugaauucuacuaacuuuuuggguuuuucaaagaaguuauuguuuggccuccagaugacugagaggcaacgugauaauccacucggcuuugauggaagcccaugggugugggguguucauccguggggcuucccagggcacuggauguuucgcggggcuuccccagggaacccgaugcuccucccucacccagaucagccucacccacaggcuuugcucucaccuccuuaucccauuucuacacacgcagcacugaacgaccucaaagguaaaacugauggacacaccucgguucacuggugcagccgcagcagcuggugcgcacacugagagccuaggcgauuuccacuccagcagccauaauggcagcugaguguuuacauggucccagcgcugccccucucuccucuucuuucuccccuaaccuccuucuguaucuuguuuauuuccugaucaaaggucaacuauuaggugaccaguacaaaaugggucucuuggcaaccacagcuaaaucggccguagccugccugaggacggggccccuaacagcccauguuguguucaugguggugucugggacgcacugguguggaugggaaguggggcuaggaaauuccccaccucgaaaguggguuuuaggcuauaauaaagcuuaaaagaacaagccccgguguuuugcacagaaugcuuagcgggauucacuuccuccagaggauggagggugggaagaacagaagucacgugaccucuaccaucgccugcucuacgcuucugggaaccacugcuguccuugacagcugugaagugggguguacaggcuuuuguauggaaaaccaauacucggagggacgguccgagguagcucaagggcggggcuguguuaguaggacugguuggucagccuuugucucucuagcaaccccacgcagucaagugccccguuaugugggauacacggccuuccugcugcccccucaccuggcugggugaggggccgcugcugguucugggcguuguaacucuuccagcuguauugugggcucggagagcccucugcagaguggcaugucagcuggauguuguucccgaucaccaucuccccuuggaugcugcagucuggcuuggaggguggaacugugaaagaaagggaccacaaagagagaccugagucgccuggagacagauacuacccaucccgauaucucucaaucuauggaggaagagagagagagagagagagauuuaauauuauaaagcuaauucauccccaaauaccugcugucauagcacccucucuaagaggcggccccacaggcugugcuacacagcagcuccucccagccuaacaguagcaacuucaucagaaaaccugugaggaccuaucagagacuuucaaggcuggucucacuggcugcugcuggggaggguauugaagucucucaccugagaugccagccacucugucauauaccaauuggccauuuguaaguaaucauguucuaacuguuccuggucuugucucagaagaugcugaaguacacggagugugggaugcauuugaagugggaguuguccaucuauacagcgauggaaauuuguccacacugagaugagauucaagcaccguggcuuguggugggcucgccuaagcuuugcauauaaacacugggaguucuccaggcugagcuuccauagaaacacuucgguuugucuuuuguguccuaaagaguuuguuugaaucuccccagggaaagagucaccacgggcugguugauaguggcuucuuguguucuaugaacucuuggguguuugaacaugaucaacguagcuguuauacagaugggggccacuggagcacacagacagaagggacacuuguucuugggcucugggagaugugggacuagaaccaagguuuccugacuccagacccaguguuugcucuauugucccaggugagcucuuucugcuccuaacucagccaggguccccguguuccugaucuguaaagucaggggacagcaagccccuguaggaggccauaugggauuuauagguauauuauuuccaaugcuguuuuuuuucuuuuggaggcauguagaauauauuuuuauucuuugaaaucuucauacauguaugcaauguauauugaucaugguuucucccccaccccacccccauccgagucacucccccuggacagcuccucccucccuucugguuuuaauaaugccuuggaaccauagggcaggcagguugugggcugacgccagccuggguuccucacccuaggcuagacgaucucuguaucccucugcuucuugggacuguucucuguggauccaccauugcccucuccccuacuuugcauuuuauuuuuauuuauuuuauuaauuuauuuguaauuuauaauuuauuuauaauauauuuguuuacaauauuuauuuauaauuuauaguuaauuuucuuuuauuauuuauuuuauuaaaaaugcaaucaacgggaccccagguagugcagagcuuccccacugggugaagaaugugacugaagacaugggagugggcagaggugaccaaggaauaccaaaggcagggguuuauaaaucccagcagccacugcaaagcauccgcacuagcuucuugagacuccaagccugugacuuuuccucaaccuugucaaugucacguuggguggaguggguggcucuguagacguuauuagguucugccuaacaguucuggguacuaugguggcacucugagucagucaaggaaucuaguggggguacagaagacaacgaaacaauggcagagcaggagaugggacuucugggccagagaaccaugacccaaugcauaauucugggcuguggccugaaggucaccauggugaaggaggugacaggaauuagagcagagacaagcaugccgaacagaggaacaacaugugcaaaggcucagaggcaagaagcaggaagaauccaugagacuccaggaagcaucguuaggggcgaggaagggagagcacuugguggaggaaguugucucugagguccuccgacccuucuaccuuugucacaugccauuuuggauggcuugcaugcccaguucaggcacauggucacccaucuugaggguuaaugccagucuuaacccaccuggaaguugucagaggaauuguccccgacuccucucuuccacuccagcagcugcauaauuucuucuuggaaauaagcaggcuauuauuaagagugccuugcaucugcugacacagcugggccagccagguauggggcggaugguaaccaccaaccacggggacacauuagaggcacucccgaaucgccaaacaaaacccuagcuccugaggaucaaaggccagccugcaggagcaggugagcagaacaccugccagagguuggcuacuuaggcuccugcagcauccugcccgcccgcccgggaguuagcagaccugagacuggcggugaaggggaggcgaaccuacccucugagcauuccuuccugcugugguucucucucccuccugggccgcacaccagaaccuugcagggcccuuaccuagccaaccucacucucaggcaugccuuuagcaggaggcgcagcggcaaacucccauacacucauuagacuaagugguggaauagcagagggacaccacccaccccccaagcuaguuuuugguugguugguugguugguugguugguugguugguugguuggucggggcgggguggaguugucggauacagacagaagugggaaggaaagugccagagaccaacugcugaggcguaaaaggcaaaggcgccuguuuggaaaacuagcaccugcuucauccacuccuuggguguggucugaacaggaacuccagaaacugcccgccagggugauggccagcaagagagauaugcuuucaagaggacugagucgagaucuuucgcuccaggcccuugaccacaggcucuaaacuuccugcgggcccugugccaggcacacccgggcccucucucuccagaucuucagcgccccaaucacaaacagccgggaucucgaguuagaucuaguuuaaagagcccgcgggcgggagccaagaggacuggcgagggagcagaaacucacaagggagagggucuuguucucacguggccuguuuuacaaacagaagguuaccugaguaauuacugagggagaggccauggagggugggaggggauguguuaggcuucaaagccucucagaugccgucuguucccuuugaagacgucagggggcgccagaggccaggacaaggauuuaacaccugccgcacaggcugcugagucuucugacuuaggggcuuccugcaggugagcuagacaaggcuagcuccccggggcuaaggucggaguuuccugcuagccuccccagaaugagccgccccguauaauuaaagucauucucuuguaaaaauuaucuaguuauauagacaccgagaaagaaaacuuuucacaaagaauauugcuggguuuauuaacauguaauuuuuuuuaaagcaagagguuaguuucaacgaauuccauacucucauauuaaacguguagccuuaacucuucggguuaaucugauugucuuuaaaaguaggugguccuugauguacgggccggaguuugguuggaggaccagcagaaucagguuucagauuuacaccgauucuugccauuuguuugaaauccucugucaaaaaaggcaggccagguauuuaaagaacccaaauguuauacaagucuguguauauauaauccucauauguauauauaacuuaugauuuuuauucauaccucuacacaaagugagauaaagggguauauuguaguauugcuuguucaaacaagagcuaaaaaaaagcguugaaaccugagguguucacggugcgcugucaagaagcaacuugcuaagugcuuuauaauaucucacgucuucacaggaaagagcaaagugucugaguguguggugugcguugggagaacgccgggcgaagucuaagacgccugccugcauuaccacugguugccacaugguggcgggguggaagaggucuugccuauucuuuaggcagcauuaguugauaaccgcaguguagucugacacgcuauaaggcuuucuaugaguccaacaacuaccacauacaauuuaaaagagcuucugccaaguaguguaaaggaaaaagaggaaaaaggauccucuguuuugaugcacagagaugcuaccucccagaaguggggccuugcucacacugcacauagacuagauucucauuaaagcaaucccaguaacugguuugaggcaauuacuuccugugggccucaccuacucagaaauuaaagcagaugaguuuccucgccucuccaaaacuauaaauuccaacaaauucuccugugaaaaggaugcuauccugggacauacuucccauugguuggcgacugugccuuuguuagaggaaggguggaaaaacugguguggaacagaguugagagcagggaaagagucaccuaugggggucacgauuggcccugugagugccacacaagaugagaacccguguauugcuugggggauccccuucacuucuuuucaguaaugaguuuggaaggggaaagaagaguugguauggagggcaacgagcaacgggagcaaggggugacuccaaagccacaccucugcccucagaaacacccugcuagccaccgagaacccccggagagcauuugagagacagagggagagacagaaccauggcucugcugcugacagcgccucucugcccacccuccucccacaggaaaagacagagacacucaccaaggaccaagaggcggacucgagacuuggcguugacauccugguccgacaucagugacacggagcacucguaggugccauugucguccauggucagcuggucgauggugauagaggcauuugacaacucagcaucguuagauacucucacucgauucucauaacgguucccauagauguauuucuuugucacaaaauuccaggugaccacucuuuccugagagaaagaggaaaugucugucaggaccugguguagaccugcccugacucaaucuucgucccccagagcaaaccaacaacaugucaaacagaagggcaguaccugcugguagauuccucuuguuaucuagcuagauaacuuuagacuuuuaaagauuugcuuuugagcuuuagggacugggguuguaguuuagcugguaguacuugccuaccacacguaaaggccuggauuugaucccagugccguguaaacuugguguugcggcgcgugccgaucaucccagcauuccagaggugaagggagggaaaaguucaaagucguccuuggcuauguagcaaguucuaagccaaucugggaggcaugacacacugacucaaaggaaaagcacaaaacagcaccgaggcacacacccugggagaccagugugcacagaagcacacacccuggaauaccgguguguaaaugaggcuggcucggaucccagcacucacauuugugaccagccucucucuccuugguucccucucagcccaugguuuauucucacccaucccuuccuucauccaacacccacagugcaccaccauaagccagguaccacacuaguuaaccacugaguuccagcucacuugguucugacuauugcccuuggaaguuguuuauuuauuuauucguugguguugacgaggcagcacauuaacagcuuagaccacaggcacagaccaggcugccucagucaaauccucacccugcugcuagcugaauggccuuggccgcucugagacucucuuuucucacuacaaaauggagauguugaugauaauacaucuccuaagauugugcugagagcuaaagcugauaauacaggcagagcaguuggggucugccuggcguuguuucuaccgugacuagccauuaugucgguccaccauguccagggcauacaacccgugaguucuucccucaaaagugaguuugaaaccaagcaaccaggguaucucaugauuauaacauagacuggccacuugggggacgauuccuacgaaggcugauagcugcuuugaaucucgaaaggcagcugugcauuaaucgcauaaaaagcuagaaggcuggagcagcgugugugauauguuagacauuggaggcaaaggaaaaaaaaacaaacagcagaaaucggcagugacaaccccaaggggcacagugugaguagugacagauuggcgagagccgagcuuggacaauaaaggccauaacuacuauuuacgauauguaugucauuaugcugcgcacuguuccaaggacuggauacuuguuaucgcaucuaacccacacacucguaugcaguagaccuuaugaucacacccaccauuuuacacgggaggaaacagggauaccacgaggcagauuaaguauguucuccaaguugacauguuuaagugacuagcagggcugagaugaucuuggcaacucuggcucagagccugaacgcugcagauucuaccgagucacaucugagacacucugcaacacuaaguaguucacaguucaccuccaaagcaauaacguacuuugccuuuugcugaugcuugagacuguggagcgaaccucgcucgguccuuccacaugcgaggcaagaacucuacuguccagcagcaucccugacuccagaauucuguauuuuggggguuagcucuuuuuccagagcacagaugaaaagggacaaguuaagagguaaccaggaggggcuggagagauggcucaguggguaaagacacuugccaccaaaccugacaaucugaguucaagucccaggaaagagggaaagcugccaucuuacuucuacauacucacccugauaaauaauuaaaugaagucuuuaacuuagaaaaagaaaaagagugaaaaaccaugauuauugucaaaucggguuguggcaacacacagagacaaaaaugaguuggaggggcaagaaaacgggggacacaugaaauugugggaccaagaugcagaguuagagagcagcuagucccagauuuagggcuuaggcacgaauguuugccgguauccuucccaacagaguuaagacacgaggagagugcuuuagacaaaaaguuuguguucuguuuaugugcaggacgccugaagcggaacacccauggccauaugggacagcugaaugucacuguaacuagacagguaaggaguuaggcaagagauaacaaggaaaccauacgaugucaugguagcugugucucccgugguuagauugcccuuugugguuaaacacacugggagaugcaguuagcucucccugcuguaucagagaugaaggcaccagcgcacuuucucauuaucauccacgcacaccuauaaaagggguggcuccuucaaaacccccagcuucauuaccauaucauuugcaugguggccuugaccccucccccacuuuguggguuuuucaagaggaucauaagacgaauuauccuaaaagcaaaaucuaguucacugugguuuaagaggaaaagggggccacagugucccagugacuagguggcccaacucauaaauauucacaaaacugcuguauuucuauacacagaaccaaguggguagccacucccucuccuuucaggucagcccacuccagucucucuuugggguucacgcuuuauuuggguaaaucaacuucuguuuuaacuguacgugucucuuggcugaauucuuccuuuugaggacagaacuaggaggggcuuucagcugguaauaugucuggggaugaaaguuuagaagccaauggcauacauguauguuuucacagagaugugggcuaggcauggcucaaagcaaaugccagguacccaaguuauucaaagguuccagugaaggucagagagacaagacaagacaagacaagacaagguccccaaaagccaagaagggcucugagaaggggaaguaguugcuagcggggaaaugcuggugauuucaagaguguuaggagagaaaaugggugagaugggcagagacgagaacguggagacgcugugccaggucagaauccugagcucacagggccuggccaguguggguugcccuggggauguuuguauuuugaugauguuaauucugcuuccgcaagaaaggcugccccuggugagaucacauacucaggugaucucacugacccuuucuaacugggcaaacaaaggcuagagccgaugauugggcaguggaagggaaaggugggaugggugaucucagagaagggaaggagagaggagagagagagagagagagagagagagagagagagagagagagagagagagagagagagagagaaaggaagaggaggagguggaauggagcagaaccacauggccuggagaaaccacaaguaccaagggguuucauagcuggggaauaaauuaguauaaauuaguauagugauagaucugcccaaucuaggcauacagcuuauaauaccugguuguguuuuuuuuuuaugugggcuuauugggguaagaaauugucgccaacaccuuuccaguuagaacaagguguuccaguuuuucaacagauauagucuagguuagggcacauggcauagcuauuggagcccacguaccuucaguuagacacccaugugcaagauacaagcuguacaaccccaucugauagcccuaauaggguagacaagccauugagaacgccuggcuaauucagggcagagggugagguggugucuaggcugcccauggauguucaggucucuccugacccuuggcuggcccugccuggguuuccuaccucauaauccucuucucuaagauguccugauuguuccaggaucucucucucucuuccugaucacaccaccugcuaaggcucauggaaaacaaugccuuugucugcauuuguuuuuggucucaagggugcugccucagguccuuuuggacauagaguucccagcagacaauaaacaacuguagagccugugugggcacucugaaaagucagcuguagguguuacaccugccuccuggacgcaucuggacggagguguagggcccuucaguuccugcaggaucggcgucuacggcccaucagggcccucagaacauauagauaagacugaguccuuugcuaggucugucacccagggggcaggugucuuacgauucugucagagaaaaggcuaaagccucuuucucucugcauggcugggggccugaggauucuuucuggcagauccguuauuaaaaguuucuuucccuaaagguuacacuaaagaaaggagaccaagggcgagucgcaguagcaagagguuauaaagcuauuuuuccuguguguguguguguguguguguguguguguguguguuguguguguguauaugguggauaaaugugcuggucaguuuuaugucgacuugacacaagcuagaaucacugggaagagaggcucucaacugagaaaaugccuccaucauaagauuugccuucaggcaacucuguagugcauuuuccugacugaugauugaugcaggaaggcccccacugugugugaucccaucccugggcuggugguccucggugcuguaaagaaagcaagcugagcaagccaggaggacagacagcaagcagcgcuccauggccucugcuucagcucuaacacccagguucuuaucuuaagucacugcccugacuuccuuugacaauggccuacagugcagaaguguaagccagauaaaccccuccucucuaaauuucuuuuuggucaugguguuuuaucagagcaauagaauccuaacuaagauaauuuuuaaaauuacaaauauaauugauaguuaaaguguaaggccuuaagccaaguccauggcuucuuucuguaugaccaucuuaaccguacacaaguucaaugagauguguagaguuugggacugggauuuuaaacuagccaagugauggcuuuguuuauaaauucauuagaauaaaucaauuuuauuuuaaacagaauuuuggggggugugggggcuagaaucaaaguggagcucuuucuggcuuuacccaccccccaacccuccaacccccugccccccccccucccguauucagguguccuccaccaccuccgugguucauguuagcauuuuagaagaagauuugacuucaauguacagacagaugcucuguguuuuauaguuacacagaugugcuuuugaucucaaaugagauacauuuuuucacuuaucaaaucacugguuaucagacaguuugagcauaugcugagaaaaugguaggcaccacuguaggugaaaaugaagacugguaagacaucuaaugaaauuaacacagaaguuccguucagucauucauuuauucauccauuuuaggacuuuguaaauguuaggcaagagcaaaauauaggaaaaaaacaauuauauauacauguauauguauaggcauauguauguguauauguacauauguauauacacacacacauaaguguauauauguguguauagauauuuguguguauguguguguauauauauauauuucucauaaaaaauuuaaaauaauauauggaguccacaacucaguaauagaaucagaucacaggaucagaucacaaggcccuggguuugaacaucaacccggggagaggaaagaggaagugauacagggaagguuuuaagauacccagagaugacacucaggagacacucaugccccaugacguuccguucacccuggagucccuaccgucugacuucggagaagcuuaucccacugaaugaaccccucucggucugaaacauagguguuguaggugcacgggagggugacacuccuuccucgagcagcccgaagaauguccuguguaguuuccacgguaagagcaucagcagcgacccagacuggaaagaaagagagaaaugaauggcgcgcuaucuucagaccgcugcaagaaugcucagaggaguucuguggcuguaugaaagcugccacagcagcaaccuggucagggcuugcuagcagcagucuccaagaccaggacagggaggaagucaagugccuugggcugcugucuucuuacucugaaguguccugaagaaguuaccugccuuugguggcaaccugacuuucaagcucagaugucugcuccucagcugugcugauugcucuaagccccagcguucccaucaguuacuggggagaugcaguuuaccucaucccaagcacagagagcucuugguaaacgccuugcugcuguaaccaagauuuguguauucacuuacuuaacaaauggugaugggacaguugcauauccuuaagaacuuuaugagcaagacuaaugcaagguaaaagagagucuuccuggggagcaguuuauuuaucagaaguaacuaucagaaaagagguuuguaagaaaaaaaaaaaaaacagucacacacauucuucuuccuuaguguuagcaccauugugaaucuggauggucuguaauuauggcgagaggacauucuauggcucccaggauagcuuaugugacagaguaugcuuugccucauccuuuucagaugucacucugggguccuggcuaaggcuugguaagcaagcucagcagacagacagacagacagacagacagacagacagacacacacacacacacacacacacacacacacacacacacacacacacgagagcuaagaagaaaaugaagagaaaguuucugagaggccaaggugucucaugaaaggagcugugauggcuuggauaagaauggccccauagccucauacauuugaauauuuagucaccagggaguagaacucuuugauagcauuagaaaaauugggagguguggccuuguuggaagaagugugucacugggggugugggcuuuaagguuucaaaaagcccaugccaggcccagguucucucucuuucccuccccaaccccugucaauugcuccagugccuacccucaugacugcaugauaccaugacaccaugcucccagccaugaagauaauggacuaagccucugaaacuguaagcaagcccccauuuaaaugcuuuguuucggggguuuugccuuggucauggugucucuucacagcaauacagugacuaagacaggggucaacugcucugaagucaaugauuuguuuauacagaagcucuggacccagagacugacagcuggaugugacaaugugaagaugaccuugacaugagcagauggaguggagaggugaggauggagcuuaaauggaagagguucaagagcaaauggagcaagaauaaggaacaaggagacaacuuucugggaaggacauaaguguguauagcuaaaaucggcauuagaaccaagacagguuugugucuuuagggggcagaugguauauuugaugauuuaaaaauacuuugaggcuguuuauugaaaagaaugagucagaagagaauggagugagcagggugguaggagggggaaacuuuagaaaggaccccacaucguccaucuacugugacaagauguagcuaaaggcacagaugaguugguaggcuuagggguagcaguaugaacaaaguuugcucugagggguccugugaugagguuguguuauaaggaaugaaagcauccugcuaaagguggccuuuggucgccuagaucugaagccaccacagcggaaaaaaaaaaugggucuccgucagaugaacaaggugugaugguuaguuuuaacugucaauaauuggacauaaccuagaaucacuggggaagaaucaucaucgagacauuaucuacauccauuuugacugugguagaucugugaggaacugucuugauuguucauugagguaggaagaccaaguccauugugagcgacaccauucccuaggcugggggggguggggguggggcucgaacuguguaaaagcagaggagguacgcuguacaagcaagcaauaacacauugauucucucuuagcucaugaauguugaugaugugacuagugccuugaguccugccuugacgucuccaaaaugaugggguguaacuuggcacuguaccccuuccuuuguugcuuuuugucaggauaucgguuagaguaacagaaauaaaacaagaacacaagauucuuuugaaaaugcaaauuccuaggaacagagcuauucguacuuugguguacagugagagccaacugccuuuacagagugggcacugcccaacaagggagcugggugacgagaguuccuggggcuucuuugugaaaucagagaaauggguacuuggugagggaaaaagucuccaaaagccagccuucuccuuggcauuuguaaauuucugacauaguuggagcaggagacaccagugccccaguaccagaugucacucugaaaucauccaacacugucuuccugggcaucugaagccugggcugucuccuauguggccauggcucaccaaaugcuccuccaugucaacugaagucucucugccacuuucagcuaucagaaaacacacucaucgucauuacuaacaagguccccuucaccaggaggcagguucuggaaagggccucuaauucuacccacuaggccccagcugcagguuacauccuggucagagagcacaauuauaugcggggguucccugggugccuaguaguagucacggcaacugccauugaucuucaccucaccucuugccugaacccauuucccuggagccuuguccucaaggugaccauucuugggccucuccguggccugaauaaggauucuuucuugucuuauacaugagcagccugucacaauggcugccacuggucgaguccagguugcacaguuccucucaucgagccauuccuuccaaauucagcugucuacucacucaugacuaaggaacaggagccagauaguaagccaacagucagggaaaggagaacaagccaacacgcagaguuguuaagucccaauuccuaucagucuuuccuacauuacacuaacuacaacucaauggcacaggucuuuuuacauuuacucccauucucucuuugauguuaucccuaguuuucagaccacaaaauugagguucagucuucauaagccuuaacauguaccucggagggguuaagcaguguguucuaugcagacgugguugacaguccagggcuucuacccaacagucagggcagauggcggggaggguauuuguacucagugccaacagaauccacgucuuccacccuuuccuuguaaauuuuuccuuguaaaugaaacucuuacauccuuucuucaguccaaggucaaguauuuaacaugugucuaccaaggcaagauaaaaaugcauggagccuccuucuuacugggucaggguuuauggacacagacuaggcucacgcaugcgcuuaguucuuucugugugucacagagguacugugcacaugaauauaugcccacagaugcuagaauagguguuugagcuagaguuacaggccauugugacccaccuuaugugggugguaggauuugaacucaaguccuacaggagagcagacagcauuuuuaauguuuaagccaucucucugccuccuuguaauccaccuuagucaaacuuuacguagacuauuucccagcagaagagaaacaaacuugagauuuuuauaggagaacugggccuggagaaugccuggaaacuaaaccugcugucggagaacacccuacacaucuguagcggguaucccacauccuuaucagagguaaaggcuggcaaucagaacgggccgcccuggcuagaucagggacucugugcauccccccucaaccccuuuccacucccagcuccccgccccuuuuuaaagucagaaacaccccuaugguuauuccuguucuuucaccacuguucccacaacacagcucacagaauccauucuaagaagcagcaggaagcuuaaaugcacagguuccaaaagucuuauuauacaaaugccacaguuagaauuccuucauccacccagugugacuuacuaaagccaccugugcggagcccucaguugaaaagcaggucuugugagcguuaagugaagaguaagcagugugaccuuugguuaauggcucccaacucauaaucagagcucccugagugaccgcuaccauuauuuaccuuuucccuuuauugagccacuuguacucagucaucuccuauucugcucucggagaugcaucuucguuaaaauuuagucaugagagacaaccacccaccaucacaaguuagccaacagaaagcaggagcaaucgcuaaugacugaagcuaaaaaguagaucaauuuuagcaaucauucuaacagugaguuauaauuguuguguguuaauggauuuauaaggaaagagacagaaaugacggaaggcucauaaagaauaauaauaacccuugacuguugcucagagcaauuugcauguuagcuguaaaucugagaaggguuuuaaaagacugacuguggccgggcgugguggugcacgccuuuaaucccagcacucgggaggcagaggcaggcggauuucugaguucgaggucuacagagugaguuccaggacagccagggcuacacagaaaaacccugucucaaaaacccaaaaaaaaaaaaaaaaaaaaaaaaaaaaaaaagaccgacuguguacccugggguaugcuuacauguucugugauucuagguguggugcaccccuguguuucagaacuuuauacucuccugggcauccacccuaacuagccuuucugcugauacacucagaguucccccauuuugacauaacagcauaaaacaccugucuggcuucgucguaacuuaaugaaucccguccuuuccuccuuccuguugaucuuaugcuuacugcuuuuucauuccuucaucuuugugggucuuugcacccccacugaggaauuaaauaaaaaaggcuggagagacaucuaauccucaacaagaaugugaggaaagaagucauuucuagaagcuuccaaccccguccuugauauuaauaucauccuuacaauucccacaaagccccagcuccucacaauuccugcuuccagaagauuccucccuccccuccuugcucuuuugccugcuuuccccucaaagcucaaggaaagccccucucuagagagaguugcuauuaggggucagauuugaaacauccccccugagacucacacauugaaagcuugguguucagugcagccauguucagaggugggaccuuggggaagguacuggacaggagggcucucacuucauugaugacugauggacugaauacuuaauugauagggucauaauuugaugggcuacugggagguaguaggaaauguugaaagugggagagcguguccuugaggccauguuucuagagaugauagcuugacccucuugucuuguuuccccucuccuucccuccuuuucucccuuccuccauccugucaucgaaccugaggucagccaugaugcaguacggugaguacauacaaugauccucugccuuauuuugagcccagagacaauggauuaaaaaccuugaaccaaaauaaaucuuuccuccgcuuaaguagguuuuuuuuccagcuguuuuguuacacagagacugacuaacacagcuguaauacauugauguguuaaccccugcagacauccauauugacggggauaaaaagcguuuuuaucugcaaggggagggggaaucacaaaaaucuuccuacaucauaguagguuguggaaaaaguuuggaaacaagccacaauuuuaagucuccaaagcagauguuuccuuuugugucaccugguacaggugaguaccugccaguucucaggaugcacacagaagggcugccagaccagccuggaguuagcaagaaccauaagaauucuccagucucagguugucuucacuucagauccucaaggcuccagcaaagcucugcaagguguucuuugacagccuggcagagucauacauaacuuucacaucagaagggugggugguuaguaacucaagacacuugguggaggaccuaugccugaguuauuagaaacugugcccacaagggacuggggacacaccucgcaguggaucuugcccaccaugcaaaaagucaauggccagggccaggacaggauccauaucacgacaaacuacuaagcaaugacuuggaaauucaugcuaccauucggguuuuuuuuuuuuaauggauauuaauagaaauuaaaaagacagcuauuuaaaggaagagaaacuuccuggauauaaaauaaaggaccaagugagccccucccaaagaagggaagccccaccagcaagaagcccuaagugguaaugagaggccauuuaagcccccugcggagcuaggguauggagacccagcuugaggccuccaugauugcuuguaaauaauuaagguuuguuaagaagauaacaagcugucuccugagagugaaguggaaaguaauacaucccaggaagauaaugaaaugcuucgaggagcuggcugccugaggcacacacagcauauuacgggagcccuggggaaacuggcaggaacgcuuggccacuuagaaaaauccauuugcucagacaaaccacagauucuugcucagggaggagaugcugaaggccagaagggaccagccugggccaggcagacucuuucaggugaggaggaugggugugucucuaagggggggggggggacaauucccaugggcagguagguuuguccuccuuccuagguacagcagcccagugcugugcuggggacaaagaacagagaaaccaaagccacagggaggguuugguuugguuugguuugguuuaguuugguuuuuagaaaucuauccacacuuguugaacuguugggucaacauagaucuuuaggaaccuauaaauucgggucaauucaguacauuucuucuaaaacccuagaccugugccaggcccaacagaacuuacagaguuuguucauagucuacagucucuggagguucuucucccaccccacccccaccccacccccuccaccugccaccccacccccauccacagccaauccuugcuggucuaccuuucugaguauaauccgcauguugacaugcgucuguguguaggcuccuucuuuuaccagcugggguucucuaagaggaccccgugucucagacuauucuaguaaguggcacucacuggcucaaugcccaagaggccugccucuuggcuggguacuaauuaggacuuuguugauugaguggcuuguggcaaaaucccuaauaagaagcagguagaugucacugucaaccaguacccuaauggagccuaauagaguauuaggaguaagggugagaagagagagauaggaggaggggaaucaguaagaggguuuuaacagggaagcagggaagaguauugaggaggugaaauuggacuucgcccucgagggaugccauucacuguguugaauucauagacauaaggggaagaggaagggugcagggguugugucugcacaacccacagucccgcaugaccacagacacagggugaauucuaaaagacaacaaaccagaaagacagcaucaauaacagcuaucuuuggacuuuggguaucaaagggcaguuuaggguuuugccuccggauacauucgucuaaguuuccccgcaaugggcagcagcccuguuccagcugcaaagccaagaggcggaggcggcacaagcaaccaacccacugugucccgcagcuugccugacacaguaugaugaaggagcugaaaccagacaaagacucuggagguuucucuaguccccuccagacaggauagagaggcuugggaagccuccagguuacagugaacgagcuucuaaagaggaagagauagaagacagaggagagaacagagaagaagagcaucuugggaaggggcaggaacacgggaauggaucgcgucauaggaggauaaagcucacucgcgguguguuacccacucccucgcagggcacguauuagcaagcuggugggcaagugaagggcagggagcuuugggacaccaagugacacuuuauucuucuccaaugaacugggcggcuguccuaaccggaagugucugucuaaagucgugucugugcugcccgcgucagaugucuguggcaugccugacucaccagcgcagaagaaaaggaaguggcccaaaggucaguggguggcgaagaggaugcaucucgggagggaaggccguuuccaagggcaguagcuggugcccugugcaggggccugcucugaggacagagggagcugggcgcaugggagggagggagaagacagcaggggaauggaguugagcguugccaaugugagacagcuugagggucauugcccucaccuccaaggucaguaugucucuguaaaucaugugucugaacaccggaauuccuacacuggguagaggggagagacuccagcuaaagggcagggaccggggaaggaagagaccucagccacucuucuucccucucacacaucagacagguacaagagucaguuguggagaggacagaguaaacuuagaaaagcuaggcucggagaggcacaggagacagugcagggcuagcaggcuuguagccuggaaagaggcaagagggcaggggagcaugcauuaucacuguccagcagggcuccagguacccugacagagguggagaagccuacaguggcacaguucugcuugcucagaggccaguccucugggugagucagauggcaauaaauaaauaaucucagaacaaaugugaaaccaccauggucacaagugcccccucccccacaauaccacacccacacagugagaaaacggacugagcaccucaggagaggggaacacgguccucagcagaggcuggaggggaagcagcaucaagaaagagagacagaagaggagaugugugggaagugggcaagguuggagaaauaggcagaguguagcaacaggaccaaaggcgcuugcucucgcucuugcucucucucucucuccccacccccaccccacuccugauaaaacacaaaggccaacaguguaccagguccaugaaggccgcucuggacaaaccugcuacuuggcucccuuccagccagauucccuauagccaccccaccaguuccucccuauaaagcaacucuagggucacaccacugacuuaagcaugaguuaaguccaagccuaagaggucaugacgacaagaggucaagcaaaaugagcagagucaagcaaggguggaagacagugucagaagcacagagggcugaccuggcuuuaggugagauagcgggagccaucaacggugaccuggcaaguuaugauaggcccaaaauucuuugaaacuguucucaucaagaaucaagguuugaggcgcggcaggcauagcaaauaccuuuaaucccagcacuugagaggcagaggcagacagaucucuuaaauucgaggacagcaugaucuacagagugaguuccaggauagcugagggcuacacauugaaaucuugucuggacaaaagcaacaaaaagaaagaaaaaaagaaucaagguguggcugaaggcguagguccagugguagaacacuuguuagcauucacaagguccuccauaaccacgaaagaaaggaaaaagggagagagaaaaggaggagggagggagggaggaguggggagggagggaaggguggggaggguagguggaugagaggugaaaauaaagaaaacuaucucccaggggugguggcaccuaucuaugaucccagcauuuggggacagagagacaaaggcccagagauguauguuccagccuaggacacacagcaacaacagaaagaaauaagacuccucuccccucccuuaaguugcagccuaugacucccugaacagcccgggugcagcagauuugcucugggcuccaguuugggacugggcacuaccauuuucuagcucuagguguuugcucuuggcuuccuacugaggcuuugaggaagcgaaggccuauaccguggaaggccacagggagcaaagccagagccaacaccagauugccugcugccgacgguaccaccacgagaagaaguuuuccacccucagcaaagccaccccagcuaagcggcaccucgcagacuugaugagaccccucucaacuccagaucugugagcaaacuaauauuagcaucguaauuuugaguaagcgguaaauuugagauagcuuuucgaauugcaauagaaaaauguagcaggucacugcuaggucucugccuucugcucuuagauggacagagcaucagauauuggcacaagagaagucaccgaggacuuaggcuagaaggccccccacgugagucggacugcagccugugaguuggaagucuuuagagauauaugaguuagaaaguugucuguuggucuugagggacucuagcuuguagagaaguaggguugaagacaggcguuuuggagcuuugagguuagcaaaggagugaagaacagugaaagcucucagugcagaaauagucacagguggaugcuggaagaacugggugucgggagcccugacaacagaagagcagaggaggaagaggcuacagaagcaugagagagccgagggcagaagagcauguggcuuggaccacaccuucggcaucucagaaaggagagagagaucagcaggacggggcacugccgaggguacgggcauacacagggccaggaucacuggccuucuggugaccaacaucacaauaaacaucacaacuggguuucaugaagcccugggcuggaaucugaaagguucaugucucaaacuguggucccugaaccacuuccuacccaacccccaccugagaggucauuagaaacacagaacuccuuacccccaccccugaccuuccaucaguaugcaucugauaaggucccaggaucccugugugcgcacuggaguguaagaauacaagcagcuggcuucccugagucaagacguccaaccagggacuagacagcagcucucagggaugaagccagaugauguaaagaauugagaagcacacagucuguucgucuggauucugauucagaaaauaggaaggaaccugguggaugcaaaugagccaggguugacggccauccccccacccccccaccccccgccacucuccaccuuagaacacaucccucuuuggcuggccaguccucacuggggcugagacugcuauuagcuggggcuuuguaauuccaauugcaucucugacaggcagccuuguguuucaucugugaucuuuggcuucugccuugcaucagcaagugaugcccuggcaucaggugggagauggaccuuaaggauuguacccagggcccugaguagggggaggacaggauuuggcuugcacuuuacuggcucuggcccaaauguaucuucuguaagucgagaguuccuggacacaaggacacuuucagauuugacuauuauagauauccaugccugaggcugugcccccucacugcccagccugggacagggaacuguacagagcuuagacucugaauccccacagagcagacaccaggguguccccagcuugugacgccaacuucagaggggcaagugguaggcagcauucuuagaaaaacucgcugcgcuggggacugugucugcugaugacagccccuaaagauucuaacauggagaacagccccgacagaccugcagcgugaaaacagacuuccuaaaaucccucuguggcccagcacucaggggguuauugaaaccuuuuaaugucuggggagagagaaaaaaaauuuuuuuuucucaccuaguaugacacuuugcaacgauagauuccuuuauuucucuacaaaaaaacuguauuuuucuaauuuagcauagaagcaacaaagaaauucgcuguacuucuagaaagguguguaucuguaugagugugggauauaucugagugugucuguguuguguguuugucuguguguguucauguguguguguguguugagugugucuguguaugugucagcaugauguaugugugugagaguggguggcuguguauggcugugguguguguguuguaugugugcaucuaugugugucagugucugucugucugugggggaauaucuggguacauguguguuuaucuguuuuuuguuuguuuguuuuucgagacaggguuucucuguauagcccuggcuguccuggaacucacgcuguagaccaggcuggccucaaacucagaaaucugccugccucugccucccaagugcugggauuaaaggugugcgccuccacgcccggcguguuuaucuguuugucuguauguuugugucucuguguguccauguaugucagugucugauugugugugugugcacacacaugcacagugcaugccuguguuuauauugucaggucucggcuccuggcagaacugaccaugaacucucuggaacuuuccugguggaagccauuuuacacaucucuucaucuuucaggagaucuaguggcugaaaauuuucuugacuggaagagccuugauuuugugcauaaacuggaggguuuuucuagcagccuuugaggggaacagguaggcccaugcugguugcuugggugauaauugggacuuguccgcaaggacuucggugucauuuccuggcucauuuuggucagaucagagcuauuagaugaugggucacuagugugucauugacuucugguaccugucuuugcucacucuaauaauagcagcaauaauaccagcauccacugagaguuccacacaggguccaguucuaaggucuuugccugaagaaacuaugugacagguacagugggcacuggcugcauuggaaauuagccucuggguuuugcaaaccuuggcauggagcucucggaggugaagugauuugccugugccccagucagagggaagagguccucagagugagagcauuaaaaugggcggggcaucugccugaugggcaaguguguuuugucaauuacucuauuuagagaugucaucuaugauaaugaaagcagaccaacguguguguguguguguguguguguguguguguguguguguuuacacagaugagaggccagaggaggauauuaaauaucuucuccaucccucuugacuucacuuuucggaaucccgugcugaaucugaagcucccagucucggccuggcugacuucccauuacguccugccugucucugcuccucagggcuggaguuucagcacgcauagcuaucccaacuuuuuuuguaaugugggugugugggugcuaagaauuugaacucagauccucuagucuucacagcaagcacucggacccagugagucuuugucucagccucguuugccauuaaaaauaauucuagggcuggguagguggcucugagguuaagagcaugaguugcucuugcagaggacccaaguuagauuccuagcacucacaugguggcucacagccauucauugccccaguuccagggauucaucagguaugcaugugguucacauacaugcuugcuagcaaaaacauucauaugcauucaaguaaaauaaaucuaaaaaaaaaucuaaggugccaaauuaaaccaccuccguacaaccuuauaauaucuuccacuuccccaaaguucagugagccugggcuaucucgugaacucagugccucucucccaaacacaaucagcacaaucuaugauggacaugaucagguagggaagggaacuuuccaugauucuuagcucccccacccccaucacacaaugcagaacgugaugccugcccucgaggcccaggggagagcacugcccagaggcuuaucgguuugaucugugacaguacccaggauuggcaaugacgaagccaccacuuggcagagugguuuccuuugccccagggcuccaagacuucuucuuagagcagauagucauggaggaaagaaagguggggugggcaugugguucugagcagagcuggcaggggagagggugagggcagagaacacacuuuaacagugugucaggauacacacacacacaccccaugcucccacuccaccacccucauccccccaucucccaccccucagcuauuccugcuggcuggguucacccagaggucacaugccucacacuccaggagaaggccaccagccugcuccaggcaguugagaauugaggacauuucucauucuaagcugggcaagugacuguguucucaguuuuugguauuucccugagccaguauuacuucuuuuaugcauacauguguuaguaacaggguaaagaacacagaguuuuauacuggugcgugcaugugugugugugcacaugugcgagugcaagucaggugugugcauguaugcaugcaugugcauggagaaaaguccuggcucaggaaagggucagaaaauccuggagcagaguaggagaggguggccguguccuuccagccucccucuccugaggcaagcauccuccuuucagauaugaaggcugaggcuggcaaauccagacuucccaucccucaggcacccacacaauccuugugcccaaugagggaccgagcagaugaaggaaugggcaagccaaggggacaggggcauuugucucaggaaaaauggaccugcccauagaacuugaacccgcuaggcagaguaacugucccucaaagccuugaacugaucaagcaguuguccugccuagcagguuguccuucacuccaaagcaaggguucagaggcaggcuggagaggaagcccagagcccuggaggaugugccgggugguggcucaguugguucugggcuugccaggguguauugaacagugugcuaaccaaagccuccucggggcuccugaauuuccuguucagcucucacuuccucccggugguucccagauccuggaagcaagcugcuggacaaagacacugaacuagggucucugaacuaaacuccucucagcguuccugacccccgguaugcagacacccucaggcacccugcccuucuccacacaacugcuuugcuauuuaacacuuaguuucuauuccgccgcaaacccaucugaugcugcuuugagaggugggaggagggguucucugccaggcagggaacacagggagcaccggccuguggaagccugcuuuccagcuuguggcucuaugcaggauaucgaggaaauuuuuuccucuuuaaguuuccugugggugacauaggugcuaacauguuuauggucgugucuuuuucuaauuuuaaaaagacuggaaaaccaaaaccaaaaccuagaucaaugguucucaaccugugggucgccaccccuugggagauggaaugguuuacccccccccccccacaggguccuuuaagaucgucagaaaacacagauauuuacauuacgagucauaacaguagcaaauuugcaguuaugaaacaacaaugacaauuuuaagguuagggggucaccacaacaugcagaacuauauuaaaggcucagcacauuagaaagguugagaaccacugcccuaggcaguaaaucuaucuagauccacacccuggcguuuuugagagcaauccuuaauuucaaauacugugucuaacccuuugaguuucucauuucaacaauggacuggggguuguuugggagcuaacggagacaaggacuguguugauuuaggaccaggccuacaaacugcccccaccaaacaguagaauguauagcucugcucagugggacagagcacugcugggaccaggggaagugagggacacuaggacugccucugcuucagcagucggucacacaccccacccauuccccagagcuggcagcagaggggcguacucacuugcacagaacauccacaccacagauccugccuuccccaacauggucuggcuccuuucccgacacaagcccagucuggaacuggcagggcacuggacaggucugggcugucugguuaaagcuauggccucuggccugguucagccuguagucccugugacucuccuccagcucaccugggccagacugggcccacaugccccacccagucaacggacuggcaggugagcucaccuauggggugaggccccugcuccaccuacucuaugaaaggccccaacaagagucuucuuccuuccuggagccagccaucuuccugccuucucccucuucagcaggagugcaaaguccugugcuucucagaaggug

SEQ ID NO: 483 - RNA, 2847 nt, Mus musculus
ggacuaguaaauguugucuuuaauaauauuuucaaagucucaguuaaaagauuuagaaaacaaguggaucaguuacauuacaaauagguucccuagauuuaaguaaaaggaaauucaauauauuucuaaguuuuuaaaaaauaaucgaaauuucuguuauuuuucuagcuacaucauaacucugguccuaguucauaaguacuucugcacaaagcuaggaagugagaaaucugugaccgcaucuuucuuacauuuuuuaggcaggggccagaguucaagcuacagcccaguggacacaaaggcuaaguccaccuuccaaacgucuggccuagccacucacaaccacaaacaccugcaauccuuugauagggagggaaacaggucuacccaggccuuaaguaggucuggugagccuugggcagggcauuacacagcaggagcguggucuaaaagguaagugaacugaaaccaagguauauguccuucaccuugacuuugagccauuuggagagcagaaugggccucuucuaaagcacgggguucauacuggcucuaaagacccccuuuugggaccgggccagcaguagagaacaugcuauuaguaguggcuuuuuuuuuccccuuccucucuuggcccaacauagccugaaucauugaaguucaccgcagugauuauauaggacagagaaaaacauuugaacaagggagauccgggaagccugccuuagguagaacaaagacaauugucucccuauuccaagaacagcauguaggaagccucccucucuguaagcaaguuggguuugagauggagccaauuccugcugaguaacacaaauaccaccugugaucaucuacagcucacacuggucaggaccauggcucccaggcagaagauucuggaauaugcgaucauagcccuuagcagcacucccuuccaaucauuuagaaaaccauggugccugcuuuuguuccugcagauaacaacaccaucucggaacucagcucccugcaugaugaugacagcaauuuccgccagucuuaccaccagaugcggaauaagcaguucccuaugucuggagaccuggaaagcaauccugacuacuggucaggugucaugggaggcaacagugggaccaacagggggccagccuuggaguauaacaaagaggaccgugagagcuucaggcacaggugacggccaugagugggaagggaccacuguguaucuguucuucuguuucuauagacuauggaauaucucuuacauauauuacacccuugugauacugugugugagaaguaaccaguuaagccuuuuugaaaugagugucuugggucccguaaugagacacucucuccauauguuuuauccuagaaccuuuaaagaacccacuaucuucaccacccugaucauuugucauaagaaugaugaucaugccaccaucucuuguaauuaauccuuauacuucuaaaaagcagcuacuguuuauguuccuauuuuaaggccaggaaauagaaaguuccagaugcuaaggaacuugcccagggugauaaguccaagcaacauuuaauaaucugugugacagcucgauuccugaauggcaugccugcacucauuaucuguccuuggaggacaguagguaccuacccccccccccauuuccuuuacccacugcagaggucucaggccucuugacuuaauaggcaacuuggucccugccccggagagagauacaauccuuucuauguuaacaauuauuccuggucuccugggaccagagcuguguguugcuguuugcugugguugugagggugggugaaguaaaacauguggcugucacccaggggucucaacacgauaacaagcugaucuguguguuucagcacuacacagaucacaagguauuuucagauacacaaccauucuggucuuccacacaaacucaggagagagccaggauugcucuggcugaacucgcagcacaaaaggugccaaaguugauucauccugcugggcugagggguaagauacaccugggccccugaaacuccaggggcgcgcugcaagguuuccaugcaauaaccagugaccaucugcccgcagccagcagcgcuccaaaucugagaugcugucgcggaagaacuuugccacgggcgugccggccgugucgauggacgagcuggcagccuucgcagacucguacggccagcggucgcggcgcgccaauggcaacagccacgaggcgcgggcggggagccgcuucgagcgcucggagucgcgggcccacggugccuucuaccaggacggcucgcuggaugaguacuacgggcgcggacgcagucgcgagccgccgggagacggggagcguggcuggaccuacagccccgcacccgcacgccgccggccgccagaggaugcgccucugccgcgccuggugagccggaccccgggcaccgcgcccaaguacgaucacucguaccugagcagcgugcuggagcgccaggcgcggccggagagcagcagccgcgggggcagccuggagacgccguccaagcugggcgcgcagcugggcccgcgcagcgcauccuacuacgccuggucgccgccaaccacauacaaagcuggggccagcgagggcgaagacgaggacgacgcggcggaugaggacgcgcugccacccuacagcgagcuggagcugagccgcggagagcugagccggggcccguccuaccgugggcgugaccuguccuuccacagcaacucggagaagaggaggaaaaaggagcccgccaagaaacccgugagggcucacccccaucucucuggagcuggguccgggaaug

SEQ ID NO: 484 - RNA, 2847 nt, Mus musculus
cauucccggacccagcuccagagagaugggggugagcccucacggguuucuuggcgggcuccuuuuuccuccucuucuccgaguugcuguggaaggacaggucacgcccacgguaggacgggccccggcucagcucuccgcggcucagcuccagcucgcuguaggguggcagcgcguccucauccgccgcgucguccucgucuucgcccucgcuggccccagcuuuguaugugguuggcggcgaccaggcguaguaggaugcgcugcgcgggcccagcugcgcgcccagcuuggacggcgucuccaggcugcccccgcggcugcugcucuccggccgcgccuggcgcuccagcacgcugcucagguacgagugaucguacuugggcgcggugcccgggguccggcucaccaggcgcggcagaggcgcauccucuggcggccggcggcgugcgggugcggggcuguagguccagccacgcuccccgucucccggcggcucgcgacugcguccgcgcccguaguacucauccagcgagccguccugguagaaggcaccgugggcccgcgacuccgagcgcucgaagcggcuccccgcccgcgccucguggcuguugccauuggcgcgccgcgaccgcuggccguacgagucugcgaaggcugccagcucguccaucgacacggccggcacgcccguggcaaaguucuuccgcgacagcaucucagauuuggagcgcugcuggcugcgggcagauggucacugguuauugcauggaaaccuugcagcgcgccccuggaguuucaggggcccagguguaucuuaccccucagcccagcaggaugaaucaacuuuggcaccuuuugugcugcgaguucagccagagcaauccuggcucucuccugaguuuguguggaagaccagaaugguuguguaucugaaaauaccuugugaucuguguagugcugaaacacacagaucagcuuguuaucguguugagaccccugggugacagccacauguuuuacuucacccacccucacaaccacagcaaacagcaacacacagcucuggucccaggagaccaggaauaauuguuaacauagaaaggauuguaucucucuccggggcagggaccaaguugccuauuaagucaagaggccugagaccucugcaguggguaaaggaaauggggggggggguagguaccuacuguccuccaaggacagauaaugagugcaggcaugccauucaggaaucgagcugucacacagauuauuaaauguugcuuggacuuaucacccugggcaaguuccuuagcaucuggaacuuucuauuuccuggccuuaaaauaggaacauaaacaguagcugcuuuuuagaaguauaaggauuaauuacaagagaugguggcaugaucaucauucuuaugacaaaugaucaggguggugaagauaguggguucuuuaaagguucuaggauaaaacauauggagagagugucucauuacgggacccaagacacucauuucaaaaaggcuuaacugguuacuucucacacacaguaucacaaggguguaauauauguaagagauauuccauagucuauagaaacagaagaacagauacacaguggucccuucccacucauggccgucaccugugccugaagcucucacgguccucuuuguuauacuccaaggcuggcccccuguuggucccacuguugccucccaugacaccugaccaguagucaggauugcuuuccaggucuccagacauagggaacugcuuauuccgcaucuggugguaagacuggcggaaauugcugucaucaucaugcagggagcugaguuccgagaugguguuguuaucugcaggaacaaaagcaggcaccaugguuuucuaaaugauuggaagggagugcugcuaagggcuaugaucgcauauuccagaaucuucugccugggagccaugguccugaccagugugagcuguagaugaucacaggugguauuuguguuacucagcaggaauuggcuccaucucaaacccaacuugcuuacagagagggaggcuuccuacaugcuguucuuggaauagggagacaauugucuuuguucuaccuaaggcaggcuucccggaucucccuuguucaaauguuuuucucuguccuauauaaucacugcggugaacuucaaugauucaggcuauguugggccaagagaggaaggggaaaaaaaaagccacuacuaauagcauguucucuacugcuggcccggucccaaaagggggucuuuagagccaguaugaaccccgugcuuuagaagaggcccauucugcucuccaaauggcucaaagucaaggugaaggacauauaccuugguuucaguucacuuaccuuuuagaccacgcuccugcuguguaaugcccugcccaaggcucaccagaccuacuuaaggccuggguagaccuguuucccucccuaucaaaggauugcagguguuugugguugugaguggcuaggccagacguuuggaagguggacuuagccuuuguguccacugggcuguagcuugaacucuggccccugccuaaaaaauguaagaaagaugcggucacagauuucucacuuccuagcuuugugcagaaguacuuaugaacuaggaccagaguuaugauguagcuagaaaaauaacagaaauuucgauuauuuuuuaaaaacuuagaaauauauugaauuuccuuuuacuuaaaucuagggaaccuauuuguaauguaacugauccacuuguuuucuaaaucuuuuaacugagacuuugaaaauauuauuaaagacaacauuuacuagucc

SEQ ID NO: 485 - RNA, 394 nt, Mus musculus
guauugagacccugcagcgaugcugagcagguuucuaggcccgcgcuaccgggaacuggccagaaacuggauucccacagccggcauguggggcacugugggugcugugggacuggugugggccacggacuggcagcugauccuggacugggugccuuacaucaacggcaaguuuaagaaggacgauuaggcagccccucccccaccacaggccucgaugguaccaugugccgaggccucagacacagcguaguccuguggaggacacugaggaagcuggacacuggagaggucugcaccgcucagggagcuuccgcguugacagacacuagggcugccuugauaggugcagcauuaaaccuuauucuuaugccuuggaaaaaaaaauucacag

SEQ ID NO: 486 - RNA, 4938 nt, Mus musculus
auuaagaacaggugcuuauuuaauuagagcuuaaucaauuaaucaauguauuaaucuucaguuggucaguggcauuagugugcugcaguucuguagugcauccuugaaguaaugaagucaaggcuucuugaucugaaggugugaaucugguccugguugugauucuuugaacaagucucuugguuuucuaguccaaaguuuucugucaaacuguuuucuuaucuguucucccagggugacuuccugcuuuacagccucuguuccugugaagacaagucacaugggaaguaaacaacgggagacugagagcuagcagagcuagcuagcagagaaugaagagaagaagacacccuuccccaauaauuaagguaaagagacuuccaaacgccugggcagcaguccauggaggaccaacaauggaacaugaacucauuaacagaguguugaguaaaacucagagaggaagagagggcugaugaggagggaguccaacuggagacaggggauucuaaugaaggaaugggggaaguguugcuaauugggucauuuugaaacuaaacagcugaauguaauuccuccugaagcaaaagaaaacagccaggggagguauaauaguacaagaauguaugcuaaugggcaaaacgaggauccccaaguaaugcaagacaauaaugcccaugcaagcuaagagaugucaagugagaaugaggacccagauuugaagaauacauaaaaggaagcauggaguaagcacucagaaaauauuuguuaaaaugaacuauauuugcaaaagcucgggugcacuuuacuauuuuaaaacccuaacuugaaggaaaugaaaaaauacaaucucagugaugauuccuuucacaaacaaaagagucaucagaaaauacauucuaaaaagaaaaaagaaaaaaugcuugcagauuguuaaccuuuaaagcaacgaggucaaauaaguucaaauuuucauccuuaguuuuauaucauaucaaugaacaguaaauaauauacaaauacucguaaauaaaaaaagcauuagagugguaaaaaaaaaagaagaaaagaaaauacauucugugcaggaaccuuugauauuuaaaauauaaaauuaaaauuauuucauuugccaagauuucucacuagcgucuaccgccagaauggaguucagagucugugcuauugaauuuugcauccacucaggccuaacaguaucaagcacaguaacuuugaaugaauacaugcauucaucuguugguaaagaacaaaacauccaagauuaauagccucaaacaacagcuacuuucucucccauaauuccacacgcuaacugcgcucuaagggaaguucuuuggggguucuuccuucucucgugugauggucaucagauggugggaaguugucuagauaccauuccaagaggcuauggugacuuuccuccuccugauuuugcaaccccaucucacucuccaugaagucaguuuagugagguagacaggcgugucacaaggggguuaaguuauccgaaagcacacagucagagcuaucaggucuucucaagcuuuugaccuagagcugaggcuucuggaguacuccacuggcuaaagcagaucacagggccaaccugugacucaaugccugaggcagcugcaaaagagcaugacucugagacgagauuguuaacugagguuugcccucccccuuccuauggagcaagaggcuuagagucauguucuuguacgcacguaccuuucuuuaggcucaggaagaaugacucagagauaagacccaaagucccagagguugaaaccaaaggcugaaaagaauaauucuagaaaacaaaagcaagauuugaauaugaaacuucccuugccuacgccagccuggauuucagaauugcuauaauccccuuccuucuccuccuccuccuccuccuccuccuccuccuccuccuccuccuccuccucuuccucuuccuccucuuuccuucuuuucuuccuucuccuccucuucuuucaauuuauccucucuccuucuuccuucugcuccucuccuuuucuuccuccuccuccuccuccuccuccuccuccuccuccuccuccuccuccuccuccuccuccccguucucagaucaggaaacaauuaucauuuucugacacuuucacuacucuaugguagugaacggaggacaaacgaagauucucuuucucgaucucugcuccaaagcuuggacuugagucucagucaaguuggauugugauccuaggcuuucagcugauucuguagaacaugaggcuugcagaugugagggaauuuuucauauaagaacaugaaucaugaagguagcuucaaugggccacggcccccauaucugccacgauaugcagacaccucuccuacuuccccugggacaugaugugaugacauugcagaagcggaagaacggacccucaacuggcuacugggaaguuuuuaggauugaaagccuccauuuccuucauuuuuuuuuucagauguugagccucuguguaagaagucuggcugucacaguugagaaaccacccuucagaaugauacgagaguccaugcagagagggaaagguucugagacugauaugaagagaaaaagaggucagccaauccaacaccccagcuaagauuccacccaccaccccuagccagcagaaucccaaagagaucggaauaaaaacugucugccugagaugggucaaccauaaccauacugauuaccacagaaaauaaaaaaauaaaaaaccagaaucagugggugauuauuggcaaaacauaaugcuuacagagguuguuaugauauuaagccaguuuagaaacauaaggaaauuuaugguauggugauuugaaaaagaaaccucucaucucugcuggcuaugaaucaagagaaucucacaaacaaauuaugaaccauguuuauagucaaaacaugccucaaauggccuauggguaagaggguuuucucuacuuuuuucaaucuguuuuuuuuaucacaucaucuuguagaccuguacaguguguguguguguguguguguguguguguguguguguguguguaucuaauauuuaaaugcaacuuuauugaaaagccugugcccacucuaggaccuauaguauugucuuuuuuccuaagccccaacuccaauacugagcuuaaaucuauauuaacauaaucucuuacuaauugcagcaauaggguuauuuugaaauuuuuuucuaugacguuaaagcaagaacuucaacuucacuuuacaugagaucucuggaaagaacacuuccaguugcuauaaccagaaacauuaaggugcaucucucagugaaacuuccaauacuauccaaaugccuuuucucacuuugagcccuugcauuagcaugaaggaaaaauggaacuccuuuggauccacuuacacguuucucccuggggacucagauguaaccuuaggcauaaggaaaaaaaguuuuaguugaaagcuaggcaucuccacacuauagauuccagcauccuuaagguagccuugaugcaguagcagcagcaggaagccacugcuccagagaccagugccaggguaacaugaugucugugaugcucauuuggcaggauuauugagaugggaugaaugggaagagaucugagucuaacucaagguagacauaaaaggagagugcuggaggaagcauagaauuuuaaaaauaaugagauggagagaagaaauagugccauuaacauaaaaauguaagaaugugagacagcuagaaaaacagcaauggauggaaaaucuaccgagaaauacacgcucucauuuggauagaaggauaacuuaacagggcuaucuuaugggcuguuggcagcacauaggugaccgagaagcagaugguuaacacgggaaggcaggaauccaggauuccacaaugugcuuccaugggugguuccuuugaaucuagcuuugcuuuaccucacuuuccaacugacuucaaggcuucaccuuccaagacaugauaaaugucugaaugugaggucuggauuuccagagagcugccuugccagacuucuuccugggggugacaucauacuccuagaugaccccugagucacagggguagacaggaaguccuaccaggacagaggacaaaacaccacgcccaauuuuacacccaagggagauucauuaucaccuauucaccacaguaaggaaaucagacacugcauaugaaaaugagcuugaugccuuaccaauaacuuggcaacaacucagcauccuucaagccaucggaagagguuucuuucugucuuucgucacuuguggguccagguauuccuguauuuaaaccagacacggaaaauaagugaugcuaugacgauaaaaccaugcuaggguggcuucaguccugccguguguaugugugugugugugugugugugugugugugacccauuguuccauuguuuaaagcaauugcucacaaguuuaaagcaaugaaacagaaucugaaaaucaugcucaaauggcuccgagauacagaugucccuuuaaugaauuuuuaucauuucuuuguuuguuccagauuucacucuuacauguauuguguucuguauauuguguccccugucccaccuccacacagccccucccaccuccugucaguuuccuuugcccccuccccacagacaauuuuacuucuacuccuauguauaugugugagagagagagagauagggaaagagagacagagauuuguguauuuauauaaaauauagaaaccacaaaugauacacaauguuugccaauaguuuuaacaucuagcucuucuaauuuuugagacuuccacacaugaguguuguuacaugauuucugccagcaguccuucuccacccuuaaacuccuccugugucucucgcuccauc

SEQ ID NO: 487 - RNA, 9020 nt, Mus musculus
uggggguggggggggggugcucauaaucacugcacaccugccaggccugccccacuuccgagcagacagaaagccccgggacucuucaaacgggugcagugccaaugugcucagacccagcaucgcuggggagacucugcaacccuccuugcaggcucugcaaagcaagugcuugcugggccucucgggaaguuaauuguucugaugacuacuucacgauggagggaaagguaagccacugcugauugucgacaauuaguucuuuugguuaaaagaugucugagcacaugcugaagggggcacagauggcuacucuaggaagcaggugagccacugcuguguucuagggggaaaggagcgagcgaggucacagcaaagcauaacacagggauuacuccacuugugcuuagccucgugcugugaacucagaaggaccaggcuaagaauggcagcguuccuacccucuuauccagcaagaagcuaacaguccugaguuagucauuagcuaggcaagaguuagcuagcgagauggcucaguggguaagagcacugucuguucucccaaagguccugaguucaaauccaagcaaccacaugguggcucacaaccacaaaaaggacaaacacugcucacaaagaacugaggucuagggucauccugucuggucaccagcugugcagaggcaaacuccccucguacagcagaaugccaggauuccgguggucacacuaacccucacaugagguaacaaugacucuaaacagucacucugcagaaacgacuucagcccuucuguguaaagaaaugaauucuuucugccuccacuuccucacccuccgccugaauacagaaucgguggccgugccugggcuugcugcugcuagcuuuggugaaucugcuaaguccuuucugaagcucgaggcagagggcagagaucacacuggagggucaaucauuccucucacuucaggacacaaguggggcugguccagcuccuuccccucacacagggggauuaagggacaaacuggaguggugaaacucaauacucaaggucgcuugcccccaaggacacaacaucuacccauuugcucucaccuggcuucuucuacacagggaagacgccuacaacagaggugaugcgcugagaagugagaaggcagcugacugccucuccuguuuauacagcauugaaucacaggugggcgggggcaagagaggguaaauggccaaaguacauaauaugcaccuauaaaaauccauacccaucauccuggacaaucaacacacuugugaacaaggacaaugaaaggcagagccgugucaguggauccucugaagaucuuccagagggaaggaccacacggacagacaaacaguccauguacacagacagaccaagagggggugcuuaggugaacacagccuuuguuggccuauucuuccacuccaugcacaagcacuggaaacccagagaccugcccaggaagguuauuuucaauuucuucuuuuguucccauccagcaucaaaaucuaaugcccaagucuaaugcccuagugcaagguggcagaggagaaacugugugccaagcaccucccucccucccgucccuccauccaucucuuccuuuuggagucuuuuuuacucucuuugagaacaauuuaucauucgaucuucauaacuucugacaagacuucaauugcuuuccuggcagucgguucccgaggacgcucccuuccuuaccaguguuccuggaucugccauucaucgcugccuccaggcucccaaacaccuacaacuucacacuccauauaaaaacuaacucacguuuuagaaaagcaaaacacagagauaguacagagauuggaaguugcuuggaguuaggcaggagggaggaauagauggguaaauggggacuuaaggcaggcaaguuccccaguuacuaaaauagugggcaugaccaacgccacugaacacacacagcaccaagagagaugugaacagugggcuucagugccagugggccgcuguagguucacaaagcaaagaauguaccacuggggggcgggggggggguggugccugugggggaaaggaaggggaaucgccuauacuuguucaauuguaacuacuaucuguugcugcaauauguccacaaagaagcguguacacaaacguucacagacacuuucuuguuagacuagaaaaaccccugggcaagagaacaggaucuggggccugaguggacacccaacauucccguugagcuguuucaaaucacuuuggcucaagaguccaucccuagaaaggcgggcucaccuuaagccaugcagaagacacaggccaaauaauuaguccuuggacgagcaacagagggcaaaaagcaggaaaaagcucacuggucagccaagccagucucuugaacucagugagagaccucgucuugaaagacagguagaucaagggaagacacucaacagcaaguuugggccuccccacacauaugcacacgugugcauacaacaccauacacauacauaugacuuaaacaguaaagcucaagaaauucuuguugauaugauuauauucaccuuaacauuugggggaaaaaaaaaggccuucccaagucauagauuucuuaaucuuuucuccauuucauguccuuuuuacuacucagugguuccuucauccuuuugccuccccaaaguaucaaacgggucagaggaggccagaaagagggcagcaauucagcagcuccagaugcuggaaacaggccagacccucggugaguacagagaccugagaggguagggugguaaggagcuuccggugaacgcuccagagagugccagacaggccugcagcugugagcuccuggaauccaucacugcagagacccaggcucugcuuccaguccgcucgcucacacuagaaaggccuaggcuuugggccacacuaaaggagccggacccguggcacaucugagagacagaggucuacugcccaguucauggugucuuuaaacacaggugcuaguucccacuucacgccagguggucugcggagggagggcuuguucuccccaaccacaggaaacagcuaaugcacacuugcacacacacccacacacaccccuguggggguuggggguggggguguacaccacacagaaaaaccucacacacacacacacacacaaaaaaaaaacuccgggguguccaugcccauccccgagccuuuggugaaauagugccaccuacagaacuagagacacaaaaucaagaaacaguagcguguguuucuaauccaucccggacaaccuccuacuuccaccaaggucuacuccuucaggaaagcaaccugauguguucugucaguccacaggacagugagaagcuuaaaacucuccuguaucauuuagggaaaaaacaaaacaaaacaaaacaaaaaaaaaaaaaaaaaaccuggaagacacugcaccacacagcucagugacaaccuaaauagccgcuaucuucuuccuuguaagaaaauuauccuuuaccaaagguacugagaaagcucagcuauuccuuccaaacagagccgaaacuuugcugacauuauuccacaaacaaaaacuccgaaaagcuauauuauacaauacuggggaaacaugggaggcaaaacauugugaccugggguuuggaguggugugggauaugauaccugaagcagagaaagccaaaggaaaaucagggaagcuggacuucguaggaagaguacugaccauggaguagaaaggaauccguggggugggagaaaguauuugcauucauauauugguuggggaaugguauccuaaauacauaaagaaguucuacuacaguaaccaaaaaccugacuauaaaauggacaaagucaagacccaaagucgagacgcaaacaaaaggugcucaacacggaugcccaauggaaaugcaaaucaaaaccacaaggaaauagccuuccacacacgucagaaagacauggggaaaggggaaguuuugcguaagugacggguauaaaaugauugugggcacuguggacagugggaugguaacgccuacaaauauuaaccauuaaauuaccacaugguguauuaauuccacauuaggauaugugcccccagagaacugaaggcagggguugaaauacaugugcacgggcucauguucacagcagcacuguucacgcaacaaccauuccuccauugacagguaagccaaauguggacuguacuuacaaugcagcgcaaccuuccaggauaacgugugcuaagcaaaauaaggccaucaaaaagacagcugcuaccuagucugcacacuucuaguccccacguuucuacccuuuuuguuacuguuguuguuuuucuggaacaggguuucucuguguagcccuggcuguccuggaacucacucuaaaucgggcuggucucgaacucagaaaucugccugccuccucugccuccgccuccgccucuaccucccgaguacugggauuauagguaugugacaucucagccaggccagcauuucuguccuuuucaccggcaucaccugaggcuccugaaaccuucccacggugaaggaggaccaggagcuggggagaaauauaccaggauuaacgaucucgguggcugaaggcaagaggaagccagcccuggaaacgggccaggcaguuggaacagacguugugcaacaucgcuagaaacaucugcaacauuucuagcggaggcccauauucuaggaaauuugcugugguaucugaucaugaagaaaccagaaguggaauuuugugguuacacuacaacccauccuucagagaucagauuuaauuugcucauccaaacacaggcuauucuuccaacuggugauuuguuucaaagaaaagaccuggcuggggucaugaaugucugccagccaggugccagaugaauuugaagcuggcauaaaggacuacagagaucggaaggcaagcagaaaugaacccccuuucuagucucuuauguaggguacaagcaagaccacucucaugaugguguagagccuggaauuugaguuugugauuauagcauacuuuguccuauaggauggucuguagcuguggacccacccugaaaaacagcaccugaaccuacagcuggcugagggagauaucacccuguaaucuuucccucauuuuagaacugauaaucucauuaaugaaauguuuuauuuaaaaaaaaagagccaaccagcguaugaccaguucccacggugaaggagccuggcacgagcugagagcccagcacaggcucccgcgugccaaugagucucccuuuccgagaagauauagagacugcugcucccugggaguacgucugcucagcuccccacuucauuccaguucaaagaggaggacagagucaugugcuagacuaaggcaaaauaauaaaagaacuacucuauccuuuugcauauggggcuuaggggcgugggaacagacugcagagcaaugaaagcaggugugugcccauccuccugggaaggagaagaugaugcggcagagggcgaccaucuccccagucucuugcuguugugcucgccauaucugcugcagagucgggagcuuuacagcacagccaccccagcaacacugcaccuggaaacuuauccccaaacgcuagcagcggcuggcaccgcaccacagagccugccuagcagcuaggcuagcggauaaaugguuagacagauaaauggucuuuuugaccaagaaauuccauuuccaugugguuguucugaggaacaaacaaaacuaauuuugcagggcugaagaaauggcccaguguuuaaaaucacuugcugcucuugcagaggacuggguuugaaucccuuugcccagcacccacacggcaucucacaaccaucuuuuccucuucaggccuucacagguaugagguacauacacgguacacauacauacauacacacaugcauacauacauacauauuuaaauagacagguuuacauaugcacauguugcuuauggaaaggcccaucauugcaugcaagcuaguagugccacuccuggucaccagcaucagaggccauuaaaucuugcugcaugacaaacauacaaaguuaccaaaagccauuugcgaagaauagcugaagugugggagauguucagaauacauuauaaaacuauacgcaauuggcccucuuuaucaugagugcuauugcaacauacuuaagcaauuuuauuuuuuaaacuggaauccaguugggcauggugacacccaacuaaccguccccguucuugggaagcugaggcgaggaaucaugagcucgauuuuagccagagcuagaaaaggagacccuaucugaauaaacagacaguauccacacuaacaugcacagacaucuuucuuguuacuuucugaagaauuaaguacaggugugugugaguaaucuagagaggauuuaaacuaagcuauacaagaagguacacacacccucaacgucuuuaaaagguauuugaacauccaagguauaaagguauuugaagauccaauccagcaccuaaggggagagcucuugagaucagccauuuauggacucugaaggacaaccguauauaaaagccucaauuuugucuaaaagcagaaaucauuuccacagucguauguguauguuaucuacgcacaugcaugaguccaggggcaggagcuggaggagacgcucauuugguaaccugcaagcacgggaaccuaaaguugaucaccagcacauuuuuuaaaaaugagcagugucgggcgccuguaaccucagagcugggcacgcaagcaggcuuagcaucugguuccgacggcaucugcgcuuaccggacagaagcccuuggauugcaaagaauguucucuucucuaugcaauacucugcaguccccgacuuacgcucgcucaugcacucacagcgaagggaagggcuggcacagcuuguuuuccaauacacaacacagccuguuccucccacgcacucccagccccuccgcugccgcuguccuguucuacguccacucaaauacugaaauaauaaugaucugggcuccuaggccuaaggaugccagagcucuucaaggacagacacgguaccgguaccggcuauucagcaccuuuucuuucaccggcaggcccacauuuccuaugcuccccuccaggauggggccgcuuagggccaggcaguaaaaaugaccucugcagaagcaaaugccugacugauugacuucucuaugcaggaaaauugcauucuuuguuuccagauucaaaucuaauaggacucuuuuccggauuucacgggcuucgagaaaagaguugcacauucacuggugucuccauguccagcaguagaaacagugaggguuuaagugcccuacuaggucauucaauguggacaaagacuaucaaacugaaacuagagccacgagucacuccggaguaagagucccugccaccugacaggcaucagaaacagcaaccuaccuguguggcuaaggaagucauagaugcuggucuuggguggcugccacauuccacucacuaacuguccuuaagaaaacaagaugugagcagggcgugguggcacacgccuuuaaucccgagugcgcacuugagaggcagaagcaggcggauuucugaguucgaggccagccuugucuacaaagugaguuccaggacagccagggcuauacaaagaaucccacaccccccccacaaaaaaaaaaaaaaaaaaaaaaaaaaaaaaaaaacccaagaugugccaggugugguggcacacaucuuuauuuccagugaucuuagaugcagaggcaagccgaucucugugaguucaaggccagcuuggucuauaggguuccaggacagccuggacuauauacaaaaaaaccuuaucagggagugagggagggggggacugggcagacuuccugucauuucugugaaaugaccaagucuuccugagucuuucuaccuuuaaggagacaguugggguagugaagcacuuguuauagagaaacuagaccugcacuugauguccagaacccaucuaagaagccaagcauggugacuuuauaaucccaguggugggcaggcagaaacaggaucccugcagcucagcggccggcuagcagagccagaccaacaagcccugggccaacuaaagacccugucccaaagaaaaacaaggccaguuuguccucuggccggaugucugucugucugucucucucucucucucucucucucucucucucucacacacacacacacacacacacacacacacacacacacagggacacacggacacccuagugacccccagguucuaggcaaggguuuuaccacagggccuccagugcuucccugaccuccuauguuaucauuaagacugaguuagcuagccccauugggcauugucugcauuaacaguguccugguccagaugccuagccagaacaggauuagugcccagaguuguacugcccgggacuagauaaucaaaaggaggagaaagaugagauuaagagaccaugcagccggguguggugucagacaccugaaaucucagcacuugggaaggccuggcuguacuaaaagccaugcuaggcuaggauaccaagaccccaccacgaaagaucaaauucucaagaaaagacaugaacaaagaggcugguccaagcuaaagcagguggcuaauguuuucagucaagcauuuggugagguuuccacacaugggacuugcuuuuuucaauaagcuguuuauucaaauguuaaucagaaaagauuaaaaaauguugagggccuccaucagagccccuuugaucucaaggagggucuacuaauuaucaucgggccagccaaaagugaugccauaucggggcugaaguuaugaagagauggaaggauuuugcuggagacuggacaugaccaugagaaaacaacaaccacugcaacaaacccg

SEQ ID NO: 488 - RNA, 9020 nt, Mus musculus
cggguuuguugcagugguuguuguuuucucauggucauguccagucuccagcaaaauccuuccaucucuucauaacuucagccccgauauggcaucacuuuuggcuggcccgaugauaauuaguagacccuccuugagaucaaaggggcucugauggaggcccucaacauuuuuuaaucuuuucugauuaacauuugaauaaacagcuuauugaaaaaagcaagucccauguguggaaaccucaccaaaugcuugacugaaaacauuagccaccugcuuuagcuuggaccagccucuuuguucaugucuuuucuugagaauuugaucuuucgugguggggucuugguauccuagccuagcauggcuuuuaguacagccaggccuucccaagugcugagauuucaggugucugacaccacacccggcugcauggucucuuaaucucaucuuucuccuccuuuugauuaucuagucccgggcaguacaacucugggcacuaauccuguucuggcuaggcaucuggaccaggacacuguuaaugcagacaaugcccaauggggcuagcuaacucagucuuaaugauaacauaggaggucagggaagcacuggaggcccugugguaaaacccuugccuagaaccugggggucacuaggguguccgugugucccugugugugugugugugugugugugugugugugugugugugagagagagagagagagagagagagagagagagacagacagacagacauccggccagaggacaaacuggccuuguuuuucuuugggacagggucuuuaguuggcccagggcuuguuggucuggcucugcuagccggccgcugagcugcagggauccuguuucugccugcccaccacugggauuauaaagucaccaugcuuggcuucuuagauggguucuggacaucaagugcaggucuaguuucucuauaacaagugcuucacuaccccaacugucuccuuaaagguagaaagacucaggaagacuuggucauuucacagaaaugacaggaagucugcccagucccccccucccucacucccugauaagguuuuuuuguauauaguccaggcuguccuggaacccuauagaccaagcuggccuugaacucacagagaucggcuugccucugcaucuaagaucacuggaaauaaagaugugugccaccacaccuggcacaucuuggguuuuuuuuuuuuuuuuuuuuuuuuuuuuuuuuuuguggggggggugugggauucuuuguauagcccuggcuguccuggaacucacuuuguagacaaggcuggccucgaacucagaaauccgccugcuucugccucucaagugcgcacucgggauuaaaggcgugugccaccacgcccugcucacaucuuguuuucuuaaggacaguuagugaguggaauguggcagccacccaagaccagcaucuaugacuuccuuagccacacagguagguugcuguuucugaugccugucagguggcagggacucuuacuccggagugacucguggcucuaguuucaguuugauagucuuuguccacauugaaugaccuaguagggcacuuaaacccucacuguuucuacugcuggacauggagacaccagugaaugugcaacucuuuucucgaagcccgugaaauccggaaaagaguccuauuagauuugaaucuggaaacaaagaaugcaauuuuccugcauagagaagucaaucagucaggcauuugcuucugcagaggucauuuuuacugccuggcccuaagcggccccauccuggaggggagcauaggaaaugugggccugccggugaaagaaaaggugcugaauagccgguaccgguaccgugucuguccuugaagagcucuggcauccuuaggccuaggagcccagaucauuauuauuucaguauuugaguggacguagaacaggacagcggcagcggaggggcugggagugcgugggaggaacaggcuguguuguguauuggaaaacaagcugugccagcccuucccuucgcugugagugcaugagcgagcguaagucggggacugcagaguauugcauagagaagagaacauucuuugcaauccaagggcuucuguccgguaagcgcagaugccgucggaaccagaugcuaagccugcuugcgugcccagcucugagguuacaggcgcccgacacugcucauuuuuaaaaaaugugcuggugaucaacuuuagguucccgugcuugcagguuaccaaaugagcgucuccuccagcuccugccccuggacucaugcaugugcguagauaacauacacauacgacuguggaaaugauuucugcuuuuagacaaaauugaggcuuuuauauacgguuguccuucagaguccauaaauggcugaucucaagagcucuccccuuaggugcuggauuggaucuucaaauaccuuuauaccuuggauguucaaauaccuuuuaaagacguugaggguguguguaccuucuuguauagcuuaguuuaaauccucucuagauuacucacacacaccuguacuuaauucuucagaaaguaacaagaaagaugucugugcauguuaguguggauacugucuguuuauucagauagggucuccuuuucuagcucuggcuaaaaucgagcucaugauuccucgccucagcuucccaagaacggggacgguuaguugggugucaccaugcccaacuggauuccaguuuaaaaaauaaaauugcuuaaguauguugcaauagcacucaugauaaagagggccaauugcguauaguuuuauaauguauucugaacaucucccacacuucagcuauucuucgcaaauggcuuuugguaacuuuguauguuugucaugcagcaagauuuaauggccucugaugcuggugaccaggaguggcacuacuagcuugcaugcaaugaugggccuuuccauaagcaacaugugcauauguaaaccugucuauuuaaauauguauguauguaugcauguguguauguauguauguguaccguguauguaccucauaccugugaaggccugaagaggaaaagaugguugugagaugccgugugggugcugggcaaagggauucaaacccaguccucugcaagagcagcaagugauuuuaaacacugggccauuucuucagcccugcaaaauuaguuuuguuuguuccucagaacaaccacauggaaauggaauuucuuggucaaaaagaccauuuaucugucuaaccauuuauccgcuagccuagcugcuaggcaggcucuguggugcggugccagccgcugcuagcguuuggggauaaguuuccaggugcaguguugcugggguggcugugcuguaaagcucccgacucugcagcagauauggcgagcacaacagcaagagacuggggagauggucgcccucugccgcaucaucuucuccuucccaggaggaugggcacacaccugcuuucauugcucugcagucuguucccacgccccuaagccccauaugcaaaaggauagaguaguucuuuuauuauuuugccuuagucuagcacaugacucuguccuccucuuugaacuggaaugaaguggggagcugagcagacguacucccagggagcagcagucucuauaucuucucggaaagggagacucauuggcacgcgggagccugugcugggcucucagcucgugccaggcuccuucaccgugggaacuggucauacgcugguuggcucuuuuuuuuuaaauaaaacauuucauuaaugagauuaucaguucuaaaaugagggaaagauuacagggugauaucucccucagccagcuguagguucaggugcuguuuuucaggguggguccacagcuacagaccauccuauaggacaaaguaugcuauaaucacaaacucaaauuccaggcucuacaccaucaugagaguggucuugcuuguacccuacauaagagacuagaaaggggguucauuucugcuugccuuccgaucucuguaguccuuuaugccagcuucaaauucaucuggcaccuggcuggcagacauucaugaccccagccaggucuuuucuuugaaacaaaucaccaguuggaagaauagccuguguuuggaugagcaaauuaaaucugaucucugaaggauggguuguaguguaaccacaaaauuccacuucugguuucuucaugaucagauaccacagcaaauuuccuagaauaugggccuccgcuagaaauguugcagauguuucuagcgauguugcacaacgucuguuccaacugccuggcccguuuccagggcuggcuuccucuugccuucagccaccgagaucguuaauccugguauauuucuccccagcuccugguccuccuucaccgugggaagguuucaggagccucaggugaugccggugaaaaggacagaaaugcuggccuggcugagaugucacauaccuauaaucccaguacucgggagguagaggcggaggcggaggcagaggaggcaggcagauuucugaguucgagaccagcccgauuuagagugaguuccaggacagccagggcuacacagagaaacccuguuccagaaaaacaacaacaguaacaaaaaggguagaaacguggggacuagaagugugcagacuagguagcagcugucuuuuugauggccuuauuuugcuuagcacacguuauccuggaagguugcgcugcauuguaaguacaguccacauuuggcuuaccugucaauggaggaaugguuguugcgugaacagugcugcugugaacaugagcccgugcacauguauuucaaccccugccuucaguucucugggggcacauauccuaauguggaauuaauacaccaugugguaauuuaaugguuaauauuuguaggcguuaccaucccacuguccacagugcccacaaucauuuuauacccgucacuuacgcaaaacuuccccuuuccccaugucuuucugacguguguggaaggcuauuuccuugugguuuugauuugcauuuccauugggcauccguguugagcaccuuuuguuugcgucucgacuuugggucuugacuuuguccauuuuauagucagguuuuugguuacuguaguagaacuucuuuauguauuuaggauaccauuccccaaccaauauaugaaugcaaauacuuucucccaccccacggauuccuuucuacuccauggucaguacucuuccuacgaaguccagcuucccugauuuuccuuuggcuuucucugcuucagguaucauaucccacaccacuccaaaccccaggucacaauguuuugccucccauguuuccccaguauuguauaauauagcuuuucggaguuuuuguuuguggaauaaugucagcaaaguuucggcucuguuuggaaggaauagcugagcuuucucaguaccuuugguaaaggauaauuuucuuacaaggaagaagauagcggcuauuuagguugucacugagcuguguggugcagugucuuccagguuuuuuuuuuuuuuuuuuguuuuguuuuguuuuguuuuuucccuaaaugauacaggagaguuuuaagcuucucacuguccuguggacugacagaacacaucagguugcuuuccugaaggaguagaccuugguggaaguaggagguuguccgggauggauuagaaacacacgcuacuguuucuugauuuugugucucuaguucuguagguggcacuauuucaccaaaggcucggggaugggcauggacaccccggaguuuuuuuuuugugugugugugugugugugagguuuuucugugugguguacacccccacccccaacccccacaggggugugugugggugugugugcaagugugcauuagcuguuuccugugguuggggagaacaagcccucccuccgcagaccaccuggcgugaagugggaacuagcaccuguguuuaaagacaccaugaacugggcaguagaccucugucucucagaugugccacggguccggcuccuuuaguguggcccaaagccuaggccuuucuagugugagcgagcggacuggaagcagagccugggucucugcagugauggauuccaggagcucacagcugcaggccugucuggcacucucuggagcguucaccggaagcuccuuaccacccuacccucucaggucucuguacucaccgagggucuggccuguuuccagcaucuggagcugcugaauugcugcccucuuucuggccuccucugacccguuugauacuuuggggaggcaaaaggaugaaggaaccacugaguaguaaaaaggacaugaaauggagaaaagauuaagaaaucuaugacuugggaaggccuuuuuuuuucccccaaauguuaaggugaauauaaucauaucaacaagaauuucuugagcuuuacuguuuaagucauauguauguguaugguguuguaugcacacgugugcauauguguggggaggcccaaacuugcuguugagugucuucccuugaucuaccugucuuucaagacgaggucucucacugaguucaagagacuggcuuggcugaccagugagcuuuuuccugcuuuuugcccucuguugcucguccaaggacuaauuauuuggccugugucuucugcauggcuuaaggugagcccgccuuucuagggauggacucuugagccaaagugauuugaaacagcucaacgggaauguuggguguccacucaggccccagauccuguucucuugcccagggguuuuucuagucuaacaagaaagugucugugaacguuuguguacacgcuucuuuguggacauauugcagcaacagauaguaguuacaauugaacaaguauaggcgauuccccuuccuuucccccacaggcaccaccccccccccgccccccagugguacauucuuugcuuugugaaccuacagcggcccacuggcacugaagcccacuguucacaucucucuuggugcuguguguguucaguggcguuggucaugcccacuauuuuaguaacuggggaacuugccugccuuaaguccccauuuacccaucuauuccucccuccugccuaacuccaagcaacuuccaaucucuguacuaucucuguguuuugcuuuucuaaaacgugaguuaguuuuuauauggagugugaaguuguagguguuugggagccuggaggcagcgaugaauggcagauccaggaacacugguaaggaagggagcguccucgggaaccgacugccaggaaagcaauugaagucuugucagaaguuaugaagaucgaaugauaaauuguucucaaagagaguaaaaaagacuccaaaaggaagagauggauggagggacgggagggagggaggugcuuggcacacaguuucuccucugccaccuugcacuagggcauuagacuugggcauuagauuuugaugcuggaugggaacaaaagaagaaauugaaaauaaccuuccugggcaggucucuggguuuccagugcuugugcauggaguggaagaauaggccaacaaaggcuguguucaccuaagcacccccucuuggucugucuguguacauggacuguuugucuguccgugugguccuucccucuggaagaucuucagaggauccacugacacggcucugccuuucauuguccuuguucacaaguguguugauuguccaggaugauggguauggauuuuuauaggugcauauuauguacuuuggccauuuacccucucuugcccccgcccaccugugauucaaugcuguauaaacaggagaggcagucagcugccuucucacuucucagcgcaucaccucuguuguaggcgucuucccuguguagaagaagccaggugagagcaaauggguagauguuguguccuugggggcaagcgaccuugaguauugaguuucaccacuccaguuugucccuuaaucccccugugugaggggaaggagcuggaccagccccacuuguguccugaagugagaggaaugauugacccuccagugugaucucugcccucugccucgagcuucagaaaggacuuagcagauucaccaaagcuagcagcagcaagcccaggcacggccaccgauucuguauucaggcggagggugaggaaguggaggcagaaagaauucauuucuuuacacagaagggcugaagucguuucugcagagugacuguuuagagucauuguuaccucaugugaggguuagugugaccaccggaauccuggcauucugcuguacgaggggaguuugccucugcacagcuggugaccagacaggaugacccuagaccucaguucuuugugagcaguguuuguccuuuuugugguugugagccaccaugugguugcuuggauuugaacucaggaccuuugggagaacagacagugcucuuacccacugagccaucucgcuagcuaacucuugccuagcuaaugacuaacucaggacuguuagcuucuugcuggauaagaggguaggaacgcugccauucuuagccugguccuucugaguucacagcacgaggcuaagcacaaguggaguaaucccuguguuaugcuuugcugugaccucgcucgcuccuuucccccuagaacacagcaguggcucaccugcuuccuagaguagccaucugugcccccuucagcaugugcucagacaucuuuuaaccaaaagaacuaauugucgacaaucagcaguggcuuaccuuucccuccaucgugaaguagucaucagaacaauuaacuucccgagaggcccagcaagcacuugcuuugcagagccugcaaggaggguugcagagucuccccagcgaugcugggucugagcacauuggcacugcacccguuugaagagucccggggcuuucugucugcucggaaguggggcaggccuggcaggugugcagugauuaugagcaccccccccccaccccca

SEQ ID NO: 489 - RNA, 25715 nt, Mus musculus
cuuccaauaaaagcccggccgcagcaagcgaguugugcagcccuucuccuccaacggcguccccggcaucauaaaggcugguuuaaccagcgcccgaggacuccucgacucggcucgcccagcccaggaccggggcgagcccccagacccugacgcuccgcacgcgguggccuaacuuuucggccacggaggcggggaugcgggugaaguccagccaccgugugacaggguucuagugugagguaggcgaucgggcucggagagcagguaacgcacugccgaggucgcaacgccgccgccaccacaccgccauccuccgaccgaccuggcuuuccaacucucgcgagaccgggccuggcgcgcgccuucggcccccgagacuugcgcguugccgcucucucccgacuauggcggccagacggcgggagugaagccuguaguuccgggucggcgccccggaagcggaaguguagacucggggcugucaaaguuguagcgcuccucgagggucggucccgccacgucucuucccggucucucuggcucuggagugcuuuccccccgcggagggugggagcgcggggacagacgggcgagaugagcaccauguuugcagacacgcugcucaucgucuuuaucuccgugugcaccgcgcugcucgccgagggugagggcggcuguuuccuuggacguuugauuaaucccaggguggaagggcacuggggucccucgcaccccaugagcaaagaucgggagccucacucccugcggccugcgugguccguugcaagaaaucccgggcucaucccccuauagaagcaggagaguaguguggagucauacguccugauuuucuuuacguauuuguggauacacugaaaaaaacaaaacaaaacauggguugaucugacuuugaaaaaaguuacugauaaguauagagcaaaaugucgaaauccuuuugucuccaauacuaacaauuaaagaugguuuguugugauuuccauuuauuucucauuagcauguugcuuuuacuguuuaggcauaaccuggguccugguuuacaggacagacaaauacaagagauugaaggcagaaguggaaaaacaaaguaaaaaaugugaguaugguaagacgguggacgguucaacacgggaaguucaaugggugcauguucacaguaacuaagagaggaguauaccaagaauacuacaagccaguguuccuuguuagggcaacugaaaucucaacacucaggagauggacaugauugugaguucgcagcuagugugggcuacauagggagauucauguuacaaacaaaaccauacucuaacuugguaaagauagaaaucaaagaccuuugugcagcaucuuuaauaaagcuaaaaggaaucugggugugguagagcuccagauagggcaggccuggucuacauagugcauuccaggcuggaucuacuuccugucgagaccuugccuaaaacggggggggggggggggggggcggggagcuaaaggggaaaggggucauggcagacacacacacacacacacacagagucuucauucuaaagaagagguccuguucuguugugagagacuauggaagaucucaugguacagauggacccagugccuuguggauuaguuagaauguagauagaagauaaaagagggagaggaaauucuagggaaaggaaaaaucacguaaacauggagauuugaaugugugagcuguguuuggagaauaagucacugugacuagugucagugggagugguacccuuuaaaguuuagccaaguuucagucgggugagaaagcugaaaaaugauugaaaaaaugauuaacauggguaaaauuugugacuuuugaaggaaaguuaaaauuuagcagggcacagcugaucauauaaauaaggccuuagguagcccaggcaggccucacauuucugaugccucacccuuagcuccccaguuacugggacuuugaaugguucucuaaaagcacaauugguauccaguguugguugguuguuuugcuuuuaugaggugggucucauuuagcccugcuuggcuuugaacucacuagcugaagaugaccuugagcugauucuccuaccuuccaagagaugaacuauagaaauucagaacccuaaaccauaccuaacuuggcuucuaagaguuucuacagcuaccuuuauuccuauauccuucuuauuuccuuauaucuuuauaaguuuugugaguguccguuuuuuguuuguuuguuuguuuguucuguuuuguuuuuaauuuuagacagggucuuauauaggccaggcuagccuauaaaagcuaacuccuuagcugaguuugaccuugaacuuaugaucuccuguuucugcucacuaagugcuggagucacaguuauucaccaucaagucaguuuguggggugcaggggacugcacucagggcuuuguguaugguaagcaagcacucugccaguugagcuguacuccucagcuccccuugcauucuuccccccuaaauuauccuaugugaggggcucagagcagagagcugugauagaguucgugccugccaugcccaaagccuggaguucacccucagcagugaaaaauaugucauuuggugcacauaaaaaccauugugguugguuauaaaaauguuuccaccuuaugggacaggagauugagacccaggaaguuaaugauagacuuacaucacaagaaaacaaagaacuggagacuaaacucagacuuuuguuuuugagccuagacuuugaaaauuacaguucgccauccuuuauucaaaguugauaguguuggcucgccauauuuaaaccaaauucauucuauuuaccuucacaaacaugaccuuccaggauuuucuuaccuuggugauuuuaugcuuuuagcagggaaauccgaaaaucuuuuuuauuuuuuauuuuuauuuuauauauauauauauauauauauauauauuuuuuuuuuuuuugagacaguguuucucuguauagccguggcuguccuagaacucacuuuguagaccaggcuggccucgaacucagaaacccgccugccucugccucccgagugcugggauuaaaggcgugugccaacaucauccggcuuauuuuuauuuauuuauuuacuuauuuauuuuauuauauguaaguacacuguggcugucuucagacacuccagaagagggugucagaucuuguuacagaugguugugagccuccaugugauugcugggaaaugaacuuaggaucuuuggaagaguaguugaugcucuuaaucgcuaagccaucucuccagcccccaaaaucuuuuuuaaaagagauuuuuaaauaugcuugcuuucuuuguugcugugucuacuugcuagcuuggacgugcugcuaggacaugguucuuugugcucacguauguaccugugugacugggaagugacuggugcaugcuaaacaggaacauugucuuggguuuggguuuuuuguuuuguucugcuuuagguuuuuuggccuugacugacugagaacuugcuguguaacucgggcugcccuugaccucccagcugaucuucuuucuaguuuagggguuacagguauaaggcacgcccccuuuuucaagcacuuguuauuccugccuguaguucauuaucaaagccuguaccuguuguccucuugaaugguuuuagaucuuuuuacaucuuccauaccugccaaacccaccuauucuaaaguagcauguuucguugacucuauuaaagcgccucaugugucugcccuucaguuauucagauuugcuuuguaggguacauguagcauucuuuuucagaacauaaaucugguuaugcuacuugucuccuuuauauggcuuuuaggauaaaagaccugugugcuggguggaauggcacaugucugugauucuaguauucaggacacugaaauagggaguccucaguuugaggcuagucugagcuacauagcuaaacccaacuucaagaaagcaauggacagacuuagugcaugccuuaaaugucugagguaaaggcaggaguaucucugaguuccaggccagucuggucuauauaacaaguuucaggccagucagagcugcauagagagaccaugucucaaacaaacaaacaaacaaacaaacaaaagggaggaggagcagcagcugccaggugugguggggcucuaguuucuggcagccugguccacauagugaguuaaggacagccaaagguuacauagugaugagaacauguagaaaggaaggaaggaaggaauguggguagauauggcuuuagcccacaagagauagagcugcaguuaagaaugcuuucuguucuuguaacacuacccaguacccacaccauguggcucauggcugccuguaauuccaguuccagggauccauuuuccucuuuuggcccugugagcaucuguacagaagacauggugcauauacagacaagcagacgcgcgcgcgcacacacacacacacacacacacacacacacacacacauuuuuuaaaaaaccuuuuuuaaaaagauaugacccaguaaaacucaggaaaauaagauucuuccuucccuucuuuucuaacauuguuuguuugucuguuuguuuguuuuuguggguuuuaagguagcagcuuacuauauacuucaggcuugcuucuaaguugcagucuuccugccucagcuucggcuagaguggcauuacaaggguguaacuaccaugucuggcuuuccugaagccacaucuuaucucauauucuccugugcucuuugccugguuuccuagggcccuuuucuaacuucugacuggggcuuggauuuuccuacuguugauucugaguacuugcuauuccuuucaugguaaacauuuucccuuuguauuuuuuaguaaacucuuaggcuuauuuagucuccagaucuuuguacuuucugauuuauccauaggccucuccuuggagcgcuuucugcaguugugugaucaccuccuccuaucucccccuucucuggguuucucuguguagcccuggcuguccuggaacuggcccugugguccaggcuggccuugaacucauauuguccuuccucugccuccugagugcugcgguuaaaggugugcacugccaccaucuggcuacaguugcaaucuuuucguaccugucaacuaugguuauuaggauuagggcuuuugcucuacuccaguguaaugucugugaaggcaaaguggugucucuagcccuuaacaugauccuagauagcuguaacagugugcuuaauaggcuaaaggauaaagugucucuguagcacggcauguuucugagaaauuuuguuaugaucacauacuaguuagcauguacugguaucugaauagaaaguucuuuauguaauauauauguguauguauauauauauauauauauauauauauaauuuacuaucauuuuuacuucaaugaguauucucauaucuuagccauggauuuuuuuccuuaagauuuuuaggcuuuucauuagugucuauaauuuuucuguuuguuuguuuguuuguuuguuuguuuuuugucuuucgagacaggguuucucuguauagcccuggcuguccuggaacuuacaggucuuuguagaccaggcuggccucgaacucagaaauccgccugccucugccuccugagugcugggauuaaaggcgugcaccaccacgcccagcagugucuauaauuuuuacaugaaguuuauuuacauuuuggaagcaaaugaaaaguuuacuuuuaauauauaauuuuauguguuuauguuuacaguagagaagaagaaggaaacuauaacagagucagcuggucgacaacagaagaagaagauagguaagccaguaaccuaaauaaaacuugaguugugugugugugugcaugucuguguauguauauaugugugugcgcgugugucuauguauguguauguauauauguguguaugugugcgugugucuauguauguguauauauauguguguaugugugcaugucuguguguguauauaugugugugcgcgugugucuauguaugugugucuauauauauauauauauauacauauauauauauguauauauauauauauauauauauauguauguauguauguauaugugugugugucuguuuuguuuuguuucuugagacaguguuucucuguguagcuuugacuauguaggaauucauguuguaggccaagcuggccucaaacuaacagagauccucuugccccuacuuccugagugcuggaauuaaaggcauguaucaccaccacccagguuuuuaaauaauauuugcaauuaaauaguuuugucacuuuaccauguuccuuucuccagcuccucccucaaaccuucccauaccuccuuccaucuuaaaucuuucauucauucuuucauuacuguuguuaaauacauguaugaauaugcaugcauaaguauauaaauacuaucugguucuucucuuuuuguuguuuuguguauguuguuucaaagcugaccacuuuguaucgaauaccaauaagagugcucauccccaagcaaagcuaauuuccccccucucugcagucauuaguuucauaaaguucuuuaucugggggugggacccugugaaaucuugucccuuccauguuauuguguugaugcuauugucuauugauuugccauuguucuggucuuguuuauguagccauuucuaggagagucaguuucaauaucagacuuccugguauucuggcuuguacaauucuuuugcucccucuuuugugauguucccugagcagggaugcaggagcuguggaguagauguauccacuggggcuggguucugcacagucuguuguuuucugcuuuguguugaguugugauuuucugugauggucuccauuugguggccaagagaagcuuuuuuaaugaggaugguagcuacacuuaucuguaggauaaggauaggauuuagaguacacaggaguuauguggcauaccaaaguggagguaguagauugguuuucuuuuuuucaagcuuuuaacuugugagccuccauguggaugcugggaauugaauccacauccacuagaagagcagccaguuuucuuaacugcggggccaucucucuccccccaguagucuuuccaagaucuaugaccucacuaguuccaggaaguuggcuagcuuucuaagcaugacuucccucuuguuuagugggccgugaguccaauuagacaucuguugguucccaccgaucuguaagugccacucauagugauuuuuaaacugaaauauuuuggcauucuucuauauuuaaaacauuguuuuagggggcuggugagauggcucagcagguaagagcacccgacugcucuuccgaagguccagaguucaaaucccagcaaccacaugguggcucacaaccauccguaacaagaccugacucccucuucuggugugucugaagacagcuacaguguacuuauauauaauaauaaauaaaucuuuaaaaaaaaaacaaaaaaaaaaaaaacaaaaaaaaacauuguuuuagggcuggugagauggcacaguggguaagagcacccgacugcucuucugaagguccggaguucaaaucccagcaaccacaugguggcucacaaccauccguaacaagaucugacgcccucuucuggagugucugaagacagcuacaguguacuuacauauaaauaaauaaaucuuuaaaaaaaaaacaaaaaaaaaacaaaaaaaaaccauuguuuuaguauggaguaagcaacagcccacauauucacuucgucuuauugagugauauugaaacaaaaugcuauuguaaucuccagacagugauaauuuauuaaauaauuaagcugugcucaguauuuuugaacuaaccaguuucuucuuuucagagagacaagaagagaaauuaaagaacaacaauagagaccugucaaugguaagaguccagaguguaacugauggcaaaccacauaaacuacuuuuucuucagccaaaguccuauuugcaucaaauacauugcauuuaaguucuuaaaauguauuaccuaucagggcuauuaauaauaaucauaggcauuauuggacuaaauagaaucaaauaugcugccacauuuaaauuucauuuuaaaguuggcauggugguauaugccuuuaaucucaguacucagaagcagaagcaagucuuuagaugaaucuuuagaguuccuggccagccagggcuacccagaaagaccuugucucaagaaaaccaacaaacaacacuccccuccccaccccccacccccgaaaaaaaaccaaaaaacuuuauuuuaauauuuuguuuauaaaggcugcuuuggagguuauaauuugucuucuucagaaaugccuugcauuuucuucuuugauacugauauauucaaguuuuuaugugcaguaaggggcauaaacauuauuagagauaaaauaccgauggaaaaaacccaucccagaguaacauuuacaguuguuuccgucacuuacaauacaguagcugccaugauacuccaugucuugcuuaagguuuuuaagguuuuccugguuuuguuuguuugguuuguuuuugguuugaaucaggguuucuuugcuuagccuugcuuguccuggaacuugaucuguagaccaggcuagccuugaacuuauagagaucccccugccucugccucugagguggcucugccugagugcugggauuaaaggcaugagccacacugccuugcaaguuuucuuuuuuuaaaaguuauguauuuuauguaaguacacugucacugucuucagacauaucagaagagggcaucagauuccauuccaguuguugugagccaccaugugguugcugggaauugaacucaugaccuugagaagagcagucagugcucuuaaccacugagccaucucuccaguuccaaguuuuccucuuuuuuaaaaaaacuauuauuauuuauuuuuauauguauagacauuuugccagcaugugugucuccacgugccuggugcccgcagaagucagaaauagauccccgaagacuggaguuauagaugauugucagcuauuauucgagugcuaggaauugaacccaggucaucuagaaggagcagcuagugagugcucuugaccacugagcccccuuaacuccaguccccuuuuuauuuuaaaacaaaaccaaucguuuuuccuuguuucauguugaaucuugguuuauggcauuuguguaauuccaggauagaggucggcacacuggagauagcucuguaggcaucacauucauguaaagauaguggguucccagcccuuuuguucccucuuugacgcagggcuauuuuuucuaguucuguguaguuagcauggggcaucucaacuuuccaugaguuucuucacuugcuggagaucuuggcugugguucuuuauuugcuaaaaauucuuuucccgaaugacucuaauuuacugguaauuuuuuuuuucugaggcagaguccuaguauauacccugacugcccuggaacuugcuacguggacuagguugccucaaacgauuagcuugccucuucauccuuagugcugggaucaaaggcauguaguaccacauacagggagauuuuuuuuuaaagauuuauuuuauguauauaaguauacugcugcugucuucagacacaccagaagaggguguuggacugcauuacagaugguugugagccaccaugugguugcugggaauugaacucagguccccuagaagagcagucagugcucuuaaccacugagcuaucucucuagccccagggagauuuuuuuuuaaagauuuuauuuauuuauuauauguaagugcacuguagcugucuucagacaccacagaagagggcaucagaucucauuauggaugguugugagccaccaugugguugcuggaauuugaacucagggccuucggaagggcagucagugcucuuaaccgcugagccaucucuccagcccaccaggaagauauuuuaaaaagcgaauuuucucaccuuuagcacaauguuuaucauguucacuauuuggaaauuauaaaaguaaaaaucaccaaguguccagagauuguguuugaaaacuguacaucuuuauacucguuuuuuuuuuaaaucuauuuaugcauuuaugggauguggaauuuaauaagaauuuaguuguaauuaacagguuaccuaacucacagugccuaccauguugcuuucuuucuguugcucaugaaguuaagagguuggcagcccuaagcugcugucauagcuuagcaggcccucaaagacucuggccucagucacaauucaccugacugguugaugcuuucccugaggcauucuguucuucauuccagucacaccaccucaccccuugaaagaagccuaagaagauucaagauuguccuuuuaaaaagggcuuuucagagccagauauugcgguagaccacgccuaugauccagcuacacauuagacaggcaggcagauucagugaguccaggaauuccagacuccaccauaauaaugagacagauaucccagucaacacuuguuacuuaugauugguuggccagaaucuggccucagagcuaucccaguuuauuacaaguaacaaggagaggaggaauuggagacagaaggugaguuagauaacaaggagcuuuuugcaaaagagaacuuuuucuuuguuuguuguuuguuuuugagacagagacucacuguguagcccuggcugcacaucucaccucauccugucagaucagccugccaccauacccagcucuacggaaaaguuuuuaagaaaaauuacaugaauugaauuacuucaauuuuuguagcaugauacacacacacuccuuuagugugaacugaccauuuuuugcuuuccuuauagguacggaugaaauccauguucgcgauuggcuuuuguuuuacugccuuaaugggaauguuuaauuccaugugaguaaccuuuuuuauaugcuucugccuaauaaauguucuguuuguaugcauaugagcauaacauuuguaguaauauuguauuugacagaauuucaaaguaauccacagccaaauccuuucucaaaaauaacgaaagaaagccaagcauuggcggcacaugggaggcagaggcaggcagaucucugugaguuccagggccagccugaucuacauagugagcuccaggacagccaaggcuacauacacagagaaacccugucuugaacuucuacccucuccccccaaaauauugaagaaagaaaacaaaauuucaaauguauacauuauucacaugucaagaaaaauguuuucauuguauauauuuauuguauguguuauaaguauacuuuguacauugagcaagauuuucccauacugccugcccuuuuaaaauuggcuuauauucacuaugcaaauguacaguacugguguauggugugcuuugagcauauccucacugucauguaucuuucauaaucauuugagaguaugcaggggagagagagcgcaagagcucaagugcauauguuacaggauauuugaucacauugugaacccugagauugugaacuguaaaaaccugcucugguugugcuauggcucagccuuugauccuagagcuuucuguuuacuguaaacaaguacuguacuguggccugucucuagcacacggcuuuaacuguaaacaaguacuguacuguggccugucucgagcacacagcuuuaacuguaaacaaauacuguacuguggccugucucuagcacacagcuuuaacuguaaacaaguacuguacuguggccugucucgagcacacagcuuuaacuguaaacaaauacuguacuguggccugucucuagcacacagcuuuaacuguaaacaaguacuguacuguggccugucucgagcacacagcuuuaacuguaaacaaauacuguacuguggccugucucuagcacacagcuuuaacuguaaacaaguacuguacuguggccugucucgagcacacagcuuuaacuguaaacaaguacuguacuguggccugucucuagcacacagcuuuaacuguaaacaaguacuguacuguggccugucucuagcacacagcuuuaacccaagagcuaaagaaagucaacacaggucauguggccgagcaagcaaccagcuggcagggagugaacagaaguggacagaaaggagggccuuuauguugaaagguauuuaagacaguguggagaaguagacuuugguggaguaggagggucagcugggugcuuucucugccucucugagcuagcagguuuucaucccagcucuggcuccugaaucuuuucugguaaaaucaaacggcugggauuuuuauuuuuaaaacaacaugcuugaguggaggucagaggacaacuggcuggaaucuguucccuccuuccaucagauaguuccuaggauuuugaacucgguugucagacaugauggcaaaugacuuuacccucugagccaucucaccauccuucuuuaaaaaauaacuucaauauaauuauguaaauaagaauuucauuuuaaacgaauacaaucacauaauaugggcagucagccccccccccccguaugugggagcugucaaacaauucucacagggguggccuaaaaccauuagaaaacaaauaauuuacauuucuauucauaacaguaguaaaauuacaguuuugaaguagcaaugaaaauaagcuuggcagacacccgaggaacuguauuaaaggguggcagcguuaggauaguuguugucuuaguuaggguuuccauugcugagaagagacuccauggcaacucaagggacaacauuuaauugaggcuggcuuacagcuucagagguucaaccauuaucauagcaggagucauagcagcauccaggacugguaguucuacaccuuguuccaaaggcaaacaagaaaggacugucucaaggguagcuuggaggagggucucaaagcccacccccacauugacauauuuccuccaacaagacuacaccuccuaauggugccacucccuggaccaagcauauacaaaccaucacaguugagaagcacuaauauaauaacuuuguuugcuugccuuuuuuuuuuuuuuuuuuuuuuuuugaggcaggguuucucaguguagucauggauguccuagaauuugcuuuauagaccaggcuggccucaaacucagagguuuuccugccucugccuccugaguacugggauuaaaggcaagcaucaucgcugccugguuccuaauaacuuuuuaaaucuacuuaaccgugagaauguuugucagauaaaagccuagacauuauauagucuuuaaagauaauuccguauaucccucuguuuuuaaauugcuuaccgauaugcuucuucagacugaagguauugguauaacaacauuuugacucaaaauagagucuuaacaacuauaauccuguucagugaugaagucaaggacuguuguugaaacagugaguaacagaguggcgcaaucguguggcgcugccuugaagagcuaggcacauccagaguucacuuagcugaucauucucggaaccauaggccucuagagcuggaagacacuggaagaugaaauaacuuuaugggcuaucuagaaaccccaugauuucuauccuauaauucuguuuucccucauuuauuauuuuuguguuuauugaugaagggcauacuacaguuugcauauagaugcuaaaggauaacuuucaagaguuugugcuuguagacuaugugggcuucaggcaugucaacuguucuauauagggccuucuaugcuuaauaauaauuuauuguacauuuuuaaaaauauggaagcaaggaucuugguuguucccaccaccaaacgauagauagauggauggauagauagguaaguguuugggagauagagaacugaaaaccauguucugaucauuacacauuuuauauguacugaagugucugucacacucccugugcuccauggccuguaacaguaugucacuuacagauuuaaaguguugucaggggccggccauggcucagugagaagagaagcuuaucgugcaagccuggugacugacuggagucuggucccugaagccugcauaaaggugggcggagagaacccguucuacagaauugucagcugaccgcugcacgcacccgcugugcacacagagcaauagaagagacuuugaucaguucauuuuguaguguuugauguguuguacuucuucauguguuuguuuuuguuuuugagacaugguuuuucuacacagcccuggaacucacuguguagaccaggcugaccucaaacucacagagaucugccugccucugucucauguuuaauauucucauggaagaguaguuuuuguuaagucuguuuacauuuuguagcuucguucuaagugucuuuaguauuucuuaucuucuagcuugacucuucagcauagaaggggcugugauaucaccaucaucaucaucaucgucgucguuuucauucuugcuuuuaaaaaaaaaucaagacagccgggcacugguggcgcacgccuuuaaucccagcacuugggaggcagaggcaggcagauuucugaguucaaggccagccuggucuacagaucuaguuccaggacagccagagcuacacagagaaacccugucucgacaaaaaaaaaauacaaaaaaaacaaaucaagacaggauuuuguuguguaguccaggcuguccuugaaaaugcaauuguucucucuuccugccuuccaaguucuagaauccuagacuuacagguguguacuaacacauuuagcaggucuuuuccuuaaagcaccugcugucuaucuauaaauguuaagacuuaaaguaggcauuuaagagauuauauuuggguuugagagguggcucagugguuaagaccacugacuguucuuccagagguccugaguucaauucccagcaaccacaugguggcucacaaccaucugucaugggauccgaugcucucuuuuggugugucugaagacagugacagugugcucauauacauuaaauaaauaaaucuuuuuuuuuaaaagagagagacuauauucuagccuagaacgcagcggacuugagggcagcuuccaauagacagugagaaccugucucaaaagaaagacaaaaaaagaccagagaagcagcucuaauccagagagcauguucccuucuugucucaauucuaggaguguaaguuuuaaaagaaggguuaaagaacuggaagcgaucagcagugcucaggcaguucuguuuccaaauaccucccagcacuccagaggcagaggcaggaggaucagguguucacucacuccagcuagggucuccccagacuaaauuagacucugguuuuuaaaaagaaaauaauuucuuuuacugagucagaauaugguuccgaaucccccuacucaagaguagcauucuugcucuggauuuucuuuuuuuuuuuuuuuuuccgagacaggguuucucuguguagcccuggcuguccuggaacccacucuguagaccaggcuggccuugaacucagaaauucgccugccucugccucccaagugcugggaucaaaggcgugcgccaccaccgcccggcugcucuggauuuucaaagcuuaaguguacuuaaggaaagucuaccuugcaccaacucuuuccuuuauuagguuaaggacgauuguuuagcucuuccuuauaaagucucauggucaucuggguggaacauaauucuuagacuuugccaaggagcucuaggggaagggaaggcaggaugauuguuggggcugaagcagagagaucgcaauuuugggcacagcuuggcauauagcaaaaucucuuaaaaaauaauugguaguuggguaaugguggcuccuuuaaucccagcacucaggaggcagaggcaggcagaucucugugaguucaagccagccuggucuacagagugaguuccagaacagccagggcuacacagagaaacccuguuucaaacaaacaaacaauugcugcugcugcugcuguugcuucucccuaccugcaguguauauggcugucugugugugcuugugggggugggggugggggugggggugggggugggggagaugaaggccagaagcugauuuuagugccuuagucucuuuccacuauauuuuuugggacaggguuuagacccagguuucccaaaaugugguuuagguuuuccugggugucucuggcauccuucaaggagucugcauuuuucauaaaucucacagcguucuucucugucacucucauugucucacaguguacuguaggguuuucuagagugcccugaugugugaugcugcagcaccccaagacuaagaauuauaaaccccaucauuucuuaggaggcaacuauuagguuucagaaguuaaaaauaucccucuucuuagcauuuuuaaauuuuagaauauauuuuucccccaaauacuuauuacuucuuuaaaaaaauugucuguguuuugugguggguacccucacauguguuaaggugcauauauggaagucagaggucagcuugcaggugguucucuccuuucacccuguugguuccaggauggaauucaggccaccaggcuggacagcagccaccuuuauauaaugagccaucuugcuggccccuaaaaauuauuuuucauuaaaauauguuaacaaaaucagauuucuugcuaguuaagaggauacacuuuuuaaaauguauauggguguuuugccugcauguaugcacaaggugucugcagaggucagaugaaaucuccuagaacuggaguuauaagacuauugugaaaauacccaauuaaaaaaaaaaaaaaagacuauugugagccauggugugggugauaggaaucgaacccugauccucuggaagagcagcaagugauggcaacugcugagccaucucuccagcccccuucccuauauuguauuguauuguauuguauuguauuguauuguauuguauuguauuguauuguauuguauuauauuuguuuguuuguuuguuuugaggcaggguuucacuauauagccuugguuggcuuguaauuugcuauguguugacccaggcuguccuugaacuccaagagauccaccugccucugcaucuugaguacuugaguaccuugcccagcuaagaggauacuuaaaaacaguuauuaucucaguuucuaauagaccauauauuaauagccauacuguacacaagacuuuucgguccucuguaauuugagugugcuggaucuuccuaccagaagcauggagaggcacuuguuucagugcuccaauuagccggguccuucugcucaucacugcaccuucagcccuaguuaaaguguguccuaccuguacccagacuucuuccugaaaaaacuuuguugauuuucuaaaaauaacaguucuuugccuuuuuuuaucuuuucauuuuagauuugaugguagagugguggcaaagcuccccuucacuccucugucuuacauccaaggacuaucucaucggaaccugcugggagaugacaccacggacugcuccuucaucuuccuguauauccucuguaccaugucaauucgacaagugaguguccguacccucgauucacuauguauagcucuccuuucugccacugcuagaucacacuagcucugccucuguaacgcugggaacauuuaucugcuacgagcucuuucaguugcucaccuggaauuccaguguguuguucacagcuguguuacaugccugcaacucuaguuaacugacacuagggauggggggcagcuguaaaaccaaacguggcucccacaccccuuccugagccucaguuccuucucacuggaucugagcacagugacuuuggucguuccaguaucaucucucucauguucuagugccuuuugucaguucaagaguguucacugcucuggagguggugggaccugggagaauggagccugaaaaugaggcagaugcaugcaauagccaacuuucuucagagcaucagacaauuuauacucuuagauuuaagaacucacuuuacagccggcuguggugguguaugccuuuaaucccagcacuugggaggcagaggcaggcggauuucugaguucgaggccagccuggucuacagaguggguuccaggacagccagggcuacacagagaaacccugucucgaaaaaccaaaaaaaaaaagaacucacuuuacgugaguaaaguguagacucacaaggacaagccaaacauggcacaaacaugcuuuucacagaggcuuguaagccaguaccaguagccagcuguauaccugagggaagcucacucguaucuguuacacccgagaggagcauggcaacacauuccaaggacaguucuguguuuccaggucagaagacuuuugucuugguuuccuaaguugucucacaagcacuccgaauuccuuacaugaaacuccauuuuuggaagguguucugacaaauguguuuuguacaucuacccuacaccucccuucaacuucugcagacccacucugacauguccccuccuggcuucaugucuccuuccuuccuaaccuaaccuaagucuauuuaguguugccugucugcauauggauaugaggccauccacugagggagcaugggcaacuuagcagucaccacccuuccaaagaacagugacucucccucccucccuagcugccaucaguugccaguagcuccucagcuaggggaagggccuuguacaccucucuccaagcguccacgcuggaguuugacugauccacaacugccaugaguucauccagaagauaguuuauaauacuccuccacauccuucuuccgagacguucccugaggcccggggagggguugauauggcuagccugcauacagcugaccagucacagucaccuguucucaacccuuugccuaguuugggucucuguauuaaccacugcgcacuggccaagguugagagcagaagagaauuguagagagacuuguuggccgugcugccuugagucagaagguaagcuccucagcgggagcauggcgcucucagucugcucuucagucucuuguuucuccaaacaguuuaacuuugcuucccacuuucuaccucaucgcaguaacccugucauuuaaagccaucagaguuuuuacacugacuuuuauucuggaaaaugacaaggacucauauaauugaccccugucucugcagaauaucugagccaagguuccuuguauauuuugucuagacuucuguguuuguuggcugaacaaaugcguuaucaucuuguguucucuauuguauaauuucuaauugugcuuguuucucagaauccuuagcuaaauacauuguaggugcccaggaaguacuggucaguuucuguucuuuuaaauuacuuuuugagacaaucuuauguauccuaagcuggcuuuaaaacugaucccccugccucugcuuuccaaguuugggguagaggcaugugccaucacaccuggcuauuaaugcucaaauuuuuuguuuuguuuuguuuuguuuuauugauuuuucgagacaggguuucucuguguagcccuggcugcccuggaacucacucuguagaccaggcuggccucgaacucagaaauccuccugccucugccucccgagugcugggauuaaaugugugcgccaccaccgcccagcaaugcucaaauuuuaaaagcaggaaauuaauagcauauuguuugauuuuucucacaguuuuauauaauguuuuuguuuuuaauuuuuuacagcugucugggaaguuauauuuauuauaaaagaaauacaaacucagauacuucucuagccugaccuauuaaugauugaucuuccuaacucauuuaaaaaauucucauuaaaguaugaaauauuuaaaguauuaaauauaugcaaauauauuuaaauauuuuaugauaaauuaaagggguccuugaaguuguauuuguuacuucauuaucuucugacaagggaugaaaguauuauguauauacaaaggagccuagauacgggcauucuccuagugucuuaaggccaacagacaacggaguguugaaggacagauaguccaggaguauaaggcuguguauacugagugccauuuguucugaaggccagcacucuaacagaaaguguggugggagaguguccacuagacuaagaaucagagcauaugguuuaaauuagaaccuuuugagacagcucaggcuggccuugaacucuugauccuccugccugcaccugagcacuggaauucuagcugugcgucaucacaccugcugcuaacuuaacuuugcuauuuuggagaacccauuaguccuuuccaaaguuuagugguuucaaauaccaaaugaagggacugagaagaguaauagaacaauauccaagguuuucuuagagaugcugugagcuuuccgauaguuggcagugacguaacacuugcucacucaucagcccucuccguuccaguaaagugcaugccgauugauucucuagucagacggcucugcaugaguacucuuuagacacccacgccugucugcuccaaaagucuauuguuuuccaaaaccuguuuauacugcuuuuacuuguuauuguaguuauguaauuaaaugaaauguuacauuagucaaagaaaucagaacauaaaaaauguuuuuuauggaaacugcuucaguacuuaaaaaaaacuaaauacacuuauauuguuguauuagauguaguuaagauaaagaaaagacacaaaguuuuaaaaaucuaaggauuuugggccuccaaguuagguaaguguucuuccucugagcuauuaugucccugccccucuggcacuauuugcaguaaagacuaaagucagucauacuauacucaagggaaagcaagcccuuguauuuuauaggcuuuguguuaaaaauaaaacauuacaguggggcgugggggcauauaccuuuaaucccagcacugggaagacaggcaagaggaucucugugccagccuggucuacagagugaauuccugaacagcuagggcuacacagagaaacccugucucaaaaagccaacgggguugggggaagugagggggggaagaaaggaaggaaggaaagaagcaagcaaggaagggagguagguuaccuagagugauugccuacuacgaacaaggcuauagguuccauauucuuggcacuucaauaagaacccccccucuaccccccuccccgugugugugugugugugugugugcguguguguguguguguguguguguguguguaugugugugagauucauucuacacaguuggcaucuuuagauuagcagcaccagguccugucaaguauguacaggucuuuugguuugguuugguuugguuugguuuuugguuuuuuuugaggcagggugucucuguauuacccgggcuguccugaaacucacucuguagaccaggcuggccuugaacucagaaauccgccugccucugccucccaaguauugggauuaaaggcgugugccaucacugccuggcauauguacaggucuuauuguugugaucuucauuauauuaaaaaaugacaccaucagcccauugcagguagcuauaguuuuaguuuauaugcauucucuuugcugauguauguaaaacacucuuuauagcuuauauuaaaauugguuuuuacugugcuugcuauguuguuucuuuacagaacauccagaagauucuuggccucgccccuucacgagcugccaccaagcaggcugguggauuucuuggcccaccaccuccgucugggaaguuuuccugaaggaaagcagaauucugaauuuccugucauacuuuuuagacauucacaucagacuuacagagcaccuggccacauucuagguuuguguuauuucucagcuauggauaugaucaaaugagaacacugcuuaacuaaugggauagugcuauggucacggauggcuucuuuaguaauaagugcacucacugguuacauuuggauggcuuauguaaccacaaacaucaucuuucuugucucacuugaguauuucaguguaugugccauauacacagaagcagacuguccaugaacauuaggagaaaaauaguuuauguaacaacuucacuguaauuaguuguuguguuuuuuaaaaagccaaauaugucacuuuguguucgacaaugagccaaauuuuuagauguuucaguuagagaaauguuugauuuuuuugcauauuaaaaagaguauuuucuguaaucugaacauaaggauaagcauuggcccaaaaagcuaaaauaaaguuuugucauguucuuuuaccagccuugucuccuguucaaaaugugggauugucccaguguacacuuugaacguguuccaguuggcuuucugguguuuugucaaacacuggccagaaccagaagcagcuuaggggaggaaagggguuuucagccuaugcuuccgggucauaguucaccauugggggaaaagagguuagaacuccagcaagacccaaggcggaagcuguggaggauggcuaccagcuagcuaacucugccuugcucucaguucgccuccucuuagcagccgggcccacccaccuagaaaagcucacauacuguaacugugcaggguuggagcaggcccuccuccaucacucaccaauccagagacucucacagacauggcuacaggccagucugaccuagggaacuucuuaguugauagucccucuugccaggugacucuggguuccauaaaggugacaguagaaacaguacgaacuguaagcuuggaaaggaaagggacagugcagugaggggaacucgugcuugucucgaggacuccugcuugacuggcagcagccgcugacggaagaggaagggcugcuuccccuuuacuggagaguaguauggaguuccgucccagcacuagaugcucaugggcacugccuugcuguuucuagaccuuucugcgagcauaauaugugcugcuauuucaaaggaagauccaucgugagcucaaacugcccaggguaggaucuuucuuuccuucucugacuugcauucccuuuaucaaauguucauuuaggauugcaggguuuagaacaggaacuauggauggggagaaccacacacuuacccaugggcauacacacacacacacacacacacacacacacacacacacacacacacauacacacacacacacacacacacacacacacacacacacacacacacacauauacacacacacauggaagucccaacaguagugcaagcguuagccagcagugugagugaaguuucuggaauguaccgauuuugauagggaacagugaagauuguuugggguacaucccacuggggacucagucgucgaaucacugagauuucggguaacaguucucugauuuuaauuuucagaggcugcuuuuuaagugacuugguaguguugggaaucacaccugggacugugcuccuugcagauaagcacugugccacugagcucuguccucagcuccagagauuguacuguaauuucacguuacagccauacaggguuuuuaguggguuucuaggccaccagcaaaaaucugaguagauggaggugguugugcuuguuuacugaguguaacugugaucauaagacuccacaugggagaaccaugggcaggugcuaagguuaucugaaguaauuuaauuuuaaaccagugcuggggucaucgagaacaccccugcaguaguccuucuggggagcagaugaaguccuguguguguguguguguguguguguuguuguuguuguuguugauuagagcacagccaugguaaggacccccgugucucagacccaugggaauggcaagaccaccuugugcaagguuucucagaccugugcauaguuggguuagacuucucucccaaaauuucuauuuaagcuucugauauaagucacuuguuaaauaauuaacagaccuauuuaugccucaguuuucugaucugggaaagaguuaauaaccuugugaaagcccuuuacagucuccauguagcugacucuggacagagucugccugacuccugcccaucuugcuuugguuccuacaguuuggauugcauaacauuggucuacuuguucuuuuaauuagauauguugguuacauaguauuugcuucuaugaaaacuaaauugaauggucuagauugaccuaauaagucaagcuuccuguucaggccaccauuacagaauagcauccauggcccugugcuaccccauggccaugggccucaacaauggcuacaaggugacaaagaacgucagcaggccagggcaugguuaugccaggggguguccuccaccaacacaccagauuccugccggaccugauccuggaggcgugccccuucacaccguaggaguggugcacugaaggucuccagggacagguguguguucaucauucaaacuugaggacuugacccauggugggaggagcgaacagaagucugaauguuguccuuaauuucgucacacacuguggcucaugagcacucacaucauauacaucucccacacacaugcuaaaaggaauaaauaaaaaguuaaaacuaaggugaaugcugaagccacggguggaaguuuaugccuguaauaccagcacuuaggauuggcagcaggaggaucagagaaggucaagucaacagccugagauauuugagacccugucuccguaaaacaagcaacagguuuagagauuuuuacaugauuuguccucaaaucccauacuaguagaucagaaaaccagcaaacacucugacccuugggguucggguuccuugucuuucuaccucauagcugcagugcugacuccuuugguccuguuaaagucuucaguuacuuagcgggagucucgaguuccacugccccguguucagauggcuucauggaagguaaguacaaacucuuagaaaaaauugugacuaauuuguuaaaauauuuccuugcuccgauaauccgaucugaauauuuuuauuaaaaagccuucuuuaaugaugaauuaacgcuuccuuuaauuuauuccacuguugccacacuguaaggaaggagacaggugcaagucuagugagaugauaaucaaauggccacuuuuugcagguggaagcuaaauauauuuuuguauggauccaggauucauuggcugcugaagaaauucaauagagucaagggcuuuuuuuuucuuagugcaaaaguagcuuucagguuuauaauuauuucagccauuuucugaacagcuaaaucgaccuucacagcugucuuaugaagagagcuaagaaaucgcggagacugcuugaccuggugguagaagauuccauucacaggaaaaauaaaugcguuuuaaagcaagaugcgacaauaaacacuucagcaccgugcuuuuccugcuugcuuucuaaacuacaacccagggaaaagcaucuauuaucacaauccaaauaaagaaguuucuugaaa

SEQ ID NO: 490 - RNA, 18544 nt, Mus musculus
cacugucccuuccucccagugggcucuacugggcucuccuugagggccccgggucuucacacucacgguccacaccuccccgagguccuguucccuagugguccaccccugcccagccagggucgccucuuuccaugggccacgccccagagauuccgccccucgccacucccuccucguuaccgcgcuaucucccccuccaguaguaaucugcuggggcuuccggacgcuuugcacgcguagcagaugauccucggugcagucgguucugugcugaccucgcuccuccgcauucaccgggcugcagcagucgccgccaugaguacuggcaccuucgucgugucgcagccgcucaacuaccgcggcggggcccguguggagccgguggaugcuuccggcacggagaaagcguucgagccagccaccgguaaccuggcgcggggcggcacgcggauggggugggucuuccccggcccugugcacugagucugcugccccgaguccuuccgagcucuccgccaaggguugcugaacuugcguggucgcagcacggagcacagaauguuggggaggcuccuggaaaagagggggcgcuaugggugcgguggggugcgcuggggggccgggaguaacuacauggcuggagcaggagagucuggcguagaaccugugggucuuuugaguuuugagagcugggccugcaggagagucugcuacugggauguugacucacaggugauuucuguuaugcaugauccacaugaccuucccccuucuagugcugggauauuucugaacuucgaugagaguugggaaaggagagaaaaaaaaaaacagcagccgacaacaucuguuuagcuuuagugccugcuagcucuccagguuaacaagagagagagagaaaaaaaaacauugaacauguguaaucacguguagugcuuaccacuguuaauuaaugaacuuauccguuaucuccacguaguuuccaccuaugaguagugagaacuuucaugcucugcacacuuggcagauuuuaagugaauauguauuuuacgguauuauuagcuguaaucacgauguucauuagauuucuacaguucauccuugcaagcacuuaaugcuuuggagcaaacccuuagcacaaacuaaggaggaagcgaguucuuuguuucuuggacuuuggguugacuuuuguguuuguuuugauuauucuuauugaauauucagagcagggaaaaaaaauguguucuguaagccagaagggcuuguuuagugagagaaguaaaaguacacugaccuccacgaggcagggauuugccagaaccugaacugaugggagaggccaugauagcugggaagaguuucucagccugccucccuuuagaggcacagaagcagcauugcccgcaggugagcucuggccauugccuuuacucgcaggcgaucuucagccauucugguuuguccaagaaauagguuuaugaaaucucagaaauuccuugugaaaagaaacugcugaaaaccuuuuguuggucgaguuaguuggguuaugauccuucagauacgggcuuaaaaagaaaaaaaaaacacuaaucuuuuuuuuuuuuuuuuuaucuuugaaagaccauuuuauuuuauuuauauguguacacuguugcugucuucagacaccccagaagagggcaucggaucccauuacagaugguugugagccaccaugugguugcugggaauugaacucaggaccucuggaagagcagucagugcccuuaacccugagccaucucucuagccccaacacuaaucuuucuguuaugauggggauaggagauugagacuuuaagaaaagacuggccuuuagcgacuaaaguuucuuauuaaccuuauucaccaaguaguagucugauagucccugauuagaacacagauaagggacaguuuacaguaauagacugaugacuuucaacuuggauuuugcaagacugucaagauucugagucaguauuaagaaccaucacaaaaugacuucuagaaggucaauguuaguaaacuuuuuuuuuaaagagguauuuauuuauuauauguaaguacauuauagcuguccucagauacuccaaaaagagggagucagauuucauuauggauguugugagccaccauguggucgguggcauuugaacucaggaccuuuggaagagcaguugguguucuuaaccgcugagccaucccuccaacuguaauguuuaguaaacguagcuaucaaauagaggagggcauggccucuuagucucaggcuauggugaguuuuagacaccgaauaguuucagcaguuuuguaaugugguuaaauucuuguuuuuauggagcuagaucugcaacccucguuggaguuuaaagggauucccaauacaaaaaaagcuaaguacuaaaugagacccugggagggauccauccuccagaggaugcugauagaaaccucucagaugcauugcaacugcuugagaugaaaucggcucuccgcuucuuucuaggccgagugauugccacuuucgcguguucaggagaaaaggaaguaaacuuggccguugagaaugcaaaggcugccuuuaaacucuggaguaagaaaaguggccuggagcgcugccaaguccuccuagaggcugcccggaucaucaagguguguaucaaucgaucgauugcuggguuccuuuggaggaagcgcugcucgcacugcucugaggggagcugcagguagacuuggaugcagcuuuggguuguggcguuucugugcaagggagaaacguucccacccacgugcccaccuuggaacgugaaauaagcuuccaccgcgugccccauggacaguuccccuuggccugcuuuguuucuugaguuuguuuugaauuauagcaugaucuuuauggcuuacuugcuuuuuaaaaaaauuuuaauuaauuuuuacuuauaugaguacacuguaguucagacaccccagaagaauacaucggaucucauuacagaugguugugagccaccaugugguugcugggaauugaacucaggaccucuggaagagcagucagugcucuuaaccacugagccaucucuccagccugcuuacuugcuuuuuaucuuaaauuauuuuuacuuaaaaguguauuuacuuauuugucuguauguauaugugcaugacuguauguguauauguauuuauacauguauguacaggugccugaagagguuguggucgguguagccuugaucucuguccaaccauacuuuuugagaugguuucugucaguagaccugggguuuaucagcuuggcuacauuggcuuaugagugagcuccagggauuugccugcucuugccuccccaguguuggggauacgguucuggugcuggcaugucuggccuuugugggggcuggggauuggaacucagguccuuuuguuuauauaucaggcaccucacagacucagccaucuucccaggccuggaugcuugcuuuuaaugugugcuuguuuuugcuuuuuuuuuuuuuccuguuuugagaauauuuaagccuuuuuuuuuucuugguguguuuucuacuagguauacuucuagaaaaauucaaaagaauauacaucacaacaugaauuguaucuuuggugggaauguagggugguuuuuuuguguguguuuguguguguguuagcuaugcugugagaaaccuugaagggucugaggauuaacaugcuugcaagugaguguauacgaauguauacucaaauaucuguauacacacaucagugcacacauguauucugauagaacacaugacgcuuuggagauuagagaaaaaagagcuuuguuacagccuguacaugcuguggguugcaccacagggaguuaguguaucuaaagaccuuccuauccuccuccagggagguacugagauuaauugguuaucagucaagucucugagacggagaagaaaggaucgcuacaguucuuacccgggaguauaaacuucuagcuucaggaacaggaagucacagccccaaaggucucucucuuggguaauguaaucucuguuuuccauggccuuugcucuucaguuggccugccuggugucuuuguucagauagccugggccgugccuaaaugucugagaguaugcugaaauaugcauucuuacuuauacacaugcacagaauagugcuuaaaacuuuccauuucucucagauacugaguugagguuguguucugaaucuuugucgccugaugaugacgaggaggcuccucuguggcagcagguuuuugucucccggugcggcaccauuccucugucgggucucauugcaaaugcccaacuuuucuaggcuuagagcaugagcgacaugugcuguuuaaacaccguacuguguauucacucuccucuguucuacccaaaggagcggaaggaugaaauugccaccguggagaccaucaacaacgggaaguccauauuugaggcccgccuggauguugacacuugcuggcagugccuggaauacuaugcagggcuggcugcauccauggcaggugagcccuggccuggccucaggugacaagaggacagaagagcagagccgaguggugaaggaguggugaagggcaaagucucaaguucacugucaccuuuuggguggcuuaaaaguuaccuuaucauucuuagauaagauggaggugauaacaccucauuuccuggguuuugaggauucagugagauaguacaugucacugagcaaacagcauugagcaaaccgagacacuaguuuguaagaguccacgcugugcgugucauuguuuuaaguucauagcugggccaggauuguagcuaagcugguugacugcuugccuacugugcauggagcccuggguccaguuccaaauauugcauauucuuuaguguggugaugccuaccuguaauccuaguaccuaggagguagaggcaggaggacuggaagguuaagggcagccucagccacauagugaguuugaggcuaaccugagcuaaaugaaacguaaaaaucaaauguuuacaacaguucauauugaguggguuuuaggguucuuagacguccucugcugcugaguuguccccuuguuuccauauuauuuuaucuaaguuaugcgcuagaccucaggagauuguuuuguuuuguuuuuaagaguuuuuuuauuuauuuuugaaaagagggcuugcuauguagccuuggcuuuucugggucuugcuguauagaccaggcuggccuugaacucacagaaacccaccucugucucugcuucucuagugauaggauuaaaggcacgcaccaccauagcugccucacuuuuacuuuuuaagauuauauguguauggcuauuuugccugcauguguauuguauaccgcuugcuggccuauuaucugugguggcuaaaagaggugugggaucauccccuggaauuggaacuacagaugcuuuuaaguuacuaugugggugcugguaacugaaccuggguccccuggaagagcagccaguguucuuaacugcugagccauuucuucagcccccacaggagauuuuuagagaauuaaacgaacuaggaugagcuagaaugugcuagugaaauugggagcauagacuggcaucauuccuucuguuuuaccucuaggcgagcacauucagcucccaggaggguccuucggcuacacccgaagagagccgcuugggguguguguggggauaggagcauggaacuaucccuuccagaucgccuguuggaagucugcuccggcucuggcuugugguaagagugaaugucuccuccgcagagagccuuccucccccaccccacuccaguagaccuucuguuucuuucuaaugugcucuaggacagucagaucucugaggaugucggccugucccugcucugccucacuccugaaggaacuaaagguugagguuacaggcccugucuuuaagugucucuauuuugcaucugucuaguuugucucugacauaggaucugcgguguagucuaggcugcccuugugaggaugucagcuucucuaguguuggaaugaaaguuucuggccucuuuuauaaaaugagacugauuacccuacuuuacacugaaguugcaagcuuuaagugggauaauacaugugccgagaccuugaugcgugagaacccaagguaggaaaacaagauguguccuuuuaaaaaaagcuaauuaauuucagacuuauuaguaucuguugucuguguaugagucuuuugccugcauguauauacguauacagugcacauuacugguaccuguagaggcuagaggagggugcuagauucucuggauaucucaaguuacagcugguuauaaacuaaccauuguguguuggaaacugaucccugucugucacuccgauccuaggcuuuucuguuauuaauaacaccuuuggugaauucggaagaccagggaccggcuggaauagucuagucuugucuaagaggagcguuugcuuuucuacagguaaugccaugaucuuuaagccuucucccuucacgccugugucugcucugcuccuggcugagaucuacaccaaagcgggugcgccuccggggcucuucaacguggugcaagguggggcugccacaggccaguuucugugucaucaucgcgagguggccaaaaucuccuucaccggaagugugcccacuggcgugaagguacggauggaaccaguuuuguccuaacaaauggcuagcgcuggcaaagcugacccagccuacugugugguuugccuguuuuggauuuccuaguuuguauugggaaugggccaggaaauucugcugguccaaaguuuccugugcgagggugagggagaaagagagcaugcauggguggucuguguugggccaagugggguagaaauucuccucccugccuaaggagaugauguguuugagggacuggggccgaggcuacgcuggcacgucucuuguuuagugaguuaaccacaucauauagaaggaagaguauuuucucagguuacuucagauucauugcuuugaccagaauuuauguccuggccaugagagcccugugaaccgucaguauguuucagaugaacuccugucucaggguuugacgugaaaguucuguaaauucucauaagcguuugccaaagaauauuuucaguggaugaaggacucaaucaucggauuacgauggcuggugggugcaggucuccuugaccuugcuacaggcuaaguuaggcgaaacuucugaaugucuugcuuuguucuguagaucauggagauguccgcuaagggagucaagcccauuacuuuggaacuugggggcaaaucuccucucaucaucuucucagacuguaauauggagaaugcugugaagggggcccugauggccaacuuccucacacaaggacagguaugcacucuucccgacagggcuggacggaagcuccccuccucuccccccaucagcacacucgacacccuggacccacuuugagaagugcaggauaguugcgcaaauaguacaaagcuuccguuguguccuugaucuagugaccuagauugcugucauacauugguucccagccuuccgagcgcugugacccugaaacacagcaucuccugugguggugacccgcaaccauaaaguuauuuccauugcuaccucauaacuguaauuuugcugauguuaugaauuguagugugaauagguauugagauaaagcuuugcuaaagggguugcgacccacaggcugagaaccgcugcagaagcgaccaugguuacccuucucucaaccugcuuacacacauaauauauaaaugcuaaguuuuccuguaguguuuauaguauuuguagauacacggucuguaacuaugaaauacuccaauguagccaaaaacgcauaaucuuuuauauaaaauuaccacacuguaacacacacacacacacacacacacacacaccacugucaguauucuuacugguguuaacuuucugauuuuuuccaucuguaacccuuacuagaacuugacugcuuauuugacuaauaucuuaguaauugaaaauaauuuucauuuuuuuuucugggagaagauccagcugaagggacugacguaguauagggguagagcauaugcuuacauagggucugagguaagagccauaacaccacagaaagacaaagaacaagccagaaaaaccccagaagaauccaucgaugagauuuaguguuuugcuugucucccccccucugcucaguugcugcugguuuguaagaaauucuuuaggcagauuuuaucuuauguaugugaauguucugccugaguguaugacucugcaccccauguguaccgggugucccuggagagcagaggaggcgauuggugcccuugaauuggaguucuagaggguugugaggcagccaacccugugggugcuggcagcuuacgauggguccucugcaaaagcaagcgagccgucucuccagccuugguuauuguuucucuaaaccauauguguggaugugcugcagugugcuaaucuaugcauguagaagacuacauaguggguaauuggcaugguuuacgucaugaguguugauguuuugagacaaagucccuccgaguagcccaggcuguccuugaacuccuaguuucccaagugcugggaucucaggcaugugccaccaugcuggguuuuuuccucucucugacccgagaaacuucuuugauuucuggcacauuuagguauuguagaucaucucguucuuuuuuccaacugaacucuggaauuagcuaucugucuacagcccugguuucagggagugggaagcguuacuuagaaacccagcucuuggccggggcuguagcucggugguagaauaaaugcugacccugcaccugggagauccugaguuuaaccccuguaagccaagggaaggagcaaccaggauuccagugcccggcucuugacugcugcuaugguguccgugcugcucagccggggcuagggaaugcaugacuguguguguacagacacguagcugaacacaccuccccuccucccagacagaguuucucugaguagcuccccccucucccugcgcgcguacacacacacacacacacacacacacacacacacacacacacacacacacacacaccuaccuuggcugccucaggacuugcucuguagaccaggcugaccuuacucagagaucugucuaccuuugccuccccucccaaacacucaagcacugggauugcaggugugccaccaucaccugcccgcccccccuuuuuuuuuguaucuguauuaagcacaaauucauucaguaagucauuguggcccuuuucuuccucccugucuauauuuguaguuuccuuuucugauagugacaguuuuuuuguuuuuguuuuuguuuuuguuuuuaaucuuuucagagccaaggaccaaacccugggccuugugcuugcuaggcaagcgcucuaccacugagcuaaaauccccaaccccagacuuagguuuuuuuccccccacaguauauugaaucaccuggucccagaguagcauugugaaaaguaagccaaguuaaaaguuucagguagccgggaggaggugguggcacacaccuuuaaucccagcacuggggaggcagaggcaggcggauuucugaguuugaggccagccuggucuacagagugaguuccaggacagccagggcuacacagagaaacccugucucgaaaaaccaaaaaaaaaaaaaaaaaaaagaaaaaaaaaaaaagaaaaaaaaaguuucagguacuuuauaguucuuuuugucuuuggccuggaugaguacugccuucugaaggcccugggucuguucuguccucccuggcuucagucugcuuaugaugcuccuuuagaagagcagguccacaggcuucugcuuguaugucacgugacgugucuuuuccucugcccuuuaaagauuuuuaagaucuguguucaucaggcaaaacaugaccauaguuccaaaugugaaacauuuuuaaagagcccguccagggcugucagucuccaucccuccuccccacucuucuccccugcuccccucccccuucccaugccaagacacuaucauuggugcuuguuucuccuuuucugugcugcucuuugaacacagcggccauauauuuguauaguuuggaucuccucuacuuucuuuuuacaaagggaagcagguuaaaagcuccacuuuuuauauauaauuuuaauaugucuuagacaucacuccauugaacuucauagggaucuauuucugggacucugcucuguucuacuguauguuugugugguauuugaaccguauucauguucauucuggugagcaugacuggugguuauuuacggcuuuagagagagagagaauggugacuaacccuccccacccccauccccuguagggugucuuuguguagcccugacugugcuaacuccauaaccugccucugccucccgagugcugggauuaaagaugucuccaucgccuggccuaaaaugcuccauuuuaaaaacuggguugaagauuacagcucucagccucaucuuacuuucagcccacacuuuaggaacagccagagugagcagccggugacgcaggacuaagagagguuccgguccugugccccguuaaaggucuucagaaaaguuaagcugaguaagaguuaaccauuauguuaaagggcagaucaugcauguagaauguaugucuacaaucacauguaugauccuuccuaauuacuacgggcaguuuauuauuuuuuuuuuaauaauuuguuuuuauuuugugugccuuggugauuugccugcauguaugucugugagaagcugucagaugcccuggaacggaguuacagacaguugugagcugccaugugagugcugggaauugaacccaggucccuggaagagcagcccaugcucuuaaccacugagccaucucuccagucucugugggcaguuuuuuuuagaagugaaaaaauucuugaaaaaaaaaauguguuauagggcuggagagaugacacagcaguuaagagcacuggcugcucuugcagaggaccuggguucgauuccuagcacccacauggcagcucacagucauuagcaacucuagguccaggagauccaguguccucuucuggccuccgcaggcaccagucacgcauuuggcgcacagacauaaugcaagcaaaacaucaaauacauaaaauaaaacauuaaaacaaugaaucguaucgccuuuaagguuguuaggugguuuuucccucuuuuuuuuccaucccauaugcagauuugugucucacgucuccuuuaggucugcugcaaugggacuagagucuuugugcaaaaggaaauugcugauaaauucauaaaugagguugugaagcagacucagaagauaaaacuuggagacccccuucuggaagauacgaggaugggcccacucaucaacgccccacaucuggaacgaguccucggguuugucaaguuggcaaaggagcagguaagaagugacaggagcucagagggcagguggguuacguccuggcuccuuauccuguuccccuccacugacagcugugguugcugucccuacggguccugcuuugggaggguaaauaugcaugcauuugcuugggcuagauuuugccuuuuggggccauacauggauuuauguucaguacaaaagaugccugccuuuucucuuucucuuagggugcuacugugcugugugguggagagguguauguaccagaggaccccaaauuaaaacauggauauuacaugacaccuugcauuuuaaguaugucuuguucgcuuuuaaauggcugggauuaaauaccaaguagcuauaagugaauauuuauaaccuauauaaugucacagaguaaggguuggcagguugaauggucccacuacccaggcuuaugaaguaagucguuacucuugaagcccccaggugccccugcacuaggucagccauauguauugguuugcuggagacaccucuuuugggaacacgcuuaaacauacauacacacaaaaguccuaaaacucagaaauacuuguuugauuaaaauaauuaggguaaugacauguucaguaauuauaaucagcauaacaaaaccaauuugucagauguaauuuugguaaguuuuaguacaucuuuucacccguaaaacucugcuuuggggcuggagagauggcucagcgguuaagagcacugucuguucuuccagagguucugaguugaauucccagaaaccccaugguggcucacaccaucuguaauggaaucugaugcccucuucuggugugucuaaagagagcaacaguguacucauauacauuaaauaaauaaauaaauaaauaaauaaauaaauacccaaaaaacaaaacucuguuuuggacagucagguauacauagguauccuacucaagccaauuccagccauucccuggugcuaguguguuaccuuucaaccgugacacgaugcaguuuagcuaaagguauagccacugauguugaaaagcugugagccuaauauccagaccguggaccagggugguuguaauugaacgaguuaacaaguagggaaaauuuaugugguguuaagugaaagauaguggguuaaacaaucaaguaugcaauauuauucuaaauuuguugaagagcagguauguauguguacgggaaaagaaggaacggagacuauauuaauagaguucucugugugcugggauuaauucuugugaugcuggaaucuggcuuguguccuaacauaugugugacuuggaaaaccugcuaagacagauuucuggucccugccccagaccucugacugucauucuuagagccuuuggccuagagaugugcguugucacagacccacuguugaccuuugaccaugacagguuaggacuggcuugagagucugucuuuaacuugcuuaagauuucagaauuggucugcguuucagauaggcaugcuucccgaugucacgugucagcuguuccuucugcucuccaguguaaagcucacugcccacagagccauuuguguagccagccuuguaagcugauaaauauuuucagagacuguuggguaauuguuuugaguaauuaaauaaaacauacauguggauuauuaguuuucaaagacucagaacacagccagcuauuuguaagcacaaucuaaauauuauacgaggcacuguugucucucaagugcaccccuaaccuaucugaagagauuuucuuuuucuccuuuuaagaauuuauucucccccucccuccaccccucccgguucugaggagguuuuagaauugcuugugagacuuuauaaugagccaguguuucuaacaggacuccagagcuccuuuuccggccccccaacccuuccacgugcagcgaccuccaaacgcccugugcaguguugcuuggagacccacaggggcucagugcugcuccuucucagaguccuaagcacagaacucaaaugccaagcauggauuaagucauuguaggcagugaguuguugguaggaacauuaaguacagauuuuacaaagcaaauauacuuuuauguauuuucacauuuugauuuuuauauugcauuuauauuuuuauauugcauuuguuguguguguguguguacaugcgugugugucuugcauacguguuugcaugccuagaugaacaaugccugugcaggcuagaggaaagcauuggauccccuggagcuggagucacaggugguuuccagcugccugaugugggugcuaagagacaaacuugggucuucugcaagggcagugaaccuuuggaaccacugagccaccucuccagcccuugcagcuuuuuauagcauuguuucuacuuguaauuacaugagagaaucacuuaaaaaaugugacaaguggaauaaaaaaaaccgauaugacauuuuaacagaaacccuguuaauguuguauuuugggucauuuucagugaguauuuuuaugaacaucuucuuacuguugagaagcacggcucugagcagcuuuauagaaguugcucgcuggggugugccuggucuguggugaucauuuccuccucuuugggugucagucuguugccuuugcuuucaucaguacagguaauacuguagugaagaucucuguaagugagucugcuugccucacuggagacuuccuuaggaagucuaaaaggcgguuuuagaaucgccgaggauaacccucuaauauguauuagccaaagugccaugccgaaggaaggucuaauugauauccacaguggcgauagccuguugaauuucccccccuaaagccacaugucucacugcuuauuaagauacuguguucugggucuaugagauugugguccccucacugucugguuuuguucugaaugcuggcagcuaauugcagagacgacaugacuuguguaaaagaagagaucuuuggaccagucauguccauuuuaacauuuggaacugaagccgagguucuagagcgagcuaaugacaccacuuuuggacuagcagcuggggucuucaccagguauguggaucaggacaucugcagcaucuuaggagggagggguuaugggaucucuugaguguguaaccauucucacugcuucccacguugcugucauuagagauuagagccaccagcaucucuguuugcuucuguguguuuucuggugcugaugaucaaacugagcuacgccccuaacccagugugcuuuucaguuuaguggaugccaaggaugcauuuggcacucugcuugucugaguuggagacugagugcccuuuguguguguugggggaggguacugaggacuaagccaagggccuugcacauaggaaacuagcguccuauauugagcugucuccaguaucaccagaccuuuuuauaacuuacuacuuugaguuagguucucuaaguugccagcaccggccacgacagcucugcagggcaggcgggccuugggcugacucaguuguccucugagcaccacagaugugcaguguguaugugcauacagaugcaggugcgcguacacuaauaaaaagcucuaauuucuccauaccugucucagccauccuccugcuguaagggguuugguuugcacuucuguggauuuccuuuugcuuuuggcuauuuaugcuuaaggaggcuuugucuaauccagggucauggagacaaacuucuguccuaaaaguuuuauaguucugcuaucuguguuccgcgugggugaaugcauauguauggugugaagggcuccaucuuuaucccugugugugagguauguaguugcucccacaccacugaacaguggugcccuuuacugccuccugguuuauagauuucuuuucuuuuuuuuuuuuuuuuucgagacaggguuucucuguguagcccuggcuguccuggaacucacuuuguagaccaggcuggccucgaacucagaaaucugccugccucugccucccgaaugcugggauuaaaggcaugcaucaccacacccagcgguuuauacauuuuuaaaccuggucugucugaaagcacuuugaacaguuugaagaaacaacaguuugccaggaucucaggaccuucagagcucacacucugagguuccugaggaaaucugcuaauaaccaauacuaucuuuucccuaacagggacauccagagggcacaccggguggcggcugagcugcaggcuggaacgugcuacauuaacaacuauaaugucagcccaguggagcugcccuuugguggcuacaagaagucaggugaggcggaggaaaagcacggacaaaccagauuugcagggaugccauucuagccagugccagcucaccagcguucuaauuguggccuggcacagccaaggacauacaggacacucaguccuccccagccucgcuggagugcaggccagccaccgccagacaacagcucuuguguaauguggcaugugaacugcuggucacaccucagugugucuugugggcgguguuacuuuuucuugcucugagcacagggcuuccacaucaggcaugcccaucaguagggcuuaggugucucucaagucauaguccagagagcuuguauuaauugauuuucuccuuuggguccacauuugagacucaacacaacugucugaucuggauggcaccaaaaugguccccuaagcuacugcuccuugauuucugucaccacagaugugugcucuggcgugucgggguuugaagcagaggugguauagccauugcuuugaguuuuuuucucuguguguggugccuguauucauucauuuccuauacuucuuuucauuuaaacuaaaaauugguuugaacacaguuuugagaguccagcugguuugaaaacaguuuugagaguccagcucauagucuuuggccaccuaaauauuaggaagagugaugcagugguggguguggauagucuacucucauaacuagugcuauccuugcacucccuaaugauacucuacuaaucaugguuuuuauuaguggcuaguguuuaguauagggcaugggccuuagagccccuaacuccaggccgguuuucauuccuuuuggguaagacaacagugugugcaugauaagagagaaauggcuaggucugaagagagccuggccugauaugcuuagucagugugggcuugggcacaacacaaaguccaagcauggggcuuuggcgaacugaacgucugcucuuugcacaugcuaacgguuaauaagucuuguuacauagucagguuuuaacagacauugcuuuucagggcugucagguugauuguuuuagaggcugcuucuaacgggcuucuuggcuuuuguagggcuagggguggggaggauggagaacacagucucguguauccagggugagccuugaacucacuauauaguggagcagaguuccuuuugccccaucugugugaagugcugggguuauaggaaugugagacuaugcccaggcuaauggugccgaggacugaacccagggcuuugugcuugguaggcaagcacgcuaccaacugagcuauugcaccugcuguuagcacgcuuccuucaaaagacugaacacuuuucagauguucacacagaguggcaggcacugaagcagguacucggcugguaaguguccuaacacucacuggcccagcuccgcagaaguaucugcucugaggacuugcuccccacccugaccagcagagucugccuuugaugcacugggacuccagaccacuguacggccagcucacucugaccccgugucuuuucaggauuuggcagagagaauggccgugugacgauugaguacuacucucagcugaagacgguguguguggagaugggcgacguggagucagccuuuugaaacccagggaagccugcuggcguagccaagcuguggaaugaguugacugccuugacaggcagcauaacugaauagcuucuuacauccaggcuuugggucauuagugugauaacgggucaguguuguccucugucuuacagucaccuucccaguuugaaaaugugcacaagugccuuucagaugguagccagguaaccuguugucccagccccugagaaauauguagaccccagaagcgcacucuucagacauaggcaggccacagcucugcuccuacacauuugucccaccaacaauggcagcuuucuaguuugcuuuaaagcaggccuuccuuccuggguuccuggugaaucaguacauauacauucuuuguucauugacaacuaaaaaacaaauucuuaaagcuuuuauuuggagcugggcaguacugguaugugccuuuaaucccggcacuugggaggcagagacagguggaugucugaguuuagagccagccuggucuacagagugaauuccagucuaggaaggucuacauagagaaauccugucucaaacaaaacaaaacaaaaaaaaacccauaaauaaauaaaaaaauguaaaaagcuguuauucuuaguauuugugggcuaugugacucauuggcauuuaaacagcuguguucuaacuaacuagcaagacagcucaguggguaaggucuuaucacuuaaacccagugacuucagguuuaucucuagaacccaccccuuccccauaucauacacugcacaauaauaaaaucuuucucaaacgcuguguuuuucuguccuuucuuugagaaaccggaccaccuggcuagagagacagguaguugguggagucggauuuuacgcagauaacugacuugccucaguaaacacucauccugucuuccacagcacuuuaucucugauucuugcaguacagccuauggccauagaaccgaagagaaccuuuagaaugugugaguuauuuguacgcuaccauuacagugaauuaaaaaccuauuacacugcuga

SEQ ID NO: 491 - RNA, 3320 nt, Mus musculus
acagauguguggagguuagaaaacaacuuucaggaacugguucucgccuuucaacgaugcaggcccuggggaucgaacucaggugucaggcucagcugcgagcaccuuuacugucagagguaucucacaggccccuggcuucuauugugaccuaccuuggaugugugucccuuaggaaagccaaaccucaaguuuuguucugaauaucuuuuagauggaagugguaaugucuuuuucccccuugagacagggucucacucuguagcccuggaacauguuauguguuauguauaccaggcuggccuugaacucccagagauggaccugccucugccucugcaucccacugcugggauuaaggguacagacaaccacuccccccuuuuuuucuuucauccagggcauccacuccuuccucuuaccuucuucaccugggucaagggaagccgcggguucccacaucaugcuguuccuucacugagguugugcggagggaucugggaacacaaaaguugguaaagauaaacauggggucccugagcucccugucagcagcucucucagggcgccuuuucaucgaccccuguacacgcaggaacacauaccugaggcccucuaaagaugguggaggaggcuuaguguuccagggaaugggggugggcaugggagugucuggguuuugcucgcuuggcaucucaaagacagcaauucuuagcaguuuggaaaauggcucccugggcauaaaaaguucagguguagauugucaugggacuggaaagccugccccggcgaugacagaggaaggucacuagugccuaaaggcucuguggggucagaguccauccuuuucggccuaugauuuauaguuuuaccuacaucugccccugaaagauuugucaauaaguggguauuggggugggugccucaugcuuuuugcucuuuguauacuuccaacugagcaacuuucagacuacagauagauuucuuaauuuuaggaggaacugugacacuagcugguagguaacuacuugguuucuauagccagcccccuugaucuaccacucuuugcugugugaccuucuuuagguugcuaaacuucucugagaccaauuuuccuuuuucuauaaaaugaaggucacagugauauuuaucugaaaguguugcuauggugacucucucuugagaugcugauacccacacuugggugugugucauccuuuuccugguaccuucccaagcuugacuguauggugaagggucacugggaggacuaaacgauguaguauaugccuaguggaaacagacaugacugguggguuuuaugguuucuggcccuguuuucuuacaugaaagagagagaccugcaccagauggucccuaagggugagccaguuccaaggcuugaaagaggaaaaauugcugaauuuaagguuagcuucuuuuguuucucauguauuuucugcaagugagaauuagauguguuucaucagaagucgggcauggaacagagugaugaagaggaaggucagggccuuuuaaucauguucuuccuggacaacuaccgccuagccagcuagaauugccugcacgguggauaauguuugcccagcaacaccaaccggaaacaaggcauccucaggguuaaaauauuuucucugagcaugcccaguuggugccugucaaccuacugagcuucaagguaggaacuuguuuuaaaaaaaaagaagaagaagccagagucacgugaccucuccccaaauucccaauauguucuguauuuaggagaaaugcuaucuuugucacugagaugggcuucaugacacacagcaggcuacuguuucuucauguuauuuuuuuaaaacauauguuugaaauguauuuuauauaccaugaaauucaccccuuugcaaaauacagcucagugauuuuuaguguauucagcgaguccccagugccacaaucuaguuuuagaacuuguugguccgccccugaccuaauauuuaucaccagucuggccaugucccucuuucccaugccuagacccuaucagcccuucaucucacagucugccucucugcauagggccauuuuacaggaauauaaccauaccccaugccgugcuuugugacuaagcucuuccacuuaacauguuuucaagguuggucuaccuguucaacacacauaugagaacucuuccaaucuuuucucaaccaaauacuauuucgcugaguggaucucuacauuuguuucauccacugccagcugcuagacacuuggguucuuuccccuucuuggcuguuguggauacuguugcuguucuguggauacuguugcugcucuguggauacuguugcugcucuguggauacuguuguuguucuguggauacuguugcugcucuguggauacuuuauuacauuacaguguuugcguguccaugucuucuguacacauaggaggggaaguacugggucacuugguaacucuauggcuagauugugagggcaugcuaaaauguuuuucagaguuccugcaguggauacaguauuugaaaauaaacaauaauaauaauaauaaaucaacuacuccagguauacuucauggccuguugcuguugacauauucuugaguccuguuaugcuuggugcuggguuuuguccucagcgauccugggcauccacuugugcuaaccuacuccguucucugauuggagcucuuucuuuuccaaguuuaggauccuguugugugucccccccccccucguccuugagucagucaaucuuuaagcucagugaaaagacauacugugaaaaguuuauuucaccugaaaaugugcaugaucaggaauucuguggcuguccucucaggacaguuagcacgcuaaagaguuagcagggaaagucaaagcaaugaauauggaacucuggaguaagguaugccacauccuuggggaggaagacacucggcaaccgucggugguaaccuuggaugcuagaccaugggcuugcagucaaaccaaccgggucaaaucgcauugguuauuugauuucacagggcaucaauuuccucaucuggagugaaaacaauaccuaggacccaggcucucuugacagacuaaacaagacaacaccaggaagcacggcguucaggguuuaaugccugugcucaaggaacugccgcuugccgcucuggcccuuucauacucucugcacccaguccuauaguucucagacggagcacugcuguauauauaauuuuaaauuucuccaucuagauuugcuagucaccacauuaaaagaacaaucaauaaaaaaaaaaaac

SEQ ID NO: 492 - RNA, 651 nt, Mus musculus
cugagccucugcugaggacucagcugccucccccucgagcccccuugcuucccgucgcucagucccuccugcccaccuucucccacagccgccuucagcaggccguuuccaccaaggaaaaggaaucgugucauauguccgcuauccagaaccuccacucuuucgaccccuuugcugaugcaaguaagggugaugaccuguuuccugcuggcacugaggauuauauccaucuaagaauucaacagagaaacagcaggaagagccuuaccacuguccaagggaucgcugaugauuacgauaaaaagaaacuagugaagguguuuaaggagaaauuugccugcaaugguacuguaauugagcauccagaauauggagaaguaauucagcuacagggugaccagcacaagaacauaugccagcuccugauagagacuggacuggcugaggacgaucagcugaaggcucaugggauuuaagagcuugugacucucugaagcucaagugaggauuuccuugcagugaguagaauuucccuucugucccuuuucacaaguuuaaaaaccucacagcuuguauaaggugaucacuugggguccacuuuuaauuuggacuaguguaacuccuucaugcaauaaaccgaaaagagacaaa

SEQ ID NO: 493 - RNA, 19714 nt, Mus musculus
agagguggagccgggccgagccuugauuggucgaggugcgcguggucacggaucaagguucaggcuaagagaaccccggugcaguucuacuucggugcagggcguggaagaugcggaaggugguuuugaucaccggggcgagcaggugagaccuccuauggaaccccggagucuaugcggggggaagcgcaggucggugauucacuucgaugggguccgcagagaccccguucccuggcuuuccaagagguguggucaugccugccucgcuuggugcucggugcucgguggcuggcgcuuugaauuaaacaugacaguggaaaggaaagcuaaaccgccagugacuggucagccuggcagugaugcuggacaguuguucucuagggaccgucagucuccgagaguaguuaauuguaggugcccacaguucacuuuaaaccuaaacacucgggguguuuaaaugucagcauccaugaacuuuaggacaaugaggaaauuucacuccugcagcauguuuucauauacucuuuccaggaaccuacagaacgaccagucuagcaacuaaggcuuauccugaugcagaugccagcaaaguuauuccaggcuugcccauuugacccuugaccuacuuaucauuuguugaugaagaauguguggaggauggacccaaccaacuccccuccuacccccaauugguuacauugcuauuuuuugaggaauuaauacaggauuuguuaaaugccacuuaagccuguuucagugacccaaucacaucuauauuaacuaaaccaguggaggggucugucuugggcuuuuuguuagugugcgcucuccuuuaggucagcuggguuuuggccguucucgaguggaaagugccuguagaagucagaccugaauuggugugauuuugauauacuguggugugugcaacuuauacuaaaguugguauuuaaaguaaggaugaauaggccgguaucugcuugguacuuugcuggcagggccgccagauucuguggauuccagacucacuuuggagcucccuuugcuggcagucugcaugagaacuuacuguuacccagaauggccucgcuaccagcagugggccccaucugcugcgaccuucauaucacucuuugugacccagugcaucugaagccuccuagcucugcucuuuccugcuucuuugucuucggcucuaucugcuugcugauucugcuuucugucuacuuguauugagggcuuuuuuuuuuuuuaaacucuuggcuauucugcugugacuuaguaguugacagggauuuaacuucaagcugugcuacuguguauucuccugaaaacaaaacaaaacaaagcaaaaaaaaaaccccaaaaaacaaaaacccaaaccaaaaccucaccgguugguucacuuacugcgauuuacaguuuuccuaauagcaacaguaccaagaaguggugagaacccuugccuuugcgggaccaaggcaccacaagaaaauggggacacgguaaacaacuaauacggccccccuuaaaguauuugcuagagauauauuaaaucacacccuaacaggugcuccaacccucacucacugugucauugaaccauauuagaggggaacaacuggauguugcuuaucaacauggcuaaucgggagauuccuucuucacauaauguuuggguauuuucuaucugcuuggauuucucauuggagcucauauugacacugucaaguuucugaaccagagagaacugccuucauuuaacaccauuucaaugagcucaugcuugugccugaauucucccuucaguggcauugggcuagcccuuugcggucgacugcuggcagaagacgaugaccuccaccuguguuuggcguguaggaaccugagcaaagcaagagcuguucgagauacccugcuggccucucaccccuccgccgaagucagcaucgugcagauggaugucagcagccugcagucggugguccggggugcagaggaagucaagcaaaaguaugucucuuugucauagauugcugucugucauaaaauuaaucaaaugagaaagggcaggaaaacauucaaagguaaugggcauagcuuaaaaggacucuucuuuccugugugguaguauagcauggcauuuaaucaaacuggacaggucagggaaacaugggaagguaauggauauaguauauauagaacaaguugugcugagggagucugacauagugaugacauucgagcccugagaacuuggauuuacccuuuccaguuggcaaaagaacuguugugucggacacuagaucuguauucugcuguauucuccguccuguuagaacgcauucaaaauggugaugcuguuuuauccagagagagauacuacggcaauccuuucaauuuugaauauauuaauuaugcugcuugauugaagccagagcuuaauauccacacuuuacuaagcauugcuucuucaugccuagcaaaauaacguguuauuacuaaaguuuguaaaguagauaaugcgauaacuaaucuggcuuuaccugcaugacacauaguagcuaaagcagcaacaaugucacuacuuaaaguagccauuuuaauaauuucaaccauaugguuguuguaugaccaagaaguacugauucauuauccauauuggcaaccaaauauauuucaaggucugguuuuaucagcuguggcucuguccugggucacaaagcagacaggauguggugccugagauucugggcgacacucugagcaugaguguugccugagugucacgggagcagguaccgccugccuggaccccacuuccuaaggggugugcguacauuaaggccuaugaaguuuuaaaacugaaaaaaagcucacucacgguugcauuucucaacuccuccaugacacauauucugaagcaagccuaauccccccagggcauuuacgguuuuaggguaugugagagcgcaaccuuuaaucaguuuaugauacguagucuccagccaugagcuccgcugcgugguuuccacuugggucuucuguguugguagauuccuggucauccagauuucagcacugauaggucacggcagaccugcugggcauuaugugacuuuaacuugccagcuuuggaggauaugaacugguaaaauagaucaggaggaagauggguuugcuugaggggucucccgugcuugguuggggggcugcaguuggauuucugucuagagauuuaacuucaaagcccuuuggaaccacccugagccaagauacucagguguccgcuguggcucgagacacugccgaggaagagccauuguaaugccagguuuacauuguggccaucuucauugguuuggaaaggguuuuucuguccucaggccuucuguguuauaguguggaguacaguuuuguuucaucuuuucuaacagugccauuuuugguauuuuacucgcagguuucaaagauuagacuacuuauaucugaaugcuggaauccugccuaauccacaauucaaccucaaggcauuuuucugcggcaucuuuucaagguaauuuccacagucuagaucagaucagugguucuaauccuguggguagagacuccuuguggggaggggcauguuacccuuucagaagcgggucacguaucagauauucugccuaccagauacuuacauuaugauucauaacaguagcaaaguuacagcgaggaaguagcaaugaaguaaccugaggaacuguacuagagggucacagcauugggaaggaugagaaccacuguuguaggugaggcugagugcaagagagguguucauuuuguugcccuggcuuugcuuuugguguguauguugagcugggggaugcugggaaggauguagauaaacaggaaggaggaguugguaccacagcaggcaagucaaguacuugguuuuguagggagcacugcccguggccaugguuuucaugguggucgagcuucuggaacauuccauaucaucagaugguucguguugaaauggcugagugugcuggucucggaacccuucuagaugaggcggcaugcuuagagagccaccagccucugaugaggcugcacuacaagaugcccggcugugugucaggaacucugacuagugaguugagagaaugcaggggacuaaugucugccugagagagucccaguauacacggaguauaguggcguucaaagcuaucuaaccacaagccagacuuagaaauauguguguuugcaacccagugcauuaauucauagagauuuuugaugcaggcgaccugcacauuuucucuuuacuuuuccuccaugaaaacaaaacacaacacacaugcaucccacuauuaggcugacaucccagcagggcagucuguuaauguguuugaugcucuuagaauuccuagugaaaaagacaaccugguugacuuuuccaguacuuaaacacacucaguaugagugaagacuuuuuucucaucagcauagcuacgauugccuaagaauaguuugccucuaaucugacuggguagucagggcaggcaagcaugggaaguauuccugugaauuugggugaaagaaguauuugauaucucauuuaauacaaauguccaagaaauugguauuuucucauuauagaaucaaagagugugugugacaucuuugguuauuuucaauucaaggagcuuuaaaaagucacacuacugucuucuguuguuucagaaaugugauucauauguucaccacagcggaaggaauuuugacccagaaugacucggucacugccgacggguugcaggagguguuugaaaccaaucucuuuggccacuuuauucugguaaaaagucuggggucauacuaauuccauacuuuauugcugugauccugaggugugcacagacauuuuacugugcugugaggcucguuaguuuaugguuagcauuaaaucaucaaguuuuuacaucugaucacugaccuuugaaaaugcugcuuccguagagcauggaggagguagauuggcagacauacagucucacuuuaaaacaacagaaaauaacagcagaaaaagcaaguucuauucuaaguaguucuauaaacagggcuuggcaccucauagccugggacaguaagcgugcugucauuaaacacugauacuuaguuggcuuuucguuaucacgguuucuucuuaagccuccguacuuccguacuuggauguacaguucuagaaauauauaaaagagucaucaugagaugguguggcuuaucuaguguguucugugguguugcuucugacccacucucaugggguggcuuuaauauggcaaguaaguggccagccaugauggcauuauaguuuacuggugcuaggagaaaugugaugcuguuugcuugcguagaaccuguauuuguuauuucuaaucucuuuuauuuuugaucccaagucucuuaauuagaccccaaugaggccuagggugucuuuauuaaaaucggaauguggaacucuaguauguaccaaucauuaaaggaagugagugacauaacuauuucugguggccucagguaucuucuuaagaaaaaauagagaaguauaauaugaauaguauacucugauugguaaaaacaagauauauauauauauauauauguguguguguguguguguguguguguguaauauguuuuuacauggauuaaaaugaaacagagaacugguugccauugaugaacuuggguaccaggauguuaggaaugaguagaagauucauauuucauugucugaauuuuaaugcuauucgguuuuugugccauguaguaucgcauucuuacugacaaugaucuacuaacauacaagguuagaauaggauucucaucugaucuuuucuuaaguaacuuuauagagaaauccaucaucuaauguguccuugaucuccuuagaaucuucucucguuucuuugcuaccuuuuugaaguauuaaguaagauaguuauuuagaagugugguggcucacaccugucucccaacucuuaggcugagauaggaggacugcugcaagcuuaggucuauccagggcuacagugugaggagcucuuuucucaacucaaacaaacaaacgaacaaacaaaugaacaagcaaacaagacuaaaauaaaacaaagugguaaugaguuaacucauuaauaauauuaauugucuuauguuuugaugaaucugcuguuuacaaaguuaaguuguuaggaaagcaaauagagcugugaucauggggcagaugucacagguguccuggcgugacuuugucuaggcagacagcgucaucgugggguucagaauccacguagcagagaaacggaugccaaagcuaugauugcaaugccgccuucuucaguuacauuuaggaaucugaccaaauuucauaaaacacagacugaagacaugggucccuuucuagucuggcuagcaaugaccagacacuaagaguuacuguagaguggggauccuuuaugugaguugcacaucccugaaguaguaccgguuaggaguggguaacugagucucaugugugugggguuuucuuguuuggguugucuuauuuauccacugcagcguggcccaugucuggaagcuuuagugguagaguuuucucuaaugaacuaacguuuuucgguaguuguauauuuauaaaacuugugcaaggguggcacggagaguccuuguccauccugugugcagugucuucucuuaucugcauuuuucuaucaguacugugcacuuguaaaaauaaacgauacagcacugauaaguuauuaaguauagugugugcuaaaguugcauguuuuauuaagucucagucuuagcucugggauucuauccagggccucacauuacauucaguagucaaggcuccuuaggcccuuuguugugguuuugaugauccugaaaguucauuuccggggcaucaaaguucagccuggcauuucccagacuggcucucgguuaauuucucugauguuugucucacagugagauuguagaguguuuuuggaaagacuguggagguaaagugccugucucaucaccucacaucaagauugcuaugcuuaucaucccagcacuugggguuggaggcaggaagacugagcuagccuguuacuacacagugagcuccaagcucaccgagcuagccugugcuacacagugagcuccaagcucaccgagaugcacagcgagauccuggcuuggaugaugacgacuguagagucugugaccuugaucaccuggcuugaggucacucgucaggcuucuccacuguggugucguccuugggucuccacaguguaguguucagaagacuuuugcucugugugagccacacugaggggguugggcuucaccuuuuuaaaggguggauuauccacagaaacuuuuuggaauuuuuccaucaggaaaacuucuuucguccauuuuaaaaauucaauucauuccauauucaugcauaaucaugguuauauacuuuauacaucaaaggguuuuauuuaaaaauggcauuucucucucuagucucuguaacauacacuauacgacauaggaugguaauuagaugugcuuacaugacuauccauaauaccauuucuucuuucuuuucucauuucauuuuaagaugggaaccaagauaaacuguuauuagaaauaaggaucugggcucuuguuucuacuuagacguuaauagcucuaggcccuuucagacagcaaaccguggagauaaaugugugcauucuaacucaugaguguauauauauuuauacauacaaguaguugaucuaacaugaacaaaccguaaugucuguaccccuuccucuuugcugccuauaacccuucuagcuucuugcucuugcaauaguaaacccguuccuugcuaccauauccccaugaguguacuuguugaauuccgguguccauagacaaguuuuacacaaguuagcacaugccccugguagaucaugacaccuuuuauucugcgucuucuucauucagauucgggaacuggaaccacuucucugccaugcggacaaccccucucagcucaucuggacguccucucgcaaugcaaagaaggcuaacuucagccuggaggacauccagcacuccaaaggcccggaacccuacagcucuuccaaauaugcuaccgaccuccugaauguggcuuugaacaggaauuucaaccagaaggcaaggccugucucagagaugccaaaguuaaucaucagaguugcuguuucuuaggggagagacaagcagcauccauccuuuuauuuauuuauuuauuuauuuacuguucugcauucuugaagaacuaugauccucugcuaagagacacugguuaacuccaguacagccacugacuguaucuacucuucugucugccugugucauuuaaugucuuccccacugcagcuaaguggcucucacuaucccaguucuuagaugagaacacucacguuuugagaaguuguggcauguacucagccuuacaccucccagccugucgugcugaugacuaaaagguagucaguaguuuaaaccucguggaagguggugaugaggcuccguagcucugucucugugagcuuacagauugccgggauguuuauguaaaugagaagaugccccuuaucggucaugcuggcuccugcugaccaccgucaccuggagucacugcugcuuugagugaaccucuugcccggguccaaaaucuuaacuggaauucuugucuuucccguuggcauuuucugguuguucuuaccgcuuggagucagaguguuaguccaacuaugaguuuccuccuaacaucuugagaucuuuagaauuugccacagcuguuuccagguccucucagcauuccuuucagagggcaggcucaagcugaauuaguuccauguuucauaaaaagcucugggauuuuuauuuuuauucuuuuuuuacauuucaauugucaaguaaaauguaggcuuuguuuucggcucaugauucuucuuucucagugucgcaggaaggaaaaccuuaggauuacauugggggauuacaauugaagccuucguaaugacuuuuuuuuuuuuuuuuuaaacaaauuuuugguuuacuuuuuuuuaaacaaauuuuuauuguuuuaguauuuugggggcuggggaucaagcccugggcuucgugcaguaccacuugggcuagagcuucgguucuuguuaacuuuugcauccugaucccuguaagugauuuuagacuuacaugguccuacuaagcagcaaggacaacugagaguccaaacuugccauucccuggauuucgggcucauaugugugugugucuuuuauuaacaagccucccugaacuuaagucaauuugcaucaaauuaaaaucuuacugugacucuccucugugcucccagggucuguauuccagugugaugugcccaggcgucgugaugaccaauaugacguauggaauuuugccucccuuuaucuggacguugcuccuacccauaauguggcucguaaguggcaagcgcuuauuguuauuauuuuuuuaaucugguguuaugaaauugaagaauucaacucauaagcaccaggcagccauuugacauaaggguuuugaugugccguaaucauaaaugcaaauuuucuuucuuagauugaaauuuguuguugcuguugcggcucuaaacggccacauaacguuguuguuuucuuuucaucagcuucgcuuuuuuguaaaugcgcucacugugacaccguacaacggagcagaggcccugguacguuacuaggguuucauugccuguauaguggcuuugugauuggaggguaagcucacugaugaaagugagcagugucaggggacaagguuguaagacagaauuccucagccuguggguugugaccccuuuggcgucgaaugacccuuucacaggggucacuagaccauuggagaauacagauauuuacauuauuguuuuaugauugggcgucaccacaauaggagggacuauauaaaagggucucaacacaaagaagguugagaaccauugcuccgugaacaagcaaauuccauuugagacaaaauucgguauaguguuacaaacucgagguuagaagcuuagcauuuagcaccugcugggacacuggucucugugacucuagagagcacaccucuauagaagcaagauguaccaggagcugcaggaggaguggcaggacacuacagagucagucaaagcaaggugauagccagugaaugcuuucccaugggauagggguaagaguaggggcaacaagacuugucgucuuauguaaaagauuuucuucguggagccggagggguggcucgcuuguucuuauagaugauacagcuugauucucagcccacacauagcaggucauagcuauccauagcuccaguuucaggagauccaacacccucuccugacguccacaggcaccuggaauacaugugguacgaugacauacaugcaagcaaagcacuuacauacauauaauaaaucuaaagaaaaaacauaaagauucaccuuccgcucuugguauuagagaaucaagcugccucacuaggauuuccuuuacuggcgcuugacaguugggcucuccguguuuccucugcuggggcaggcauugcucggaagccauacgucuguuuccuucgggccacucguaaugucuuugcauauuucucaacucagccccaaagcucuacugauggaucaggauucucauacaagaaccugccucccccaugccauugaauuggaacccugcugucuuaguuuugaagggugugcuccauccaccgagauaggacuuuuauccuagaaacuugcaggcuagaacugugguguccaggccucguuauuuuuuuuuuaaaucuugaccaaauugaguuugggggggaagcaugaagggaaugauacacauuaaagaaucaaauaguuucugacacccagugauugugggaacgggugcgauuagacuguguugguauagcugccaagauagaaggaccuuuaauguggugcuuuagggauuccucauucugcauaucuggugugcaagucuugucuaggcguuagguguauauugagcaccaguggugugggguguauuuagaagaggggcucacaguacuugcugccauuguugagaaccaggcucaguucccaguccccacagggcagcucacaacuaucuguagcuccgcucccaagggcucuaaugccuuuuuaaggcauauacauucaugcaggcaaaacaccaauagaacaaaaauaaaagcuaaaacccaucgagaccuugcauaauuuucuaaguguacacgcauaaaaggcagacaucaccgcagacaucugacucacucacaucuggagaggcugcuagggacgaugaaggaugguagcucaguuuugucuccucacgagggaggcaugagcuugagcuaaggcacaggccaaccaugaggaugccagaauuauauuaccuauucacauccaaguucuccaguuccuagcuuggaagcuuugaacauuguuccacacaucuagguuuuuauuguauauaaaauagaaagaaaggcaaccaguggaggcagggugugauggaggacuagguagauuuuagcagaucaggguuuucaaaaaaugauuuuaaucauaacaaauacaaugugauggcucaauggaguaaaauagaaaguuuagaaggcccaugaagagagauuuaguuugugauaaugaccagaaacaaagggaaaagaugggcuuuucaagcaauaucgucaccagaagggcauaaaagaaagggucuuuauuuccuguuuuucacuaaaauaaaguucuagauaauugaagagaacuauaugucagaguuaaaauguaaaaguauuaggagaaaauacagggaaauuauaugaaguuucagaaugugaaggcuuccuugucagaauguggaaucucuaagagagugaaaauuaaaauuagcaugaucccaaacuccacuauaaacaaggcacagaguagaauacaaacaucugucuuacacaaaagguaaauauuuucuuaguaaaucacaaacuccagcaaauggggaaacagcgcuuguuggaaucgcagguaaaaggcauaagucacaaagauucuaaacggguuccgccgugugcaaagaugccugaccuugcugaugcuaagagaagugcaaacuaaaucuauaauucagagcucagcucagauuagggaagucuuggauguuuggugcagagcugugauggcuuaaggaacugagcccgagccuguguuacacagcuucuguggcggacucucuggcggguagucacguguuaaaggcgcguaaccuucacugcagaguuucugguuuuggcaccgcuuuuauagacggagucaggcuguggugaaauguacucaccaucccucgugguuugguuaccgcauacauuuuuucauuaaaaguugaacauaccaguuccagcuucugccccgauggggcucuguucuuccaaacagcucgguauccacagguuugagaagagaaacugaagguuugauguuaaagcggaaacucccaugugccaugcauacccccguuuaagagagaaggaaggguauguguuacuaaaugaagagauuucuuugccugaccacaugauagagcaguagguuccucccggagacggcugcgaaauugcaaagagaggaagacuucuuuuuuguaucaugcacaucuuuugaucaugugcaucuucuuacugguaaaauauugucccagugaccugugcuuuauuaugcugugugcuaagaaugacauuaacuuaagccugugggugagucccaugacucauaggaggacuaagggaguagaugggcgaagugagaauugguuuuuguuuuguuccguuuuauuacucugcuuagauuagcucucaaagucuacuguggagcaggcugauuuacagugucucuucaaaauaugauagcgguuuccaaaggccuuuagaucggcuagugcuuuuugagaggacuuucgagguuucuuuggggagcccugcagaguacugaugguaaagcuuaccugcuuggggcaggcgcagugucacagaugucacugacacgcucuuccuuuccagguguggcucuuccaccaaaaaccggagucucuuaauccucugaccaaauacgcgagcgccaccucgggauuugggacuaauuacgucacgggccaaaagguacauaauccguugauguugucaagugagaugugcagcaucacaggccaggaugcggccugugauguucacaaacccaucugcuuggcuucugcauccgaguccucaugcuggcuuuaucacgguccauuucauuacucucagcuuucuccugucucagagugccgggcaucuucuuucugcuaagccucucucaccuuuguucuuguugaugucugucacccaucagaacucaguuucuucccagccuucucugucucuuuagaacaggccccaugccuguggugggauuucuuguaccuguucuguggaacacucacucucgggugccccugucagcauauaagcuuuucagggaaggagcauaccuguuucccucguaugcugucucacguggaggcuuuuaauaaauaaauaaagucguauagaauaccaaauacuucucugugaucuuaacuucucucugaaugcacauucuguuugagauaauugccagcuuugucagacagcuauuuugaagaggcaaggcauagaauagagaaaauuacaucuguauugagucuuuuggagucugaucuaaaaagaaaucaaauagaaucgcacagaggugggguagagagagauaagagcauguaccugggauuacaagaacauggugcagcuuugucacgagcaggguuuauuauagcauccuguuuuucucugcccagcucaccgaggaugcauugaugcaaaauagaacuagacuggggcaagugugugaccucugucaguuugacagcagggugaguccagugaccgccagauggguauaucacuucccaugcuaccugacgcuaaaaccagccuuuucuaguuuucaaaauguguuguguugguuacuagugacuugaggacauuuuugagaaacauuuccucagcagguggaguugcguggugcucccuggccgucugcaccguggcugggcuggcucaucaccaugcauuaacccagaaacggcuuugggaaaucaaaaccguuaaacagacaugacgugguugaucuggguuuuacaaacuguucaacacugcaugaauuguuuuguuuaagacauggucucacuaaaacauucuugcuggccuggaacucuaaucuuagugagggacguuuucguugcuguggcagaacaucaggagagaagcaacuuugggugggaagggguuauuucauguuacacuuccacaucacaguccaucagugaggaaaguuagggccggaaugcaaaaggggaaccuggagccuggcaccgaagcagaagccgugaaggagcgcuucguuuuggcuugcucccacuggcugguucauuugcuuccugauagauagccccaggagcgucaucccggggggcuggagcugcccaccuugagcugaguccucccacaucacucaucaaccaagaaaaugagccacaggccagucuggugggagcauuucucucaguucaugcauguuaccucuuccaaaaugacaguugugucaaaugacaagcaauuaaucagcacagacuaguuauauaccagguucaccuacagaggcagaucacagagaucugccugccucugccuccugaguacugggauugaagauacgcacugcccugcauaucuuuuuaaaaaaaacaaaacaaaacaaaacucaaguuuguguuaauuuauaauccuuaauauauaaaagugauucaguuuagaaacucuguuauaaauuauuaagcucccuuuggggcuuuuagaguuuauuuaaacuuauaaccuuacagggaacaauuaaccuaucagugggaagaaaauguuuaauuccacaaacccaagcauuucauuaauauucugugaggcacauugaagagaauacuuuagccuuugauucauuuguggaaaucagcuuugcccucuguuaaaggguugagggaaguagugacugcuaaucuugggguuggagggcagucauugucuucaguuguguauccacugagaagccugccacgcugcagcaggccgccacacccaugcauguguggaccaccucuguuaaacccagugugccacaacacaaaccaaaaugauacgaaagccuugcgggcagggaggaguugggggggggcgugagaggcagaggggcugaggacgaaucuaaccagaaugaagauuuuuccugggauacauuucaauaaaggugagcuuggacagagagaucugugacaucugcagucucaguccaaauagugaaaagaaucaaaugaggagaaauguuacuuccaaaauguugaagguuuccuuaaccccuagccuuuaggaagagcccgguuuuugagguucaggcuccucguugauuaggaaacaaagagauccuguuuauaguucuuguguucgguugaaguaagauuuucucuaggaagaacaagaauacaacauaauagugauauaagacaggaucuccaguuucaugcacauaggagcacuuuggaagcgggugaguguggacaggaauugagaugugauuccccgcacuccccguuucccucaugguuggguuaggaguuagacuaggaaagacauuguguaucucucugccaaagcaagcagcaggagauuuggcggaugccaguuugcaugagcauuuccguccucagguguuucccagcugccccuuccugccccuuccuagcguccaguucucuuacacgcgugggcgccucccuuugcgccagugcacuguguuuuguuuuuucuuuugcagucaucuuuaucugugcuuguuuuccagauggacauagaugaagacacugcugaaaaauucuaugaggucuuacuggagcuggaaaagcgugucaggaccaccguucagaaaucggaucacccgagcugauguaggcguuccucagggcaccccgugggcaccuccuguacgccauggcacacguggcuuuccaucucgcugggugauacacauuugcaguaaaccauaagccaugacgaucucuccuccuaccuuucacagugaucuccaagacugugugugugcacauuuuugcaggcgugcacacacaugugagaaaggacuggcaaaguagagggaccaacuacuuaccccuccagagcaguguccuguuggaacugcuagagguuuccugcggugcauccuuggaucgcuuucugccuccuagagcccaguaguuuugacuugugugauggggacacaguacagccugaagcuucuuuuagucucagcacggaggggcaaugccacuggguaggacuucuacuucuuguuuuuccuccacgauccccucuuuuacucucuuuacauucuccuucauaugcugcuuuggcuaaucuuauucauucaugguccguccauguagucauuuucaagagaaagguauucaagagaaaggugugaauguguuugggccacaagcauuauuuucggucuuuaauaacaucuauacuauagauguauucauuaugaacagcuuauugucaugaucauauuucacuggaauuaaacuuagagcaaaagaaaauauucauguuucaaaaaaaaaauuuuaaaaacccugacaaacugcuaggacgccauccgguacacaguagaagcagaagaguugacuuuuaugugucagaugaugaguuuuucaaaccuuuucuccauaaaucuuaagagccaucccugaguaucagaacgcuagagauggcaagacauuuuuaucauaaaggcauccuaucucucgggauaaaauucugaacaaaaguaagaaagugauagauacauaaauauaaucucccuacaacuugugguaugaaaacuuucugguuagagugucucuaauuuuguugacuacguuuucuuuuguaaagauacagaggagaaugaguccacacccacgggccccuccucugucucugggaagcaaggggugguuuuucauucuucauccugagugagcccccacuuggcaaaggcuccaucucagggggaacucauguuucucaucugcaaagcaaagcugucaccccccuguucuguucuucgcggccuugccugaggauccguguucugugugaaccaugagaauuccucauuuugguagagaaucagguuccuuagagaucaauaagccagcaugcugaggcccagacacugcaggccaccgcccuucugaaggauggccccuucucuuccccaugugcuuguuuccaggagacaguaccgagcucugcagugguauggggaggauuagggucccugcggcuggguagucauaaccuuaacuugccuugagagaguggauugagaaaaagcuuggguuuugcuuauuugugaguuuggagaaaacacccuuuucugggguugucaaguuauaaacaucaaguuauucuuagaagucuuuauuaacuuuuugcuggcuucauugggaauucccucuguuuuauuccugauacuaguaucugcccauggucagcaaggcaggagcuuuuccaguuugcugguauuugcaaagaaccuuuguuucugccucauuuuuuuccuaguuauuuacauauuauccauauagauuauuagcucuacuuguuuuaauuaucuuuuuguuuucuuugacuuaaaguaaaacuuuucuaguuccuugaguuaaaacuuagguuccauauuuggaaaucuuucuuaauuguugcuauaagcauuuacuuauaagcauuuaauuaucuagaugcuauucucaucccacaugugccgacauuguccggcauuauauuaauuuauguugagguuuccuuuuaugaauuauuaagcaauauucaaugcucauauuuuuagagauuuaaaagauugauacuggcugggaagaugacuuagugguugagagcacuggcugccugcccuggaacgcacucuguagaccaggcuggccuugaacucagaaaaucaccugccucugccucccaagugcugggacuaaaagcaugcacuaccacugcccggcuacuggcuacucuuucaaaggacccagguuugauuccuaggaccaugugguggcucacaaacaucucuaacuucaguucuaggggaucugaugcccucuucuggccucgguggguaccacaagugcauccgaugcccaggcaucugugcagacaaaacacauaagaauaaaucuuuuaaaaguuggaacuggcuucuagguguagucuguugggauuucauaguuugauguuaauauagucaggguauauuaaguccuauuucugcauugcauuucuugacuuuuauuuauuguacaggaucuguugugcuugaaugaguguucugugaauuuuucuucacaccacaccagcucguaucuccuccuuggaacacucuuguuguucccuuuguguuuugugcggaguucacgggugccuucaggcagguguugugugggagggccgcagugcucuguuagaagcaguauuucucaccuuuacaccggcuucauuucucuugugguuuuacccuucuguuucuuuccugugcucaguccguuuuucuuguucuaugaccauuucugguuuuaauuuuaaaauuuugguucacguuauucuuaauuuauuuucauguauuuauuuugcaugcuugggcguauugaauucagggccuuggggcucaucuucuuucuguaguugauucccuaggcuggaaugcugcuggaaugcugcuggaaugcugcugugguacuugucaacugaggcuuuuguucgguugguuuguuuuguuccaguuuuguuuucuucaguccucaauaaggucuucgauaguuauuuaaucuaaaauuucaucauaucccucggguucuaucauccuuauuuacuuuguaaaaaaaaaaaccaaaauauuuauuugaggucugaagagauggcucagcacuuaagagccccgagugcauagcuucauugcuucuguaggcuccuagccacauuugaagcugccgcucucagaaacguauaccagcgcuaaguaacuugucuuccuuguauugauagagggugcuuuaaaaaaaaauuaccuauuuuucugucaagcuguguauuuaugucucuuacuauuucuuguuugauuuuucaccuuugguaagaagagauauuauuaucuauauaauaaagaaugaagcuuuugccuaaaaaucauuuauuuaucuaacacuugugcucauuucucauguuuauuguccuuuacuuuuccaaaggaucagggccaagaccuuccaugguuguuucuggcuauauuucuaguguuugaccagugcuugccauuuccugggcucuugaugaauguaugaacaguugauugaacaagcaucuauuugaauaaaauuaucaugcuaucuugguuuua

SEQ ID NO: 494 - RNA, 138846 nt, Mus musculus
uguggauguaugccuaccacggggcuccuucaccggcaaaguggaaaaagaagugguucccgagaaagucuucuggguugggggaaccuauuggauuauaaccguuuccuucucuucaaaccugggcgucccuggacuggaaguaagugauguggcuccuuccucccugcccccaccuucguuuucuuuucuaaaaacgaaagcucuaaguggacuucucuuggugugucaggaaaaguucggaaaagcggcagagggcagaguuugaaucagggcggaagggcagggagcugggcucuucaagacucaggaccgaggcagaucucauguuuuggggucuggauuugugucagcgagggaagaacaggcgccaauaaccaaagaaggcugaagcgagguacaggacuccauagcagcugcaaguacaauaaacaguuuuagcagagcuggaaauguuggcaggcaagacaggccgaucgcagagucgggcugcuggagagaggugagccaggagcuguguuuucaggcuuugagcacugggguuugagggaccugaguuuuggugagaacguggccuaguaccuuuugugauuuaauugugggaagggagacuguggcugcgggcuugggaugagggguggcuucaccuuuggucuuggguaagguugggcgggaaggccagcugccuggaggguuugcagugggugacacgaagcaaucacuucccagacucuccuucuccccagcguugggugcuguucuuuuuguugucagagggccggucuguuagcaguugggacccaguguucuggccuacccaucuaagggacagaguucucugcaaguggcagacauacuuaggucagccauuugaggagaguuuggagaacucaaggcagcggcgccuuuagcaccaucuuaacuguucagcuuuccgcauccuucccuaguggcaauuggagcguggaaaggggggucuuugcaauugcugcggucucuucugacccguucauuacacagauuucagacauguuagcacggcccuagugccuguugcacuccacgcuuaugccuucaggcuuauuuuuaagauuuagaagagacaauggggcaagucuucuccgggcguuuaucagcuauaaaaaaaugguagaagugguucaucagcuggugguccuuggugugugugucaauguuggugugcgcgugugcacgugugugugcgugcacgugugugugcacaaaugaaacaaaaaaaaauuaacauuugaguccuugcucugaucagccuccagauauuuuccuguuauuugauucacgguucuguaaggcaccguuccuguuuuacaggaaaggguuuuaagacagagaagugaaaugaauuguucgaggaagcacaacuaaugugcuuaaaaguuguuacauccggagucugguccuccgacucaccgugggcaggucucccgucucccacuccacacuuggacuugcuuacuucuggagucaaacuucauguuucaccgggugaccaggagguacccaugccaggcuaagggaacaguuuggauuugcacucagagaaacacuugcccggguaucagauggagguuaaauuccagguacuggaugucuguuuagcuuugugaugcagagagccugggacuuuuagaguugguagacccagguuagguucugucucuaucuuugacugcuuccugcacuucagccucuguguucacuacauggaaaugagaauacucuugaguuuuacuguuuuagacucggacaugaaugcauucuggaggcuaugaagggcuucauuaggucagcucuuaugguuguaaugaaaugugaccgaauguacuggaaauuagcuuuugucaggcugggucuggcaguuggugcagacccguaagacugugccaaacucugaaauggggaguggcucuaucuucacuccuaucucuuugugugugcauaccugcacacgugcguguacaggugcacaugugcagguauguuuguguauguggaggccucggugauaggaucccucagugcccuagugcucacucaguaggcugggcuggcuggccucugggcuccaggaauccuccugucucugccucugugcauuucaggagacuaaacucagguucucaugcuugugugauuugugugauaaguacuuuacacacugagauaucucuccaggucuucaugccuaucuucuaacgggaaccauccugccucauggggaaauacuccuggauuuucucucuaaaaauucccuuguaggucugguuuguguaugguuucuuaucuaaaauggaguggguugaaggucaguagguuacucgaagcaucucuggaucugcaccgucucugaaugagcaagguuuaaucuggaggagcuucguggucagcugaggacagguccugagcccagggacaucuuaucacuggcaagugcaucucccuucaucuuccuguucugagccugcagucagaaaaguugcaguucuccugaaguaagagucuaaggcuagccugugggggccuccacgucuguuucugcuuaagauccaguugcuuguagaagugucgcggggcaaagcagaagcgcuauccagagaaaguccuccauugucucaccuccaaaaccuucccauauaacuuccuuccaggcuuacacagucacuuccgggaauggaagccauuugggucuguauuccccauagggaauuuuguucuaaccucuccacgugauagcauuuuuaacagauguucuaauaaagacagagugcuucccgccuaucagugucaugccacauacauuuagcuuuaauucagauauccaucucaacuuucuuuggaagaugcaucgucugguauucuauaucaccucaaacacauaaggcaaaucagggcccagcuaaaaauggacuaccacgacaugcuagugcgugcuggcucacaucaaugcggacuugucugcaauacagacacacuagacucuuuaugugcuuggccugcugacagcuguacaacauaugaauugcuugacucuuuccccaccaggccaugaaugugcccaauaucuccacgcaucccagaguugcucugaauucagcaccuggauuaaaauccucacaguguguccuuacagcugagaagaugauguuuuaauagacuugcucagcaguaauuuggaaccccagguaggccuuaaggacuucuagaccaguuaaauaaaaauaccaaaagguggaaaacaagaguggguaguuuguuacccaggucauucuagugugaagcagagauaaguauuugugcuggcaugagucuaaggcaguucaauucaauucuguuugauuccugcccccccccccaaauaacacagcucaacaaagacaucuagauaacuguccagugauauuuacuggaacuccaaugaccugauggugaaacugagggacuuuaagcucuuccuuuuauucauuguaguuacauacguuugaauauauuauaaucaaggcugcaugcuuuauaaauaauuugguuauaaacaauucuguuauuuugaugcuaguucuaauuuuuguauucuguucuuaaugucuuacauagaaccguugaauguuuccaacuuucuguguuaaauguuuccaacuuucuguaauucuucagagaugcagaauccugucaauugacauauuguguacuugcuagccggacucucacuuuguccuguaaacacagagaagaucagcuuugaguauuguccuggccuggaaguugaacauacaaauaaagaugucgcaaagaugaguuuagacuguugccacaaggcggaacuuccauggcucuucuagaaacuaagcucuguugacaguacagucuugucacuguguuucaagccugccuuaaaucuuugaugagcccuuuaacuugccacucagaggucagugcugccugguaucuccacagugugagaugggugauggggaaggggcaugugaugagaagagcuugccagguggcugucaauuauauuaugagguuuuggucucaacaucacuauuuucccauguauuacuugggaaguccuaucuucacugagcuacaaucuccauugucuugcucauccacuuuuauucucuuuguuugggggagggucagauaaaguaauggaagcuggaaagcauuguuuauacaacaaugguagguagggaugaccuuugguuucuuucauaggaagcuguccaguaaaauuugcugaagauuuguuaagucuuuuguaaagacuuaaauaaaaacccuaauugugugugugugugugugugugugugugugugugugugugcgcacgugcacaugucuguauguaaacacugaggucagagaaggucacugaacccccuggagcaggaguuacaggcagugaugcgggggcuggugagauggcucaguggguaagagcacccgacugcucuucagaagguccagaguucaaaucccagcaaccacaugguggcucacaaccaucuguaacaagaucugacucccucuucuggagugucugaagacagcuacaguguacuuacauauaauaaauaaauaaaucuaaaaaaaacaaaaaaaacaaaaaaaacaaaacaaaaaaaaacaaaaaauacaggcagugaugcacugccugauguaugugcugggaacugaacucaguuccucuguaagaacagcaaguguucuuaaccgcggagccaccucuccaaccucuguguuuagggucuuaauggccuaggauacuggaauaaacugagaugggagaggaaguaaucuagugcuuuucaauuuuccuuuuuaaauguaguauauuaggaauuuauaaaacaugaaacagcuaaucucagaauuaucuugucuaaggcaaaaaguuucucauuagcuuuuucuucccaaauaguguuauucucaaaagccacagguauauuuuaugaaaauguuaauugauguacaaaaagcauauuucuaucuauuauaaauuguauagcauucuggcaucaucuacccuaauuuuguuuuucucuauugauuuaguaauucuucagcaaauauuuauuugguaucuacccucuaaguucuacauuuuagugauuauaauaauuuauuaucauuuauuuuuuucuuuuuaaguguauguccauauucauguguggauaaaucucucuccucaaguaagcuagucuggccagccagugaacucuagagcucugccugucucuuccucccaggaccaagaauugcaagcaugcacaaccaugccagucucucauuuuauaaaacauggauucugggccauccaaccuagguccuuaugcuugugcaggaagcacugugcccacggggccagcaucacugccuggcccugcaggaagcacugugccaacagggccagcaucacugccugguccuucauggcuuuagacagucauuguuuuagguucugggguacaucacauggauuuggacuaaagcugacuuggaaaaugguuauucaagguuagguaauaagauuguacauuuucagguuugcugaaguacgauuaaauaacucagcaauaggaauucagaaaugguucccguacgugauaggagagccagauguuuuacaaaaagacugaaagguuuguguuuuauuuuucacaauuuccuuaagaaauuaauaggcuuuauauuuuauagcaacuuuagcucuacagaauaauugagaacagaauaucgaguucucuuaaccuuccacucucucacuugguugccccgcuggcaacaucuugcauugguaauuuuuauuuuuaucaaccauucaauauguacguauuaaacauuucauguccucuguuaguuauuacagaaggauaagagaaauauaucacauuuauuccuuugaaaccauguauaaugauacguguucauaguuuaagguccuguuuauuuaaacagcugcugcgcccuuaguacuugcccagcauugcuagagcugggacauuguaggcauccacugauugugugauauuaacagguaaaggaucuagaagccaaacauaaucugucuuuaggauuuaggagacacagucacacccagcuguaacagaagaaaaucucaaaagcaauacagagcagugcuuaagcaaggguaggggaaacagguaucagcaaaggcaagcaaaccacugcccacaugaccagugucuuggcugggacgggcccagggggagcacggagagcacuaugcuccuccucaucucuguugaucuccaucagcaucgagucauguuuaucauuccacaucugcaucaaagacugaaaacaaaccacacagaucauggcaaggcaggagaaggugugugugugugugugugugugugugugugugugugugugugagauuguguguauguaugauuguguguguuugugugugugugauuguaugugugugugauuguguguaugugucaucauugugugugugugugauucuggaagaucuaaagcaccaucacucagauacaaaugcuucacauuucuuaccgggaguaaaaugaauuaggauuuugguuuguaaaaggaacucauacccuggcaauccucauaggagcugcaucgaaaugcuuugccauccugcaacuucauagacgcuaauaaaacuuagagggugggucaggguuacagagaucuuuacaggacaacaaccaauauaacgaaacagaggguagaaguuacauucucuccagaaguguuaacucuuacuggugaccagguacagcucugcuugcuugcucauuguugagucagacuuugacucuguagcccaggcuagccuggaauuuaacuauauagcucagguagaccugaacucaggaugauacuucugcgucaucuuuccaaguguuagacuuagcgggugugcacugccacaccuggcucagacacuuuucuaaucuuaggauguauggauuauauagcuuuaaaauuaagaaggugaugauaauguaaaaauagcauaagaggaaauuaaagagaaacacagauugcugcuugcuagccuugguugaaucaugauauaccuuuuuuacagaaaugaauuaccuuuucaaguuaaaaauucccauucccaacccacgaccuagcaaguuauuuggggggauauggagaucggcugauggugaagcuuacguggagucccaagaucaugcgguggugcauaccuguauucuggcacuaggaaggccgagucaggaggauccuguucaaggccaacauacagugauaccccgcuucauugaaauaauguuucuauggggagcauauagccagcauagcugacucuauguugaugaaggaauacaguugaagaggugguaccuuaugaguuuaggguucucuauaaagcuacaguaaucuaggcagcacaguacuagcaaagaacaguguguaauagcauggagagcccuaaauugaccaacacaaauacauucagagaguauuggacaaaggaguaagagccguacagcaaagacaaggaagucuuuuuucuuagcaaacccaaagauuguagacaaucacugccauccuucacagaaguuaaagaguaucccagacccaacugugcauuugaagcuacaugaaggagauaagagauaagcuacaaaccauuaaaauuaacuuccuccuuguuaaagacaaugucaagagaaauggggauaucaaccagagauuagggaaaaacauuugcaaaagucguuuucuaagaaauacaaagaaagcugggcgugguggcacacgccuuuaaucccagcacucgggaggcagaggcaggcggauuucugaguucaaggccagccuggucuacaaagugaguuccaggacagccagggcuacacagagaaacccugucucgaaaaaaaaaauacaaagaaaagagacauucaacuuuggagcaaacagacaauugcuuaaaaaaacaaaacaaaacgaugaaauacuugaaguacacuucaagagagacggagggcacacacacacacacacacacacacacacacacacacagagucagauucccauaaagcuacacacacacacacacacacacacacagagucagauucccauaaagcuacacacacacacacacacacacacacacacacacacacacacacacacacacacacacagagagucagauucccguaaagcuacacgugcuuucaccguaggcuguagcaaauacacacucuaauauuugcuuagaugaauggaagacuuuggccacacagaacuacaugugacuuuuaucugaaucuagaguggccaagauagccuucaguugaagugacaccuaccucaguggggggcgcuccugugaaggcaagaagcauaggggaaacaucgcaguguuugcucaguuccucuguaacccagaacugcucuacagaaaaguguaauuaagaacauaucccccccccagccuguaaguacuaacacuaugacucuaucuuuagcucuuuuuuaucugaaggaaaguauugugauauaauaauagcugggcauuauuuuuauuucaaaaugauugauuaugugucuuugauagcaucauuguagcaguuguauuuuaagauugaauaguauuauuuuacuuaauaaagcaaugugaagcagaaacuuuaaagauuaccgguucaccgcaaguauccaagcgcuccaggggauauuugauaagauaaaaaucuucuugccacaugacaacuauuacuuaaacgaccaucauuuacauuauuauagcuaugacaacagacagauaaucuugcuuaauaucauccuaucauaauauccuaagauguuaugguuggaagugcaguagaccaaggguuaauaggcugcaauucuuauuuuaacuuugcaaacuuuuaacagugagacuuugcauggcuauuguucacgucuuugcacuugaaauguucuuuugugggcuggcagaauggcucauggcacgacaagugaaguugcuuguugccaaacaaagaccacuggaguuaguucacugugggccugccauagcaaagggaaagaacugacucucucaagucaccucugaccaccaccacacaugugcugugguccacauacacgcacacacagacgcaugcauacauacaauagauaagcagauguaaaaacguaaugcucauaucuagaaagaacaucacaaaaucccaguuggguucugauaaacauugccuggaacuagcacccacacccagagucauuucacaguaaaaccuugagucauaucugcugcucucugaauagaucccugucucccugcaccucagcuaaauaguccucuucuuaaagugcaagcuucaguuucaguguucaugcagcucagaucauauauacauauauauauauauauauauauauauauauauguguguguguguguguguauacauauacauauauauacauacauacauauacauauauacauguguauauauaugauguacacacacauuuuuauuaauuacauuauuuacuuacaucuggaucgaagcuuccucuccccuccucuccucccugucucucccucuccccucuccccucuccucacucccagcuaccccuccuccccuucuccucugaaaaaggggagaccucccagagauaucaaccagccauggcacgucaaguugcagaaggacuaggcacauuggaaucuucuccuauugacgguacgggaaagggguucaaaggcaggcaauguagucagagacagauuccucacuaggagucccucaugaagacacagccacacaacuguuacauauguguagcucagaucuuauuuauuggaauuccaaggauuuuuuuuuucccuaauuuuugucaggaugauccaguuaagcaaggaccauauguaacuuagguggucucuauaaaucacuuugagcaaaacccauaaaugaguucuuuuuuuuuuuuuuuuuuuuuuuaagauuuauuuauuuauuauauguaaguacacuguagcugucuucaaacauaccagaagagggagucagaucucauuacagaugguugugagccaccaugugguugcugggauuugaacucuggaccuucggaagagcagucgggugcucuuacccacugagccaucucaccagccccauaaaugaguucuuaacuggcuccuuaaaauaggcuuuuuauaugcccuccacaguucugacuugggaaauuucuuggacaggagcaaugaaagccucucaauucuguuuuugagaacauaaaagaauucagugucuguuaauugcuuucgcugucagaucaggagucaggucguguggaaaugaccuaagcacugaauguacuguugggagcucuguggucaaauucuauuucuuauacauuguaacagucgaagaaagaggcuggugucuucaugaauauguuaaaauuauuauaguuuaaaaauuaaauauuauaaaaguauuaaaauuacauuuuaauaaaggaagagagacagagccuucucacagguugacagagggguagacgugguuugugagaaauauuuuguuaggacuauccucuugccaucacgacaugaauacugugugagucuaguuuauaagaaacaauucagcuucuugagugaucaguuauuaaugugcuauuaauacauguauaaaucuggggcuggauagauggcuggauagaggaugugaguucaggucuuagcacccauauggcagcucacaggcagauguaacuccaguuugggggcuuccaaugcucuaugcuggccucugugggcaccaaggacucucauggugcauaugcaugcaugcaggccaacacucauacagauaugauaaaaacuucaaaauaguuuugaaauguauaaauaugaaacuagguacuucuaaugcuuauaagcucauacauagguguaguggcuauuccugguugucaacuugacuauauuuggaaugaacuacaauccagaauuggaaggcucaccagucacccuuaucuggaggcuuggagauagaaguuucugaucuggaucuugguauggagaacuugaggcauaguggcuauggauuccagaagacuaaaucuccaaguucaaggucacccgggauuaaaggugugguggaacacaccuuuaaucugggcuacaccuuucaucugggaauaagggugugguggaacacaccuuuaaucuggcuacaccuucugcuggagacaauauaaggauauuggaagaagggagucuugcucuugcuccuuugccugcuugcugugugagacugaguaacugcuagaucuuugaacuuccauucacagcugcgacugaaccauuguugggaauugggcugcagacuguaagucaucaauaaauucuuuuacuauauagagacuauccauaaauucugugacucuagagaacccugacuaauacagaaguugguaccaggagugggguauugcugugauaggccugaccaugcuuuuauuugaaagaauguggauuuugggacuuuggauuuggaaaacaguggaaugcuuuaaauggggcuuaauuggucauccuaguaggaauauggaagacuuuguugcugggaguaauuugaacuguguugaccuggcccaagagauuucaaaagagaagaauuucaggaugugacauaaagacuguuuuugugguauuuuggugaagaaugugguuacuuuuugcccuugucugaaaagucugccugaggcuaaggugaagagacuuggauuaauugaauuaacugcauugacaaaggaaguuucaaaaaagcccagcagagacucuguucucugguuaagucucacaaagagaagucugaacaagcauagcaagcuuagaaaggccaaauauaaaauauaugguucgaguauuaaaggcauaccaggaagugaaauggagcaaaauccuguguucuaggagauagcagauuaaggagugggaccuuggagcaagauccuacccagcuaaauuaaauccagguauagugguacacaccuuuaaucucaggagaccggcaugcugaucucugcauucaaggucaaucuacagagcaagauccaggauagccaagcuuaggcagugaaggauuuggaaaacagaaagccagugacaauguaauagcacaagcaggucauguuguaguuccugcaagcagcaaaacucugcagcuucagccacguggcucugucucuagaguuaagaauggaaggaacuacugggacaauugaugcugguuagcuggagcuaagaaauuagcagugauuaagaagagaccagcaucacugaggugaaaucuucugggaaguguuuucugggaacacaaagaagcuauguuccagagauagccaagguuguaccucuugcugcagcuggacuugguaauauguaagagucacccaggugguacugguuuugaaggcaugaagauguaaugaagaacagcugaggcuuggcacugugagaggucauggaaggccauuggagaagguguagccucagcuguaguugauggcccaggacugaaggggucaugcaaaggaggcuauuggugaagccuaguuggaguggaauaccccaguguauuggagaugucaguaccauggagugaucaccaagagcugcagcuguaguggaguggaucaaccugagcuuagagugcuacagagggcagagcuggagaagugaugccagcccuuaggaggagucuaaaagaugaaguggaaucccagacacugaaacaagaagcuguaacauugaaauugccuuggagacucagagauguuaaagaugccagagccaugggauacaugcugaggaaagcugcuaacagggaguggaaacagcccaggagaaagcaguuuguugcagucaacaaagaugaaaaaggaguggagaucugaagaucgcuuugacaucagccauggagaugcagaguuuggaguuugcccagcugguuuccugccuugcuuuggggauuacaguuaauuaaguugaaugaaucucagaagagaccuugaacuuuggacuuuuaacauuguugcgacugcuauagacuaugaggacuuugaaaguuggacuaauggcccccauagacucauguuuuugaacaagucuauggggaccagggaguggaauguaaugguuuauauauccuuggaccagggaguggcaccaucugaagguguggccuuguuggaauaggugugaccugguuggaaugggugugucauucuggguguggguauaaaauccucacccuaguugccuggaagucagucuuccacuagcagccuuuggaugaagacauagaacucucagcuccuccugcgccaugccugccuggauacugccaugcucccaccuugaugauaauggacugaaccucugaaccuguaagccagccccaauuaaauguuguuaagagacuugccuuggucauggugucuguucacagagguaaaacccuaacuaagacaauagguaaccauaaagcuaaaauaaauuuauuauuagugcaagcuaaggucaauuuauuggugcaaucaaaugauuagugaaaucagauucaguuacgagcguggcuguaaugggacagaugauggggcucggugugaauuuaucaugagugaggaagcuaguggcuggcacugaacagccuuuuacuuguaacuuggguuuauuauauuauauuauuauuauaauacuuaugcagagaaggcuugcugguguaggcccauugaauaaauugucuuagccucgaggauuuauuaacuuagaagacuuggaucucaaccaaaaugcauuagcaguuaauggucaauuguuagguuuuguuguuguuguuuuguuuuuuugguuuuuuugagacaggguuucuccguguagcccuggcuguccuggaacucacuuuguagaccaggcuggccuugaacucagaaauccaccugccucugccuccggagugcugggauuaaaggcgugugccaccacaccuggccaauuguuaguuuuaaauuugaccauugacuaaauugcuguauuauuuacuugucucauuucugugaccaaaugcuccccccuaaaaaaaaucuuaaagaaagggcuguuuuucacucaugguuaguggaugcggaccaucauggcagggggcgagcagagcaggcaugguggggaguguggcccuagcugucugugcaggagugugagguagccacuguagacauuggguccacagucaggaaacagagauggaugcugguagucugcuuuuuccaauucucuuuucuuuuuuaauucagucugggacccaaguccaugguauggcaaugcugucuucaaggcaggauuuuccuccuuaguaaacuucugggcauucucucaagggaaggucugcaguguaucuucuaggagauuccagugaccauuaagauaaaguaucacaauugcuaacucacuugacgacaagguuaacauuguggugacauuaaaacugggacuaaaugugcauuuaaccccauuacuaauagaagcuggacgaaaucauucagguguguggguuucugcccuagcucucuguguauaagcuaguacacgcugccauguaagauuucagauuccaaagcucacaucugcccgcagcagaacagcugugucugaauagauuaaacugccucauguccagcagagacucaguuuccccacugcuucuucucuuuccagauuggguugaucuggcuuuuguuugauguuugcacaauuaugaacacaaaugaaaaagcuaggugcuaagacugaauggauguccccaccuagcuaucucuuauacuaaaagucaaauuagagaauugaagauauagucauuuuauaaauucuagaaaucgugugggcuucaagaauacauugacaauaaccuauuacaagaaaacuaauguaggguucuauaauagcuagucccugucaaccugacauaagccaguaaucuacgaagaagcaaccucugcugaaaaaaaucuuuccaucacagugucuuggaagaauguccgugcagaauuuuuuugguucauuauugacaugggaggacccagcacauuguggguggugccaccauugaguagguagucaguccucuguuguauaaaaaaaagcagguugagcaagccauggagagaaaacaagccugaaugcagcauuucuucauagccucaguaucaguuacugccucuagguuccugccuugaguucuuacucugccuucccucagggauggggcaugaacuguaagcuaagcaaacucuucguucuccaaguugcuuuuggucauuguguuaucauagcaacagaaaagcacauuaggacaggcuugguacuuuccaggaagccuucuuugaucuucuuucaaaucucacuaauaauuauuaagugcugcuaauaacugauuagugcuguugugcauuguagaaaauucaagcacuucagauaaggagucucuuugaaacugucaaguauggcaagguagggacuucuguuuugccucgggacauaugacucuuagcaaaagucaggcacaggguguggaaguagcuuacuuagaauuugaaccuguaccuuucucacugcguuauacaaaucuugccgacuccuuauccuccagaugucuucauuaugcauugugagucuguuauuacaaguaggcauaaugacuuuguguguguguguguguguguguguguguguguaugugugugugcaugcauauccauguguguauguguauguagaugccagagguaaaccuuagguaucuuuuuucaagagccauugguuuuuuugagauagcuuccuucacuggccuggaguucaccaagcagaugaggcuguggcuggccuaugaacaccaggguuccaccugucucuaccuccucagcacaccaguggaccugacucuuuuuuuaaaauguggaucuuaaauauugaacuuagguccugcuuguguggcaggcgaucuauuggauaagccccacucgcguucccaagaacagcuguuuuacaauuaacccuaaauguuuuucuuuuucuuuuauaaacuaggccagccuuucaucuggcuuucaaacuuccaauaugcuucagacuuacccggaaugcuuaaaaaaaauauaucaggcuuugcuccagccaaugaauaggaaauuuccagccagugucuagggggucacuauuuguuuuagcagucuccuucagacacacacugugaguaaaacaccuguaacugacuacagaugacucagguaccaggacugacuugucucuuugcuuguuuguuuugugguuguuguuaaaaagaaucugugcuugcauauuaauaugcugauuacaaaaugauagcgauacaauuaaaagaacgaaggaaagauaucgcgguugccaagaaggaaagcuuucuugggaugaauuuuguugaccagccucuuuggacuguuuagagacacgacaccugacacacccugucuagacccuccccccuggagcaaggcaagaagcugguguagaaguggcagaaagcucugcucugucuuuaggaaaauuagaagaauucucugggucuacuaagaggagauagaauauuucuuuuucuuccuauuuuccaagacugaggucauuuuaacuauaaagaucuguucuaaaugcguuugcguucucaaaagagguuaguaguccuaguuuuugacuugaaguguuauaggcuuuaaaauugcacuugaucuuagccaaaaggccgagaagcgauacaauugcacguuuaauuuauagucaugagacaaauguggauccuuucuuuuguccaccaagauacuuuccggauacuuucuaaguacacuugagaagcacgauguuuucccuucccaggguuaguauggaucaagaaaugcaggaaccugguaaagagcaagacaugcaaagauaggagaguuggagugggugaaucgccuguuccaccucagggcuguggugggggggaggcuggaagguaagaaccagaggaaauuggagaggcugagacagcagacaggcagagcucagcagucaugcugcacggguggccagggugucagcagaagggcagcccaaggugaugaggaacuagcugggggagaauggaaugccucguaccauacuguuagggcaucagugagggaccuugguuguugcagaguuuugaacaauuccuuucugugaaagcaaaaacaguguuaucuuaagaagaugaacaggacagcaucuuguaagaagaugaacaggacggcaucuuguaagggaaauggcaggagagaaggaguuagguaggggcauucauuagaaagcuucuuucagagguccuugcaggacuuugaguccugagguuuuagaucaggauggugaaguccuagagcagacauggagggaccugacuggauagagagugccuuugcuaacagagaacagaaggacacacuuacauuagccgaggcugagcacacagggaccuguggauggagcccagggucuuuagccuaggaucagagcuccggaagggccgcauggccacuucacccuuugcugcuggcagugcauguggcucuacuuccucuuuuccuucccuucccuugcaucucauggcuuccuuacuaggucccucacaaggaagacugcuccaugggaacauuuugcuugggauagcaaaaggaauucuugcuaaugagguuuauguuguccagaguacaaccuuuggaaaauugugccauguuaguagauaacaaagcaaugggguagaggugaaaguccugugaucaagugaacuuggaaaaugccacgagagacuugauaggcuucuuucuuuucaaaugguagcaaaugcauuaccuuggggcuggggagauggcuuaauuuggaaugugcugaugugaaaacuugacaaccccgaauuugauucccaacaccucgguaaaaagcuagccauggugccagaugccuguaaucccagcucuggggaggcugagccaggauaccuggagcuugcuggucagcuagucuagucaaaugagugaguuccagauccagugacugucucaaagacaggguggagagugaugaagaaaaacagcuaaaaacugaccucuggucucugcaugcaccugccugcacauauguguacaugaacaugcacacaugcaugaacaucaugauacacacacucacacacacacacacacacagagagagagagacagagacagagacacacagagagagacuuaucauagaggguagauuguaguaugucacaagcuuccugaaccaugggcucuuuuuagaaggagcaucccaggggaagagaaaugcacagacacauggcaaaaucaggcacugggaaagacaucauagaaauaagccucuuaaugcuggaaguuuguauguaauggaaagaaacaagaggcugggauuugggucuggaauguacaaucugacaaccagaggcaagucacuggguuccucucaaccucucaaccccagugucuguaggcuuuuuuuuucuuucuuucuaauauuauauggauccucaagguccuuucaacgggucugagaucauguguauaggcagaagaaggagugaucugugauuuuucugcucuguaauaacugguauggaaacaggaaggaggcaauggggacagugacaagaugaugagcaagaugugguuugagucccugagcugauuacaugguugggccugacacugcuggcuggugcggcagagacaaagggagucuguagcucguucccagaccucugucacaccacugugccgugugcugcaugggcagaauccuugaugcuaagauaacgcucauucccaaugcucacccacacugucucaguuuuucaagguagaugcugugugauccugguuagaucagccuucuggauugaggguucuucaucugcaaaaauaaggagcuuaauuuugggucagagucccugauguuuuguaagaaagaacuguuuuuaaguagauccaagacuuucucgaagauauaaaggguauauagguauuuuucuuaccuagugccagcaguggacccuaagaauguucuugguuuucuccuucuuuggucuucucaccuacuucaaauguuuauuccugacuuagguaguuaauucauccacguagggacagccucagacucacuagauugccaggcucaaucuugugucucuuuacaugcaaugccuaucuuuuuaucuccauaggaaaccaaauuguuuagguucaaccuuucuucaugaacaaacccuucuuuugguuuucccaguuacaaaaaaguaaggaucguguuucugaucuccuguaggcuaggagcucaggcucugggacuuccuccuucccucuccuguugcuagucauggggccacucucaacuaugccuacauuauuauuauuauuauuauuauuauuauuauuauuauuauuauuauacucuacauuauuucuuguuucugaugcugucacuaccacaggucagguucuaucugguuauuaugcucucugucucuccuuuaaagucauucacaugccacauucagccccacagagcuuccccauagccuuuguucgaaccacucaggcugccggcauucacagcccuguccccaccuugacuguugaccgucuuccagcucucucaguuacuuaccuguuccuggcuucuaaccauccauuuauugaucuucucagcccacauucugucuauccagaugcucccuucucagccuuucauccuauucuuuuuugccuaaccaaguccuaggaauaucucaaaagguagcuuaaacaaugccuuccuucuccaucaacaaacccucaauccugucuggugccucucaggagcaaucacaauaucacuuagguuucuuggcaagucuuugaagauaauaguuuuagaacuaaaacccuaaaugugacaguuguaaagacaaugaaguggggcucuagcauagagaagcccgggaccauggucuuggcugggucuuacuuucuuccaaagugcuuuucuuucucuuaaucuugugcuucaaaucuguauuacaauaucuucaauaaaaccuaaacccuguuccauacagucuuggccugacauucuuugcugccauuuacuggaauugaggucccuaaaagaugaaaggaaguccuuaggcugcuagggaugacagcauagugccuuaucuucaugucugucacugcugaugugugcagaguuuaauauccgagggauccacugcaaaccuaguuaauuguaugaguugguucuuccuuagcuucaaaaucaggaaaguuguaagccagcaggauuacccauuugugaucuuugugcuacagggaagcagcuuucggaagcagggccuugcucuccccucaugucaacaugauguugaugagagaggauucuauuuguaaacagcccugcgcacaggaccccugauccuaaggcaugcuuaauaauaagcccugccaugaaaugacagacaucuagggcaaaguuuagcuguuucucagaguugggagauuucagcuguaugcuuuguuaggaaaccaaaagaugaagaaagcugucuuuagcuacgaagcaucuauucuuauuuugugugaccacucugugccuauuaggaaaugacgcuuauguagucagucuguaaccccuccaacccauaggcaccacauaaggugcacacacacacacacacacacacacacacacacacacacacacacacaaugucuguguguaugugugugcgcucauauucauuaugacucaauggaucagugaaaaugaaggcagcugcaaaaaagcauaacuuagaauuugcccuaacuuguaaaauagaggaaccaagggaaauguagaguuuggugccauuugaccuuauaaaccuaaccuuaaaucuguacauucauaccaagcauacauacauacauacacacacauacauauguagagcauuccuagaaaacaauucagaacagauaagcaauugcauccagggcaaaggaugauagucugaggugcccaugagacuuuuccucacgugagaugcuauaugggauuccuucaaguccucaagguucauuaggaagauccacaugauaaaguuauuuucauaacagugccaagacaucucuugcugucuccacccucucuuucugcugugaguaccacaaaggagcuuuccagagguuaacugacaugugauacuacaacaaauugaauccagaagcagauaugauaaucuaguuauuuuugaugaagccagauguuugugauaucaaaaauguaaaacaauguuguuauuucauaaagcuccccgggaagaauuuauuuuuuuuguagcauuuaauauuuauguuaacauaauugucauccaggaguauauaauaaauuuuaaaugcuccauuuuaauuuauaagucaagcaguauuaggagauagacuugaaauccccuugagguucucugggauguguccagucccaucagaacccggggugcuugggaucucauggauggggcugcuaagaaggaacaaaaugugauugaagcaaaacuuugcaauaaaauauuacuuuucuuucccccuccccucaagggaaaucuacaagcgaccugacauuuggugcucuagagcauucuaaggcuugcugcuugacuucuaaagaagcugaaauaauugaggaggagcggggacccucuguuuccaaggacucuguucugcagagaauguucugcacccucugauguaaguagucacucgcuggagcucuguugcacaugacauugaaagucaggguggugccauguugaaaaucaucugucuugguuaaaguuggacuuacccaugccagcacucaugggaauguugggucccugggugugauuucuaauauuacaaucucaauaauuguuauaaguugcucuauuucaacaauacuuugaagugacucacaagaaaaugauauugaggaacaccaaaacuggggucuagagcagucauccguacuccaguuuuagaagaguaaauaacagcaauauguaucucagagaugcugcagauacugagucaggauuugagucauaaagagaagcaugcuacauugcagagauuuuuccaggagucuccccauuggccggacuucacuucuggucuccacgggccuucucgcuucacacuuugggcaggucagaucucaccagugaaucuaacaguguggcagcuucacaaaucugggucuuuucuagccuagggcucacugauaucagaaucauguccccuuuaagccggagcuguaucuccaggaccuagcauaggggcuggcauguggaggaugcucacugaagaugcucaaggucagagccuugguuuagaccugacucugagacuuuccuauucaggaacucacugaacuaagauguaucauuuccuuugugccugcaucuucaccuggcaugugaagacugcucaguggggauugccuuagacuugccugugucccacacugccucuggaauacuguugaguguugaaugacugagcgaagcagguggaacuguggaauaagugauuccugaauacggggaaaauucagugccccuuccuuagaccccacccaaggaaauuucuucuguugcacuauguacacuuuucuguuucugaucaagggaauuccucacuauucguugccuccuuguggugaugucauaguuuaaugaagucuuuuugcagauugcugcaugagucuuccuccugcucgccuuguuuguuguuguuguuguuguuguuguuguuguuguuuuguuuuguuuuguuuuguuuuucuuucuuccuuugauaaacucuuagcuggagccuucacaugggauggauguuccagaaugaguaauucauagcuauacuuagccacuaaucagaaguuauugugggcuuucucuauuccauuagauuugccagaguuauucaccuaugaaucauuccacgcuacguuucaggggcucugacuguggucucacuucuucucuuccaucugaaauaucuauuuccaggagccauuauuucaauauggaaggcaugugcuaaacacagcccagugaccugagacuugguuugggucgugugugucgccccccacccccaaucucuuccauggcauuguaccuuggagcuaucucaaguucauugguucuuucaagcaaaagccuuuuuugucaacaaucuaaguuauuuugagcugccagaaacaauaagagggcuauuauuguguguguguguguguguguguguguguguguguguguguguguguguguguugggggggagguugguguuggggaguugggauagaggagagggauagugcaaaaguuagaaucaggagaaaggacagagucagaauggaagacauggggagaaagugagcagacugaggaagagagaggagaggcgagaggaaggcaagcugaccaguucuaccgucaucucaaagacuacaguucugaagcaguugaccgccucucccugggagcucucauauccacuguggaccaggcucugugcuaugcagccuaugcuuuaaucacauaggcaagcagagcgcuaggaguuuaaucgcccaaggcugcaguuaacuuccgcugucagaauccacuguaagacugucaaaaagcagguggccacacaggucaagcuccagauggccuaugaacaacucuuuuuccugcaugcuucaguugggaugguggucacguggucaugguacucauaaguaacugauuacuguuaaggucuaagcagacugaaacaguugcguccuuucugguugauaacauggccaacgagaauuucuccuuggguuuucaaccucagcuugguuuucccucaugacuuagaugaaucuuucccaucauucaucuguggugggugacaguggucccacguguccuggaagaaaugugcucaaggacauaaaggcagcacugcccaagauauuggaaguggcugaaggcugaauagaaucaaaccugggagccaugugcuggcuacugaguacuuaauggcugagguaaaugagacaccgugaucuuauggaugacaaguugugucaggguuaguuuagaaaaggcgggauuuggauaaguaacuaauuagggaggcuccaccgcugucauaagucuauauacuuauauagugaugggauggacuagaaacagaggcaagcaaaucugucagaggggaauugaaguaaaacaugaccagguugacuuagacauuucuggaugaacaguccuccagcagugcucccacagugcucccaaacgcaucagcuugggacagaugucagcgacguaagcaaagcacuggcgucugggagucagcucuguuggugcugagauucaagaacuuugaaugauauuuuuacuuuuaaugaaacaggaacaaagguuauugaaugucugaggcauucuugggauuauggacgugaguggaagggaaagaaguagaccuauguuaguaagaggcaauuccagcuaaguauucaugggcaaaaacaagggagggagagagaaagagagagagagagacagauacagagagagacagagagagacacagagagagacacagacagagacacacaaagaaagucagacugagacagacagggagagggagagacagagagacaaacagagacagagagagacagagaaauggagagggagggaggaagagauagagacagagacagacagagucagagagagagagagaaagagagagagacagagagauacagagacagagagagacacacagagagagacagagagacagacacacacacagagaauugcauaugcucagguggguagugacaauggcaucugauucuggaauauuuuagaagaacugcccuaaggcuuaaaggcauggagcugcagcuaaauguuggugcuaggaagaacucccaacauguagaagagagggugugugaucgguuguuauuguuggaguuggcuuaggccacaaggacccagagagaccuggccgggcacgugagguggagaagagaggaaauagcagucuacuuggagcagaggguggguggaggagugguggauaagguugcagaggagaagagcugccagagggggcagagcccugacugcuggcugggguaagacaucuggaugccauguuggggacucaacauuugugcugucuuugcucugguggggagggggacuucaacucuagacaccuuuauuccuggugucuguucuguugagugaagguaguucugaaugagguuugagauaucauaaaaguaaaauuucaggagaaagaguauacuggggggggggagccaaaaauauaugcacaugacauauuuuggacuaguguuuucuaagauuucaaucuguuaguuuugcuuugaucuuuaagaaccacccacaaacucuguugcucucggagcagaacaugggcugcuagcgagacauauugcuuucauaguuucaacucucagucuuagaaguuuucauaucauauucaauauuuuagcucccauuugugggcuguggagaguaauguuaagugucccuugcuggcaauguucacugaauugcuaccggagccugaaccuaaucuuagucccugcuucccagggcacagggcuccuguuuccuuccuucaaacagaugguagggaaugaacuaagaaggaauuuuuaauggaaguauguuugggcucgaugggcauaggcaugacuacuugaguuugaucuccagaccuuacaguggaaggagagcacugacucccuaaaguuacccucuuguuuucacaaguaugcugagauauguguaugccagcacacaugugcaugcgugugugcgugcgugcaugugugcacacacacagagacacccacaauccuuugcuugggcucauuaucaccuguguuuuccauuggagaagcaguguuaguccccgcccacuucuggucuggccucuggguagccagauucagauguuuccuucuuuuaauuuccuggggaaaaucccaccaccugugucuuauuugggguuuuugaacugugagaugauggcacccacaauuccuagaauagcugcauccaugcgccaaguguaccagacugcacacaacaacggaagacaggauuuagggcaaggaacagcagaggcgcugggaccaggcaucuucuccacaaacauacagcugaguccggagguugugggaggagaaggcagggccccacugacucacucgaggaugugggcacgcuggcugcucugaucugcaagucgugaggguccuagccuggcuuuucuucaagaacaaaacuucaaaggagguaggcauaggaugaagcagaguucccuagcacccaggagguuuugugugggauucugugagaaucugcuacagcccuggguguucaaaucuccucccuaccauuuuucccccugucuccauagcuuagcacucaaaugauucuuugagaagguaggguaggcacaaauggaaagccuuuucuucacuucaguucuagagucuggcuuguaucuugccaauucugggagauuauaggaaugauuuagaacuuguauggaaaacuaccugaccucuuccagggagaccucagggaauuccuuaaaauauuuaacuuuucuuaugucuacuuuagugcuaaagaagaagauuucauccuacugaucccaugguguuuuaugcuguggcuuauucauuuauaaaccuuauuaucauuauuauuccacugaaaaaauacuagaccuuugcucucauguaggugcuaaagacuguaggaaaacuugauuucaucacacuguguaagaaagacuggaagggaaagcagcuaggagcugcgggugccuagauggauagcccaaugagagagcaagggggccuguagccaagcaaugccaagcagaagagagaggaagagguuuugcccucacuggagaguaacuucacugacucugggaggaacgaggcacagccuacuguggcuacagagcaagggacagugauugcauccaggagaagaugaugcggaaaguacaggccacuaggaucaagaaaacaccauuaaucuuugguuguuguugcaaaauugugcuuuccaaagccuuggucaaggaugcagaagccucaggaugagcccugggaugcuguccuaggaaaugcgcaguggaauuccccuucauaaauccuagaggcugggagggccucugagaagaggaaagagcuguagcauugccuggaagacggcagaacaugggcacgcaaggaguagccaaggagcgagagauggagagauauuuuuccuuucuuaaucauggggaauauuuauuaaguaauaaaaaccuauuaaaauagagguuacuuucauucaauaaaaucucuaauucuuucugauccuaaaaucauauacuuuugaauauauuaaguaacaaaaaguagaaaucgaccagacaagaucuaugagugaccuuaaaaagaauccauacuguucaagaaauuuuguuuuaugaaugcaucaagggguugcucuaaaaggagccggcuuuauacacaaagaaacuuauuacaacauuuuguauauauaauaaaggaauguuguaaauugccgauuuugaggucaaaauuuuauaugugugugaaaaaccugucaaucagugaugcucucuuggagugugagauaacacaagacggucuuuguauuuuuagaugaaauaaaaauagaaguuaacaaaguuauacaaaaaguacaaaaucaaugcauacauaugcccaaauguugauguucuacuuuaguuccccauugacauaauacaaaacuacaagagaaagcaacuuguagaggaaggaaugucuuuagcuuacagguuagaguucaugacugagagaagccagggcaggagcacaggguagaaacccggaggcaggcgcugaagcagaagcuacggagggaugcugcuuguugcagcuccuugcuuugucucuaggcucguguucagcuagcauguuuguaccucauaggaccaccugcucugcagggacacugcucacaaugugcugggcucuccagcaucgauuagcaaucaagauguccccagauaucuucacaggccaaugugauggagguaauuccucaggugaggaccccucuucuugggugugucaaguugaucauuaagagccaccaucacagugaaguguguuugcuugcagacuaaggcuaagggugcaucuuugguccuuuacauaauuaaacugucauaaaugugcaugagauauuuuuuaugugagaaaaagaauacauaaccuuauauaacauuugaagagggggagauguuaugaaaguaucuuuuuucuaucuagagggauuacuuaaaaauccugagaauuuucuuccuuuuuuauauucugagaauuuuuuuuuuaagauucugaaacaucuuccuuguugaaaguuaaguucuuuacauguaucaauccgacccuagcuaaacaacaacaacaacaacaacaacaacaauaacaacaacaacaacaaaaugcaggguuuguauuugugcucuacucaaaccuaugggaugcucugugacguccauggaaaacaaguuccacacugcuuggcuugcuguccacacugggaacugacucccagggaaucucaguuacugcugugcauugucuuuaagauucgcuauucccaccaugcccagcuucccauauuggaacuugcauuugcucuucgggacaccauguucccugggcauguguuaagcacuauaaagugcuccaauacuucuuacaucaugaccagguuggcccaucugugugagcuggcagaucagcuccuucucagaccaugacacacaaugugccuguacaucagagacucugaggauacucagaguugcccaauaguuuuacagaagaacaagccuuguuucuagcuuccccauccauaccuccucacaggcuaugacugccagaagugacauuuuccucacuuccaccuuucagaugcaacaauuccugacccauguuccauuuccuucuugauucauucccagugguuucaauuaacaguggccauguauggaauuuugaccacucaaauagacuguuuucuuuuucuuuuaaauuaaaaccauagcacaugccaagaauauaacagacaauauaacugggauuuagaauucaacaccaauggguagaaggacuuaauuaaauggucuuuuagacagagaugcaaugucucuaagucucucaucuuauuagcaacacagaaggacuaugacuuucuuguuugucuuucuggaaccaaguacugugcaaaacacaugguggacauuccuuaaguguuuguaagaugaauagaugagcaucaaaggagggcagcuuugcuggcacagggcuaguguggacuacugaaaggguucaguaccacaguggacugggugaugggaaauggcucagacuuaaucaccauguacuuaguucuuccagcucuuuaaaagcaugugaauguguguguguguguguguguguguguguguguguguguaugcacgagcauggaggagaagacugggcauauaagaauauaagagugcuucccuuuggaugauacacacuugcaaguccagauacuucuacuguggaguaggaggcugaggaggagggaucccaaguuuaaggccuguguggacuauagaguaaguucaagaccaaccuggauacacuugugagucccuuuuucagaauaaaaagugaaaggaagaccagggauauagcucaauggucgagugcuugucuagcuugcaugacaaccugucugaauccucaaucuugucaaaaacacuuuugccuuaaggagacuggauauauccucugauacaugucgagaucugacacuuacaaaguauuucacuuccuuuaggguuuuguuauucuuguuaaaauccccccacccccaagucacugucauacuaaccuuagccuaccacuuaaaaauuauauaaugugaacucccuuccuuggcaucucuucuaaugcugcuugccuuaaccuuacagcuccuugcguguccccaaagacacaaagauuauagcaaugugugcauaugcuauuuuaagaauagaaccaucucugccucucuuucccuuuccaaaccaacuauugcuugaaugaaaaaaaauuccauauuguugaagcaaaccauuauuuaucaccugucaccaucaacuggugauuugugauugcaaacaucauucugugaccuccuuaugcacguacacccauaagccuuggggaagagcugacuuuguuaacaaguuauuugaguuauucuccugacucauaaacacaccauggggaaggagggcagagauuguuacuucaguuccagaugaagaaaacacaguaaacgcaugggaggaguagccugcuugagacacaagcagacucacagcucaauuguaccagauccagauuuccugaucauuuaaacuguggcuggcucagagcuccuuugaucccacuccaacaaaaccacgagagauguuauugaauaaauccaaaaccaugaggagagggguguaagcagacucuugcauugcaaccuccuaccccaaucucaagaccaaauucauuugaaagguauaguuaggagcaaauacauuaauggugagaggggccagcagugguaaugauuguccugcaacggacuaucccuuuugcaaugucuccaauauggcucccaaagagugugggcguggcuuagguugccuagcagcaggagaugugcauacuaaggaagccacuccucucacccuggagggaaguagguaucugauuaggaucagucuuaagggcaauucucaacuggaaguaccagcuuugugauuaaaauucacaggugcauugagcugucacucacucagagcauaggagggaggcugggcaaaaggagaagaauguggugggaaaaucuuagggagccuggggugggacuagggaugugggugagucacguuccuuggguacagauguaaagauguuaagaggaaaaaaaaucagaaaccaagauaaacacuacuuuaaaucaacauuuaguguauaucaguauaucauuuggcagcuaacaggcuauggccaaaagccucuuuguaaguaagaguuuacgaaaagucaauagcaggagagccaagcuuaugcccugguauuaaaaauccugaauuaagcccagaaugucagacucaugaaaccuuagccugagaucuaugagaaaauauuucugaaggaaaagagcaauggauuugacuguuucuguuauuuaguuguuuagagauucuauaacgagugaccagaagcugaguguuuaaggaaacuuacagccucacaaaucuggagaaaaugcaauaccaagcugcggagcagagccaagguuguucuguagauuucagggagguaucccaucuccacccuccggcuucucgugcuuccugaacccaugcaguuuuaccuguguggucaccuagccuccucccugugguugccuguguuuguuuguuuguuuguuuguuuuuucucauaaagauccauuggaugauaucuacuccagaaggugaaaagucagaacaucuaccaugucccuguuugcaugguagguccuacaggcaggcagagucaggacucgaacaaaucuuucuugagguacaaggcgcaccucaaccagcucgcuauuaggcagggacauuucacuucaaacuuggcuugcaggaguggugauggauuggggaaacagaccuuucauaauuuaaauuccuaacgaaaugaaagguagguccauuggggugcuuacauuccagucucgauaauugacagcaacaggccuaugauucuauuagaagaucugauuuccaguacucagcugauaaugaucgggaaauguuuauacuaaauuauacauuucuuuuguuaacuuuucccuuugaguacaagcaauuuauuaaauuauuuugauuacuaccaaguguaauaaauuucagauuuaaaaaaaauguaaacucaccagcuggggcaaaaauguccucugucaaaucuggugcucugauuuuuaguuacagcauguggcuguugcaccugggaggcugguuaaagcuucuagaaacaguuugcuuucuuaaagugguucacguucuuccuguaaccucauuuauauaaaugauuugcuuucuaaaaauuuuuuuauaguggaaagguaaaauugaauucagcuuagcuuaauucagauuuuuucuuacugcauacuaaaaauaagcagaaucucaauaaauauauaauuuggaaaguuauuuaggggacuaaaauguucuagaauuuggauuagguggauguaggauauuuuggguuucccauugugggugagaauuuaaauuuacuuacaugcccaauauuuaucuacuaguguuaagucugaacuugucuagcgacagggaaaugaauggaguuaacugagggucuucaaaucugagauuccuauaagagcccaaggugauagaaucaaagaggaaaguauccaugacauuugaaagaaaagauuauguauuuguucuuaaacuauaaacaaaauuuaucauuuucuccaauuaauagaaaucaaagacauuucauaccauguuguacuauugucacucuuucaggaagcacucacugguguuuaaaacuuguaguuuuagguccuugacuggaucuuguuaaaugggcuacccacaucuugcccauacagggcacauuucugauuuuuuuuugaugauugcauuucgguuuaguugauuuucuuuguagucucauacucuuuguguauuuaaccauauuguuccuagcaaggguucuaggucuucauuagacugcaagaagugaucaugguagucuuuagcuuccagaagcuccuuagaaagggauggggucucaugagcaccccuuguccaugaugguguuggaaggcacaugcguggguuuugugacaguacucauggcugcugugugcacaugacuguaaccuucauguccuauccagacgaguguuccccaacacugcuccgcauccucugccacacacagucuguccuccucuuccacaauguuccucaauugagggggugaugugaaugcccuguuuggggcucugcaaagaguauuuuuaaugaaacauauucauuucugucuucuugcaagguuccucuccagggcaccgaccuaacaaaguaugauugcuuugucagcccacaaucagugcagaggcaggucguaccuccguuccugguuccuuuuuuuuuuuccauaaaauuaguaauuccccauuguuccuucucaggccuuuaucguaucuccagaagauuccguuccaacagucuucuguaugugcuaaggcacaugagugcuauugugaagucaaccuuacacgucugcaaugaggaugucugcaauguggaguucugcugaagcuccgguuucaaacagauaaucaugaaagcuaauuaugucauacuuuguaacuguugcuguucuucuuaauuuucccacauuuaaaacuauuagaauuuugguuaguaccuucugcauucauuuucuuauugcuauaaccaaaugccucuuaaggaaccacuaaagagacgguuauuuuaccuuaugguuugagggaauagagucuauuaaggaguagaaugaaugugagcauguggcccuguggccucuggucaccuugcuuuuauacucaagaagcagggaguuggcaggaaauggagcugggcuaccaaaccuccaggucuuccccugaagagauuugcuugcucuagcaagacuccaccuccgaaaagucccuuaacuuuccacaauagcugaggaccaaguguucaaacacgugagccugaagggggccuucacauuuaagacacagcucccucgaguuuguagcuucuaaaacagacucucucugugaaugaaaaacaucugcuuugaggcauaucuucuccaccccaucugugaaggugaauggaaagaacguacuuaguugugcaugguuggagucagaucaucaaagaugugagcuagacuuaguagcaccggaaggaaagaagaaaguuuauaaggugcccucucugugcccuucuguauccuuccaagguuucuaaccuacuucccggaaguccuugugcuugagggcugcucuugacuuucuugcuuagaagcuugcuguucucauacuacauucucucucucucucucucucucucucucucucccuuuccucugucucucuguuucucuuccugucucuucuucccucccuuccuccuuccuuuucguucucucugucucucucugucccucuguuugucuuugucuuugucuuugucuuugucuuugucuuugucuuugucucugucugucugucugucugucugucucucucucucucucucucucacacacacacacacacacacacacacacacacacacacacacacacacacacacacaaaucccuuacuaggacauuuuuggaucuuaguuaaucccagaugcagucaagucgacaaccaagaauagccaucacaaccaccaccaacuuggcuaacacagauuggaagacuucaaaggauaguggccgaagucagcucggccgauggcucugacucugguugcuuuagacaggagcaaacuucuggcugcuucaguuaucgguugauaguggcuccuaugauuaggaaggauaaguggcuucucucggcuuugccagaaccaaguggucauguucgcggaggagugggaacacuaauuucagggauuugacucugguacaaagcccgagggugcgauguugcuuuuuccuucggcccuaguaaacaucuuaugcucgguauggugguugaacugcuggauugagucuucgguuucagugccaggagguucacaguaaaugagaggugugggcucuuggggaagaguggcuguggccuggccuccugucugcacccugucaauaaacacacacacacacacacacacacacacacacacacacacacacacacacacacacacauucugcaaugcaggugugcgucacagggagguguuuucuagagcuuugagagcugcuaggagaaacgggccgagguguggguccagggaggcaggaggucuggagaaauagaacagagccgagaaugaccuuuuagcuccuaccaucccauaaucccagcuuucccacuccugcccuuauuugugccauaaucaggacacauuaauuuaguucuaggccagguacacgcagggcuauucgaguuugguagugaacuagacacacaugaauuuuaccuuucauuuuuuuuuaaccugauggauuuuaacuuuauuccauaauuuauuaccaaagacaauuccacauaguuuauauuuuucuaacaguggcaaccuaucuauuacaucaauguuuauuuuuuagcacagaacaaucaacauuuaaacauuucgauauuauaagaucaggaauuuuaccuuucauagcuuaacuguagagcaauuugaaugaauagcagcugaucaaaucauuagcaccugcucagcguguggcugugacagaggaaguggggaguggccuagggggggguccaucccuggaggcagugacgaacugccaauacuuguccuacucugaagucaaaucuuuuacgcauccucuuuucuuccucuaagucuccuuccuugugcuucucaugcugccccagauuuccggcucuucuuuucgaagaccucucucacagaucagccucuaugacuuuauaguccccuuaggcgcuugucuuggaucagcagcugcuggcuggacaccugugucaaaagguagaucggugaagaacgcacucuccauuguaucccaccuuccuuuucugccucugacagguuuaucugccuugucaccccaguuguaagcuuugugguguuuggcuucccauuucugccauccauguuacacagucaccuccuucauucguaccuguccugugccgcuucucucucuugcuguucaugucucaccaguaacauuuugggggaucuaggacacucugcgcagccgcaguugcagugccguacuccccgcgguucucuguuacucugcggcuguuucuggucucuuuagcucaggggauucuccuucggaaccuccagagcucacgauuuuugucuucagagcuugucucucugucgcuaguaacuuuccagcggauuguugcugagcucugcauguagacaucugguuucuaaacccggcacugccugccuaacuccugguucaccugggcauguucuuaaucacgugugcuguggucauucuaucugcgaacucaccguauuccuuucauagagcuguggcggggaugaaaugaguuagcgcaugugcaguaaaaagugucugacaucacagcacuccguggugcacuuccucuuugucuuagggcuucuagugcagugauauagcagcgugaccaaaggaaacuggaggagcaaaggggguuauuucacuuuguguuuccacauuacagcccaucaucaaaggaaggcagagcaggaacccaaggcauccuagcauccuggagucaggaacugaaggucauggaaggauguugauuacuggcuugcuuuccauguggcucauccugcuuucuuauaccaggaccacgggcccagaaauggccccauucacagugggaugugucccuucaauccuuaauccagaaaaugccccacagacuugccuacagacagucugauggaggcguuuucucagcugggcuccucuuuccagaggacucuaacuugugucaaguugacaagaaaacuagcucagacacugcuaacaccuugcguuuuugcuuuuaugaccgauuacucaguauauuucugaaucguuuauagcauugcucauaaaauaguuuucuggauccacaucauaucgaugacuaugcuucuugugacaaccaaauaccugcccgaaagcaccuuaagugaggugaggauuaucuugaucauggcuuaagggaauccaguccuucagugguaaggaaggagugcuggcagguggcucugugguggcagcugcuugauuccaucccaucagggcuguuggcagaacuggagcaggaaguaagggccaggcuagaaaccucaaggcccacucucucagaggcccacuuccaaggcuaacccccaucccucauagguuguaagcccuccccaaacaaugucaucaguugguguccaauuguucaaacauacaagcccaaggggggacauuucauauauaaaccacaggauuugucuuucuccagucacauacacacaaacacacacauuaugcacgugugcuauuuauaugcuaaacacacacaugauuuguuuguaggcuuuaguuuuuaaucagaucgacauuuuuuuuuuuagauuuauuuauuuauuauauguaaaguacacuguagcuguccucagacacuccagaagaggaugucagaucucguuacagaugguugugaaccaccaugugguugccgggauuugaacucugaaccuucggaagagcagucggguacucuuaccaacugagccaucucaccagccccccagaucgacauuuugaugauguuucuaaaaaaaaagauuuagacaagucuccagccagucuguuauuaugaugagauaugaacugcuuuuagcuuuuacuuaguguguaagugaauacacagcacgcaugccaugacacaggaguauaggccagaugacaaccuuuggugucagccuuugcgcucgauccucuugagacaaggucuuuucugcuauuucucaugacauacccaggacuagcuggccccaaguucuaggaauuuccaucuuugucuuccaucuugcagcaagaacucaaggacaaagggggcuguggcccgcuggcgccucguggguucuggaggauucuaguguagguucucacucuucuugcucagcaagaacuuuacccauugagccaugcccccagcccaagauccccuccaccagugugugcuuauucuuaugaaggugugccgugcugacugguuuaugugaaaguuugaagugggccugaucucagggccucucuguccugugaaaugagcacacucggagacauguaaaccucagagaugagcucaugggagcgauuucugcaaugaaaauagugaugugagggugugccagggacuucagguucacagaguauaauuagaacuuuuuucaaaucacugcccacuguaauuucauuguuauguauauucuuuaauuaugggcucuaauaguccaguuuaguucuguaauuagguauaaggacauuaauuucagagacauaacaauuggcucaaauguacuucuaaauucuuucccauauccuaccuuacaaggaaaauuaaugcgccauaaaauuuugugcaggaaaagagcuucccagagggcagcuucgaggagccugggggcuuggguucagggaagacaugagacucuuaccuuggcuccauuucccuauugaauguuugucucauuucugauaggccaagucgagacuaugguggacagagaagaaccccucaauucacauugaaucuguaucccuuaacuggaaaacuuagugacaucaaagccugaugagucccggggaaaggaaagaacaguuagggcaacuguacccauauacaaauaaaaaucaugccggccucaugaagcugaaugcaccauuuuuuucagcaaguuccaagggaaacaagugggccuguuucaucuucuacagugucuucauguguacccauugaccccauucguaacucugcccuucucagccuccagugaccccuuuuaaacucuacaacaaacuccuuauuuaaagcuuccacccaggaaggggaaagugcagucuuugugccugacuucuuuuuauuaaugucuuccaguucuagcuaggcuaccuugaauaacaggguuccaucccuaucauggaagaguauuuuauugcauguauguccuacauuuucuuuauccaucuuuucaucaguggacauuggggcuccauuucuuagccuuuggggugcaauccauuggaggguguauagugucugaacacacugguuuccuuuuuuaaguuuuguuuucuuuguauagguacccaguagagggauagauagcucaaucaugugguaguucugguuuuaguuuuuugaggaacuucugugauguuuccauaaguuaucaguucuuaugaacacauaauuuauaauauaggcuuuaauauauaacauauaaauauagguuagaguuuaagcucugcuucugcuacuuacuagucuaaaggucaacgacugcagggcgcuacacagaggugauuuuuauuugcuaauuacauugcagugaggauucauaaaucuacugucagugucagaaacccucaaaacucauuucuucucuaugaucaacuuagcugugagagacaacgaacacccaagcauguuaucgugugugcugucguagaaggaaugcugcuuccucaacaagaacauacuagaagauucucaugacuaaagggucaugcugggcgcuggacacacagaguucauagggugguagagacaggcagguagaucagugaguggaagaccggaaccagagucugacaccgcacuuaaccacaggcuaaguguuaucaugggaaacauuuggucaguucuccagggaccaugaugauacaugagaauguuggccaugucacuguguacaggaagguuucucucugugugugcaugaguguauacuugugugugugcacacguguauguguauauaugcauguucaugcaucucuguguguguguguguauacauaucuaacuugggaauauggggacaugcaugugcacagcaggcaugaaugaaagucagaagacaaucucaggugucaguccucaggugacucccauuuuuuguucgagacaaggucugucacuggccugggauuucaauguguaggcuaggcuaacuggccccugagcuucuggagaucugccuguuucugucucccauuucacuguuucuaggauugcuaguaucuaccaccauacuugucuuuuuauauggguuuaaggaauccagacucaggucccugaucuugugaggggucaucuccacagcuugagccccugguaagcuuacuaggcaaaaugagagaugagcaaaaacccacagccuggagaugacugguggcuuuaaggaaccgcaucuuccaggucuguugacucaucaauggauauguggguuauuuccauuugcacuggaaagcauaagccaggccaaaggcuugcacacuaggcaccuagcugauauccauuuaauaaacagauaaaaagggcugaaagaaaguuaggauguuggaaggaguggggucauggagaccccauguucuuuuuguuugccauguuugccagguuaagugauagauaaacaaccgaguuucauggucaguuuggaccucagaaacaacaccuucguucacagaacagagaguggauugaagagaaugacuggaagcuaugagcacggauagacagggaaggcagcugagcugugcagggacaagaaagcacacacagguaggguggugagagccucacagaacucagggaaaguacacggccuggaaaggguaggaaggcaaagguagagguggaucccaaugugagcauugauugcaaugugagaauaaggguaacugugugugcgugcauucaaguuggggugaauauguacaugacauguguauaucucacaguuauuuaaguugaauguacucuauaucccauucuacauguguguaugaggguguguaugugugugugccuaaaugagugauaaaugagcacucaagaauuaucuaauacucaucuguuccgccuaacaucucauaaaauacuauuuaggcuucacucuuggucacaugcuccaggcagaaccuggcagagaacuuccaugcugagucaugcugagugcaccaacccuaggcucacacagcgcuuucccccacuaugcccuucucucacgaacacgaugcuucccucuugcuacacaaggugggucaagcaugcuauguauggcucccuccaccccccagagucuaaccuacucagguucuuaacacauucucaguuaacguauguugaauaaguuaaaacaauuuuuaguuuauuuugcauguuuacagcuuacuaaaguggaacauuaagucgaauucuuaccucccacaccuuuuagaaacaauagcacguagcaguuacuacuugcuccuagccuauugugugcugggcacugagcuaagcauaucauauauaaagcuuuuaagaaaugccagguuggaaauguuguccccugccuucgacagaugacagaagucaggcucacuacagcuaagccauuuccaagucacacagcuaaggcugcgugucaaagucugugccgcuaccauuuauguccuuaggcuuccauucccaugaugcaucauucuuaguucucuguuuccugccuaaguugacaaguccaugcauuucucuuuggaagucaaagggcaccaucugguuacaaggggacugcuuccucugugcacaaggauuuuuuagucaaccucacagaggaaaccaaaaccauuaucccagaaucaugucuaguuuggguuugauccagcccuggauaaugucagcugggcccaggggcacaugggaaugauaauaucucacuugagacccauuauggagacugagacucuccucccuuaaacuagugccuuucucuuuuguuccccaagaguucagacaggauacuuucuaugcccggggaagccacgugcaauuaugacuauuacagggcggggggggacuucaaauaugucuagacuucauuccuuucagcuccguguucacuacgauggcaaauuuaaacaaaagagcauggacccucccucuccagauugccuugcccaaggcuaacauucaaugaauaauuuauuuguugaaggaucuuagcugacugcucaaggcuuaaauaaaccucaugaauacaucucgguugauguuuuugggcucuuggugucuucucccagugggauucucacauucaugggcagccuaggagaaagaggaaacccugaggauccuguucuacaugucauauuucuccccaucugacuugccaccagucuccaaguuagaugauucauccacaaagucuuuauuuaacauccuggaacugaacaguaccucccuaggagccuucaaccucaucaaccaucaucaucaucaucaucaucaucuuucagcagcagcagcagcaagaauauggggcucagcccucuuagagaagccuuuguuaccagugaacuguggugaaugcagaaauucaugacuguauaagcugcuacaaauggucagccauaaacaagauucuuauauuauccccuuuaagaccaagggagcacugcagaagaagggagaggggaugggaagaauauaagagcuagaggacaggaagagagaccaugaaauaccagcuucaggcaauaaacucuaaauaauuccaggugaccacauggggucugcacaagaacagacccaucaucagcucaguguauauggagguggggcuugagaaguccuaccugucacuaaggaaucuauuuccuaccaacagacuccaggaaaggagacgucauuaccgucacugugugccaacauaugacauuaccagguuccaauggagaauuccaaucaaauggaaauguagauggcucucuggucaaagcaaaugggacauaaaacagaaucaaaggucaugaaucugucaaaggggccaguagggaggaggcggcgauggaugggugauaagagaggguaagggagguuugguaacacaagugcaguauagacaugugugaaacugucaaagaccuaacuaaacuaaggaaacucuugggguacagauuucaguucucuagcggcucucuugcuuuuugagacucccccugugcucaauaugaacuucaccggcucaccuuuuagcuuucauacguauuugaaauacaacuauucauagugccuggugauuuauaugguuucuauaccuaauaagucggugccucucuaggcucacggguuuaaacacuuuauccccaguuagugggacuauuuggaaaagaguugacaguguggcccuggugaagaaggcuuguccuugggagugggcuucgagguuucaaaagagagguucccaaagacuucuacaauuuccagugugcucuccccaccugcucugccuccuacuuucaaaucaagaugugaguucucagcugucccuuugcucuaccaucuaggacucuaagcuucccuuucuaccuccaguuccuggaaugacaacucugagacuaauuauuuacuguuaaaugccuaggccauaagcuuuggcucauucccugacuaacucguaaccuauuuaaccuauucaaacuauuauaacuuuaccauuugcuuaguuaccucuccuucaguccugccugcuuccuucuucaugucucuucugcgucucucucucagcaucucccugacuucaccuacuugcugguuuauguucaucuccuaggucugucucuccuguccucaccugaaucucccguuuagacucucauuauuucccagaaucuucucuuuuccugccagugucacaccuccuauuuccugccgcagcucauuggccaucaacuuuuuaauugacagguggugcuuauaggagauucucucuacacuaacccuccgaaacuaagccuagcuaaacgcuuucuugcauaaguugccuugguuaugguguuuaucacaggaaaagaaaaagaaaccaauauggugccugaacaaagacuuaaaagauauucaaaggaaaccauaaagccaugaagaauuuggguaacuuguaaggaagaggaggaauaaaguuggugaacccccaaaucaguauaugucacuuuggggagagacacagccauguagacaggucuuucuaaaaaucauggcucuggagccagacuagcugacagucaugugauuugggucaaguaaacaacuucucugaccauaguuuauuuauguguaaaucagggaucuuaagaccccugucuuagggcugcuguauuaagugaggccuugcauguagaaugcuaagaauaguacacggcacacuguaaacucuuucaaaugggcuauuguuagcacugagaugcugcagugcugaguguuccugugccagcacccugcuaauaaauccucugaguuuauugcuaaaaacugagccuugcagaacuuugaacuggaaggaagcggagagauaguuuuguuuacuccucuuuccuagaugaagaaacaugggccuagggucacagaguaggucgcugaagaauucaaaaauagucucugucgauugccugggacaccuuucuucucacaaaaaaacacacauccagagccuguggccagucuucuagaggucuagcauuccccuaaagacaccuccucaccuacgaggcacuuuuggcuaaaacucuacagcguugaaucaugcccaaagaccagcuagguggggagacugucuccuguucuccaggcugggcugggugcagagcaagggcaucuugagguaaccugggcagaaggagaaacaugcguauuugccggaacacacauggacaguguuuaaagacaggaguguggacauguuucucuuaggcugguucuuacagggcugagaugugucagagugacuuguaucagcccauugcugauggcuuuauucacuuucaauggccucaguggccuuaggcacauucauaugggaugccacacagaccaaugaacuuguuuacaaaaauguguacaaacaaacccaaaccuagagaaggcuuuacugguggcaggggaagauuuugcucacagccaggaaacccgaugcaucuagucaucuucucuuaacacacuguguuugcaaaauugagaccaagaaggcaagauauuucaaaggaaacucaaggucacccggggacuuguugacuaaccucccggaagugauugagucuuuucgagggacggagucuuguguucuucccaagucugcaucuguuugcuuuugugauugaggauggaaggaugaggagaccagaacacugucugcagccaagagguccagacugaaaccagaacucacaucugggcucugcguccccucuugcugggugaccuugcugucuuaaccuuccuggaucugguaucgaaggacugccuaucugcucgcuuaaugugcaaucugugcucagggaaauguucacaagggucagaugucacuauaugaauuuuguuugugaugugggacagauuucuaugcugugagcagacugagugucuggcugaguuuccucauguguaccaccagguccugccucuacccucuaaugauggacaucacuuuccagaccauucugaccuucucucuuucacgaguuugguugcucaggcuuaugcaaagacuguguucaugaagauggaaugguaggauagcauuuuccuuuggcuuuguuguuauaacaaacgaccuagauuuguagccaacugacaacagaaauacauuuuuuuccccauuucuggugguaucaguccuagauugaagugccaggggacuugauaucuagugagaucccaccuugccuccugguugaagauacagagcccucaaccaggaagaaggucuccgguuucccguuuuaaucuuauucagcggggcuuugccccugugccccucauuguuuucagaaggcugcagcuccaguaucuucuguugcagaugugcuucgagagugugaacuugggaagggauaaacacuggagugaaguacgcguggguagcacgggucugcuuucagcagaggagagccaugaauuguaugcggaccuccgugccucuccucugcgucaucuuaagagcugcuucauuucaagggaggaaagguuaauuuuggguccucuugaaacaugcaggcaaugccugccaaauccaggauagcuuagagccacaaccucaugaggggccuggucgggucugugugucugcuuuggaucagccccaaggccuugcccugauuccugugugagcuccucccuccucuuuccuggagaaauccacagcgaggcagugaggcuagggggccaguguuuauuuuggccucucuggagcuggacucugcugcucuguuugccuaggaugaaguuuggucccuccuuuuuuuauuuggccagagacucaaccucaaucauuugguccguuggugauuuuaggccagauguacaggcucuuugggacagggagaagggcacagguauuacuccugcucaaaccuacuaggaauaccagguaguuauccuaaaauccacggcugcaggcacugucagccuggagaauggaccuucaguuuucucugaaguggggcuggagcucaguaagcagguggaccuaucugggcagcauaugccuagcucaagccugcuugcuggcugucuugggcuggccaagugacuagauguaagcaagggcucuggagccagucuaggcuaaggguucacugcuuccuggauguuaaccuugaaaaugauuuuaguucucugaaucucaguuucccuuaugaaaugauuguauuuugacgauuugauuugaaggauuaaauacacuaauauguaaaacugaaagacaugaaauuugccuucaccuauaagauggcaaagguuaauagaaugcuuuaaaaaugugauccagcuauguguuguauaugagaaaagucuuugagcuauaagguuacagguauguuggacaaaaaggaauguuuuaaaucauauagguauuagcaaucaauauuagcaaauucaaucaauauuagcaaauugaauguagaaagagauugaacacauucagaguguucauuccaagcauacaauauuggcuaaauauaaaaauuauaugaccuucuuaaaugauucacaaaauaauuugccagaagucaaaaaucaaucauuggaacauucaaugaaaucucuccuuaaguaaagaguagaggacaauuacuugauaaagagcggcuacaaaagucuacagcucacuuugcauauggaaauggugcuuucuucccaacacuggaguacaaagacaccugccuguguuuccuuuccaacacaguaccaaaaguucuaggcauuauaaacacaaguaaagaucuaugaaguaccccacugcuugagcugcuaaugugcucagaaagcuaaaaaaaucaaucguaagucuaugucucuggugagucuaagucacuugacauuuucugacucaacuucucuucuaccagaagaagccccgcccucuuccuucauccuuuaagaguaaagaacucugcauaccaaaacacuuaauauguugagcaaauggggcugugccaauauaggggaaugccagggccagggagcaggaguagguggguuguggagcagggugccgggggaggagauaggggauuuuucugaaaggaaacuaggaaaggagauaacauuugaaauguaaauaaagaaaauaucuaauuaaaaaaaaucuagcuuuuccccccaaagguuaacugauuuacugacugucauucuaaggaagaacuuuauuggaaacgcuuuuguagaacuacucauuguuuuuaaaccugugcuuagaaauuagcugcuuuguguuggggagaguuugaagaaggagauggggguauacaaauuguauuuuauuauauauaugugaaauucucaaccuuaaagaaaaauaaacaaaaaaagagaaaauauucaauuauaauucagucuaauuuagaccacuaaucaauuaaauuaaaauuucgugccaaaaaaaagagagagaaaagaaaagaaaugaaaagaaaagaaaagagaaaaaaggaaaagaaaagaaaaagaaaauggggcuguguaaaucuucugaagucagaugccaaggacguuggcauacauuuucauuucuuucuuccuggaugauaguggaaaaucuucuacuguccuucuugaagagcauggaccaugggguuuaauuuuagagagcugccuugagaauuccugaagacucaaaguucauggcuuggcuagguaacuucugagaauguuuggaaacaagagaguuuauagcaauuuaagggaggcucaaagaugcuuguuucugcuuguaugggcaggaagaucuugaagugauccaaaacaaccagccaaucauguaagaugccgacaaagauaacgacauguaaauucauaguaugugagcccuuaagaucuucaaaaaccacaaaggaauauggaacacacacacacacacacacacacacacacacacacacacacacacacacacacacacauacacacacacacacacacacagcuagcucccucagcaccagugauaucuucugaggcuacuguaauaaauacuuaugguuaaaaucaagcgaggaaacuugaagcuuaaagcuacagcaaucucuaaaucucaacuaggucacacucacgaggcacuauagcaaagugguuagaaguauggauuucugcuggaguuuagauccuacuuucaccuuuguuagugccguccuugaccuguuguuuaacuguuuccugcuuugguuuuuggccucaauaucauuauguuaacuguaauaucuaucucauaggauugcuggggaaaucuaaagaagucagcuauacucagcuuuuaugcaugaagcagaggggauauaugaaugcaaucuaaucuauuuguaugauguauggcgggggugggcggcuuuugccuuuaaguacugucuucauaaaucaugucaugaugcuacugugacggugcccaucccccuucuuuuagucacugaaacguaaguaugucucagggccaauuaacagaaugauuuauaauccauuagauucgcggggcacuucaggccuugggucuccucccagggcuccuaguaacaagguguaguuauagauccgugaacugguguccccgaacuccauucccaucuacauauugaggaaguuaacgggugccugcugagguccuuuguuuccuagaaggcagcauacuucugagguggagaagcaguuuuacugacagggacaccguugggaucuccuaggaacaaaguguccucugagaacauuucagcagugggcaguuuucuaagcccuuuccauuaaugaaccauuggagcaaauggugaugaaggcacauccccauccucacuuaggaauaagggacagacagaagcugaguugcccaagguucccugauauuaaauggcagaacugggauucgguguaccagaaauccuguucuggaacagacggguaagcaaagugacggguaaacaaaucaaagggccagguccuaacugcugcguuuccucuaugguccugugcuauccauagcucugcuagguacucagcugacacuuagcauccucaaugaucauagacauguguuuagcuaaacugauuuuagccuucuggcuugcuaggcguauagagucaagauguccucaguaagguuaauuuuguuuugcuaauauccuccgcacaaagcaggggucucaguuaggggcagaagagagcuccuuggcuggacaggaagugguagaugagagccagaaggaaacagcaugguugucaggcuuuggguuucuuuggcucuccagcugccacugucuuguuauguuuaguaaaaugugagguuugugucgucucuaggaggacagacguacacuuuucugauguccuuuaaugcuggguguggcaggggaaauggagacaagguauuaucugaaccaggaacccuggcaaaacucugcucucccgagugugcccaguggccuuaucuugagcaacaguuggggccaccauggcagccaaugcuuugcauugucucuccuggcuucuggaaggccugugcugcuuuuuagauguauucucauaaggugcugagaacuugcuuguuagucaccaaagugacuguggcagauuaggaauguguggaggguaccccaagucuuuauuuauuuauuuuuaguucuauaucaucaucaucaucaucaucaucaccacuuugguauguguguaucgaaugcauguauaugaagguauguuugugcagguacgcaugcccacacauguacccaaggauaccagagguugauguucgauauuuuccucaguuguucuccaacuuauuuuauuucuugagacagauuaucucacugaaccugcaguuuacucuuugggcuagacugacuggccagugagcccuccacccucauccuccuguguucucucccagggcuggccuuaaagauggguaccauugagaccugugcucuguuaugacugagaucucugguggagaugaggcagauggcuggagaccagaaccaguggagugugccuaacccaucaugggggaugagaguggguuuuguauuuugagaccuccuucagcaguuuuagggccugagaacugaaucucaggauggaaagggaggagucagaguagccccguaaguauuaaugggccagcacuguguaacacucucgugggugcccuuccugugguuaggguaaucagcuuuagcuaaccaucugguguuuucauucacagucuuuuggaacugcaacccagugugcguguuuccagggcgacucaguucaaugggguuuguuuuggaaaccuagacugagacugacucaguggcugaguucagcauuacgacuaugaaggccgggaggcugucuccaaagccuuugccuugggacugguucucaggggcuuuuaggaaagggagcacuugaacuagaccuuaucagagguguucugugcgcgguggacagugguuaaaacagacauccguaucugauuagaguguagagagugcucagcuucauagggagugucuguauccuccauguccacccuggcucagaggucaucucugaagaggggauggaaagauuguaagagccagagguuaaggaggacaggagggaaacuguaucccagacaugacaggaucacugcauucaugaaugcacaguagcucugguugcuugcacaagacccgcacaagaccaagccacucaacauuuuagccugaaugcucacacgcucccagagauagcugcggagcuauuuacaguugaugguuucagagggagagagaacuagauuuuuuaaaggguguggucccugcuagguuggcccaugcucuggggaauggccgcacaccuagaggucuaugggccauauaaaauuggacuugguagguuauuaaagaaaacacaaagagggcaggaaguugggaggggcgagaauauaaaagucuugggagaauuagggguagaaaaacaagggaauaugaucaaaauacaauguaugaaauuuugaaauaauaaaaauagucuaugaaaaugaaauaaaugagacaguauauuucacaguggaaauauuagcauacacaaauggcuguccauuuguucuguccagugugacacuucuuuucugucuuuuuucccccuuccccauuuguguggauaccuuucccaaccaguguaagugguaugccaagccaacuugucuguuuucuggguacugccuaaguguuugcccauguuaauucacucaauacugcaaacaccaugugugguaaaauacaauuguuauauuuuauugauauggcaaccggagauaugauucgguuaaagaucugccucaaaauaaacaagaagaucaggcaagauuggaaggcagcuccaaaccccaggcucuuaaccacaaacaacacuggccccauaaauucucugaguuuauugauuuuaggcuccguuagcuggggaacauuuacacacuaucucuauuaaaaaaaauccgcguggguuuucaaucugccugcaaggagacugcuaugacucaccgaggaggggcaccagggugcgucaguagacacgagucccauagcuguccugggcugaacuggguuguugcuuaugccagagcucuggcuggagaaguuucggggaaguaccaagugugcagggguagcaugcgagugaucccuccacacuugccugcccgucuuaguuuggcuggaucuggaugaugucgucuuaugccaauggauuguaauaagucauuuccacugauuucgaagacuugguccccuagauuacccucaaauguucuccaaauaauagccucuacuucugauguguggcccagguuccauaauucaagccucuugucacaggacuuuauuccaguaacuaguguuggcuuuguuaguuauugguacaucucuucagcucggggucaggacugcauguggauucggaugguggcccuggcucuaguugugauguggucuguuagggugaccagucaaucccaagacaauuccacucuccagcaugcagcuggauuuacggaaacucacacgaccucucgaggcuguuuauuaugcuggcgacggcuaaugcuugcacuucuagcaagucaccaguguuuauuccuugccaugacccuaugggguuacugaaaguuccaagucucauuuacagucaaagcagcacaagugaagagugaaagauauguguauuucgucugauaagaaacaaagagaugagucagagcuuaagcugagggaguuaagguguagacucugcgcuccugacugccaggcuggcucacccugguaggcaguuggggcuuuagagugcagacaaagcacuuuccuaaagagugucuuguugcauuuagguuauuuacauuuucaguagacuuugguuuuuauugaaguugauaggcuacuagaaaaaaaaugcaaugccaugcauaagcaauucuccaagguuugucuuuagauuaauuuuucaagggguuuagcaaggacacaggacacaggauguagucccaccuugucauauguucugacugcuuccaagggggcaaccaucuuauggaagaagaaaucgaaguucaaggauguuauaaaagccacuuagagccauccagcuggcaagcagggggcuguuuggggcagucuggcuccagacaccaucuuucuaauugcccauucuucucuccagugggaggguuucugggcuuggguuugggacacgaaggccaacucuuccugaggcugacucaugccucuucauccauuuauccaauagcuacuucuagcagaccuacugugugcuagagcuuguuaguucuggcuauuuacuacugugauacauguaugcuccgccuagguucuuccagaucucauuguuggauuuucaguuucugccucuguaacagauaagcaugaaaaacagaugaguaguucucacccuuuuggaagcccgugccugucuuauuuauaaagauaccuauaaacguagcuuaugccguccuuaauguuuuucugcaauuuccaaguaaguggcuuauggugacuaaaaauaaaaugagaacaauucugauguugaauaauuuuuguuugaaucacacaggcccucgucucucucccacucuguuccccaucacagccuucauucuuuucauuaagaagcccugggugcuauucucacgcuaaaacaaagggaucuaccguuauagcucuaacugcucugagccgcugggguugcgucuguuuaauuuauauucauucucucacccaguccuggcuuuggggacugugcagcaaauaaagcauugcucauuucuuuuacugaaaaccucaucccccccaugggacacuggugaugggaaucaugugcuuuggagccaucugacauuuccccauccuguuuggggagugugcagcgagggacaugcccaggacucugacacagcaggcccacaggcucuuugcucaagggccuuaugaguuagaugugcuuuuggcgcuaggaaaugccugggcuguuucuacucuagacuuucaugggaaaggcugcuucacggaccucuuagggacagcagauggcuuauaaauaucuccggaggucugggcuucucacuuaguaacguguaacuccaugcuguucuugaaagucuucguagauucacuuguaaaguaugaggagccaaucaccauggacgguaaugagcaggguauacugauuguauugcaagaggagagagcaggggccucaugauuaucacuagaggaauuuuuuaaccuggcuuuuuagcuucuuuaaagacuuuuuuaagugugugguguguugugugcgucgagggguguguggacacacacaggagcuagcgcacgagggaaggcgcuugugucgucuagagaggggauugauuggaucccccuggagcugaaguuacagguuguuuguuuaugagugccugagauggguguucggaacuaaacuugaguccucuggaaaagcagaacugcugagcaauccuucucgcccaugccuggacuuuuaaaaacagugcaaugaguuguuaaaaaaaaaaauacaguuuuuauaaacacaagcuucuccaccugugcuccauuuccugaauaaugacucagagguuuauuaauaauuauaaugcuaugaccuuaagcuuaggcucugcccccccccagcccccacuagcauguaacguacguaacucauuuauuauagucuaugucugccacauugcccguuaccucuucucaguuucaugcaucugacuuccucagaguucugggcgaauccucccaccucucucuagcgugcagaauaccaaaagaguuccauccucuauuuccugccuuuugcuaagaggccaucagcuuuuuauuggugaugcuuccaaacaguacacaagagagucucucuaugaauuuucucaacaaacacugacauagguacauguuuugugauaagcaucaagagaugggugaugcucauaacugggguuaugcuggcaaugguuaaagaauggauccuacagaagagguacucagcccugguguguagcuuucggcaaaucuccugugugcguacucuaaucauggugauuugaacuacugucaugaugucugcugucugccagaaucucugaauauauaagaaucauuacuuaggagccuguaaaagcugguccugaaccuucagccaguguuugcuuucagagacagaugaacagauagaaaguuucuccaagggacagugacucgccuauguggugaacacauccaggugguucagacuaacgcagcugggauaguaaggaagaauucuagggagagggagacaguuaccuuucaaaacagucucucugccuucaagccaagagaaaaggcguuggacugguuucaagguuccuggcagaccagcuacaucucacccuccuagguucguucccacacuggcugauacaaaccuucuacgcuggccagcccaggauguuguguccaguccugagcacauaaacuucucuugcuuccgaaggcuccucauucagaagaugcucucccuccaucuccaucucccugccuuguucagccuuccugugcacacaauucccacucucagacaugaaaggaaaagugacacaguggacuguagugaagugaaccauuuggguucaucacguuacuguuaaaaugggaaaggaagauggcguaaucaggagguauggaugguccuccauucaauacgggccuggguucaggaugaccaagaacucucccaaccacauauagacaagaguaagggagcuauagaguaacaauaacagcugucaauaagagugaaaauugguacagucuuuccauaagccuuuugguaguauuuauuaaaauuaugcauguacacacuaauuguucccuuauauagguaaaaauauggcacguguguuaccuaaagguuuauucuagacugcuccuucauaugcugucauuauaaggauuccaaauugggaaaaaccauaugcugaucuauaauagagaguaagucguggacuagucacaagguggaaugccauacagcuuugaggaaacauugagugucaugcuaugugauauuaugaguguaucucacagauguaauugugagucagaggggccagacucaaaagaauacaagugaaaauuuuuguaugcaaaauugucugccugucugucuaucuaucuauccacauguacaugcacacauacauauaccuauacccauauauacauacuguuugccugccugcucacugugacauuaguuuuaccccagggcucaccuugggugcuguuuucaucuaggaagcuacucuaacaaacacuucugagguugaucagauacucaugggcuggcagcauuuccccagaguuaccuccuuauaucauucuguaauuacuuuucugaaccuuccacucuacucuaaagggcugaacgggcagugacugcaucaauuuguauucuggguauuuagcacaguuccuggcccugagggauugaucacuauuaaauaauugcagagggaggucucuguauugugugagagaugaagcuuucaaucacggugagguacgagagugggagaaaguuagguaggggcuugucacuugucugaggugucuuuggaaguucacuucaacaaguuuaacugaguuguaaagacguaagcaucagauacucugcucauagccaccacucacugagcaacugcuacaugccagaucucaaacugcuggaagcugacuguauuguuuaagucuaaugaucaucaugagggguccacaucgucauccuaucuugcagguuaauuaaggcugagagagcucaaguaauuucuccugggucacacagcaggucagugguagcacugagcuaaugaacccagugcuucuggcuugaaauguaccagagcacaugucuuuagguucuacaucucucauauugaaagcauaugagcuaacucauucuggaauuaugcacaucuuccuucugcuuauugcuguagauuauggauaccucgugcauccauuguccuccugugcuguuuaaagggcaggggagaaggggauggugaauuccauggauccagcagagcaucugacccacaggggacacggaaauugcaucguuuacagcaggcaacacuaacauaggcuucacuuagcagaaguucacaacugaagcacucggaaaugugggcauggcaguacuacacugggcaaaugaugacccuguagauggacugagcaggaauaucuggccacccuucccugaagucccuuuacccucucaggccucugggcucagaguucacaggcugaggguguguuugcuuggcugugacuauccccucaguuucucuuucuggguaucuuauuucauaagcugagccugccacagagcucugggauucugcuggcuuuagucugagccucuggcuuucauugcugcccuucuagccagaucugggaaaggguuugaaaaaugacacugauuggaugcacauuugaugaaggugauggauggucaggcaacucugagucccuagacccagauauaauugacagguguacccuccugaugggagccaagacccagacuucuuaagagaggcccccucccacuccucuccacccacaccccuacuguuugccuagcucuuucugcagagacccaagggagcuaugggccuuucccugccccugguccucacucagccaccucugucuccuuggugcugaaaaaccccgccuguguuagucuucuauuuggggcugcagagucucuucccaucccauuacugaacacaugccuuggcuuugugcuggggaccuaguaucuccauugccuugcuaugucggaccccucuucuugugccuucccgccuuuuccguggaucuuccauucucauggagcauuuuagcuagaucuugaauuaaggucuuauuaggggagcuucagagcacauuugugacaacucuuucucuguuuucgaauuucagagauuucauggguugggguuaaccagcuagaagaugcaugucuuggaaaggguggaauuccagacuauuugaaagagagccaagaccugcccccagcaguuuagagaacaacccaaauauuggguuuaacuggucugcuagagaagucauaagauccagguccuaagaaccccuuggcaggcaaaagugaaacucuauagagucucccaacagcaucugcugacaguggaaguauuccacguuucuaaugaguguaggcuuaaacauacuugggaaaauaagucccgguaagagauuacucugacagcucugcaugcuaacguggacugcuucuuauuagagcagagggggaugggcuuucuguuuguuuuugguguguuuguuucugcugccaagguguguuguaaugucaagguuguuuaauauguaugagccuccaccauguaugagcgagaaucagagugcauuugcugugaaaugagauugguuccagucauuuaaacagcuccagguguaauaagagucgacaagaauugaugccaagaacugcuuuaaggauuaacucauuuaguccugaggcugguccuuucaggcaggacugccauuggcauuccacuuuuagauaauaaaacuuagguuugcuuacaauaauacaggcaggcaaggcuagaggugacauugaagaugagcuaucauguucuaaagccugcaugucaacugcuaacuuaaaaccugugacguguuguuguagguucagaugguacuggacuuguacauucuaaccccgagaaccuaccuuuauugauaagagugacaacaacuaccaaugaaggacauccucuuugagaccgaaaagagaacucgaugguuuguuagucacugauguuuguaauuuguccacuuguuuaucugccugagacugguccuucuuaaaacacugcuaaugaaacaggaugcuggcaucaacgaaggaggaaaaugagaagggagaagaguaggaaggcagagugaucaaauggcagagguuggugggauaaagcguucaagaagaacagaagcuguccaaguggaugcucugcuaguccugaggguuguuaguccucugcugcugcuaugugcacccuugaggcuggccaggcaucaaagauggcggugcucaugcucacuugauucugucuuacuccuggauaaauacugcuccuacuuccccaugucacucaaguaagaaacacaguuuacucugucccaaaggccuggcuccagcaguugucuuaauugaugguuuugaagacuguagagguuuugcuguuggugaguguuguaagggugucugugguucugugaucuggccucugcaaacuauccaucuggaugauguauaccaucaagcuguucucuguauuuuguuaaaauguauuuucaauugcuuguaaguucauuucaacuuccuuccugaaaaaaaaaaacucacuaauuauuccuauaaacaccaucaguugugugaaagugaaagccuguuugagucaggccgguggcacaggucuguuuucuuauccacguaagaggcagaggcugauggaccaaaaguucaaaggcagaagggcgagcucagggucagccugggccacuucaugugacaccaucuaaaaaugaagcaucaugaaaaacuauugugaguguucaagggugguaugcuuaccuauaacaaagcccugagauuacucagacuaaugcugaggaugagagagagagagagagagacagacagacagacagacagacagacagaccuaggcuuagcuccauaauccacacauaaaaacaugaaagucaaacuucucuuuaaaauucuuaaaccuaaaugccgagagcaugcaguuugcacacauuucauuuaagcaagccucagagagaacccuucacuccaauuagcuuagguaaggugcucucaugguaagguuaacauguccugucaguuuguuugaagcuguuggaagagugacaucccaucuaagccuuaaccugagcagaagccucuaugcgcucuuugcaaacaaucauagcuacucaggcgagagcuucacuccacagccauaggccaugcagagguguuagccauuguaggggcagugaccaugacauuugccuagagcacaucccuuaccacauuuccagugucaugagguucuaaccaugugaucuucaguccuguuuuaaggcccaacccaccucucacuugacauuuuacauaucauucuguauaacagaaucauuugccauguugaguuugccauucuccucauugcugaaucuuaucccuuggcucaggucauuauaagcaccaugccuaccaggcuacuguagacucuagucuaggcccuauuucuuaugcuacauccccuuucaggacguagggucacacgauucaacuaagcacccaucauguacaggugaacuucuacacaagagggugugcuugucuaaaagcgugggaguugugacaguucucuugccaaacauaccaaaaugcacacucuaaccaaaauucuagaagaagugggaauugagacguguacuguugagacuuggggucauggcaaggcauaagaggaaauaguacugagaagacaugauguuguguuaacugaccguaggaagcacuucuagggcacaguggagaauaagcaugcccagcucaugccauuaaauuguuuauagcuaguguuaagggcagagaaggaaacuuuaugccuugcagcuagaccaacguuuucuccucuguagcugaucacucagugugggguggugagaagaaacuagagaagcccugagcagcguggauuuguguuucaauagcauucaacaccccgaugaaucauuuaggacucacugaguugaggcacagaaaaggaaguggaaagauagcggcaguuuaccaaugugcuugcagaagaacacagaggggacgcagcacaacagaaaggguuagcuugggaacauuaaauggcgucauuacacauggcuccuuuucacuguccccacaugguacagcauagugagaggagcucuauggggucuccuuaugaucuucucuauuaagguuuucaaauggaggucuuacaguauagcccaggcugguccccaucucccagcaaccauccugucuuagccucccaagugcugggauucuagcuguguaucaccaccccuaguuuuggugucucuuaagagaggauugaaagaguccuuauuaucuuuuauaaagaugccaaaagaucucugucacaaaugggguaacaggcuccaauaccauugcauaguggggccaguauuucaccaugaauuucagagucauauaucagcauucagcaccgucuaugagaccucugaacagcgugcucucuauugugaaccaaaaggcuuuguccuagcuucugcuucuaggucuaccacagcuucuugaagacaggcccugaggcacagcucagagagagcaagucuccaauuccaagccuuuuggcgcuuguuccccccacacccacccucauuaaggcuugcucuacuuugaagaugucuccaagacccagaggaagcccuuagauagcuuuguuucuguggagaucuuuggcuggacuuuugcugucucucccagaggugagaggccgugguucccaaagccucggguuuggcaccagcuccucccugguaaguucagauuucaaaucuuacucuggccacggccuccucucugaccuagagugaccuuacaagccaccaagcagacagacucuuagccuuuaccauuggugguuuucauuccagacaggagccaauggguuuuagaaacggaaugagugggugccucucaccaucuccacucuggccugggucuggcagagauuuccucuguggccugggcaaggaauaacugaugaaaccaggcugucccagugcuuuguagugugucgagcaggcaaaguucuuauuacugucagauggcaugcaccugggcuacauaggaaccauauuccuccugaguuggggacggcucugcuaagcugugguggguccuauacguguuuggaaccaugacagcauggggaauaucagcaaccuugguuugagaagcucaguccccagccccaauggauaguugauaaugcagauacucauaacuggucaaagugauaaggauaagugacaguugaguguccaucucuaaaugagauaucucuaucaagaugcuccucacccuaggcccagggaacaccacagaagggaccaaaagcaucuaagcgguagaggauggagggagugcuaugaaguaugcucuugauaggacauggcugucacacuuaugaacuuacaacagcugggguccccugaauaaaaaccugcauuagaucaagccugucagcauuucaaaggaaugggggagggacuugugaaacccaccccugguuguaguugauggcuguagagggcugucuguuuuggaaggguuuagacaaugauagguuacauacacuccaauagaugcacccaccccaaaccacaugcauguaggagcacuaauuugucucaauggcuauaaagaaagaagagggcauugaggaggguggggugggacaagggggaacuggagaaaugggauggugggguuugggugcaauaaugucacauuguauacauuuuuaagaauguuaaaaauaaaugaaaauauuacuuuaaaauuuuagagcauuggagcugagagacagcuuggaauccaucuauucucguuuagcccaauuccuuuagugaagaggaagcugggcccuuuaugggaacugcaccacugcccagucugggugggggguggugauuaugguagagcccaagcuagcgcucaggcccauggguggguuugcugguaguuucucuuucuguccucgcugguucaggauccuuuagaggcugugaacaaaaugagaaagauguauaccaagccuaacacacugccugguauuuagcaagugcucaauuaguguuuaucauuacucgaagaaaaacuuagaggaacaagauauccaugccuuugagaccacugaaguuuuguugaggacucacaagacucguggucauacaugcacacaacugggaauuuguaagguacagguuaccguagguaggguuaucugcugagucaauggguucagcaauggaagagauauguuaugacugccuauaaggaggaaagaaccucauggaagaagcauguguucucugucuucucuuucuugguggcaagauuaacaggccagcagauauuucagauuguuaaagaaccccauaccaucuugucaucugcccaacacauucacugauuaucauuguacuugguguucugcacugggaaacuaaagaugauaauguuguaccuugacccccaguauacacacacacacacacacacacacacacacacacacacacacacacauauauauauacacacacauacacacacacacacacacacacacacacacacacacacacacacacacacacauauauauauauauguauauauauauauauauacaugaauguggcuuguaguguuuuaaauaggaaugucccauaggcucauauauuugaguguuugaguguuuagucaucagggaguggaacuguuuggaaggauuagaaggauuaagaggcauggccuuguuagaagaaagauggguuucaaaaacccauacccaacccagucuugcucucuuggccugcagauuuggaugcagcucucagcuacugcuccagugcuaagcuugccaccauacucccugccaugaugaucauggaucaaaccuuugaaacuguaagcaagcccccaccuaaaugcccagaugucccucaacagaggaauggauacagaaaauggaguacuacucagcuauuaaaaacaaugaauuuaugaaguucuuaggcaaauggauguaucugaaggauauccuaagugagguaacccaaucacaaaagaagucacuugauaugcacucacugauauguggauauuagcccagaaacuuagaauacccaagauacaauuugcaaaacacaugaaacucaagaagaaggaagaccaaaguguggauacuuugauccuucuuacaagggggaacaauauacucauggauggaguuacagagacaaaguucagagcagagacugaacgaaugaccauccagagacugucccaccuggggauccaucccauaaacaaccaccaaacccagacacuauugaagaugccaacaagauuuugcugacaggagccugauauagcuguuuccugagaggcucuuccagugccuggcaaauacagaaguggaugcucacagucauccauuggauggagcacagggucccuaaugaagaagauagagaaaguacccaaggagcugaagggguuugcaguccccuaggaggaacaacaauaugaacuaaccaguacccccagagcucccugggacuaaaccaaaaaccaaagaaaacacauggugggacuugugucucuaacugcauauguagcagaggauggccuagucggcggucaucaaugggaggagaggugcuugguccucugaagguucuacuucccaguauaggggaauaccugggccaggaagcagaagaggguggguuggggagcagggggagggggaaggggauagggaauuuucagagaggaaacuaggaaaagggauaacauuugcaauauaaauaagaaaauaucuaauuuuaaaaagaaagagagagagagagagagagagagagagagagagagaaagagagagagaaaggaagaaagaaagaaagaaagaaagaaagaaagaaagaaagaaagaaagaaagaaagaaaggaggaaagaaaggaagaaagaaaggaaggaagaacagccugagggguagagggggcgucaagugugccacccagaggucaaaaaaaguaaugagaccuggaucagaugccacuucugaggccucaagauaaaggcaguuugucaccuaccucaagagucuuugcuugucacuuucccguuugacuccuucacccuaugaccuaaguccucaugcuaccuugcaaggccacaagcaaacuggugagccaaaacccaggcaauauuaagaaaaugggcccuucaguuugugacaggcaagcuuuaccugugugacucguugcgguuacucuuugcuuuacacucugucaccucaaagcucagugagacaaagccacagcaaguguuuuucucauggcuucgcuucggugacuuggcucaccugucuuugcucaaggccuaccuugaaguuucuggaagccacugugguggggcuccacuggacggucuccucucuccaaagugggggaguggaaucuguugucccaugggaccucagcuuggauggucagcgggaacaccuaccuagggcuucuuuuuguggccuggacuuugucacagcauggugccuggcguucuaaggcagcagucccagggaagagaccagauauuguuccacaaacaucauuuuuuucacccguucauuuuguuagauguggcuccguugaguuuauauugacucaguucaguuauacacagugaggcgcuagacuguaacaacuaucuguggagacacuuuaaaacuaccauaaagguuucccuaguaaguauucugcugguuuaaaaacacacaaacagucagacagacagacagacagucagacagacagaaccuaaagauuuuguggauggcucugcauuuuaggaaggaagaucagagagcuggacuaggagaggcagaguaacagagaaggacuucuggacuagauaacuagaagucugaccaugccucuggugccccagagaaaggucguguaacauugggaaagacaaggucuccggucucuuaaagcuuuuacuguugugguucugugguuucggaagacuagaacauuccuugugaccuuccaagcucucaugccaccaucccacauacugacccccccccccuguggcccaggccuuggagagacagcccuccacucaugaaggccagaggagcugggauaggggugcacuggguaagcaagaaaggcuggguaggugggagauucacauguggaauccuguuuggaagugucaggagagagagagagagagagagagagagagagagagagagagagagagaggaaauauguguguguguaugcucugaaugaaguuccagggccuguugaaacccagcaaggucaugucuaagguauuggcaagccaaaggauauugcauugugugucaugcugaccacuguuguguguuuggaaagagcucuacuucuauuuagcauuuaugccaucuuccucuuccuccuggaaauccucuggcagcaucuagguuuaacaucccaaugggguauaauauacaaugaaaauaggugagugauauuauaugguguauggcuggugcccacucucugcccaggaagagagugcaucuuccacaacaguggauucacuuuuuaccaucuccuguucugcgaaggggaaugauguaaggcaaggcaucuggaucguucuuuccuucagcuacuuuacaaauucuaguugucuccauuuuacagauggaaagacagaggugaagggaaacaaauuccuccucugaugaaggcagaaggagcuuuugcuguucugugcaagcagagcugguaaccccaggucaccugggucacaucucaaguccuuaagcauauguugggccucucaaggauuuuggcucaggguuggggacaucauguagagaggaaaaggccaggagacccagggagaaguuaggagugaagaagacuuugacauauccucaggaaucaagauaagcaugaagauguuugggaggcucuguuguuugugugugugucuagggaccucuuacccaaaccaaagucauuucugcauauuuuucugcugaauaugaaauacuccaaagauuacucuucuuauuuguuaaauucaaaaugacucagcagagaggaaaaacaagucuugaaugaccuccaauguccucugaaucaaauccgugaaugagauuucuccucaucaaaguguaaucgucugcacauguacacacgagugccacacaguuauaucuguacacaugugucagcgucagcuugucacacauccuccgauuucauuucuagucauucccuggcuuuucauccacacccuggacagagcugacuggccaggacagcggcccuucauaugugguccuugacauaggcuucaccgaggcccucagaggaaaucuauagacacugauucuucaucaaauccagcaucaugucagguuguccucagcuaucgggucugggacgauggacagucugggaaaagggcagccugcuaaguuggacaugcuguauaccugagaaguugguuauacacuggauuuuagugcacugaguauuauuucgaaugcacuuagaggauuucuguuuaaaggugccagguccuggauccuuuagcaauguuggcuacucauucaaugauucacaacuuugauaaguagacggaacacuuuuaaaacaccaaaugccauuuuaaacacacuaugugggauuuguuauucaaaacuaaucagcaaaguuuuuuuuuuuguuuuuuuuuuuaaagaacuagccugugauggggauaagaauguaaugguuuucacauuaaguaagaucaggcauuucauaaggagggauggauauaccuccaguucuacuucagagaaaaagaugaguuauacuaacauucuauaugaagauacaaaggacccuaccaucucuggguuuagcuuucucuaaggggcuugggaagaacagagcuguuaaaacuucuuacucacuaggcaagaagaccccaacaguugccuggacuuccuacuuuuugcauuaugacagacugaaaacaagggguuacuuuaaaaaauuaauguuacuuauuauauauauguaugcauauguauacauauauguacauauauauguauacauauauguacauauacauaguuucuaaagaaauuucugauuauaauuguaugcauaucuguaccaucuaaaucaguuuauuucucuacuugucuucugcaugccaucuaucuuaauuuauuaucuaucuucugucauuuucauccacuuaucaaucauauaucaucuagccuuucucaucuaccuuucauuuauaaucuaucaaccauuugucuauuuuuuuuacccacccaucauuuacuaauuauuuuccuaucaucaaucaacauugauccgaucuaucuaucuaucuaucuaucuaucuaucuaucuaucuaucuaucuaucuaucaucuaucuaccauuuaucuaucauugguuauuuuucuauguauauaucuauuaucugucaaucaacauuuaucauauaucuaccuauuaucuuccugucugccuaccugccugucucucuaucccccauguauucaucuguccaucuauccacucuuccauuuauuaucuaucacaugcauuuaauucuauagugaagaauagauuuuccagugggguuuguggauuggucugccaaagagugugguuucccacuaacacagagaguccaaccuugcucugagauuaugaagcaugcgcauuagaugagguagugacauuagcuuucugcucacuuagaagcucaauauuaaugucaucuuugucucucaagguucuuucucucucaccuauucacuacugugaagcuuguucccagggagguacucugauuuaacuaagacaguuguaagagacagguaccguuauaggggcgcauagcccuugaguucaagagccauaggacugaccaagagugaggcaucuugugagaaccuucuguaaaauaggcuugaccuuucucuaugaagugacuuuacugcaguugagagaggcuuuuguaagcucgucggaguucagagguaauuaguaagaaguugaacuuuccauacacuuguuuuuguucccugcugaagaguugcucauuuuuggguguggaugccacacuccuggcugaccuuccauuuuucuuccugauuuccuaguaugucuaaaucuugguguggaccuaccuaagguagaaagucaauaaucuucuauaagaucucauagaguuuauaggaaguccugagcuguggcuucuucuauguucaccuaggaguguccauugaacacggggaaggggaggggauuuugaguugaagaaggggggagaacggauucuuuacuaccuauucucuuugagccacaugcccauugauguuccuugggaaguguugagcugugggcagagaaguaccagccuugacauuagggucacuaaaaucgauguuaacugucuuuccuccuaacuucaugguccagggaauuaaaaucaaccuuguuuugaggcagggaaaacaagaucccuaaucuuagaugagucauagucugacuugguagacagacagacagacagacagacagacagauggguuaagaagagaacuauacucauaguaguggaugggaaaaaguagcugguacaggugagacuguccaggguguuaaugaagcaacugugcuuucuagaucuguagaaagaagaugacaauccccccucuacaugauugugaugacugugauaucauacauuugaaagauccucaacauucaaaacuagaaagacacaaggugauucucaaccauuuuugugcucccacuuguaagauguuuuaaucaauauggucucugaguaguccaagugucuuuuggagaugcaggccauguugccccaacaccucccauucuggaacaugcaggauugccuggaaagcaucuugagauucugacagccuuaugccaagaauaauguuuucauuuuuuucagaaaaguuauuauaagugacauuaaccaaaaacacauuccccucuuaaagaucaaacaaugaacuaggaagauggcucaguguauaauggacuuguaaagauuggaguuugggucuccagaacucacauaaaagccagguaggcagguaggugugguagccugcugaagucucaguguguacagggaauuccuggagcgagcuagcuagccagacuagcugcaucagagagcugcuguucaacaaaacagucugcugcugcaguuaauaaagugaagaaugacccaggaagacagucaauaccaaccucuguucucuacacacagguacacaagcauguacguacguacagcacauacacacaggcacaaaaaaauagaauuacuaugaauaaggcagucuccauaauugcagucauucacgaguccucuugccaaaaucugcacucucucuaacaucuucugcucugagggagucauuguuaccagaucaucugugaauauauaaaugugugugcucaugaaaacauauagaaugcuccaaaaagacuuugcagccuucuuguucaccuaaaaacaugucacaaguggcaagcuaugugaccgcgcauagcuguagcucacuguuuuuauuuuaaugaguuauuuauuuuauguguaugaaugguuugucugccuuuaccacauauguguagugcccagagagaccagaagagagcgcucaauccuccuggaacuggagcuauaguugguuguggguugauaugugggggcuaggaggcaaacugagucuucuguaagaacagccaauacuauuauacgcugacccaucucuccagcuucuggaauucauucuuuuuuugccaucaaaaaguauuucuguaguaggaacagcauaguacuuagcauccuccuguugauaaacaucuucccaaguuuuuguuacuuagaaaauauacugcagagcacuuguguguacacauaugcuguauguaccugcaaccugcucucuaggauauguaacaugugggcagcauggugcauuuuuagcuguggagcaugcauuucacaccauugucaggccucacgucaucaagcuuggauagcuugugagaccaauucagcgacuacucugguguuugguuuuuggauuuuucugagcuagaaugcuuucagaugcaauauacuguccccuuuguuagauguucuuuauuuacuuggcccauauuuuuaguggcuuuuuacaacagaaguuguuucacuucacaguuucaaauauuuaacuuuguuccuugcuuaucuguuaaguuuauaauaucuuucuuguuccuuggauguuuugaauuuuuguggggaaauguuauuaucacuauuuuucuucuauggaguuugcuuuuuaugucuuuuucaugcaagccuuucuuuaguuuauagcaaauucuuguguuuucuugagguccuuucauuguucugucuuuacauuuugggcucuauauuuuugugugagguguggauaugccuuggcuuuuguuuuugaaaaggcuguugagccacuggcacugucauugauguuguuuuguuauuuuaaugcuuauuuaucaaaugcuuguuuauucgugaauggcuucuggcugcccagccucuccacuguuuuccuuaucugccucugaaccgcuggcaugcuuagaggauuuuuacuguacggcuuuccuggaacagcguaucuacuucugcagucuucaaucuuguuuucuuuauuguuuacagcuccuccucacaugcccuaacaucuuguuuauuaugagagugaaaggggaagaaaugauuuagagcauuuggccugucaguugcugucucuuuaucuuugcauacuuuuauuuuuaauuucauuuuguuuuuuuggggggggguauuuuuguuuuuguuuuugagucagggucuuuuacugagcccacugauuuagcuagauucccuggacagugagauuaaaggaucccuuucuugucuuugucuccccaguacuggaauuuguagcugugucaguauaccuuagugacauggauucucggagaucaaacucagguccucaugcuucuguagaauacauuacugccugagccacugacccagcccuucucugacauuuaagauguauauauaccacgugaauggcauuucccaaacaauugcugaguaaaugaauacaaggcaguacucugaccaggcauauuuucauuuugaauuuuauuuuauuuuaagacuuggaugaaguguuuguuuuaggaguucauguuguuagucacaaaaguacacagaggaggacucucucaacugcucaucgcauuuccaugauugcucugggcucugucaugugccacauggguaaauacugaauccuugagaccauugauucagaggguuuugucugcucauuggaauccuugaggaaaauuccuuuuagggcaaaacauuucagauuagcuagauauagucacugaguauuugggucuaugaugguauuuaucaagccucucuguugaguguuuugaacacaguagcauugagaauaaacauggagcuuacagaaaggauacuaaauagucacggugaccauacauaguugaaagcaugauccguacuauaugaaaagcuauguuuucagugcauugagcaauugagucagaacacuuagcugcagaaauaacuauugaauaaagacuugggcagguaaggaggaaagagcuugccagagguccauaggcaaaagccaauagaagaaauaaaugagaagcuucaguagaacugagcuggagaguaggggcaauagaauagaauggaauagaauagaauggaauggaauggaauggaauggaauggaauggaauggaauagaauagaauagaauagaauagaauagaauagaauagaauagaauagaauagaauagaauagaacagcagacuaaagggaugaugacaaugucagugaccccaggcagacucuggagucaugcgaaccccaggcccaugugccuguuuguuucuuugugcuguaacauggggccacuuguuuaaaaucagauuagcuauguaaauuauuuggaauucuuuuucauggaaaaugagcuauucucccucauuuguuuauucagucauucauuuacaucaacauggauuuguggauauuuauuucauacucugaguuauaaucuaauacuccucuauuuguuuuguugaucaaauuguuccagcuuucauuacugggagaacuuucaguugacuccuaugugcuuuugauguauuucaucguguguguguguguguguguguguguguguguguauguguguauacacaccugcacgauugcaugugugugcauacaacauauauucuaggcuuaucuuguauauuuccugauccagugcuagacucaaccaguuuuucuaaagacuucugauucuuuuauuggaagaugggauuagaagccaagaucugggcacuugguuugcauugucaaugaaugcucacugacaagaugcuguugucucuaggccuuucagcugagugaaaggacagugcauauguaguauauucacuuguauacauacaaauaacuacacuauagauagauaguuacaauguaacuccguaugccucuauuaagcuaaaucuggguauauauugauauguccauacuguaucuaaucuguugucacaugaucacuuggaggaaaccuuaaagaaagaaagaaagaaagaaagaaagaaagaaagaaagaaagaaagaaagaaagaaagaaagaaagaaagggaaaggaaggaagaaagccaaaaccaaagacucaaaugucacuucaaaacuaauggaucaagauaaguguugauuuauagagauuuaaaaagauuaaaguuacugaauguuuuucuuggguuaauguuggaauuaauguugauaauaugaaaauauuagcugccaucauaaauauaaauuuuacuuuguuacuaccguuugguauucgcgucgguaauacauugcuaccuguguguaguucuguugauuuuuacuuccaggagugaguguuuaauccaagagaguuggaaaauucuugcacuuaaugaucccugggugggauuugaggcuuuaaauguggaaauaaacuuuacaagagucccagauugucugugaagaucguguucccgugugcuggugaaaucugcauuauucacuucucuuccuucucucuuuccuugcauugucggugggcugcagacuccagauccaacuccgucuucugaaaugaucccgauucccagaaugccccuggugcugcuccugcucuugcucauccuggguucugcaaaagcucagguuaauccagguaacacagccacuacucagcugggugcugaggaccaggugcuggcacacaccucugccagugguuaucuuagaaagagcucugccaagaaaacuccacugucaguucucccuguguggugaaccguggccacgauggucagaaacaggaaguuguaucacucccccucuccuuauauaauguguuggguauuauacaagagauuuuacguagaccagagccauuucaauggcauuaaaaaagauuaggaaaaggaauggcuguuucauguuguguauuuuggggaaaaugggaaauuagagauguagcagacagcuucauuugguuggcucauccauuggaugucuugggucuggauuuuaauugaguguccuguuauacuuuugggaugcuaauucugugggaugccggguucccaagaucucagguaagcuuuuguucucacaggaugugacuguucaaaacagaugugaggugacucuuuuaagucaauauuuuuggauuguuuuaguucauauaucuuuaaacuuuaaccuaaaguaugugauuguaucaacugucuguuacacaacauguugcuuaacgauugucaauagcucaguggcuuaaaaacaugaauguuuguuuugcucauaagcuuauaguuugauguuuuaucugucuuggcacauuuaccuaucugguaauauuggcucaucuaggguuucuuuggcccugaugaagggcacuuuggcuguugcucuguggauuccucuagcagacuagccuggccauguuuucguggaaauugcacaagagccugaguagaagcagcguaugcaaauucaauccagugcucaaauuauguuuguuaagacuguguaggccaggaugagggcuguaacugaagaccuugucuggagggaugcgggcuggagcuugguagugcuuguccacuaaggagacccuauuucaauuccuagcacugagcggggggaccucauuggucaaaguaggucacauacaugugcucagaguccauagaacaaaaagaauguguaugauaaagagauagguacagguugucugguuuuuuucagugaagaaauaaaucugugggcuggagagauggccuaguuguuaagagcacuugcuguucuaccagaggcucuggcuuugaaucccggaaccuacauuuaguuccuaucauggugggugucucagaacugccucuaauuccggcuccaagagauccagugcacuccuugacuaaauggaacuccaucauaccccucagaucuuaccccagaaauaaucacuccccgaauguauuguauaucccacacauguagauuuuacuaaaacaacacauagcuggggauauagcucauuugacagaguacuugccuagugugcagagaguaccauagaggacugagaguggcgugcauaccucuugccagucgugguggcacaugccaguaggauagguaaagauuuuaagucauuuuaaaaauucuuccucaaauacaaauauaugaaaguacacauaucuuaguguucaguuugauggauuuuuacaagcccaagauauccauucagaccugucuaacuugaagcagagucuaacuaugaauguggacuaacacaaauuguacacuuacauaaagcaugaggguuuuuuuuuccccauucuccuuggacacaccagaggagggcaucuauuacagauccuauuacagaugguugcugggaauugaacucaggaccucugggagaacagccagugcucuuaaccacugaaccaucucuccagccugugagguuuuuuguuuuguuuuguuuuguuuuguuuuguuuuuguuuuuuaaugugauuuuuuuugauugugcugcuucucaaugugaacuuuguagaugacaacauuguguggcaauaucaaagauuggacagcccuggcagugagcuacccuucauauauaagaaacagaggcaucauggagagcucucaccuaccucgcccuggugacagcaauuauguugcucucuagcaagaaagaugagguuucccugcuuguauuuuauauaaguggagacacaggauacauggacacugugccuagcuucuuuaacugaacauuuucuguauggcauuuauuccauggcuacaaguacuagcugacuauccuugcugugguauaauauuacuucguguaguucauuuauauggucuaguacagaugggaauuuggauaguuugggccuacugugaagaaaucuuccauauucuuguauagaguuugugguaaggacauauacucacuuuucugggguuuauauacagaaguggaauuccuugguaacuuguaacauaucauuuaguguucuucauaaugccauagaguuuuccaaaguguuuuuuuuuauccacuuagccucccacaauaguauguagaguucaauuuuccaacuagcuguaauuacauuaucaaggguacauccaucuugucuuuguacuagcauaaugguauauuugugagagugcuuccucccaccaagucuguguccaugggcuauucuuuauguccuuaguaggaaacaugaucaaaacuccucaaauaaaauaaaauaaaauaaaauaaaauaaaagaauuguuguuugaguggauucagugccuuucucauuauuauaauaagcuuagugaaggcaccucagaucuuaacuccaacagcuuuuaguauuucugcuguguauuccucuuauccucuaaaguuugguuugucuccucugauggucuuucugcucuaagcuccaaagaggagggggaagggugcacacaguugucauggagacugguauacccaggcccacuuaagcaauuaaaccaagagaaccaguuucuaguuagaauagaaccaguuucuuguguuagaauacaagcuguaguuuuugaguaggaaacgggcugccagaaggcgauuucacucccugucuugcuauuaggcauuuucguuggaucuuucugccagcacaaagaaauggacaucuuaauuuugaaccauguuccuaggcauaugcuaccaagugaagggcugaccauucucuuugccaccuccuuccauuuaccaguuaagcuggaguugaggauguagagcagacaacaauuuuuccauuccagcucaguuuuaaauggcugucuaggaacuuggggcucauggagcuguaugguuuggccacuacuuagugcagaguagauacauaauaaaugcuagcugauuuagaggagacgcuucagggguuccuacuggugucucccaaaagacugaggcaacugaaaguacugauuguuacagauguugcucagggacaagcaguucugggcuuuuaggauuguucacacagguuagccaaacuguauaccagagagacuuggguuauaagcaaauauuauaugaucaacucuuagaagaaguugguuuaagaccauuuuagaagguaucagaaauccuauccuaauuaguuauaagccaaauuuauugcuuuuuguuuuguuuuaaaucuuuuuaaaaauuuauuuauugauuauguauacaguguucugccugcauguaugccugcaagccagaagaggacauuagaucucauuauaaauggcugugaaccaccaugugguugcugggaauugaacucaggacuguuggaaaagcagccagugcucuuaaccucugggccaucucuccagcccgccaaauuucucuuuaaugauuguuugaaagaaagaaagaaagaaagaaagaaagaaagaaagaaagaaagaaagaaaggaaggaaggaaggaaggaaggaaggaaggaaggaaggaaggaaggaaggaaggaaacggaacucagcaauucaaaauuuuaaggccauccaucuacaaugagacagauauuuuucuauaagaguagaaaaguugguaauccaguagaaacacugcaguucauaauaugcuuguuaauaauugucucauggcuucaggcaccaucuuuggcacuguggagucuggcagccugugcagugcaaagugcauguguccugcacuaaccaucaaggucccagugaugcugugcacugcaacaugggugagcacagccagaaacaccccgcugcuacacaucccagucugagcugaucuuugucguugaacuuucaaaaaaauguuugcaauuccuguguucuguaacccccacccccaccucaaguaugagauugugacccacaguuuaagacaucaggcuguaacccaucugaguuuuggcaaaggaguugguaaguccagugacgauacugacauuugcauagauggcgguguucuaaguagcuagagaggcuguggagcaggcccugggagucuccaugaaaaauaccgagaugcugcuuguuccaguucugcaguauggcuagugugcuagcaaccguuuaguuccaccagugcacuagaguccaaaccuaacaauugccaaucugcuggaggaaguaauggaaaggcugaggguagcauuguaaagcagaggucaugauucagaaguuagaaugaauggcaaccugcacccagcaaacaacuaaacugccagucucuccaaggcaucuuuacaagccagcaagucaauuuaggugggauuagaaaauucuaacgaacaaugugaaguucacuuagaaaaagucuuagcuuuaguguuuauuuauucuuucauuuauuauuuauuuaauuagcuuauaacuacaaguugauuaaguuugagguucauuuugaagccaaaacaauagcauaaggcuaagagagguacagagaauucacacuuggaaacuuagucucuuugucgaacuaaaugaggaaguccuaaggcagaagaccuuuggggcuaguucaccuuggcaaagaaacugaaguacuggguauguucugggucccuucuguaacaaguugccuucuuacuuccaucaagacugauguauuucuauuuccaaauuggaaaauuauuauuuaccuggguucucacuauucaaauuucaagagaaaugcugagaguauaauacucucucucucucucucucucucucucucacucucucucucucuuucucuccuuuccucccccucucucuauugcucucuugcucucuuucucuggugauuggaacagaucccugggagggaaugauauaaaaaagcaagacagauacguuccuggaugaauuccucucaaaugagcuaucuagaugggcucuuucuuucuugcauguuuguuugucaaguauagcccuggcuggccucugguacccuuucuuccaguaaaagaaucuuccuuuggggacaacagaaacucaacugucccugaacucuucugauuacaccaaguaaggaaaaagaaacuguucguugaagagcucauugaaagcaucaagugauauucaaagaucaugcuacauguuccugguacuguauuaagucguacuaauaauguaaucuucagaauguaauaggaguauguaguauuauuauuuuaguuuuacaggggaggaguggggccccacaaauguuuggugaaaauuaaauguuauagaggaaucagaguagccuagaugggauccugucuaguacuaugaggaugauagaccuugaccucugagcuccacugccuccugaagguagugagacaacuaaauaccaauguauaggagucugugagucaugggccaguugugugggcauagauacuagggccuaagaagcuacugcaguugaaucucaaaauuugauuuguggaggcaaaagugcauuuuguaaaagaaaacuucucuguuacuagauauuugaaggacucuguggccaguucucagaaaguucaagaaagacugguuuaaucuagucuuuuacaaaugaggaaacugaguguuguggcuguaucauuucuuugguuauagugaaaugcuccgaacaaaaggaacacaggagaggaaguuugguuuguaguuguagguuauaguccaucccugaaggaaaaucaacacaggaacucaaguaacacccacagccaagagcagagagaaauaaauguauauugcugcuugcuuuugcucagcuaucuuuuuucacuauuauauaguucagaacccccugccuggggaauggugccacccacagugggcuaggucaauuaacaaacaagacaagcccuugcagauauggcaaaagaccagccugacuuagacaauucuuuuaugaggcuaucuucccaggugauucuagauuauggcacacuggcacuuaaaauuaauugggacacagguucacagagacaaaaugaugggaggaaacacccauuaaaaaacauacugcuaaaucuacuuuguacauaggcuguguccugauuguaugaaugagcauggcaggguuuucagccuuuguuugaacacacucagucuucucaucuaucauugcuaaccaccuacggacuauugcaaagaacaagauuaugcauguaaaggaccuggcauaaacacccaacacaugaaaaaaugcuuaagagauaccaggucuucuggccuuaauguauuuauuguauuaugaugauugcguacuucauuaacaauuuaauuauucuacacugucucauguauuugaaauuguguagaauauacuuuguguguguguguaggaguucauggaucuuacaucuuaggaugaaggagcuccaaguguaauuucuugacaaacaguauuuuaucccaaguaucugguagauucuuguccaugcucugaaguuuugcuuguauuuuguuauuuuuuuauuuauuuauuuuuccuuuuccauuuuuuauuagguauuuagcucauuuacauuuccaaugcuauaccaaaagucucccauacccacccacccccacuccccuacccacccacucccccuuuuuggcccuggcguuacccuguacuggggcauauaaaguuugcguguccaaugggccucucuuuccagugauggccgacuaggccaucuuuugauacauaugcagguagagucaagagcuccgggguacugguuaguucauaauguuguuccaccuauaggguugcagaucucuuuagcuccuuggcuacuuucucuagcuccuccauugggagcccugugauccauccauuagcugacugugagcaugaacuucuguguuugcuaggccccggcauagucucacaagagacagcuacaucuggguccugguaagaaggacacaugcuccacuauguucauagcagccuuauuuauaauagccagaagcuggaaagaauccagaugccccucaacagaggaauggauacagaaaaugugguacaucuacacaauggaguacuacucagcuauuaaaaagaaugaauuuaugaaauuucuaggcaaauggauggaccuggagggcaucauccugagugagguaacacauucacaaaggaacucacacaauauguacucacugauaaguggauauuagcccaaaaccuaggauacccaagauauaagauacaauuuccuaaacacaugaaacucaagaaaaaugaagacugaaguguggacacuaugccccuccuuagaagugggaacaaaacacccuuggaaggaguuacagagacaaaguuuggagcugagaugaaaggauggaccauguagagacugccauauccagggauccaccccauaaucagcauccaaacgcugacaccauugcauacacuagcaagauuuuauugaaaggacccagauguagcugucucuuguauuuuguuauuuuacacucuugagacuaaagucucaagcuuucaagaaucagacaguuguuggaguacaagagaggauagaacuuuucuuccaguggucauggagucagaaugcuuggagacuuaggcuccaagccacagugccaggagcaugaucauguaauugccaucagaauaccacuucagguuccuuuccugggccuccuuucuuugccaccaacugcgaacucagguucacuuuguugagaggccaagagaccacagaaggauccucaauccugccaggaacauacaaggugucagugucuccagucacugagggccuuacuaaauugcuuagacuagcuccaagaaugcuacauagcccaggcugacuuuauacuugggauguaccuaccucaguuaggauuauauguguauacugucaugcccgguuuauuuauuuguauauuuacaauuauguucacacggugacugaguugucaaaucuccagugucuugcuggcugaaaugcuaagauauguccgugagcuacaggucaggugacaagaggaaggugaugcauuugagugcaaggaaagguauggaggcacacaugaagaacaaaauaggaagauaggaauaguugccaauaagacgucacaaaggcaaagauguauacaggugguacaauaagcaggcgaaacauaauuuugaaauuguuaguguaugccaaauauuuaaugaccacagcucuuaucugcaucuaggacuaagauccacgauggaccccugacugcaggaggcagguuucuugugcuacuacauuucaaugucucugagaccgggguauuguuaaguuuuaaucaguaauagcccuccuuaagcuuucuuuccagauuguucuucuccuuggacaucuuccuggccuuugagaucauucuuaggacagugugucaacuauuugcuauuagcaauggguggagagagaggugaauagauggugacuguggaggucaaaugucaagauuccauucuacaucugacauaggucaauguuaugaccuuaaauacuaaaguaaaucuugguaccacacuuuaaucaccagcucuuuguugguauaaugaaaugccugaggcagggugauguuaugaaaaaacacaugucuguacucacagguucaagagcaaggggaaggacaugacagaaguguguucaaaaaaagagauggacagagcuaauuucagucuucaauaacaaccaaucaugggguccugagagagugacuuugcuuucuguaggugggacccucaccuaagaacuucccaggaguccucaccuuuuaacauuucuccaguuuccugauugccacauuggggacaagguggacaauguggaccucugaggaacaaacaaaacucaaacaauugcucaauuauaaaccuuacucaguuauaagguagagaauguaacuuuacuauuuccauucacaagauuaccugggggugaagguggggaacucugggagacagagaauguauuaagucaaggacuugggaaaguuacaugcaaauacuaaacugccauuugugacuuuggaaaaagaagggaaucaaaauaaucuagacaccccacauacaaaguuuguaucaaguagauaacaagguaggaaauggaaauacaagugacccugauuuugccugcagucuccaagaaagacuugaguuguuagugggaaaugagaccucugccagcccugggcuguagucauccugaccccaaagugacagagcaaaugugguguauguguucuaggguagagugauuguugauuuagcuuuugcuuuuagaagucucugaagagccaaauaagccuuucagaguuuuuggugguuuggacacauacauaguuaaaauaaaacaaaguuacagucguuaaaucuuugagguuugaguguguguuuuaugggcuuauguggguggugauaaauuguuaaauaacaugcaacguuuccuucugauugggagauguuucuggcuuuggccuuuaucuguuuuucuguggugaugaucucccacgcacucauguccaugacgagugcccguugccaugcuuggcuuaugaaggcaaucaguaaauacuugaguaacaagggcagcgaggguagaaaugaaagucaaggaacguuuaggcccaucugcguuuuucuccaaaggggaaaaguguaaauuguaucaugcgaaccuucauuucgagaagcuguuggggaagcugaagggggugggggcgugggaaugggauuccuccaacagugagaugcuaaguguagagaaagcaaaucagaaggaggggggggggguugagggugagcugaggucucccagcuguagcuaauucccagucuccucagcucuauguggagacacccccuucccagguggagggguggagcaacccuggccacacaggagugagauacccagguucccccuccuaugguauacaggaugagaauuuggaguguuacagguaacagagggcgugguugcauuugguguacuucucuuacucuuggcauuuguuauggcugaguucagacugccccuuucaaauguuacaaccacaguaaagaucaaaggcgaucgaggccucccuguguguuaucacuaacacaucccugguguggaauaagccccaucuguugagauggggcaaauggaauuuacaaaaguaugcuuuuuuuuuugaugaauguuaucuuguacuuuuuaauuuucauacuuuuuguucuuuuuuuuuauuacguauucuucucaaugacauuuccaaugcuaucccaaaagucccccauacccucccccccacuucccuacgcacucucauuuuuuuggcccuggcguuccccuguacuggggcauauaaaguuuguguguccaaugggccucucuuuccagugauggccgaccaggccaucuuuugauacauauguagcuagagucaagagcuccgggguacugguuaguucauaauguuguugcaccuacaggguugcagaucucuuuagcuccuuggauacuuucucuagcuccuccauugggggcccugugauccauccaauagcugacugugagcauccacuuauguguuugcuaggccccugccuagucucacaagagacagcuauaucuggguccuuucagcaaaaucuugcuaguguaugcaguggugucagcguuuggaagcugauuaugggauggaucccuagauaaggcagucucuagaugguccauccuuuuucgcagcuccaaacuuugucucuguaacuccuuccauggguguuuuguucccaauucuaagaaggggcacaguguccacacuuuggucuucauucuuccuaucuccuuguacuaaggucaaaucuuaguggaucaaggaacuucacauaaaaccagagacacugaaacuuauagaggagaaaguggggaaaagccucgaagauaugggcauaggggaaaaauuccugaauagaacagcaauggcuugugcuguaagaucgagaaucgacaaaugggaccucaugaaacugcaaagcuucugcaaggcaaaagauacugucaauaaaacaaaaaggccaccaacagauugggaaaggaucuuuaccuauccuaaaucagauaggggacuaauauccaauauauauaaagaacugaagaggguggacucaagaaaaucaaauagccccauuaaaaaauggggcucagaacugaacaaagaauucucacccgaggaauaccgaauggcagagaagcaccugaaaaaaauguucaacauccuuaauuaucagggaaaugcaaaucaaaacaacccugagauuccaccucacaccagucagaauggcuaagaucaaaaauucaggugacagcagaugcuggcgaggauguggagaaagaggaacacuccuccacuguuggugggauugcaagcuuguacaaccacucuggaaaucagucuggcgguuccuuagaaaauuggacagaguacuaccggaggauccagcaauaccucuucugggcauauauccagaagaugucccaaccgguaugaaggacacauguuccacuauguucauagcagccuuauuuauaauagccagaagcuggaaagaacccagaugccccucaacagaggaauggauacagaaaaugugguacaucuacacaauggaguacuacucagcuauuaaaaagaaugaauuuaugaaauuucuaggcaaauggauggaccuggagggcaucauccugagugagguaacccaaucacaaaggaacucacacaauauguacucacugauaaguggauacuagcccaaaacuuaguauacccaagauauaagauacaauuugccaaaugcaugaaacucuaaaaguaugcuuuuaauuugugacguuuuaguaaauuugaucgacauuuaagauugauaauagaguuuguguuaggaccuuucucaaagugauagauuaguucucccucccgccaauuaaguuaaugacagccccacaauucuaucuuuggcuacugguguguuucuuucccuuugucuuucuggguuuuuuguuuguuugguugguugguuuguuugaucuugacuuguaggaccccaagaaggagcccccccacucaagucucgggaugcaggguuacccaaagaaacacgagagaccuucuuguugcaaaagcacguggcagcuuuaauggcggagcucugggucgauacguaucucacgcaggagacagaggaaucgacccugagacucaaaaacucgggguuuuuauaggguaggguuuaggggcuaggaagaauuggcacaucugguuaauguucagcuuucaacuaugcucucuauagaaaggggggugagcaggaggcgcugggcuaccagauggucaaugagucagccaagauagucagaaccaguuccugcauuccuccccuuauccuuacgaccgggugaccuagcuucaagacggacucgggcaugcccgggcuuuuuuucuuuguagucucagucccaggccuuuuuaguuuaaaccuuuuauuuuguuuaauuuucuuucauuccccucuucuucuguuuagacuaauucuaaucauagaauuuuagagauugguguccccuaacuaccugaacuacagguugauauugucucugaagaaccaugaguuuuacugcaucgauucuacucuggaugaaagccaucccuuuauuuauuauacaagggccgaaaacuaaagcuaagcauaucauaaggacugguucagcuacaguggaaaucaaagaagucauccaagaugguugugacucaaaccacgacucaaaucacccccguugagcaucccauucccauuaccuucgcucuaaucuuucucucaguuucugcauagaaucucuaacuaucccuguaugaucugcauagaagcagcacucuucuuuaagggcagcacacaguccuccuuccuuuaggaacaacaaaucaagaccucuacuguucugcaaaacuaccucagacagggaggucaaagauuuuucuaaagcgucaauggacuucucuauugccgcuaggucuucauugacagcaucccucaaagacugaauucccugucucccuucuaucaaagcugacacuccuguccccacuccuacugccauaccuauucccaugaauguagccaggguuaaaguaauugguucucuuuuugacugcuggccagcauagcuuucuucuaaacuggaugcagggugauaauauacgcgggguaacagcuggaucaugacacaaaaaucaugagaugaauuaaaaaccuuaguugauacacagggaguaaguccuauauugcaagcccaccagccaaccugggaagguacaagauaguaauuagcuuccguccuggacacggacugaauuugucugcauagguguuuguggguggaagguggggugccuauacagagaccuguacuccucgcggauacuucagucagggucaguuuuuguccuauuccccaagagcaggacguauggcugcugguucuguugaaaucuccauugaaggcaauuccuucauaguaaggaggaccugaggacaggcauagccagcaguccucaguagcacuuggaucaguucuauuaagggcauaaaagguuccucucacuagguuaaacauccucugucuuguugaagggauuguggagguaauaguuagagguacuugaagagugggagguugggugagagugaccauauuaaggggguccgcaaucaccggaguaggcugaguaaugguauggguaagggguguggacuugguuggagggccuaaaggauuguagagggucucuauuuuuaaucugauagugaacaauaaucccucaucauaucuuuccuuguaaauccuaagaccccagguauacccuuuuguccaucccagagcucuuuucccugguucagugaaggugacaaggaguggauggcaccagucaguacacucaucuaggucaaauccuccagguacuuaagacgcuagggaauaguuggcuguuacucuaauauagucccagcuugaggagggcuuccagcgggcuguaccugaagucucgcaaccccagcucuugcaaaagaagucagucuuacuuccacauguuggauugagggacugacuucgguggggcccggggcagacauagaagugauggguuugaagcaugcuucuaucccuuugguuagagcaaccaccccaugggucucucaaauguuuuucuacauauggaggggguguuaaaggugcccucugaaugucagaguaccccuccaagucccauccaggaggggcuacuauagccaacuuacagaugucagggaaaagaucaggccaccaaguccauacgggguguaccuuggcaauuguccauacagcccuaccccccucauugaguaccuccaacauuuguugaacaggacugaggggguugaaguccuuugggauugcuccuacaaagcaggcgcaacuuaagaggguuaguagucuucuccaaaauccacucaucauggcugacuccagggguugcucucuugacgugggaugcguggacccaaguggggauuccuuccacuuugaccacagugggcguugucaguagcaccaaguagggucccuuccaccucggcucuagguucccugcucggugucuccucaccaggacugcgucuccuacuucaaacuggugcggcaccugugugucaccagcaacauagguuucuuuuagcuguuccaagacuucuuuucuuauuauuuugagagcuuuuaaucgagccaaaagacuagaggaaggagagaaagacacauccgggcgauucuuauacccuauggucauaaaaaugggcgggggcaccccauacauuaauucaaaagggguuaagccaagggguccagggauauuuugaacccugaacaaggcauaagggagaacggcuguccaaucacuuccgcuggucuccagggcuauuuuaguuagagucucuuuuagcguccuauucauccuuucuaccuguccuuccuucugccagccuuaaggcuugaauuacugugauaaguuccgcuuuuuggucuuauauacccuccugcaagcugcuggcccauaugacagacuuuccauccacuacugcugccucagcccuccgcuuaccuucuaccacgaagcugcuaccauuggugaaccaggucaucgccccuggccaugguuggucugugaggucuggccggauuccaguuucuucugccaguauuuccucacacuuaugugcagaggccucgucagccucagguaguaaaguagcaggguugagaauggcugggggugcaaaacuuacucgcucugccaguaauaggcucugguagugcgucauucuggugcugaucacccagcggucuggugguugccugacaaugcucucaagagagugcagggccacuaugguaacauucuggcccauagucaguuugucagcaucucuuacuagcacagccguggcugcuaucgcucgcaggcaggagggccauccgcuggccacagaguccagcuucuuuuauaaguaggcuaccaggugcuuccauggccccaaaaccuggguaaggaugccccuugccacuccauuucuuucaucaauguauaggauaaaaggcuugcucacaucuggcagggccaaugcuggaaccugcaguagcgccuguuugagaguuugaaaggcuagcugauguucucugguucaggugaacucuccuuuuucuuugguuaauggguacaauggggcugccagaguggcaaauccgggaauccagagucuacaaaacccggcaguccccaggaacucucuuaccuggcgagcagugguuggggccgggaucugcauaacagcuuguuuucuggcuucugugagccaccguuguccaucucucagaacauauccuaaguaggucacuucuuuccggcauaacugagccuuuuuagcagagacccaauaccccagcuuaccuagcucgaccaggaggauuugagucccaguuucacaguccuugcguguuucuacagcuaguaggaggucaucuacauacugcagaagagucacauguggguuacuggcuaggaaaggggcaaggucuugguguagggcuuuaucaaacaagguggacgaguucuugaaucccugaggcagccucguccaugugagcuguccggcuuguccacucucagaaucuugccauuugaaagcaaacaaaggcuggcuguuuggguguaaccucaaacagaagaaagcgucuuucagaucaaggacuguguaccauguccgagcagguggcaaggugcugaggagguuauaaggauuuggcaccauaggguguaugucuugaacccucuuguugacuucucuaagguccuggacuggacgguagucacaggucccugguguuuuuacuggaaguagaggaguguuccaaggggauuugcauggaccaaaaucccuuguuggagcagcuuguugauuugggggcauauacccucuugagcuucuuugcucaugggauauugucggaccccuaugggguggccccggacuuaaguucaaucaccacagggggaaccuguuuagccaucccauuccuccugucucugcccacgccugaggguaucgauucaaacaguccuguaaucccucagggggcuucacuuuauuuugguagagucgauauucuucuccuaguuguaaaguuagcucuagagucuggggcgcuuucauuccccaggauaucucuggucauugagagguaaagguuauuugugcuuuuaacuugguuaguaagucucuccccaauaagggcauaggacacucuggaaugacuagaaacgaaugaguuacucgauuucacccuaugucuacuauuugggaugugguccauggauaugacuuuuguccuguggcccugaucaccaagguuuuuucguuuuucuucacuuuuccuaguggcgucuugaguacugaaaauucugccccagugucgacuagaaaguccacaggagucuccuccacuucuaagguuaccuuaggcucggggaggggggccgagccccauucccccuaguccucaucuucuccaagagaaagcaccuucaccucuugcuucuuuuuuggacagucgcucauccaguggcccauuuccuugcaauaugcgcauugguuccucuccaggcgcugucugccuucucugggucuccuuggucccugcuaucuccugucucccagguucccuaacugucuaccucuucucccuuuaucucuuucuuuuacuucggccaguauccuagucaaaaccuuuuccugucuccugucucuccuauccucauccucuuuucucuuucuaacuuuucaucuucuguuucucucuuaugauacacuuucucugccucucuaacuacaucccuuaugguauaaucuugcaagcccucaauuagcuguaacuucuuucuaaugucgggagccgacuggccaaugaaggccauaaucacugaggcccuuugacccucagacguggggucaaaugggguauaucuucuguaagccuccaugagccuuuugaggaagacugaggggggaucagucgcucccugcauaaccucucuuaccuuggccagauucgugggccaccaagcagcaccucugagaccggccacuagggcccagcgauaauuggacagucguucccuaccuugugccguauuauaaucccaucagggccggguuagugggaauccuucaucuaucucagcuggaguuuggacaggcugcccagccucaucucggacagguguuuuuccgagccucgaggaaaauccuuucucucuccucgguggugaauaaagucugcagaagcugcugguagucaucccaggccggcuggugugaauacauuagugauucgaccaacccuguguguccugcaggguucucugaaaaaggagggugauuagcuuuccaauuauagaggucggaggaggaaaaaggccaauacuguaagggcugcagacuaucaggaucggcagggagagccccaauaacccugagggggagugccacgguugaaucagcaggccccucagggggcaacuccucgccggcuccuuguuccuguggaggcacccccuccuccggccggggccugaggcagaggucccaagggagcugaagguuggggcuggggagcauaugguggggauugaggggugucgggacacucaggggguucuucaaucucuggauagaucuugggggguuuugucacuugugugcuauguucaucaucucccccgagcggugguuucaguuucucuuucucagcauuuucccagauggcuaggaucuuggugccagggcagagaggugggaagaaugggcgaacccacagggguuaguagcgugccaaguccucccauaccgugauguaugguugcuggucuguaugcgacccuggcccuuccugaaaaacaauggccuucaccgcccuuaugguggguaagucaaaaguuccuuccaguggccaacccacuccaaaaacagaaacagaaagucauccauagcuuuuucuucacuauuacugacaaauuucguccucuagcccuaauguuuguccaaugguccuuagucaaaggaguagacacagucugucccauaguuaagaauaagaauaaaaacaacacaaugacagagauggaagacacuaagacaucuaaacacacuugucugcgucuggacuuauacaaccagccaaacgcuaccucugauggagugggauuucguguccacuccuucgcuggcaggaagagcacucucucuccuucacucugccaggcaacagccagguccuccugacuguuccguacccugggcacaaccuccagggucucccuuugaaugucuuccaggggugcagccugcgggccuuagggcaucucccuccgcagccguggguccuuacgguccucaacggcagcugccaaaauaucagacuccgaaaaacaaaggcacagacucaguggcugcacaaacacaccacacacauacaaaacguaccuccaagggguauuucgaguccuuggggaccccucaaaucccggacgagcccccaaauguaggacccccaagaaggagccccccacucaagucuugggacucgggguuacccaaagaaacaugagagaccuucuuguugcaaaagcauguggcagcuuuaaugguggagcucugggucgauacauaucucacgcaggagacagaggaaucaacccugagacucaaaaacucgagguuuuuauaggguaggguuuaggggcuaggaagaauuggcgcgguuacauacgauuggcccauucaaacaucagcaacaugauuaugagucagcagaguaguacgugcaggccggggcguauaaggauucugaagcugggggcuuaucugagucgacauuguaucugguuaauguuucagcuuuuaacuaugcucucuauaaaaaggggggugagcaggaggcgcugggcuaccagauggucaaugagucagccaagauagucagaaccaguuccugcauuccuucccuuauccuuacgaccaggugaccuagcuucaagacggacucgggcaugcccgggcuuuuuuucuuugcagucucagucccaggcauuuuuaguuuaaaccuuuuauuuuguuuaauuuccuuucagacucaagaucaaacuauauagcuaagacuaucuuggaauuugcuguguaacucaggcuggccucauauuaugaaucaucaucaugucuuggccuccaaagugcuuagaguguagguauaugccaccaaauaagucugucugucuguauauauguaugccacucccccaccucuuuugacucucuccucccugcauuucuuucuuuuugacuguuuugcuacaggcucuccuauugccuggacugggauugaacuuucccuggagcuauggcugcccuugagcuccggcucuuccuuccccuaucuucacccuccccugggguuauggauguauaccgaggugccugccucuguuuuguuucuugauuaaauaaaagaaaugcuuaacuucugcaagacaguagcuuuuugguaguuaguaaugcuugaacacagaaaacacaguuccuuagacuuuacaucuuaacagguuacaguacccaaaagaguggacuggaaccuuucccuuggcaagccaagaguaaggauuuaaacacaagaguaaaggauuuggguacauuucugccccuuauucauuaugacuaguuauugagaaaccugugguguaguaguaguagaacugguauggccugcuuccuuguagagcugggcuggcuagcucuugaagcaugcucuuguaucuuuggcuucuguaagaggcugugaacucaaauccagauuggcuauuggcggagcaguuggaucuucugguauuuggcagagcgacacauauucugucugcacaguugguaggguauaagcuggaauucuuggacacugagaguaucuccagacccccugugaguuuucucccuggcaagucuugaguccuuuggcuuccacacuccugcuugacuuggcccagcaucgggcacauggcugaguggaagaacuuuguacacagcucccuucagauccuuaucagauugcuaguuucccucauagaaaccccugcaggugccacaaccagcaucacccacuugucccugucccagucuggcggagacugaaagggacugcaagaauucuuucuccugagacugcucucuucucuaaggucuuaguuguuccacucucucugccucaucaauaaagcacuuuugaguagagcauuuaccaaguguauccagccuuuccgggugcuuuuggaggagggguagcauugauuaucacaaguuauucuaccucaccuggggacagguaucaaaaguuagcaucuccuucgguuguuacuaugauuccucuucccccccccuugguuuuuuuccauacaggguuucucuguguagccauggcuguccuagaacgcacucuguagaccaggcuggccucgaacucagaaauccaccugccucugccucccaaaugcugggauuaaaggcgugcaccaccacgccugaccucuuuuuuuuuuuuuuuuaaauuaauuuauuuuaugugaguucacugucacucucuucauacacaccagaagagggcaucagaccccaugacagacgguugagagccaccaugggguugcuagaaauugaacucaguacuuuuaaaagaggagccagugcucuuaaccucugagccaucucucuagcccucuaugauuccccuuaaauucuaauauuccacuuaacauauacuuuauuaugaugaugaugaugauguguucguguacacauaauugugugugaauguguguguguguguguguguguguguguggugcaugugcuaugacacacauguagaggucagagaacuuugugaauuugacugucuccguccacuuucaggugaguucuggggcuugaacucuggucaucaggcuugcacagcaagugcuuuacccccugagcccaucgcacugggcuauuucacuuuuugaauugacuuauaagcagaaccagagugaaaaucucuucccagugaaggggguaaugcagaguguugcugggguuggacucagcguuagaaugccuuccuugcaugcaagugaggccuugaucuaacacugcaagagaaaacacagcuuuggauacuaacuccaccugauuauuaucccaguucucuuuccccuccucuuauuuucuuacuuauuuguuuuuacucuaugcaacucccuggaggucaguugcaauccuuuauuaagaggauucauaauaaaaauaaccagagaagaauuaaaagcaccuaaauauuacuaaacuucauugcucuaaguuuggaagaaugcuaacugacuguuuuuuuuuuaacacaucuccauaagaaguaccauuauuaugauuaagcagagagcacaagauuaaacggucauaaaauuuccauguuacuuaagaaaggaugcaugugguauucagaacacacuaauucccuuucuccuucuggguaucaucuauugagcacuauuauaucacauagaacgugcugugguuuguauuuuaacaauuucugaaacaacccugcuuauuauuaaggaugaggauuauuaaggauuguuaaggaaacguugcuuauuuuuauauugcugggacugauacccaauaaaagcaacuugaagggggaaagaauugauuuuuggcucaugguuuuaaaggcacaguuuauaacagcgaggaaggcauggcagaguugcuggugaggggaacguauggaagaggcuccuuguauugugguggaucaagaagcaaaaagcucuggcuggaacuagaaguugauucugcuuucaagguugaacagcccaugucugcuaacuggaccacaaaguucuacaacuuaccagaacagcgccacuagccugggaacaaguguucagauauaagagcccaugacggacacaucacagucaaaacauagcagaggauauggaaucuaaaguucccaaagggaugggauguaguagccagccuuguacuuccauauuagaaggacagaaucaaguuugaaacauagaauuauuuuuuuauuuauucuucuuccauauauuaccuccugacugcaguuuucccucccuccacuccucuuuguguccccaacuccucccuuccccagaucuccuccuccuucauuucccuucagggaagagcaggccucccagagauaucaaccaaacauggcaauaccaagaugcaauaggacuaagucaaaccgucaugccaaggcuggaugaggcagcccaaugggagggaaaggguucaagaccagggaaaagagucagagacagacccuuuucccacuggugggagucccgcaagaacaucaaacuacacagccauaacaugauaugcagaggacuuagacccauacaggaccugugauuguugguucagucuucgugagccccuaugaucucugguuaguugguucugugggcugaguucucauuguguccuggagcccucugguuccuacaaugcuucuuccccuucuucugugggguuucauaagcucugccucaugaaauauagaauuguuacaugcugaaccacaagcuguaucuccuauaacuucacagcccguguuauuucuaacccaguuguuuuuuguuugcuuguuuguuuguuuggguuuaccucuuuguugggacaaaaagcuugcuguuuucccaucuacugguucauguauguaaccaggaagagcaugccauccaaucuguaacuccguacccuaaagcccaugcauucagauuuucuuuccugucuuuaauauuuguuucuggaaacuaucuauuccuaagaggauaucgaaugagggaaagcagucuuugugaaauagacccauguguaacaaacccagagccugaagaaaaugacugaccuaauaauagucuugcuugugcacugcaguguguggggagcaaggcccaggugacaccguugacuaggcuuguucuuucuggaacuggaagaaguagguugagguggccugagaaggaccagggcugagaacacuggauuuccgucaugguuacauuggucgucugugaguuucugaacgagucaguucaccuuucugaggauuacagguucugauaucgaguauggaacucuaggguucagugaguuaaaauuucuucccuggaucuaaaauuuuguagucauagauauaucuuuagaucauuagacuggcuuaugauaaucugacccugauaaucucccucuaucaaacguguaccuggggcgagccaggggucauacuucugugcuuagaccuuucaugugcccuguguuuuccuggaagccguauguagcauacucagugacaggcaggccaugggcuggagcuggcugucggggguaaacaucuuggaacaagcaaugcuuucagccuuacagccuuggcucgagaguaugagaaguaagccuugggaagcugggaccugguggcagcuguuucuccucggucugcuugccaacccuacuggagcuugggauggacagaguucucagcugggccuacuguggcugaugcugguaguuuuccacucugggaaacuggaagaguccguuggcaucucugucaggagauugguggguagcggaagcauccggaaaccaccaagacaacucagcaagcauuuuuuuuuuuccugcagugacuuuugcuuccugugacaggcugcucucuguacauauuucuuuauaucucaggauauggacugaauaggggaguguaauccagggaacgggcgcgggggauuggaagaaaggaguccugaugucuaggauuugagccaauguugcaguucuguaucuucccaaauagcugagaucccuuccaccaguuacccaaaauaggcacauucaauaggaaaaccacaccggggcugcagagaagcgccacguuggguucccugggccaaggcuucuucugguuccaacgacccagcgggauggguaaggcuauccaagaucagcucgcacucuuccucugcccuuccugugaggccccugggaacacugaaucauggagaaacucugcuuacuuauuuuauguuacauugcugcuuuaucagcucuugucucugaccucccugucuucaaccuuguaguccuuggaccugguuucuagaucacuagcccaacucccauuguuguaggaugacugaaaaguuggucauucuuuaucugggguuuugcaucccuugguuucuuuguguagucaaucacagucugaaaguauuagauggacaaagucaggacuaauuuauaaaucuuaaauguagugauugggacugaaagaacuaaaucuugagccccccccccacccgucacacccagugcuugucauucacugcacuuuaucucuguauauaagcaccguuuugccuucuggaggcaagugggugugguucaauaagaugggagagaggcuggggagauggcucagagauuagaagaccuugcuuugcaucaugaaggccugcauucagaucccagcacccauagagcaagcugagcaucccacagcugccuguaacuccagcccagaggcauuaaacacuccuuucaggccucagugcaugcaaguucacacaucugcauacauuuguguguacacagucacgcacacauaaacaaaauaaacauuuaauaaacaugugagagcuacauucacauaacuuuuacuugggauaucauaauuguuccauuuuauuauuaagcauuguuuaucucucacuaugauuaguuucuaaguuaaacuuuauuaucgguaugcaugugcagggaaagacaaaagagcuuguagagggcuuugcacuaucagcuguuucagccaaccaucagaaaauauccccuucuagugaauagaaaucuacagugacccuuguggcucagcaccuacucugacauugaacugugaguuuacaucauggaacagaacaagauucuugucaucccuuaggucgauagucacuggaggcucuucuaaccaaacacccaaaacucuuccucagucgaucuuugugacuaguuauccggcagugcuaaggucuaugcuguggcuucucuuugucuccuacacauaauguacacccacuguugaacuaagucacugccugaugaaagacaguugggcaagcugcugccucacaaauacuugcugaaccccacagaugacaacucacuugggggguucugaccuagaaagccucuacugcacuugcccuucaagaucuaacaugugaagugaauuguuuucauucuucugucuggacauuuccaccuaucuaccuagcucuccaccuuuuccuacuuagcuguuuguccaguguauguugaacaccuaaucagaguugugagucagcaaggcugaaagcggccaggaauccaauaugaugacuaugcucuggaaggucaagagauacaagugugcuagaaaauucacagugaaaauuauuucuuagaagaaccugucacuugcauccugacaccauauuuuaguauuuuugauacuuugucagacucucugagaccaugauagcaacugucaaauaggaaagcaacuguaucuuuuugaugucugaauaccuguugucuaccauuugucucuuggaccauaauggaggucuaggagagaaaucauuuuaugacuuauucacuacugacugauuguauaaaugcaagaacacucacuaaugggcacauuuguuaaugcuauacgugaauggauagauugcaauaaaguaagcaauucucggauuuauggggaauccuuuucuauuuguuaucugcgugacucaagguuucccuuggaugaauucccaagacuacaucuuuaagucucugggaagaacucagcaguccucugacacugcauagcagaguccuauguggucuuucuccgucacucccucugccugccugucaggcacacuucugaucucguuuacuucauuuuucuauaucuguuaaguaggggaaaauucuugcacggagccaauuacaacaugacagaaaaaggauuccuagaaauacaacccuaccgagaugcauuguaguggcaguggcagugucuugguuauugucccacagaccagcaggccccacgaugggaaguuauuuaugauacuaucaugacucaccuuguuggcuguucccaaugucuggcuuaccucacgugucccagaggacagagguucucguuacauuuacagccccacaucuggacacaugugauggaugggacuguggauguucuaugcugcagcugucagcagggcccuugagcgucauucucuguccaggauggaugggaucugggagcggaccucagaggccaaacccacagcaggauaacugcaucuucaccaacaugcagcuucuggguuuaguuuucagauacgcuagaguuacagucgcaaagaucuucacauguaggcagcaaucaggcaagagucucagggccaaaauggaacaggaaaagcaaagaugggacuaacucuugcucucagugaggugugcuuuucauugucaguuguucagagcacacuucagguucuucaggcuuuggagaugagggucucucaggccuucagccuccugcgggagcuguagugguggcuucucuuugcguucauuugcucacgaccuggacugagcagccccuaguucuccucucucugccuccugcagaugggcccggagguaccauucagugucagugugugugugugcgugugugcguguguguguguguguguguguguguguguguguguguguguguguguguaacaugaggguccaauuucucucuuggaaauauggauauccaauuuuuuucagcaccuugauugacaagacuaugcuccccgcccccugugcauuuuuugguaccuauuuugaagauggguugaccuuauauaugugagguuaugucugggcucuccauuccauugcauuggucacauuuuuaaguauaggacuacuuuaauuacuacagcuuugugauauauuuugauaucuaaacuccuaauaccucuaggucuguucuccuuuuaaaagaauacucuaggguuuuuuauuuguuuguuuguuauuuugugguuuuauauuucuggaaaaauuucuggcuuuccagaaacauccauucuuucuuuuccuucgucguaaugauuccauuucguuucaucuuccuacucaucuuuuaucucguagacuauggugacuuccgaguguuuauaguuacuuguuuugucuuuguaacucuggaaguccacucaaucuugccugagcucucacuccuuugcuguaacugggcgcugucggggcguugcuggcuccuuuguuucccaucucuccaagauggugguccauuguugucuggugcccauuguuugaaagcuggauuauuucccauagggaauuucauaugcucugucuuauucucuuuguugaaagugaagcccaucccugaaacuacuguuucuaacaggaccagcaugcucaguacuaacacgggacaguggauugagcuguuucacagucucauacaaucugcuccuuaguaaaccagagugcuucuacccaucuagggcuaccugauggcuacaaggauaaugcuacuuuuaggaaauugauuuaauauguaaaucugcuaguaaggaacuaaggcugggacuauugggguuauuacucaauacaagaagaaauuugcacauuaaauuauauuacauuagucagaauuugggccaaaauguaaguuuggcuguugguuaaaucuuggagguauuuggauauuaggauuaggaaaaagcucuguagcaucaguguggcuggacuugggucauagagggaucuaggaagauuucaaguccccuauuuccuguucuguuaccaguuucaaccuucuuggggacucuggacuaaaacugaaagcacauucucuguuuucucucuguuuccucguuccagccauaugccgcuauccucugggcaugucaggaggccacauuccagaugaggacaucacagccucaagucaguggucagaauccacggcugccaaauaugggaggugagauagcuuugucaagaaggccuaagugccagggggaggggagcagggggaggagggaauggcuacacagccacaacucaagaugcugggggaagggcuagugcuggugagagcuugcaagacuggaagcgagaugugaagggguuugugcugcuuggaauguuucagagagaggcgaagccuuggcugcagucacuggccuggaaaccucuucccaaccacagaggccucagaaccacaccacccacugugaauggggucauugauaggcaguggauuugcuuuaccggaccucacugugggccguuguaggagaaaggccaagggcgcagguacagagagguguagauuauguaggacacuggcagugagugaugccugcgucucaggagguaucugaaaugccacugggcagagugucuauggucaaaccagacacugagguuuccaguaaguucuuccuucccucaaggaaaccucacacagaagggccauccucaucuauaaacagagcaaauucuauguggaguauguaauucccaaggucccuaaaugaacagacucccaacucagaagcuacgcugaugaucggacccuuuucuuccugcuagaaccuaauuauuugauguaaauuucguauugauuuuguuaaaauggaaucacacaugaggcaaucgacccccauaaccucccucaucauaccugucuuaguguuugagaggagagaguaguguggaguuauggggggaaugagaaaugaguggguaagcucugcgaggaaagggaguguacuagggaagagggagaaaacucagaggguacuucaaauaaaccuuagagugauuucucaaugccguucaguggcggucuagccuggaguaguaaaugaacccagguuauuggucauucccucacaggcuuuccacccucaccuucaccauggcucccauggcuuuugcuggguugccaugcccauucugcuggcuagcauuccaccauacugcauagcccacacugaagaccuaccuuuccucccuacuccuuccucccuccuauaacuugauacccaaaccaggaggagccugcucugugagauuguggcugaggaauggacgugggcagggugaaagaauuccacagaggagcauggguggaaaggguuucauuucccuagaguucucuaaaucaagauuaaaaggcuacaugugcuuuggaaggccccagcuccauuguggugacucucccugggcuguguggugcuucagagacaggaaacgaaccacaaauggaaaugguuaggacagacagacaccauggggaggucccccaagucccucuggacuagaugcuggguuuucacucucuccucaggcgcagggcagcugccuacugugagcuggugagugucucuuguuucacaguugcucccucucuucccuacccuucuucucaaggcuggacucugaagaaggagauggagccugguguccugagauuccagugcaacccgaugaccugaaggaauuucugcagauugacuugcgaacccuacacuuuaucacucuuguggggacccaggggcgccaugcagggggucauggcauugaauuugcacccauguacaagaucaacuacagucgggauggcagucgcuggaucuccuggcguaaccggcaugggaagcagguaagaagaaaauggccacgcuuugggggaauauaggacucaauaguugucaauaguucaaacuguguauguucaagcccgauaugacauuguaaauguggcauggugucaguucagaguugacacagaggaucuguuagcucugcugagagaguugagugacuauauucugcucaugaacaaggagcaaaguguccaucaaaugcaugauucaugaagaaaggugaacaugauuuuaaaggucucugcuccuucucauaucucuccuaggugcuugauggaaacaguaacccuuaugauguauuccugaaggacuuggagccacccaucgucgccagauuuguucgccuuaucccagucacugaccacuccaugaacgugugcaugaggguugagcuuuaugguugugucuggcuagguaaaucucgaccacagagaccuucugaaccauagagaaacuuccaagccccaagaacuaaaaaccaccaacucagaaagggaugaaaucacuccccuuuggaaugagauuauuuccuuuugguuaaaagagaagaaugagccacacccaucuacccagggcuuggugcccugugguggaaaugacauauucagaguuacucagguaacugcuguuguggugagcuucccaacagugcucaacuguuaacccggauugaaacccaguggacaugauggacaagcucauacuuccuuggaagcuuaaguagcucccuaggcuaauugguuaggcagcaggugcaucuccuuaucacaaacgcugaccacuguguuuccuuuggcagauggcuugguauccuacaaugcuccagcuggacagcaguuuguacucccuggaggcuccaucauuuaucugaaugauucugucuaugauggagcuguuggguacagguaaauacuaggagauuuaaauaaccaccagaauagaggaaauggccauaacaaauauuccaucaauaaucaaagagucagucaauccaccaguauucugcacaugugugauacacggaaauaacuuagauguaguuauuucuacaucuacauauauaaacugcaugguguuuaucuccauuuugaaguugacuuuuggaaaacaaaauaguaauaccguagacaggagaaaaauuacacaaaggaauagcuaaacuuugugauauuuuuauaagugugggaguuauauauccugaaaugaggauguauauuccaaucuaaaggcuaacuuggcuauagauacaaaguaagaaauaagauuggucaggucacaaaguuaagaaacaaugaacuccauaaauauaguacuuuagaagcugugaaaagaaggagcuauuaaggcuugcaauagauaagagaagcucuuaggauuagauguuaaugaaagcaggaaacaguagguagaggaguggagaggaagaaauggaggaacauuggucuaauuauggcagaaacgggugagagcagcagagaggccugaaguggacagaugaagagcugugguagaaaaacaucaccagacacauugggguacagagcugggaaagacaugugccuauccauucaaucauuacauucuucuucugguccauugcuaauccuugucuuucuuaguucaguguuuaucuguaagaauauugugaaauaucgauccaacaauaaaguuucuaggggccaaaaaagaaacauauuagugagucucaggaagcagauuguagaaugacagacagccuuucuacuggcucaaggguggagagugaacuaucuccuucaucagccagccccugggugaagucucaauucauccagucuucuagccuuacuuauuuccuuuccaucugcuuagucagucacuucucuccacucucuuacaucaucuucacauguuugacucagucacacccuagcuagccuagaccuaaagcacacaggaaaugagauaccaauuggaucuuugcuagucaguuguuauguguguagaaguuggcuagguguuguggguaauuaagaaaaaugaagccaugggucucaugcuuaaggcauucauaguuugggucaauggcuaugugagaagauugauuauucuauguauuuguugcuuuuuuucauugcuaugaccaaaugccugacaauaaacaacuuggggaaggaagauuccauuuaguucacaguuccuggcaggagaaguuauagcauaacaauguucauggugguggagacuugaaugcuaggaguaguaagaaggauaucaagaagucggguggggauggagcaguuuuccuuuuagcacaguaauuuccuuuuaauauaguaauucauugaugauuuuuaaaguuacggaaggaugugauuggagcugagcuucaggcagauuaaacaaguagcugacaaagauuagaugugaguucuaguggggcauacuuuaaaaucccagauucuaugauguaaauaugaacuaguagccaaggccacaaugguacucuuggaaauaaaauagggaagaaauguucauuugggggauuacaagcaucuaaaucaaauuaauauuacccuaaugaucucuuucccugaaucaauggagaacucaguuucacaucaacaaauguuauaaaauaacgaguguuuacugcauuagcagaaaaaccauugaagugcuguuuuauuaguuuguaugacaagccuucguuuuccccuugugucuuuuccuauauguauuaauauggugucuugguauaaugguucaccauuaucaauggcaucuaaauuaguucauuagugggggaacuaaugaagaacaugaagagcacagcccuugacccaucagugaccaauacugguuggacgcauuugcaucccuuccuggacugcacaauucagaaaaggaaaccacuagauaaggugcauuugaaagauuucuccuaaucccuccaccucuauaguuaucagcucuuucaaaauccagcagugaagcaaugggcugaaaaguucuucuguggaugugugaguaacuccaggcuucucucuucucuccucuucccauggccugagcagcaugacugaagggcuaggccaguugacugauggaguauccggccuggaugauuuuacccagacccaugaauaccacguguggccuggcuaugacuacgugggauggcggaacgaaagugcuaccaacgguuucauugagaucauguuugaauuugaccgaaucaggaauuuuacuaccaugaaggucagugguagauucucuucaagaaccucaaaauuaucguguuggggggaaaaugcccgaugugcccugagcugauguugacagaacuagauuuuaaaauauauuccacuacuacaaguauagaugaauucagaguaacaucacuuuuaaagguuguuucuucauuuguuaacucugcacaacagguuagacccauuguuauugaguuauucucuucuucccuccuuccuuccuucccuccuuucuuuccuuccuuccuuucuuccuuucuuuccgucuuuccuugcuuccuuccuuccuuccuuccuuccuuccuuccuuccuuccuuccuuccuuccuuccucccucccucccucccucccuccauucuuuccuuuccaacaucagagccaaacauuuucauccaaucagacauaacaguuauuucaucaguacauaacugcagaacaguuaaguggacauuggugagugguaggauggaagccaauggcuuggucaaggcugcgcuagaaggcugucaugugaugggucaccucaaauaugaauauguggcaagaucugaagaaggaauuuuaaguccuagaucucauuuugccugaaguaagacccuaccagggagccaaauccuuaugccacccuugauaaggucuuuguuauaacauaaaggguuuccugguauguuguuuaaaucauuauuuucuuuugcccucauucuauccuuggucuguuuuagagagaagggcaugggaaagaagaaaaguucaugcaaaaaguaacuagauuggaugcuaaaucuaaauuguaggguuagggaaaaguagaggccaggggugugaaggaaagccuuuguguucaauguagguugaggcugcaggaucuuauaugguuuguauauaaacuccuaauggucuauaaaagagaaugaggaaaccucaauaaaagucucaggaaaggguggacaaauaaauuuggucuuccacgugcauguucaccuaucugccccuuuuucauauuuauauucauguguaguaguaaucuacaaacuugguaagccuuccucaguagucuucagucuauagcuguuuccuggguuaaauggaagagaucguaauuauacuauauauuuaaauuuuaucuguuuaucugugcuuguuuugguuccacaacuauauuuggagcacagcaugcuagauucugaguaaagaauauuuccuaucuugggaaacauuggucacaaggucaguaggaaaggcaccauuaauuuucaaaagaaugcaugcgggauaauaugggacccagaagaaggaaauauacaucagucauuauuaaggguucucucuagggcaaauauuuuauuccuuacacaaacuaggcuuaaaaaaauacuugucuuuuauauuacucucagauguuaaugccuaucucuuaaccagauuaacacuuauucauuaaaugaacaaaacauuuaagaugaggacagaaggaacaacauaugcccacucuguugguuuguuguuggaaggucuuuggcaaguguaaaacauaugggugugcaauuacauguaacacauuauucuucagagauuuuuguagauaugaaguaggaaggggaaaggaaggaguaugcauagcaacaaaaauauucaguaagagaaaaaauuauuuuuguauuacuuuuuaauauaccugugaacauacacauaaauuuguaaguuuauacauguuggggaagauuuguaguuuaacaaauaauuaaacaaauuuuaaaacuaucugggaucuuauaacaucucaccagcaaacuuugaucuuccugaaucuccagaacuccuuuuagcucauuacagaucaaaaugauucaagaguuuagaucaagaagccagaaguuucuaaguaggagaucuagggcagccucuucaggcaaacauauccuccacaugguuuaauuuucauggggaaaaaaaagugaaaaauuacuuucagggaacuaauaucuuuuauagagcagguuucuuucugaggcaaauuacuccucaucucuugcuuugaagaaggguuaaaauaaaccauuaaagcuuacucaugcauucaaaguauauuauuuuaauaaauaaauauguaagcccacauuggaaugaaauccauugcuauuuauuugcguuccagaagaauucuugaaccaucuguaggaaagauuauuaccuucccugcaggguacuuacccaacucuuuguagauuucagaacaucugaaaaaccuauugaagcuggagaugguauuucuuugacguuuuuugcccuuagccucaguccaucgacuuggggucaauaaacuaagaugauuacuucacuccaaggaagauauuaacacauggguucaucaauaaaaccuguggagaaaaaaaaaaucccaauggaaaaguuaaggugacugcuacauuucuaugugguaugagggcauuguaccagauguuuagggcucuccuuccaauuguguugcggacuggacauaggucaggaaaacacgugaguacuccuaccuugucaguacauagaugaacuagaagguuucuacacccuucaguagcucucaugaucuacccuuagaauaucccgguuccaguucucugccgugacgucucuuucuucauuacucuuccuucuucaucuaaaaagugaauucagccugguaguccugcacugccuaccuagaggacuuacagaguugcacacaguacaacccagggcuuaagcaggccuaagaaacgggaacuacaguccaugaaugacagucacgccuuucuaaccagugaaauucuugagggacaauggccaggaaagaucuguuuuccccauuaagacugagucagagcaaauggaaccaaauugcuguaagggccuugagucaguugcuaauauacacauuacacuuuuuuugugggguacugaaggacuguugugaaauuucugcucuugaugaccucacaagccaaaaaaaagaucccgcugaaaggucaugagucaggagaguaggugcuagcuaccucccaccugacuucuugucucaucucagauauuaucagugacaaagaucugaugcucccaucugagcgguuguaaauuaaacuaaauuuaagucugugucucuggcugaaagugucaguccauggcauuccaagcgagauugucauaaagaaagaugaaauuaaauuugcuugaauauuauuuucuuucaaguuucccacauugccuuccugaaaaggaauggucugccuugggaagguaccugggaggaagcaggaugcuaaguuggcucaccaucucagaucagaauagcucaaauaugggcagauagcacguaugauuaaaaagauuacagagccaagagaauuccuguugggaacagaccugggaagaugcuaaucuagcucucacuuaacagguggggcuacuacagacuaaaacugugaaccaggugaccagagcacacaguugcaaauuggaaacuggguuuuagaaggucugaccuggguaucauugccacuguccagaagacugaauuauggguaguguuuagagaaaugggcaggacuaggauuuccuacauaacccagaagggccagcgugucucuuugaccucccucucucugccagguccacugcaacaacauguuugcuaaaggugugaagauuuuuaaggagguccagugcuacuuucgcucggaagccagcgagugggaacccacugcugucuacuuuccccugguccuggacgaugugaaccccagugcccgguuugucacggugccccuccaccaccgaauggccagugccaucaagugccaauaccauuuugccgacacguggaugauguucagcgagaucacuuuccaaucagguagaaaaaccucgggggcuccacagggaagagaguggguugaugcaggagguaggaagugcauccgugcugcccccugcccaggucucugagaggaacggguuucccagaugccuuacagguuuuggaaagagagaauccuuuguguuucuuguuuuauauuacguaauuauaagaaccagaguggaacaguacaaacuuuauuagacucucuuacauguuugucuagaaaagauuuauggcaaaagauuguuaaaaugugccaaaagcuauacaaauuaagacuguuaaugggaagcauuuaaguacuaccaaagaauucaaauaaaaaucccuagacauuauguacaaaaguaaagacaacaauggacucccaucucucaccuuuauuacuaaucauugucaccuuuguucauucuuucuugcugugguauuugaaaacaaaucugaaacauauuuagguuuauuacuagcacuuuggaaugcaucuaaggaaauauuuucuugaguacaaugucauuauaauaacucaaaauauuuaccaguaacuucuaaaaaugacuuaaucgucuuugaguaaacaguaggguucauggaaacccugugcugcgccaugccuugaaaaguuaaaugggauuuaugacuucaucuaugccauuggauuuuaguuuggaugacaaaaaaguggcuuuuuagaauuaaucuaaaguaccaccaagccuaaccaaucaggaagagcaaggaacaaaacgaugggcuuuccuacauagugacaaaggcgugaugcugcauccggccugaaagaaaaguauaagcauaaaauaaaaugauagggaggagagaauaaccuagcuguggguuagaagauaagauccuuucugccuugaguuuuugucuuaauuuugguugugagcuuagccuuuaaugauugagccaucucuccaaacccuggcuugauauguuucuaaagaagaaaauuccaagaugguuuauuuauuagccuaugcuaauaggauaagagaguguguauauauuuagaaagcacuggugccuacaugcugucuaugccaauguaauuuaaaagcaagcagacuaauuaguucauguaauauauucagaacagaacuguauaugcucaaaagaggcgugcuuaaauuguaaaaauaaucagaagauaaauaaauacuaucccuggagaucaucugggugaaagaaaacacagauguccaccuacugguauucuuggcuauucuuggcagagcaauccaaugaauucucucuacauauuguugaaucuagguccuucuuuccaugcauauuuuaugaugaucuaugaccacagcucucugaaacaccaugugcuaauguuuuauauucucauaauaucuaauauuuacauuugucuuauuuuggccaagcacagcuuggacuaaguuuuagauuccuugaauucucuuaagcuucaaacuguaugucuugguaauguuauuuucuucucgauucuuaagaacuuaaauuaacacaaauaguugaugccagaaacuccuuauuuguauaauaaugcuaagaagaaaaaguaagauuuguugaaagaauaucuuguagaagacaaguucauauuuuaauuauugacaaaucagagguaaaaaaaauugauuaccaguguccauauggcaauuacacuuuugaaagccagagccucacaguaaagggcacuucaaagacaguuuucuaucucuagggauggauaaagccuuaagcugagaguuagagcaaugaaggacaaugaaaaaucccuuuagaaaacaaucuaaauuguuccauuucuuuauuguuuaauugauucaauucuugggaggaaagacugucuucauacuagguugauuucaugcccauauauccaaugaauucucuccacauauuguugaaucuagguccuucguuccaugcauauuuuaugaugaucuaugaccacagcucucugaaacaccaugugcuaauguuuuauauuuucauaauaucuaauauuuacaacaauuguuuuugcacuaggaaaaaguaucuuuacuuguacagguaguuauacuuuauuaaauguauuuauggauuuauucuuacuuuguuuuucauagacauuauacauuuuugcauuuacauacugcaguaaaaugaguugaugcauguauaauuuuuaaaaacacuaucgguaacccaguacauugacuuuuacaauguacuaugucucaggcuacguucagaugugccauugccuggcugucuguucccagucucuaauucacucuuguucugugacagaugcugcaauguauaacaacucuggagcccuucccaccucuccuauggcacccaccaccuaugguacgugugauuaguacuuguacaauaguaagaugaaguuaccuccuggaagacaaagaaggguagagauugcaacucuucacugugugugaguggcuugauuccaugugacucugaauggauacuugugugguaaaggaaggacaguccacccccaaagugaaggacccaaaguuacucucauuugucaccauccaugaguuacuucagcugagaggggcaggaucuagaguguuacaacucuuccaugaaugauuaagaagcuugggggugggggggaggacaaguaaggaggcauuccuaaaugagacccaucacaaugaucucaugaacaaggaguccauggaacaaaaucuuuucuaucucgcaguagaugaauaugcaaagguacauucuuugcuuggagaagucacuggcuauaacagccggcaaucuggaaacauguuugauuggguuucuucugagaggaaucucagcuccuuugacccaucuccaagaaugaagagugcaacucauuccucaccuauacuuucaugagcauuaagaaccuauuccaaaccacagagacaaaauguggggaugcguaugaaaaccgcucacuauuuaguuggagacacagagagagggaaggcggugacccauggaagaagauuguaggaaauaggagcaagguaauaagcaggagccaaaaaaaaaaaaaccauaaauaugaggauggaaccuucuggaauucuccugaaagaccagggauggucuccaugcucuccucuauuccccacugcucucauuugcccuaggaagugaaucuuuucucugccuucucuaauuggucacagaucccaugcuuaaaguugaugauagcaacacucggauccugauugguugcuugguggccaucaucuucauccugcuggcuaucaucgucaucauccuguggaggcaguucuggcagaagaugcuagaaaaggugaggauuugcaguaugaacaggaacugugugucuuagucaggguuucuauuccugcacaaacaucaugaccaagaagcaaguuggggaggaaaggguuuauucagcuuacacuuccauacugcuguucaucaccaaaggaagucaggacuggaacucaaggaggucagaaagcagaagcugauguagaagccauggagggauguuacuuacuggcuugcuuccccuggcuugcucagcuugcucucuuauagaaccaagacuaccaguccagagauggcaccacccacaaggggccuuucccgcuugaucacuaauugagaaaaugccuuacaguuguaucucauggaggcauuuccucaacugaagcuccuuuuucugugauaacuccagcugugucaaguugacacaaaacuagccaguacacugugcuuccauuuccuguacugccaugacaccaggaacaaagggcaaauucuaaaaaguuauaauuggcuaaugaguucucugagguaaccgagaagcaucgguguggaaaggcuguugaagcgagcccagaaagggauuagccgagucuaguuccucauuuucagaaugaagauuguggaaucugccuuaaaaucuuaggaaagcguuucuaguacauuaaaccucaucuugggcauuucccaugaagagucagguuuauugguuuuaguuagggugcaggcaccuguguguguuuucaguauggcgcaguucugacggccagucaagguuggggucacucuugauccuguuacccuuuuugaccuuuucuaaacuucuuguucuuuugcuuuuuaaugucagauuacuuacuuuuccuggugcugugacccaauaucugacaaaagacaacuuaaggauggcuuuauuuuuuaucacgacuuaagagaggagacagucuaccacggcagggaagggauggugguaggaaggaagcagccggguacccugugucgacagcuggggagcagagagagaugaaugcugguauucggcuugccaucuccuuauucauucugggaugccagucuauaggauggcacugccuccauucugggugggucuuccuugcucagcuaacccuuucuggacauucccucuuacauaugcauaauuaugcuucugagguaacucuaaaauccaugaaguugaugauggagcuuaaacaucucucucucucucucucucucucucucucucucuccccauaaaaauaauuagguucauuaauacccaaguaguuuaucaucaucuuaauccuauuucuuuauguauuugaaggucaugauuauauguuccuaaauuccucaaauuacugagccaaaugacaugaaguuuuuuauuauauaacauauuuuaaagauauguuauauaauauuuuaauaugcaaagccuuauuucucaugcuuguuuuuuguuugguuuuuggggcagucuccugguauaguccuggcuaaccugguguuguagaucaggauggccuugaacaugcuaugguucuccugccuguguuuuuccugagaguugucaucauaggcauguauuggcacauucaguucacacauguuauuuuauaugagacucugaguaaugguugcauggauuauauuuagcuuguccuaaugacauaauacauacucacagggcaaucuguguucuaucuuaugguuuuugucaacugcccaaaauugauacacuuucccaaugaugaggaugaggaccuauaauucucccaggcuucuuaaucauuaaagaacuucaauggacaaugcuacugagugacuguccaccuuuggaucuaucaaaauguuucuggcuuugaccauuucugaccaguggguucaauggcuuugggcugugagugucugcagugacuacaagggagucauugacuucagagaccaagucuuuuaccaaaugaggggcaggacaccaugagaagggucuugaaucucuagacuuccuuguuuauagaguauaagauaaagggaucacuucauuugagaggaacaaucuagcaagucaccugugguccuuucugaccugcuccacauccagguuucaacauugguuuuaaggauuuggcgcaggaauauuucauagaagagaaaaucucuuuguaucucacaacgacuuuuaacaucagacauaaaacacaaaauaaagccuucaguccaucagcagaaucuaaagaguugcaaagcagacuacagagcauccccucaauggcauucauguuucaaggugcaggugggaagugcuaagcauuuuccucuuucagagguggaagcacacucauaucuaaauggguagcuccaucgugaacguagcaaacagggaguuuguggcagaagaaauugcuugacuaagguuucauucagcugcuugaggcuaacauaugcucuuugaaaacauauuuguguuaguuccuugagaaguugauguaauguguuuugaucauuucuaucugccuuacuucucccugaacuuguccuagaucuaaugucaccucuccuaccccucccaacuucuuauuuuucuuuuuucuuuucuuuuuuuuaaaaaaauaaccuacuguguguuuguguugugcugcucauguagucaugggugugggacuauccacuggagggugaugaaccuagcagaaguuauaaccuucaagaaaacagacugacucucccugagaggaguauuuccucaguuagggguggaguccuaguguaugcuccuacugaauagucaaguagggcuacauucuacuugaaggaaaagagaaucuacauucucuccucugggcucucucucccucuuuauuugaucuagaguuuaucacacuucucugggucuuucuucugaaaucugcuggaccgucuuccuugucugggagaucaaagcucaucugggaagcagaauuucccuuugggucuuuaacucagucuuuugagaaacucuuucuaccacuguguguagccguauauaauuacucacaguuuccuggaauggcauucuggauuucuugcuaggauaauuuuuuuuuuuuuuuggucuguguggaaaagcuuauauacacauaccaacagcauuacuaaacauauuuuuaguccauaacaguuuuuguugacacuuuugauggugucuucagcaauacuucuuugagaaagucaacccauauuuagggagaaccuacuauguucugggauccauguucguucugaguauguuacugcaacaaaggacuguucaaucuaguagaaagaccuaugauucugucuacauguauuuauuaaaauggagcauuuuacauguucagacucaaauacuacauccauuagaugcuagcaguuuucuuuuguuggagcaggcaguuacauuagacacgaugccacugcagcugguuauuuggugcuuucucuuccuguauuagauguaacucgucauucuguuugcggguuaguaaaaucuagcauguuaugcuaaccaauaauacuagggugaucagauacacuguuaauuuagcauguuuuagaacucccaaguuaauggguguugcaguuuauguuuacacagaucagaggguuaaagcacaagucgacaaaacccauuauuuacuagaacucacacaacucuaaaaaccagagaaaauauuuggcuacuuacaggaucucauugcauuguguaaaugaugcugacaagugcuccguggaagcuugugaauguugccgacacaggaugguuaaagucugccaucuaaagaggaagcuauugcuaaauuucugcaacacaggaacucauggcaccagccugccucucuaucagcuccgguguuccugggggguugaagguaugaaccaagcaggagggcuggauuuuagagggcaagagugacgauccucucuauucaugacuuucaggcuucacggaggaugcuggaugaugaaaugacagucagccuuucccugcccagcgaguccagcauguucaauaacaaccgcuccucaucaccaagugaacaggaguccaacucuacuuaugaucgaaucuucccccuucgcccugacuaccaggagccauccagacugauccgaaagcuuccagaguuugcuccaggagaggaggagucaggugaagaugaaaucaugggugaauugagggagaagaagccuugguuuauaugauguaggcauaacucuugcuacacguuaaccaaauccacuaagucugggccagccucuggagaaguguacagucugucugucugcuugcugcugcuucuagucuauucugacacucuuccuuuuauucuuaacacaagauguucagagggaccccccccccacacacacacacaaagaugucaaagugucacugagguguuaucagaagaagcugagcagucucauccagauaaccuucuuguccugugucuaaugggagagaaggcccauucugugcucacuugagaccagacuagacuggaaauuacaaugggaggagaaaagagacaugaagccaaaggcauucuauaucucuggauagcucucuagauaauugaauggcuuaauuuguugacuucucuuugauaaauacucauuacacuaauauaagguuuuguuuuuauaguaaauguguuuuggcuuuucucaacaaaaguauugaauaaggugcauaaugcaaauugcuucaaagcccagucccccuuggaaaguacuacagggugacaucagaagugguacugggucacugaugguacccuuagaagcuguccauggucaucagccuagaagugacaggacuaguaguagaggacuuguauucaggagaggaaggccuaagccagauggugugacuuaauagaaaaaaaaucagcucauuagagaagaaacaugcugagagaagaaagggaauuaacccaccaaauucaucuaauuccuagaaacagcaagaccgaagacuacaugugagggggauggagagauggcucagugguuaagagcaccaacugcuuuuccaaagguccugaguucaaaucucagcaaccacaugguggcucacaaccaccuguaaugagaucugaugcccucuucuggugcaucugaagucagcuacaguauaauuacauauaauaaacaaauacauaaaaauuaaaaaaaaagagccgggcgugguggcgcacgccuuuaaucccagcacucgggaggcagaggcagacagauuucugaguucgaggccagccuggucuacaaagugagcuccaggacagccagggcuguacagagaaacccugucucgaaaauaaauaaauaaauaaauaaauaaauaaauaaacauuuaaaaaagagaauugaaaaucaaaagaagaaagaaagaaagaaagaaagaaagaaagaaagaaagaaagaaagaaaagacuacauaugaacuuauuuucuuaacagaaccaaagaaauuaaccuauuuccuaaggucuacaucucccauaccaaucauauuccaacuuuuuacaauuaugguacauguuaaacaugauuuuauaaauucaauaugaaguuauuuucuucccuaaacuggacuguuaaguuaauggcagcauuccaaaaauuaaggaaaucugcuauuaaaccuuccaccuucaagaauaccauccugauauggcagcuuaagcauuccuaaggcuuagccccccgaaguccacagauucgucagggaacuuguuccugauggugccuuguaggaaacgugaaaaacaaaauggcagccuaccuucuuaaguccaaagggaaggaaggugccuagagggagcacaacugcccacaaauaaguauuguaugcagaggacuagacugccguggggcugguucucacuauccccucaggucucccuauagcccugggaaaccagacucagggcccaugucuucucagggugcagugguguugugaagccggcccagcccaauggaccugagggcgugccccacuaugcagaagccgacauagugaaucuccagggagugacagguggcaacaccuacugugugccugcuguaaccauggaucugcuaucggggaaagauguggcuguggaagaguuccccaggaaacuguuggccuucaaggagaagcugggagaaggccaguuuggggaggugaguuaaucuuuggaacgaggcccccaguagguccugacaugaaggaagugggcggauaaaagggaucagcagaacaagugucucucuagaagugaggucucagccaaagggcucccuuacuuguuuaucugcauugcuauugagauaguuaauggucaaucucaucuuugcuuaagagcuguggauucccuaggacuuuugguuuuuauacaaaaauuuuaagggaagcgagucacaagagccccgcuauccugaaaaauacccaaugcuuucaaaaacuguuuaccauagguuucugagggugggacuuauggauaucaucaucuuugguggauuaucuaggaacacccuuuuugcuuagcuacaaucuuuuuuucccucauaaugaggguuauaugucaaaaugguaaaaacaaaacaagacaaaaaaccaaccucgcccuuguuuuggucuuggaaugaaaaccaccaaggaaugaaaucaccacaaagauaaggaggagcccucuucuggguuguucucagagugauucgugggauauuagaccuuuugcucuuacauaagccaucagaaccuucagagaauucagagcagugcucucagcuguaacuggaauccuugaauccugucaucuaaguguuacaucaucaaauguaacacacgauuuccagugaauaugugguugacuuccaguaugaaucaaguauucuuucucuaggagguuugguguucgagaagacagagggacccucgacauuugucuguauugucacguggacucauucugucccuuggguugaaauucuauguucacuauacuauugcuaacaccuaggcaaacuuuacaacauucucuucacccuaggggauuauauuaggaaauugccuuauguuuuauaugaucaagggauuaacuuucucaaaucaaaguugaagcaauuaugucaaaugcuauuuucuaguggaguuaugcugugauaaaaugcuacauuguagucauuccuucccauaucaauauuccauucaauguacauuucuuuuguaaggcacugauguaucauauuagcuggauacuucaacguugcuuauuaauuuugacaauuacuugguucaaugauaugucagccauacccucuuauuggucucugauuauuuugccugggucauaagagucaguuuuucuccggagcaugcccagcaagaauacugaggcaucuccaggagacaggaugaugcugagacuggaugacuuuugucuagguucaucucugugaaguggagggaauggaaaaauucaaagacaaagauuuugcacuagaugucagugccaaccagccuguccugguggccgugaaaaugcuccgagcagaugccaacaagaaugccaggucuguggucugcauuuugaauuuuccuuuacuugcuuccugguuaggauugggaauauucuggaacauuucugagcuuuuauuuuucuuuccucucucgagaugggaagguuucaugaguggucacacaagcccacuuuuagguuuuauacuucuuauguggccagaagugcccaccuuuuccucugucucuuucaaacacaaauguacauauuuauauuauauuuacuauauacuuacuuaaauccccucacccaguccacauaacagcccaaauauauuccucccucaugaaacccagauauaaucuugaaugucacccucuccucuggcugguuuuuccuaauggcaaacaccuuccucccuacaucugugaauucuccacucucccacaucucuguucucauucucacccuguguuuucucuuuuaugcuccuuuucuucuauguucagcagccccucacaaaagagaagcuacuucuacuuggaaacacauccguggaccucugagcaaaagaauccacaguccuuugacagguuuccaaacuggcuaguagucucuuggauccuuuccuacacacacugcaguuugcagaacacugcauuguucucugacagccuuuccauuacagucauggugaguuaauccucacccagagacccaugcugguggaaaacuauuugugucucagagaaaccugaacaucuggauaccacaugccucuucccauguguguugucuugauaugucuugcugauacucacccuaagaggaaguuuauuaucccuacuucccuaaauuauuguaaauuccagagaugaugauagguuucauugaaagucuuacagugggcaggauguggacugaagaggagacaaaggugaggaaauggaacugugugggcuuucacauuuuaaccaaaagcuuuaucuuaugaauauuaacaugauaugggauauucuucauauuaaucuucuucauaggacaggagagaguagcaagugggggaaaacauugugugagauaagaccauguaucucuggguuguuuggguuggugauauuugcagaucuaucuacucucucuuguuugguagugauggaucgccuaaguucuggaucuuuacacaucgccaaaauccauagucugggauuucacaggaaaaggagaagggagaugcuaaaucagaacuacauugguuccaauaauuuauaccaacagaguuugacucucagugcagaauuccuguaaaacucacuggagacuucugauuugcuccuguaguuuugggaaugugggcuauuggcuccauguugacaauuuacaacucaaauguggcuuucacuaugaacucaagucauuaccaguuuggccuaaauggcuuugaaacaacuccauucgaacaggcuacuaaaucacuguguguuguagcugacuucugguccagauaguauugggaaaagcuaguaggugccaaaacaaacaaacaaacaaacaaacaaacaaacaaacaaaacccagauaaucaagagggugauuauccacuuuguaaaaacugucuucacuuuauuaagauugugauuuaguagcuuuugaaagagacaaauaucuuacagcacuugaguugguuuuaaugagaagcuccauuugcagggaaauuuuaagcaacacauaucaguaauauuaacaacauuuuauaucgugauauaaaagugcaucacagaucuuaucuuugaaaacauuaucguugacucaauaaagauccauuguguucauggagaaggugaaugggauaguucugggugccugucugucuguuaucucagagaugauccagaggggagccaggcauggugugauggguaggaaugggcguugcugugcauccauccuugcucaguucugucucugacaaccucugacuuuaucuacaaucacacccuccaaaggaaugauuuucuuaaggagaucaagaucaugucucggcucaaggacccaaacaucauccgucucuuagcugugugcaucacugaggacccgcucugcaugaucacggaauacauggagaauggagaucuuaaucaguuucuuucucgccacgagccucugaguuccuguucuagugaugccacagucagguaaacaagucaggucuuggucuuuucugugcagucaugagaguaacuccagggccugaaaauggggagugguaaaacuuaagguaucaguugucaugggaguaguguggggaaucagucagugugcagugaugauggggcagcuacccuuugugggaaaucaaacauucuaugagaauggaggcagaauauagaugguucaacccugguuugaugauuagcauaugcccuguccacagcugcuuucuuucuucuuacacgugccccuaguuacgccaaccugaaguuuauggcaacccagauugccucugguaugaaguaccuuucgucucucaacuuuguccaccgagaucuggccacacgaaacuguuuagugggcaagaauuacaccaucaagauagcugauuuuggcaugagcagaaaccuguacaguggugauuacuaccggauccagggccgggcggugcuccccauucgcuggauguccugggaaagcaucuugcuggugaguuucuccaucugugagcccugucgcaccaaccaaccugcugcucagggugaagguggaacaaacuggaggcagcaggaggcaagccccacagaccuugacauuuuccccugacuagagaggaucuucucaggcacuauauuauuauuguuguuuuguuguuauuguuauuauuacagacuuuccuauaucugcuggaaaaggggaaugcaccauuauagaaacuuuagggaaaagguuuaaaagaauaagaaauuugcuaucuuuuugucucuacccuucucccuauuggaugguuuuaguucugggcauuaaaacccuuaucuguuaaaaaaauuauguuguaauauaaauuuuccauuuuaaggguaugaccaugcuucucauuaauuauuuagaacagucuguguauuauuuagugacuuuuaccauuuacuuguugaauccauaauuuuucuuuuuuaugauuuuuaccuaauucuugguguuuuguuccacaaaugaaugacuucagaugucucucuuggagcucagucguucuggccauguauaucugaggcacuucaauguugguuuuacagacacucagcucauugaaggaaugaguauucacuuucuacaaugcuaccuugauugucuuccauaauauucagagaaaagucagagcccaguuugacuuuguucauuucuacuucaucugcuuuuuucuggcugauauucauauaauauggauucauaaauuaguuuugaaauaaaaaaaaaugaacauucuugucuccucaauaaguuaaugcuuuggaauguugccuuugaggguuuuuuugugcauguauuucuaauauguaaugucuuuaauuuuguauuuuuaaauauucaauuguauguguacguguguguuuguggugggucagaauguguguaaggacaggugguugcagaggccagaagagggagucagaucccauggagaugggauuacaggccguuacagggucuggaaacugacucagguccucuggaagaagaaugaauacuuaugucugccuguuauuccaauucacggggggggggggaugcacuagaauaauugcuguuaguuagacauaagcaugggcuagauagcaagauccuacaggggaacgccagggccaaaaaaugggaauggguggguaggggaguggcggggggggggagggugugggggacuuuugggauagcauuggaaauguaauugaggaaaauacguaaaaaaaaaaaagaaaugaugcuauaaacaagaagaaugaugcuauaauaucugccauuuuauaaaaacccaauggcauuuucaucgauauaugugagccuuuaucuuuaucaacuucuaacauaugaaaucacuuuaaaaaaaaaaucugaaggugcugugugguuuuaaaaagagacacauugaguuacauucagaggacuggguuuccuaguccaguuguugcaucauuaauggacuuauuaacuggaauaauuugcuggaucacuccuuuuauuuuucugaucuaaaaaucaauacccucuacaugucucugccacuaucuuuauuaaauagaaaaauguguauuuaaugagugcugaucacaaccauucucaguguugucauuugauaaagucguccucaagucuguggcuaccagcaaauagggaaucgagaguccuggauccaccaggacuaauuccaggcccuuauaaggcuuccucauuccuaccaucaaaaccauugauuucuuaugcuaacuugagcuuuccccuggguaguuuuccuaaagugguucauagccuauaggugaccuagcauucagagagcugauaacccagagguacuuguuuuaaugcuuaguccauggccuuacggacuauguccuugcagcucuuggauuucauguccaagagaagcaggacuaagcugaggucacagggauggcagaguagacagcuuuccaguaaguucacauggccacuucuaguuucucuuugcacaucaguuucagcauugcucacccuugucaggggaaggaagauugguuucagaugauggucauggaacaucuucuuugugggcuuggcuugcucugacuuucuuuucuccagccuggucuacaaaaugaguuccaggacagccagagcuacacagagaaacccugucucaacaaacaaacaaacaaacaaacaaacaaacaaacaaacaaacaccuuuucucuccuucaauagggcaaauucaccacggcaagugaugugugggccuuuggggugacucugugggagaccuucaccuuuugccaggagcagcccuauucccagcugucggaugagcagguuaucgagaacacuggagaguucuuccgagaccaagggaggcagguauggacuguugcagacguggacuugggugcucucaagggaaggagaaaggaagguccugacuauguaggaagaccccagcucaaggauggaaacaaaauucaccuucuuauauucagucaauucauagaucuagauuauccagaaagucuucuugguggggggagggggagggaagggugagggaagucaaugguguuguuuuuuguuuuuuguuuguuuguuuguuuuuuuuuuuaagaaaaaaaaaaccuucaaauaaguuaugguguugguuuagguugguuuagguuucuagacuugaacauccacaaauggacugguauacccugguccuucucuggggagguaccuuugggccuacugauugauccucuggggacuuauggagagccgagcccucaagcucacauggaguccuaauucccugagauacuaagcuuucuuugguuggccaaguuuuuaaugcuccagugagaccuaggauuuaaagcuugcuaguaacuagagcauugcagucccccaaggggucugucuguagcgcaucugacaucacagcauuucaaagaggcagauagaugguaauagcuagggaaagguuuuguaggagauaaaaaguggguccucucuggauuaccuaggcuuaaacaaggaaaugacaaggacagacaagaauaauacauggugcaugcugaaaaugagaacagccugcaauuuaauuuuuaucucaauguccuuuagauaauuuggcagcaggaauucuaaaucaugcauccuggcuaggagaugucccaguuaacguuucuauugcuaugaugaaacaccaugagcaaaagcaaguuaaggagaagagguuuauuuggcugacacuucuacauuggugcagaggucauggagagaugcugcuccucauagcuugcucaaccugcuuucuuauagaauccaggaccacaugccaagggauggcuuuguccacaguagacugggcccucccuaaucaaucacuaaucaagaaaaugcccuauaggcuugccgacagccagaucuuauuguugaggccggccagaggcucacauguuggcaaacacacuuuauaaagaggggaggcccauucccagccaggcaaaguuccuuugaaguagacagaucagccuuuuagugggaacuugugaagaucacaguucugugcuaacucuuggagaacugguucagccucaggcagguuagggcucaggcagguaguggcacaucaaaggagaaugcugagaagcagcacagcagguggcuccgccuaaguggcagaugguuugaggccagccuagcuagccuggaaggagguaacaucuuauggagauauuuucuuaauuaauguucccucagauuucauaacugagguucucucagauguccuuagcuuuugucagguugaccuaaagcuaucuagcauaggagguaacaucucucuuauugugauaaagcaaagauuugcucuugucuuuaugaaauauacaauguuccaagaagaaagccuuccuuuccuagauuaauguauuuaaacaacccuuuagaagacaaauuccaaauuaaaaguuguguguucaauuagaacauggauucccacucauuaaaauaauaaucuuaauuugaguauauccuagauucauaggcaaauguggguuuauugagagccucuugguauucuucaaauuauuguuuaucaacagaaauccugcagagucaguuuuuauguaaacuggaccaacauccaugccauaggaggaaggccaaguccuuuccuggguucuguuuguuuuauguuagucuucaugauauuaaaaaugaucacuagacagucauauguuauuucaauucuguuauacagcugcacaagaacacaucuuuuuaaccaacugaaaaucauagacauuuucauucauaauaaucuuuagaacuuuacuuucucauuuaguuugagucuaugugaaaaggaccacuaauuuuuaccuacacagauacuagcaauguacuacauacagauuugaccaucucccugugaucaaguacuagaaucagggauuugacugaauccaggcccaaagcaaacaugaccaucacauacuaagucacuucucaguuacaacucaaaauuuugguaaagaaauuucuaaauuuagcauaucacauguaaacaacagguuaaauacaauugaucagauuugguaaaauuugauuacuauuguguuuauagcugaaguuccaguauucauguucuagaguuugacaugagcauauauggacagcacuguguguaucagcuacuauguggcuucuauagucccugagcuacacagaggcggugcacucauuucccaauaguucauccaaccuacugggcacaggagauacaagcaaguagaugaaccauguggcuuaugcaaauucuagaagaaacuucauagcuuaagcaaauuuaaaauuaagcaaauuuuaaacaauuuaucuucaauuuaaaaugcuuaaaugucuacagcaaaaauuccaaccauuaaaaauuaauuuggcauuuuuuguguucaauuuacaaucucaaggugugaagaaguuccagguagcauuuuucuugaaugcccacaguaugaauagaauuuaguaccuaaaauuaaaucaguuuaaauuguacuucaguguuauaagagguaacaacaugguauaugugauaugaaaucguaugaaauguaacuuaaacuguucaaguuaaauuguuauugcuguuguugcuuuugagaccaagucuugcuacauuuccaggauggcuuugaacucugauccuccugccugagccucccaaguacuaaggcuacaggccugccacaaccacuccuggaacucaacauuacuauaccuuuuuuucuaaaguucucagaaagagcucagcaauuuuuuuguuuuaucaguaauaccugagaaugccgguuaucaauaaugcuuacuuucuaaugccugguauuuuauauccauuguuuuauaauccugacuuaaacuuuguuguaucugauuugauaguccagcuaacuugcuauuuuagcagaagccaaauauuuuugcuuauuggccuuuuuacuggcaauuagaaguugaugggcauguguuauuauuagacucuggguaaagcccagcuccuaugauacaugauccaggaugguguuguaugagguaaggcaaggcaaugggaaguagcuaaugauuaacuagguacaaauaucggguucagcaaagguaaugaugcuuuuaugguugagugaucauggaaaguuuaaguacaguuuaguaaucugucaauauagcaggguauuaaaauguauagguaaggagaugauaguaaaaauauagaaugcgggagauggacuggcaguuaguaaaauagcaucuugcuuguggaaaugguaacuggaaacuucagaguagcauccuaggcuggaauuauggcaucauaauuauaccuguuaaugcaauccaaucucuucuaaaugagaacaauacagagaggggaacauggagaacaauggugaguauugcuaggauacagccuuccucccaauuuauacaucuggcugaauauuauuccaauaaaauugcaauaaaaccucaaauucuuuagcagaagcuacaagugugcuuuauuucugucauauuggcucagacaagauucacccucauugacggcagaucugaguucuuuuggcauugguggaaccuuuaguaggaaggcaggguccucgugaaauacugcuugagaggacuagaauagaagaagguaauaagaaagggguugaugagcuuugugugaugggagaauagacacaacacccgugucuuuugcuaaguucaguaaaguggcgaggguacacauagagcuauguuacaguccauucucuuccugccccuuaauauauauuuuucucucuuuuaaaauguuuguucccauagaucuaucucccucaaccagcccuuugccccgacucuguguauaagcugaugcucagcugcuggagaagagaaaccaagcaccggccauccuuccaggaaauacaccuccugcuucuucagcaaggagccgagugaugaugcaucagcaccuggcaguguuccuguggcccagauccuucccacaagaccuacugcucacccacaucuaagccacuccagcuggacauucaauggacccgagagacagagaauuagucacucugcccucucugucccuugccuccuccacuacaccucccugcucccuacuauugacucauauauacuuuuuuacaugaaauaacuaaaagaagaaaaaaaaauauagagcagauauuaguaaaagaaauguuacuugauauaccaaaugguuagauaaugaagacuagaaacucagauaauuuauaaagguuaugcuucuguuuauaagugugcagauccuacaauauuuuuccgugucacuuucuguaaaauaccuuuagaaagaaaaacuugaagaauaugaaugucuugagaaacaugagauuaggcuuaaggaaaauacuuagagguaaugaagaauugcaggacuuggcauuccacaacaaauggaugauuuucugauuuggacgugacucucagaucucucugucucugucucugucucugucucucuccucucucucucucucucucucucucucucucucucucucucucucucucucucucucucucucucucucgucaaagugaguggcauguacuuaaaaaccucuaucuugugucuuggaaugaauguuuucuucaaucauggccagagaucagagccuacccaugaaacagggcauauggauagaaagaaaugucuguuguaaggcuugaaguaggacacagaaagggaaagauugcacaagcuucccgguagaccauggucauaggaaagaagguccucggaggaugacucgcaaguguacuauuuguuguucaucugugagggucuucaccuguguguucuagugacaacuugacuuuacucuguaaagccucaaguuuugauauuuuaaugguugcuccaucaguuccucuuguccaguucuauaucuuucacuaugugaugccuuugugggauuuauagacuagggcuucaacuucucaggcacaaguauccaaugucauguccaauauacaagagauauguuuagaguguuuccaaaaguuuggccaagaccccuggaaaaaguuauaggaagacugauuuccacuuuugggaaaauauggaaauagaacauaugcagguggggguuuucccagagauggggaaucucucaucuccgaaaaguuucagauacuagcugaagaacucugcagggaagagguuguugacuacuggguauauauguaugggauaauaaaaggaugaccauuugguguuacugaaagugcuuuugccaaagagaggguggccagcggcaaagcaugaaguucuuuucuggcuuugggauucacgagaacugaugcaugaucaagcaggagucaccuuagugacuaacuuagugacccuaaguuuucauccuucacagacucuaagauucagcagcaaucuacacuacaaaacccuuaaauccuauagaggaaaccaagcugagguaaaauaguggugaucugcuucugucuauccagucagcuugcuccauggucucuuagaaaccugagagcuucuugguucagccuucagcauggcuacaggacacagcagauguauaacucuaagucuugacauuaauuucauagaucccauucgcucacagcacauuuaccuccucucccauggcuuuucuaccauucucagcaagacuaacuucgaucccagagguaggagagaacauuggauugggaacucuggcccugugcugccucaagccaaguaugucauuuucccaagucuugcuucucucugaauuuguuuucuuaucugucucaaaggaaaaccgaaucuaugauuuaggaaucucuuggaguuuugcuuuguuuugugcuugcuggagaacuagauuugugguugauguagguucaguuacugcucagacaauuguggccaguaauagugaucccgagagacaucauuuaaguaagagcaacaccugcauuauaucugcuuuagagugaccagugcugcuucacguuaucucauuugauaguucuagggccagacauguuucuuucacaacucuugacuauauacucuucaggauucugcccccaguucacuguauuccuuuacaaaugaaauuuccaggacuuugcuuuauggaacuaaucuaucccagauggcuaucaaauauguaucuucauguacaggcacuuuguuuuugguaugaagaagguuccaccuucuggcacugaaaccuuuguauuacagacacagguuuaguuucuaguuacacuaguagaguuuagcaguacaggucugaguagccaaccaugguagaagguaaagacuuacucuguagacagguagcucaaaucuaaacuagggaaaugaagguagguuuuggaaaagaaagcagaaacagaugagaaacugugggaucuuguuauuuccccaaguaacucgugaucacgauauaugugaaccauuuaugucaagauguccuuuagacuaucauauuucaauuuauaccuuuauugaugaaugcauacauuaaccagguccauuuauguuuuuauuauuggggaucauacccagaacucacauuugcuaggcauggguccugucauugaucuauguucaaaucuugaucuggugaccagauaaauguguaaccaugucacauaugugaccuggaguggaaaugagugcccagaggagagcaugcauuguuggagcuguggaaagauugucugugaacgcucaaaacuguaauacaaaagagggcuguaugcaaguaugugaguaguguuuuuuuuuuuuaaguuguuacaugaauguguguguguggcuggaaggagaggauggguagaaaauaagaaagaaggcacagugaaaagaggcaaggagagguucuggggaagauauggggugaggcaagucaaacgugguagagacaggguuggcuggaggccaugaagucaacgcugaugcaugccaagagaucugagagagguuagaaaaagugacuugggaagaauggaggguagguaaaggagaaaugcugggugaaggagccugucuuuaguaaaucgaugucagguacaccguagguaaugcaagggauuuuuguagaguugaagaaggacauggucuucauggauauagaaacauguggccaccagaaccauuagggagucaccuauucaucucaggaaguggguacagaaggcauuucgcucuccuguggguucuagaccacauguaggguuggugacaaugcugucugcgcacuggccuuugguguuccaugugcuguuggggcaugaagguguaugagcguuugguaguuaccaaauacacuuucaauaaugcucauccuuccauggucuaaaauggccacagcaaacauggaaacaauagguguaaguuagacaauacuaaguuucaucugaucuuugacagaggggugugccauauuggaaacauguuuuccacacaggcaccccacaagaacagugugaugugggcguagaccauguguuuuaaguaaagaggaaaucagggggcgugucaggaugaagggaaugugggaagauguuccgaagacaugcacuagaaaacagaacggugucuguuuucguccaguacuaaaugaaaagaauugcaauacauugcuuauugcaauuuuuauccuaaguugaauccaugagccuggugcuugcagcauaguuuuuuuguuuuguuuugaagccuauguccuugggcacuguguggggcaaggcccugauguuuuggcaacaugcagauucuggucuccuggaaaccuucauauucuuucauauucuagaaacagaugaaugucauuggcacuuggugaauuaauuagaauccugagcuaagagggaaggaagcuggguagugacgaaggacuugaguaggcuggcaggaaaggacuggggagggaccauuuaguugucccguguuuuucagaaauuucucauuuugcaaugaucugagacuugaaagaaguuacaaaagaaucagcaccuuaccuugguucuguuuuccacacacugaaaauauuucagucuauuuucaucuauuuggaccauuuucaaaacuaaacccuaggcccggcuuggcuuucaccaguuuuccuacauuguauucaguugcucacuggauacuuuuagccuuuguugguuuguaaucuggcuuugguggcauacaggauaaaggauucuaccuagauauuacucuacaaaugagagaaaacaucaaacugacaagcucuuuuaucagggaccaguacuccagcuguuugcugaacccacuuucgauuacagcucaucauugcuggacccagaacggccacagcguuacacgggagucauauguaaugaucagcucugcuguuuggccacccaaacaauccaaggacaacuuaagaaaaguaacaauauaaaaggcuucaaaguggaagggaauuguaaacagaagaacgggacuuuuguuggugaccagaggggucuaugauaaagcgguacuuuggucaagaauuaagugguacugaauggagguagggauaguuuguggcuagacuauggcacaaauauaaaccccuaaugugagguuaaaacacugucuuuggaggaccagaggagcuucauucgccuaacuguucauccuuaauuguaauaucagcugcuaagcuaaaugcaaacacaucagcucccuggggaaaaguugaaacucucguuucuuggaccauuacuuuggguuuccugcuagacauuuuuaagcugccuugcuuaagggcuacaggauaacaacugucuguggcuuaugagauuccuagcacacaaaugaguaguuuguguauguuauauuuuuaaugaauaaagaguggaaaaauuauguaucacauguguuaauuuggggagaagcgcuuuauaacagagggcuuacucucaaagagaacaaaggaaaacguguucuacagacaguguauaccuuugaccucugaaaaaagcuauauaguuucuccuacagacaccuugccaguaaccuuacaggucuuauaggagagcagauccaaguugccaggcugaucugcaagcacaaacauuugucaagggaaagcacaggucguuacuuucaguacaaaaugguucuuugcuauggauggauucucuucuucuugccccauguccuguucccaaggaccgacuuccugcagcacugugguggacucuucuaugaggagacaacaucugggccuuauucaauagccugugguggguaauguguuuugucaagagcuaaacagcaaauggauuuaauuucugcuuaacauggucauagucauucugaaauggcuacagaaauauucucuguacuagaaaaaggaauggaacguggugccaauugucuauuuuccuuuauuuauucccuguaagucugucagaugauaaauuguacauaacagugauuaaagagucaugcuacugauacagucuucuuucugucucagcaguaacaguucuggccuuuguugucuuuccuccugacaccacugguggaguggugaugugacacagggaaagugugcacacgguuaucagggaugucugacagagagucaugugaaaaggcuucuguuagaugucaguugacagcuaacuaacauggcgaugucucugacauaguagagaccuuguuucauaucuucauguuauugggccacuucugggaaccugaguuuccagaauucuuuugaaagccuucauugucauuacuguggaguuguuuuguuuugauauauuuuuuuuuugaaggaacagaaacacuugcuaaauccaaauauggucugucucaggcagcuguucacacaagcauaa

SEQ ID NO: 495 - RNA, 1144 nt, Mus musculus
acguuuuggacaauaugcucuuuauugacugcuguagccgccaauuucuuucuaagagaaugcuucuaccccagggacuugcacacauaaagaaggucaagagauucugggcaaccccauugugggcaggcucugaauucuucacuuaagacucgguacuuuccaagcuggaaguaugaaaacuagagaacacacccguguuguuagucuugcuccaggaaggcacaccuaccacuaucaacagcacugugggugccauuuacagcuucucaggcgacguggcguucugacaggauuccagagagcaugcaaggcuaaggccaagcaaauacugcuaauaauauaucauguccuuccuugauccuguuccaccaagcuguuuauccaucuaaucucucaaagccacaaaggugccuuaacagaugggcaacuacguuuuuauuuacaaaugauaccccuuguuaaaugauauuucuaaaugacauaaauugauaguaaagucuggauuaaaaaugaauacgcaagaaugacuaagaaaacacugaaaauguaaaaugaggaagccuauccaccugauggaaaacauccugauauguuaaauuuaguugcuuuugacaucucaacaaauuggacucucguuucaaaaccugcaaaaacccaacauaauagcucuaaauauaaaugcaacuucauaacacugagauuauagccugcacaugcacaucugcugccuaugcuguaacaggacaguugaauuuuagcucuccucuccuagcuaaguucuugcucucugggccgguucucccugacuggcacauuuugcauggccucgggucaucuaaucccuuuugauugcauuucguucacuagucgcugugcaaaaggcaacccggcugugucgacacccaagagacuccgaagacaauggcagaggaagcccgggucacuggcaaacagguauguggagaauuagagacaaaaucagcuagcuuaaggucacaggccugccuuggagggaucucugccuagaaaccggcgggucuuucccaaccacacccgugggcguucggaaauccgucacuugaagacucacugccagcgccgcgcucccuaccaggcgcucugauccgccccgggugaccga

SEQ ID NO: 496 - RNA, 2393 nt, Mus musculus
ccgggcuuccucugccauugucuucggagucucuugggugucgacacagccggguugccuuuugcacagcgacuagugaacgaaaugcaaucaaaagggauuagaugacccgaggccaugcaaaaugugccagucagggagaaccggcccagagagcaagaacuuagcuaggagaggagagcuaaaauucaacuguccuguuacagcauaggcagcagaugugcaugugcaggcuauaaucucaguguuaugaaguugcauuuauauuuagagcuauuauguuggguuuuugcagguuuugaaacgagaguccaauuuguugagaugucaaaagcaacuaaauuuaacauaucaggauguuuuccaucagguggauaggcuuccucauuuuacauuuucaguguuuucuuagucauucuugcguauucauuuuuaauccagacuuuacuaucaauuuaugucauuuagaaauaucauuuaacaagggguaucauuuguaaauaaaaacguaguugcccaucuguuaaggcaccuuuguggcuuugagagauuagauggauaaacagcuugguggaacaggaucaaggaaggacaugauauauuauuagcaguauuugcuuggccuuagccuugcaugcucucuggaauccugucagaacgccacgucgccugagaagcuguaaauggcacccacagugcuguugauagugguaggugugccuuccuggagcaagacuaacaacacggguguguucucuaguuuucauacuuccagcuuggaaaguaccgagucuuaagugaagaauucagagccugcccacaaugggguugcccagaaucucuugaccuucuuuaugugugcaagucccugggguagaagcauucucuuagaaagaaauuggcggcuacagcagucaauaaagagcauauuguccaaaacguauuuauuuauugaguuauucuacaguagaacuuacaauagacucuacaggggaaucaagagucuauuucuucaagggauuccaauacaaugagagaggcaggggagagacgugcuccuucuuccuaagggacggccgugagugcagcagcaaaggcucagaugagcauuagagcucagagaaagcagaggccuuagcuucagaaaggagugagggaccacccaacacuucugaaggcugcccuuuaguucucugccuccaaggcuuuuguuuuauauauauauauauauauauauacacacacacacacacacacacacuuggaaauuugaagugccaaaagggaguaccugccaaaagguacagauucuuaguggugugagcucaacucaguuuaaaaaaauaaauggguaacaguuuugucuauuagcuggauagguggacgggugaaugggcggacagauacuuagauggguauuaugagaccuggaaagaaaugaucaccaacacugagaaauacacaaaacacaacagcacaaggacacgguacaguugacagagggaaagggaaaggacagaguacucguguacaguagucgaugaggaguauuagcugaaaacagaucuggggaaaaugaaaggagaagcagaagagucacaugaugugauaaagcuacggauaaggcuggggauacagcucaaugauaagaauagucacgugugcuaaagcuacagauaaggcuggcuaugcagcucaaagauaagagcacuugcuuaggauauauaagcucaacccccagaaacacacagacaaaaaacguuauaucagaguaugagaugcuuucuuuuuaucauaauauguauuauacauauuaaugaguuucacuggauuuccauauauauguauauauauauguauguguguauauguguguguauguauguauacauauauguauauauguauguguguauguauauauaugaaugaaacaguaaucacccuucucuacucccuuuugagaaaagaugcuuuaaaugagccauuauugugagauaauuuaaaauuugaaaauaucauauauuaauaauagguucuaugguuuuagguagauauauuuggcuaaguuauaaauuauuuuaacuuugugaaauacauuacuuacuuaacagcuuggcuugacugguuuuucugagugacuugucagaccugugccagucugcccacguugcuuguuucucagaauccguuauaacccaccuagauuuuuuuuuuuuuuuuugaaaaguguguggguccuuggggcugccacaccaaaagguucuguccugaacaugauggccucaguugguucaaggagguuuuugccagcaagaggcacaaagcaccagggcagugaggcucuucucagccugggucacggcaaggccugagcacucaugacauuacug

SEQ ID NO: 497 - RNA, 1693 nt, Mus musculus
cgcuuccggugucauggcagccugagguccagggagucggucagggcgcugcaggccccucccugcggagcggcggguccgggcggggaugugacggcgggcgccgcgggccugccucgcgcgucgugucggcucgcguguccuccgcccagcccgcaccauggcgggguucggcugcgcguguggcgccgagccgccgcgcuuccugaaggccuucgggcggcuguggcagguccagagccgccugggcagcugcucgucggccucgguguaccgggugcggugcugcggcaccccgggcucgucccccggcgcccucaaacaguuccuaccuccgggaaccaccggggcugcgcugagcaguugcagggucacaggaacaucgguaauuguggcuguccccaugucccccaugucccgguccaagcauaaucgucuucggccuggacccuggccuuugguccuguagguggaagguguuagcauuccgcuccacaguuaccuggcaaaagccagguaggccugacccacuauaaaaggggcugcuugccccuuccuccauuucuugcccuccuguccucuugguaccuuguuccucucuugcucuuucccugcuuccguuaccccuucucugcccauucacuccccccacacacacccccucuccacgugcucauggccggccucuacuaaucuacucucuuucucugccucuacuauuguccuaacuccccuccccaugcccugaauaaagucuauucuguacugugcuguugugugguuggucucucagggggaagggaugccuuggcaugguccacugagacauccucuuuccuuaucguaccucaucauaccucuauagaacauauucccccuucucuuuaucuuuuuauaaacaagucaggagaggauccggccucacuuucaaucuggcuuuacauugcagcucagugaaguauacgguggcaaugauaucauauaguaaauguuuaguuaaaaagccugauuugcuucaagaggcaggggcacuuuuuuacaaacucaaggagccugcuuuauucauuuaccugguuaucaaucccagugcugaagcuuccagguggccgaacauucaacucuggcaacuaccuaccgaagaaauaggucagguuuugcagcgaccaugguuacaaaauggcauuuauaaaugcugcccucuguccgggguagcuaguauuuaugccaagguucuuccacggauaguuugugaagaaaaauaaauaaauaaaaagaggugacacuucuuaacuagacauugcagaugaagagagaaaauaauagggaagaaagucuuaauuacaguguaguaccuggaaugguugugcaguucuuuggcuguccuagauagaacucagaaaucugccugccucugccucccgcacgccaccacgcccagcgguugugcaguucuauaaugccuacaugagggaaucuggaauucuaggccagccucaacuacugagugauugagggugucuaaaugcuugagauccugacagucaaacgaugcacagagggagggggugggaggaggaguaauaauuuauaauugaucagaauccauagaaaugugauauaauuaaaaccuuuucuauuugaggaaaaauaaccagcucuaaaggagaauacauuuaauuuuuucucagccuua

SEQ ID NO: 498 - RNA, 163341 nt, Mus musculus
uguccuccggccgccgccguuucagguuacucacccauccgaguugugagggagaggugucuguuucggggaagccggcuuguguugccggcgccauggagucgccuuuuaguccgguucuuccucauggaccagaugaagacuggggugaguggaucugcgaauguacccgagcuaggucgggccgcgucugcggguuuuuuucuccucccgauuuccgcccgguggcggugacagguguggacgacccguguccggggagcgaggccacggguugagggucguagaagaggcuggcagagccucugggcuucuguccuggccguagcaauaauggaaugauguucuaauugaaauugcuguaguuuuucagcguguguuccugguggaaauuccaggugaucgugagggaccagaacuuaguaggaugaugauuguagcugccccaaaggcuccaagcuauuuucucagacugugggcguguggcuggggagcgcugaguguguguguguguaugugugugugugagugugugugugugugugugugugcgcgcgcgcgcacugaacguguacgagauauguugagaaaacuugguuaaaauacagaagaaaauccuuggcucccagcuugaacuguugguuuaagacauagauccaaauuggcaaagaagaaacucucccaagcaccugaccucgugucccugauuacuagaucuaacacaaacugauguaauccugacugcuguccaaacacagcucugaaaucucuuguuaagucuauuuuuaguguucaggaaggauggaccagagaaugacaaggaacaagcuuuggcauccaaauccuuagagaaagcugauagucccuucucgauuucaagacagaauguuaacaggauuauguguguuaauaugugaauggaguucuguagguggcucaauggauccuguagugagacuacauuguccuucaguuuuggggacacuuuuuuuucauggacuaacauuccacuauaacaugagugggcccucaacuaggaaguguuggaauccuaguuuaauuuaacaguggcagaugcucucuacaauuacaaucuauaaaagguuuauuuuaaucuuugggccgauuuugacaacuuucuggaaaaaaaaaaccuuuaaauguucauucuccaguucauuuccccagcuaaaugcuuuuguuauaguaacagcagucacuuguuuaggacuuuauuuugcuaagcacacuacauguguuauuuauguuauguucauaacaguccaaugaggucccgccauccuauagauguugaaacagagguugacagaaucuguucucugagucuuagacgaguaagugauaaaguaggaucagaaccaggcuuaucuaacuuugaagucugugccucugguuuuucuacucuguaacacuugcucccccccccccccccaagccuagauucuuccuaaugcuaauguucuuaacaagucuacuuagauauguuggguaguuacaauuagaauuaguuuucucaaucauuugaccauuauguuuguggcauuucuuaaaguauaacuaaaaggcacuuccugaugguaucguuuuuguccuagagucugauucucagcugcauuuuccuaacuccuaaucuugauucuucaacaaugcgcaguucuuuguagucagcugacugacuccuuucucagguauccugcccugucuccucuugaauaugucauuuccccaauguuuuuuagccuucccuuuucagacuguuaacaguugucucuugguucaguacuuuuauucccucagguguucaguagguaggauagauuuugcaggcauuagaguugaacacuacugucuacuagggcuucuuaauaaaauaauagguucuuugguaguugcuguuuugaauuuuuggucaauuuacugauguauuuaguaguaauuuuaacagcuguacuguuaaauuuuaaaaauuggcuuuuauaauugguauuucuuaugaagaacaacuuguacaauuugaaggacguuaucucagcacaggguacgaugggauguacuucuacuuuuuuauuuucuaaaugugauuaaugacacuuagagcggacaucugcaagugguuuuugaaaagguucagagagcagcuauuuuaggcaucacuguccuguggucucugucgaaacugcucugccacagggaagaaacagccguagcagaagguauagaugggcaagcauggcugugcucccaccaaggcuauggagacuggcauuuggguuacacacaagugccuuuuguuagaggccauuguguagcccaggcuggccucaaacuucugaugucccugccuuaagccuuuggaaugcugggauuacaagcguacaguaccauaccuugaggucuuugaggcaaggucuugcuauauaguguaggguagccuacagcuuucaaaaguuuccugccucuugcuccccaauuauauuuaaugugucacuuaauaauccuuuuuaaaaguacagcuuuagaauuuuagaguaauuuagauaguacaugcaguuccauauauuucucucuacuguucccucuacugaugacaucuuacauuacuaugcugguuagguuuuuuguuuguuuuuaauuugacacaagcuagaaacaucaggaaagagggaaccuuuauugagaaaauuccuccaucagauugucaugcaggcaagucuaugggucauuuuuugauuaaugauugaugugagagggcccagcccacuguggguggugccaacccugggcaggugguucuaggggguauaauaaagaaggugagcaagccaggaggagcagcauucugacguggcuucugcuucaguuccuguuucuagguuccugcccagacuuucuuucauguagacacauguaagccaaguaaacucucccccaaguuacuuuuggccaugguguuuuauuacagcaacggaaggcaaacuaaagcaauuaguauuguacugucaagauggaggcgcuagggcuggugagauggcucagcgguuaagagcacugacugcucuucugaauguccugaguucagaucccagcaaccacaugguggcucacaaccauccauaaugagaucugacacccucuucuggggugucugaagacagcuacaguguacuuacauauaauaaauaaacacaucuuaaaaaaaaagauggagaagcuaauguuuuuuuuucuuucuuucuuccuuuuuuuuuuuuuuuccuuuuuuuuucuuuuugacauagggucuucuuauggagucuaacuuggccuggaauauuugauguaaccaggcuugccuugaauucuuaaugcucuugucucagcuucccaaauacuagaauuaaaggcaugagccaccacaccaggcuugauacauuaguguuaaggaugagccuuaauacagggguuuugacaaacauaauacaacaagcccaucauuacaguguuguguauaguagugugagugucucucuccuaaacauucucuaagcuccaccugcucaucucagaccucagaacagagcuucucacugucgccaccauuuugcuuuuguuguguaguuggaaccgaguaguauaaccuuuucaaauuggcuucuuuacucaguaguaugcauuugaaguuccugugucuguggcuugaugacuuacuuucuaguacagaguagugcuaaauauaugggguuuggacaaauguauaaugagagggaucugucauuacaguagucuacaaggcauggaggaugcuagcuagcaugcucagguuuugaugguagccuucuucuucacuuguagaugacugcuuucuugcuguguccucacgugguaccgaggagaguuacccucuucccacaccaucaucuaaccuuagcagucuccucaggauucugucagacguagccauauugggaauuaggguuucaauauggcuuugggaggaccuaacucaguuuauguuaauauaucugcuuaucuguuuauauaucuuugcauauauguuuauaugucuauauguaauuuguauaucuguuuacauguugcuaucuuggugcuuccaguuuuuagcaguuacacauguagcugcucuaaccaucugugugcagguuuuuguguugguguaaauuuucguaucauuuggucugauugaguagguuugguuuauaguaaacugccaaacuugcaguucugugucuccaucagcagugaguggacguuucuguuugcugguauuugcuguugccuguacuuuggaguuuagccauuuuauugggcauguggugguaccuuguuuuaauugcaaauuucuaguauuucaugguguuggucaucuuuccacggcuaguuugcaaucuuuccuuucccucuucuuuccuccccucuuccugucacucgaguugugcagaagucacucuuucuuuuuuuuuuuuaaagccacauaagaaaugugugccaagccaaaaagcuuccugccacugcgguuucucucaugccuuuaggaucuccugugaagccucucuuccuuuucuugcccuaaucaaagcaugacacuccccugaugacacagcuuuccccgcuuucugcacacagcaacucagaauauaguagguguuuucuuauccuucucugccaucuccagaacaucuccuguccuccauauuaaguaucuagguguaaaucuuauuuggucacaguauacaguccuccaccucguucugcugcugaggucugcugauucuucagucacuuucagucccuucucagaaaauguagcuguuacuuucuccaucaugcugcuguugggauucuuggauaucucaguaggcuuggccagucuauucuuuggucuuguuucucucucucucucucugaugauuguucccccaaagcuuuccucuucagccucuuacucucuccccuuucgugcucugagugagaacuugcagucccucucucucucucaucucauucacccacaugcuugccuugcccccauggagaugcugaggaugaccucucgguagagagagaccaguuuucccugugaguuucaacucccuccugcuuuacuagaaaugcaacccaagcgcuuuuccuaaguauuucucccaucucuguuagaaaacagauguauaguugguuaucuucuccuguuuggaggggaaaaugccagacuucccuuagaugucacuuccucuguuguuaucaaauuucuccuccuccucuucccccaccaccuuuuuucuugaaaguucauguuuaaccgccguuaaaccaacauuucuucuuuuagcucucuuuuguuauauugauuucuuuguuugccuguggaggugguggugugcaugucaaggcacacaggugauuaucuucaggauugauuuuuuuuuucccucccaucacgugaguccuggggaucaaacuuggagcaccagacucagcagcgagcacuuuuacuucugagcugucuguggcccccauauuucaucuuacugaaaauaauaagacucuggucaggccgagauagaguuaaaaagcaaggucacugugguguaguaaacaaauaagcggucagggcagagggaggcgagguggaaaagcuugcuaagaaagcuaagaaucccagcugcugucauagagggaagucuaagugucggaggugugaacucacuccauggaaaggacauggggguagguaguagauuuaauccuuuagaacgguacuuugugcuacuaguuucucauggaaaucgucuaugcauacaaaagugcauuuauccaccuucaguuuuuuuuuaaaaccacagaaaauaaaagaagaucggucaguacacuauaccuguauuucccguacgcaccaacugugaaaauccugccccacuuacuuuguguuucguuacuacccacaauuccccugcuuuuaccacaggaaacacuagcaugcagaaugaaacuccuaaauauuuuaccggguauuucuuuagaguaaguaguguuuguuaaaacaaaacaaaacaaaaccaugaaugcaugauaauguuucuaguucucagccagaccauaggguuccuucuuauugcacaucaacuauggucauccaucacuuacaacaggaacacauuuugagaagugugcuugcugugugaucuucauagcauggcaucugcuuacaaaaccuagauuuuaaggucugcuacacacuuacauugcauaacacauauguguauauauaaugcgguauagccuauggcuccuauggccacaaugagcaaaacaauccaagauuaaauaaaauacaagagacaaugaugcaguugagacacaguagaugcaagaugcauggucuauuugccaguguagcaugacucacuauguuauuguaaaacuguuuuuauaaguagagggaacacacuauuaaauaaggaggagccguguacuguggcaaauccuaaacuaguaaugcaguuguugguugucaccaucaagaauuauguguagacuguccauaauuguaugcucuuaugagcuucacaguggcuguuuacacaucauuaccacaaaucccugaguauccaucaucauaagauaccaugacagcccugaugucgcuaggugauggggauuuuucaggucuauuacaguuuuuugggacugccuuuauauaguguugaccauauuuguuuuccacaccccuuuuuaaaagcgcuuuuguuguguuuuguuuugacagacuggcuaguuuccagcuugcucuauagcuaaggaugaugaccuugaacccauguccucccaggugcuggcauuacaggaccugugcaugcuccacuccacggauggagcuagucucuaacccuucaauagguuuaacaggaucuugcuauguacccauguugguucaaacuuuugauucuccugugucugccuccugagugcuaagcuuacaggcaugugcuaccauugucugucucucuuuuauuuguuuucauuuuuuggagaggaucuuaucuagccuugucuggcuuccaauucagggcauagccaaggaugaccuugagaguuuacuuuaaauaaaaaaagguugagauuauuuuuauuuaauguguacggguguuuugcccauguaugucugugcaaccauauguaccucuagugccugcagaggucagaaaagggagucagauucccugaaacuguaguuuuggauagcugugagccaaccugugggugcugggacuugaacucaggucuuccagaagagcagccagugcccuuaacugcuaagucaccucucgagcuccaauuuaucuuuuuuuuuuuuuuaaguuuuuuuucgagacaggguuucucuguguagcccuggcuguccuggaacucacucuguagaccaggcuggccucaaacucagaaaucugccugccucugccucccgagugcugggauuaaaggcgugcgccaccacuccuggcugcggcuucuaauuuaucuuaauuuaaaauaaguaaguuuuuuuauuuuuuaguuacuguuuuguguguguguguguguauauauauauauauauauauauauauauauauauauauaacauuaugugugaagguaagaggacaacuuuguggaauuggucuucuccaucacuuuuaugugggugcugagaauggaacucaggucaucaggcuugcuuggcagguuggccagcuaagccccccuugaauuucucuguugucucucugccucuaccuccugaguaggacugcaggcauuugccaugcucgguucauguggacuggggauugaauguauguuguuucaugcauguugcauuuuuccaacugaacuacauccccaucccaauuaauagcuuuguuuuagcuguuauauguugagcagagccugccugagggcggcggcagaagucaggagacgauuugguggcuucuauaggggauucccagaguuaacugacagcagugaauguguguacauacacaugcaugguuuugagucaagauuugucuguguugcucugacuggucuugaacugguggacuuaagcucucuuguuacuucagcuucacaaguaguugagacuagaggucugugccauauuguccaucuagacacauauuuuaaaauucugaaguaguuucaagucuguaagaacacuguuguaagagcaccguaaagaacacuguaaagaacucuggcaugcucgucugcaguuuuuaaguuaugucauaguugcccauuucuuucucuuuucuccuucccaucuuucaccuuuaaauacugcaguaucuaucauuccccaccagaagauaacaagcaacaccccaccacaggcguuucuccauuaccacaguguguuucuuccauucagaaaauaaacaggguauaacacugguguucauuuuacagaggguucacauuuugcuaucugucuuaguggucuggaauugguuguuuuuucuuuuucuuuuuuuuuuacaugucuccuugauguccuucauucuggaauagcucuuuaguucccccacccccucagucucucaugccuuuaacaguuuuuauacaagaaauuaaucauaaucuggaucuaugcacuguggccugugaccagacucaggccaugcaauggcagguaugccagaggccugaugcugugcuugauucucugagucacgugguaugggucacaugauuacagaugaguugacaucugucagguuucuccacugucaagucaguuuuuuuuuuuuuuuuuuuuuaaagauuuauuuauuuacuauauguaaguacacuguagcugucuucagacacuccagaagagggagucagaucuuguuacggaugguugugagccaccaugugguugcugggauuugaacucuggaccuucggaagagcagucgggugcucuaacccacugagccaucucaccagcccgucaagucaguuuuaaccuuuuguguuuuuauuuauauuugggggagauaaugugacaggacacuaauguccugccauaauuaacaucccucaccucuauccucccugagucugccagcuuaaaucaaccacgucucaaaugguugccacaugcaaauuaucucuauccuguguuauauuuauuaaagcaaugcuuacaccauuagaaagagcccucuuuccuucccucccuugcuuccuuuuuacauaugaauucacuucgauuuuuuuuauauuaguggcuuguaaacuuuuacuguguuuuaauguuuagauuucucagauuuggucagugggaguucauucauguuagugccuuuggucuuucaaccuccucauguccuuuuguuuguguguacaugaagcagcgaggauuguacucgggccuuguacaugcugggcauggcugugggucuucugauauguucaugucuuucaugucuuuugcugagaauuuccuuuuuuuuuuuuaaacaaauuaagauuuccuaggcuuuuuuguccuuugcucuguaucagccauuuccccaaagugcgccguagugauuuccacuuaguggaggaugguucuuagugucuacuaucuaagcacuaacuuaaugcugagcacuaucuuaucuaagacuuagugucuacuaucugaguagaauccuuauucuacuggcgggccauugugcacaaaccuucacaaggcagaaccaggaaaugaaugcaugucucugugugcacacacacaucugaacaucuuuaaugauuucuuuuucccuguuucauauuuguuuugagacagcugccauuuuauagcccaggcuugccuggaacuaguaauauagcacaggauagccuggaacuugcauauucuuucaccacugccuccccagugcugggauuauaggcugagucaccauucuuggguguauaugaaugcauuuaaaaauuaguucauuuacuaauuaauuauuucagucuaacaucuuauaguucuuuuagccuuacucuuuccauguuucagaauccucucucugacagugagguaccucccuccaguucuuuuagauauauuuauucauuugcuucaucaguuaacagauugcugacuggaaccacugcucaugguugaggcuucucucccaucugucaugcucucugcccucccacuggcuccauggcauuggcggcuagggaauauugccaccuauuucaggcagccuguucuucccccauaccaugucuguggguaccaggcgcuuuggugcagaugacuaugcauaaaaccccagcagccucauugcucugcugucuuagaugcuggagucuuuguguuggggaggcuagggaagaaagcaacagauagaaagaggaggaaaaaugggaugaaagguaagaagcuggguuaugauauagaaacauacuuuuggaauagaaagcugcuaggauuuggagguaaaucuaauauagagagagcauggggaaggaguaaacauugguucuaagguuuuuagcuugagccaccaggagaauugaaugucauuaagugacaaguagaaacaguagaagguuaaauagaaggaacaagacuucuguuuggagugugccaaguugguacuuuuuaauacgguacuuuuuaaacgaucaugagaaacgcacaguguguuaccugugcuucuugacaucaucugcuggagauacauauuuggggaugcuugauauagagaugcuguuuaaagccaugaguucaguggcguuucaaagagaaaacauuugauagaaaacuucagccaaagcccaggagcaguuucauguuaaagggacgggaaaccauuuagguagggccagccagugaggugggagggaaaucaggugaaugcagaugagugcuauggaagcuaagugaagaaaauguuuuaguuaauaggaaaguaucagacuaucagaugcucuuguuugguugguagaggcaaggacugugaacuuaguaguauggugguuacuggugacauuaauaacuguuguguauggaguggggugcuugccugguguggguucaagaaggaugggaagacaugagagacaguaaaugcagaaaacuuggaggaguuuuagccuaaggcacauccccacagucaucuucuugcaugauuuuuggcucuggagcugaguuuaaaguagccauuucugacaacuguguggguggccuggcauucuuacuaucuauacauuaucacugugauuuaguuuaguuggugaaagauucuuaucacuggucagugucuucauuacuguucuguuguuuuaugacaccaugaccaaggcaacuuaugaaagcaagcauuuaacuggggguuuucuuacaguuucagaggguuaguccaugaccauuguggcugggagcauagcauagcagcaggcagggugcuggagcacuaguuaagagcuuauauccuggucugcaggcagccugcagagagaguuggugugggcuuuuaaaaccucaaggcccaccaccagugacacaccuucucucacaagaccauaccucuaaauucuucauaaauaguucaccaacucugagccuuuuguggggagcugguauucucauucaaaccaccacagccagacaaguggacuggcagugcagcugaggagagugcgcauggacagaaucacugcacgaguuuaguccaaaggaggagcuggagcugggaaacuuuaacgaguucccaguguucaggaagggaagcuucacagaguguaugagggagugggccuuggcagcaccuugaccuucuucuaaaaagauuuuucauguagaucauggaggagucuuuuucuguuccauauuuuucuugguuuguaaagaaucuucacuagaaauuagaauauacuucaaauugcugaaauuuaggcuagucuuuuauuauuuauuaaauauuuuuguauguacuuacuucugagugugugcaugggugugaguguauguacauaugugugugcauguagagaccagaggccgaugcugggugucuuccucagucauuuuuaucuuuuuuuuuuuucaacugaauuuuaucguauguguguugggaugagguugggccugcuacugugugugcagagguccgaugacaaccguauguguguguguguguucguucuccuuccacucccacaugggucuggggacagaacucagguuaucaggcuugugcagcaggugccuuucccugcugagccuucuugccaagcguccacuuuuuggcuuugucuucaagacagagucuccuacugaagcuggaguucacugauugggcuagcgagcucuggggaauccaucuuucucugcuuccccagugcugaggcuccagguauauauagcuguacccaguuuuuugcauguguuauggggagcgaagcccacguucucaugauguucacauugcuugagcuugucagcagcagcagugccuaaaagaaaacaaguagauccgccaaggggcacagcacagagcuuguuccacucucagacgccugagugacagcagcauuucuuuuuccuucuuucuuccagagucgacguuguuugcugaacuuggcuauuucacagacacugaugaugugcacuuugaugcagcacaugaggcuuauguaaguacuaacucucagagcaauagugaauaacuugauguuucaucuguacugugauuaaugcaugaaggcuucugaauaguagguuuaggcuaguagcuaagugacaccauugaccaugaauguuagcaccucuuguagucaauaaguacagagcuauaaaauuguccaggucuugguuugccauaagagagauccagauucaacaagauagauuuuuuucccuuugcuauuaagaaaagcaaguucaaaaaauagcuauucauaucuucucucuauagaauaaagaaugcagacacagcuggaaacaacgcaggaugagugcuguacggggauguccuuuuucaucuuaccauucugugguuuucaaacuucuagaauuuuuauaaacucaacaaacaaacaaacaaacaaacaaacaacccccucccccucaaagccuuguauaaggcuucuuagcuuauuuuuugucuuaggggugagugaccuuggaaaagucauuugacagccuauuuguuuguuuuggacucaaggcuucacucuguagucuuggguggucucgaacuuacuacauagcucuggcuuguugggaacaaaauaaaaaaaagggacggggcuggggcccuggggaagaacggaaggaacacccugccagaguuucccuauucucuggucagucaggcgugggagggcugcuaucuacccuauccacucauccuugggugggcauuccucuaucccacucuucaggggguggucaaggggcagcccugccugagaacccccccccccccaagcuacuuugcuaaagccaccaggguugugggagagagggaagagggaagaaguucccaacacugaccagagugugcagcggaacuugaaggagcagagcagacacucuaugguuuuagagcuuuauuauagaaaugcaggggaaagagagaagguauaaaggagggagggaaggagggagggagggagagagagaagagagagagagaaagagaaagagagaagagaagagaggaaagaagaagacaaagagaaagggaagaggaaagagaagugagagaagagagaggugagaggacaaaggaauaagagagugaggugcgggcgcgcuacugugucauauaggugaauuaugaccaucaggguucagaccucagcucuacuggaaaccagccugcaauuccccacacuggcuggccugccauugcuagcaguccucuugcuucagccuucuguguacugaaaguauaggugugagcuguaagcugaguccuauuucuugauuuuuacagauccuuugcugcuugugggagauggugggauuaagaggcaugcaugagucauguaucuugugaagaggaacuuaccaacuuccucuucaagaacucuaaaaauuagucauagccuuauuuuuaucuuugguugguuagaaaacuauguaaaaacuguuacuguaauacuuugaaccaucaaaaugacauauuuuuuugauuaguauauguguagguaguuagcuuauagaauucugaacuuugccucauucuuuaagccucuaccuacugagcuuguuuuauugacccuaaaaauguuuuuuggguuuguuuguuuguugaguuuauaaaaauuuuagaaguuugaaaaaccacagaaugaaugguaaggcgaaaaaggacauccccguacagcauucacccucuuucugacuccugcguuguuuccagcugugucugcauucuuuauucuauagagagaugauaugaauagcuauuuguuuggacuugcuuuucuuaauagcaaagggaaaaaaaaaucuaucuucuuggaucuagagcuuucuuaugcaagagacucauuuugugaaucuuuaauggucuauuuccacaaaaaaagaauaaaucucacaaaguuuuuaguuauugagccuguuuccuuuucuaguuguucuuguccuuuggugagccagaagugcuguaucccuggguucucugagauguaucugcaguauggggcaguuggcuugggggguagccaguaugcuauccaugguaaauggugccugaugguuuuacuucauucuuaaccauuugcugauuugacaccuacaggaaaauaauuuugaucaucuuaauuuugauuuggauuugaugccuugggagucagaccuauggagccccggcagccacuucugcucagguaaugaugugguugccuauaacauucuagccagacuuaugcucuuguuugguaaauacugggaauuaagugggucagaaaauccuggccaacagggcuuacgaaaugaugaaaaggaugaggcuaggguuaccugcaauucggagccucacagcaguaucccugaguuugauguacauccuuuugaggagaggcacagcuugacuaaugcuauguuuuuuuaagugaucaaaguuuuauaauaacaauagaaagaggaaauuggauaaaaauauuguuuguuuccuuugccuguuccuuaaggugugaugaugagccuuucgcaggcuguuacucaggacagaucaauacacuguaaaauccuuguuauuuggacagagaguuuaacuacaguuuacaaaaguuuaauuuggauuuuaauguucaauuuuaauuuuuaaaaauuuaaauuuaaaauuucuuugugugaguguuuugccugccugugugucuaugcacugcuugugucccuggugcccaaagagaccagaaguggguaucugauccccuggaacuggagguagauaauugucaaccucuuuguggguacugggaauugaaccuuggucuuuuggaagauuagccagcucuuaacugcugagccaucucucuagcccuaaggcucacauuuuguuuuaauaaaacuuauaguucccucuuagcuuuggcugaugugucuacgcauaagaaucgauugagagguuucauuuuccauaacuuuacccagcuucucagccacucuggcuuguucuacaauuuuguuauuuaaaaccaaugagccauccuacugugggauaauuuagacuuuguuuucuucgaaagaaaauaacagucucaugacucuuagcuuuuucuuaccaauacaucucaccuucuuuguuaaauagauauaaaaguuauucccuuuaaucucuauuaauuuuuuucugguauguguauguguguguauguauacauauacauguguguguauagagacuagaagagcuuuuuuagaaaaaauuuuuagguuuauuauuuuuuuauuuauauuuuuauuuuucuaugguuuuagagcuuuauuguagaaaggcagagggaaggagagaagguagaaagagagaggcuggccauagccacguggagagaggagggaagggagagagagaaggagggcuagagaugagaguaagaaagggugagaacuuaaagagcgguuuauuuuuuauauucgugugcauguuuugcuuacuuguauguuugugcaccaugugugccuagugcuuuuguaggucagaagaggauguuacagccccugaguagugagaauuuugguuucuuuaaaaacacagaaaucuuauaagaaugcguuuuuguuuuaaucccaggugugggauauggggcuguuucagauugcucacagcagcugaccacucucucaggggagcgguuugccagcagcagauagugucuguaagugucuggcaucuggaauucugggaguucuucagaggguauagaaaugcuagggcaccaagagcugggguggauugauggcaggugguuaguugcuuuugguugcuguugguaaguagucaugugcuaagaaaaaaacaacagggggauuuagauauccugacagcgaagaucaaacuugccccaaggaacuugacaccccuaaucagcaagaaguagucuaacgauaaggucaccccucuccccucuguuauuuuuucccuccuaucuaguguuggggguugaaagggcagaagaaggguggagaaggguggaagaaaaaagaacccagcuuuagugggcgaguuuuccuaggggguguugggucuggagcggggcugcgcaacaguggcugagccgcuccgcguuggugucugccucucccugcugcggccgcgcaacucugaguggcagacugaguugcagccuccaggggaaggcaugccaucugccaagcagcuagcuuauauuggcuucaagaccucugccucgaugaugcucuucacuguguauggggguuaccucugcaguguacgagccuaccuuuaucuccagcuucgcagugccaggcgccaggccgcagaagagcagcagaucucaggaguccugagaauugaaacggaaaagaccuccccgcgcgucaucccuggcaagaacuaggccacgaugccuuucaaaccugcugggcuaaaaagccaugguuucugugguacugcuggcuugugcuguuuugacaguuuuggaggccaucaaauaaauggaaaugugagggugagguuuauuacagagauuaaauauuuugcuuuguuagaaaaucaaaacaaaagcaaaaaacaaacaaaaaaagaaagaaaaaaagaaaagaaaagagaacccacaaaguagccagcagucuggccacacucuggcacuggaguuuuggaccauugugaggugccaugugggugcugggaaccaaacucagguccuguguuauaagagcaggugcucaucacagcugcucagcucucuguccccucugucccuuucugagguauuucuuugcagcagagccucucccugaaccuagagcugauggguuuugcuaggcuggcagcugguagugcugcuauuuuuaagggagcuugaugagguuggguuugagugagcugagagaaccugcagcaggcugucagacagagcugacaggagaaacugaaggaacagugucuucuccugucuucuagcaugcuuccuucuaggucccugccuacacugccuacaaggaagugggcguagagaucauuagugucgcagaugacaggaguggagagaaaguggguacagaaccagcacauuuccccaguaaaccccuuucaucccugcccuuccuagucucuagucuccuucauuucauuucuuauuuugcucaaucccugucuucucucauggaaugugaguuaccugaguguucuccagcccaaguuccugauccauagauucugggaacuuaauaaaauggcuguuucagcaaagauuuaguuacacagcaguaauagaaaacugaguguguguguguguguguggggggguguagcccagugguaaaguguuuaccuggcaugcacaaagcgugggguuugagauucagcuccugaaaacaacaacaaacuauagcaacaacaacaaucaaccaaaaaaccagacauaaaacaaaaagccaaaacucuagagugagcauugaccuugugcuuuuauguucugcgguggggggcaggcguagguuagauaggugaguugauacagugagggugaacaggcagauacgguucagaugggaggcugcugcuuauucaugguuccugucugacucuggguaguuggcuuuuugucuacggccuaauacugaaaacagagaggaguuuauagaguagaacguuucgccugcucuuguuccucaaccaagaaagccagugcaccaguuucuucuuuuucuccagagaguuagcgcaggagugacuuccuacaggaguacaagugauuuugaguuuuucauugaaaugauguuuuuguaaccaaacugcuaauugaauuuucaaagaccauuuugcccaucuuauugugaguuuguaugaguugguguguaaaacuguccaccaugucuuucccugacagacaugaaggcagagccccagccucuuucuccggcuuccuccaguugcuccaucuccucuccucgguccacagacucguguucuucaacucagcacguuccuguagguggccagucucuugugauguauuuauuggguuuaaugccaucugggaaaugggggcuggggugggguggggggaaggcgguugacauuaauguuuugaguaaucucauucucugaggaaaagagacuugacagggccuugugggagugagaaaucuguuaccuccuggguucggcucccucccuuuuguucuugcuuccucagugcccaguagucuuugcuuacugguuuucuuuucuuucuguacccaucuuuccacucccuuagaauauacauucuuuaaggacuuggaagaauguaagauuuauaauuccugggucauagaguucaggaacuccuaccauuaucuuucaaauuaacuaagaucuuuacaaaagucugauagcuccuuuggagugcaucccuggcccucacaacaaaagcuuugaaaucaaggaaauggaauaccugauuuaaguaaugggaaaggcaaaguacaagaagaaaaaucaaauuaauauuucauauauuuuaacuuuuauaaauugagccaucuuuauucuggcagguucuauacuuagcaaacuucuaaauuuugggaauucuguuugcuuugggguguguguguguguguguguguguguguguguguguguguguuuagguagaugacaaccuucaggaguuggcuuuuuccuucuaccauguuguuaucagcugaguuuuugggaccugcacggcaggcauuucucccugccgagccaucaucuccccagcgcuguauucacuaggaauucuaagauuacuuuuugcuuuugcugggccaucagcaccugaccuuaggauaaaagccauuaggaucuuaccugguggucugucuaccaacucuccaaaccuuucuuaguagagucaccuucaaaaacaacucuuaaaauuacaaaauguacuauguccuuugccuuaaagccguuuaauuacuuccuagugcucaaaguguggaguucagauucucugugugcugguccuccaggucugccgugcuuacaaacacuuucuaguuauuucagccuugcuuuguguugcccuuccuauccucacuccccauuuagcuuguguccugugaguuucuucugagaacugugcacauggcucaugcaguccugugcuaggcacuuugcagcacuggaaguagggucucuguuguuauaguguuaggggguuuuguuuuuguuuuguuuuuuaaugagacagcaucuaacuguauagcuucuucucuugcugcuguggcaaaaccccugaccagugcaaccuaaggaguaacggucucuuuugacucagucugucauggaugggaaggcauggccgcaggagacgaggcugauggucacaucgugaccauggucagaaagcagacagacaaacgucccugcuuugccugcuuucucuguuucugaagccugacaccucagcccauggagcaaggcugcccacauucagugugggucuucccacuugagucuaacuaggaagugccucacaguuaugccuaggaaucuguuuucaaggugguucuaggucccgucaaguuaguaaccaguauaaaccaguacagcagugaaagggacuucugacuugugguccugcugccccagcaucccaagugcuaggauugcaggguucuuuuaaagguagucuuacuguguugcccaggcugggcuucagugcaggaaugugccacugugucuggccuggguuguuuccuuccuuccuuccuuccuuccuuccuuccuuccuuccuuccuuccuuccuuccuuccuuccuuccuucccucccucccucccucccucccucccucccucccucccucccucccucccucccucccucccucccucccucucucucucucucucucucucucucucucucucuuucuuucuuucuuucuuucuuucuuucuuucuuucuuucuuucuuucuuucuuucuuucuuucuuucuuucagcaggauuucacuguguagcucuggcuggccuggaacuuauuauggagacuagguuggccuugaacuuguagagauccuucugucucugccuucuagguguagagauuaaaauaauaaccagcacgccuagccugguuauucuucuucuucuuuauauuuauauaaggugcacauauauuuauuuuauuauuauuguucuuacuaguucuguuauuguugcugcugcucuuccuccacuuccucuuauccauguccuuauccuuuuuccugccuuuuaccucucuuccuccuuuccuucuauucuuccuccuccuguuacucaaaagcuuaucacucagaaagacauucucuaauuuuuuauuguuuuuuguuuuuguuuuguuuguuuguuuguuuuuucgagacaggguuucucuguagcccuggcuaucuuggaacucacucuauagaccaggcuggccuugaacucagaaaucugccuaccucugccucccaagugcugggacuaaaggcaugcgcuaccaccgccuggcuaauuuuuuauucuuguucucuugcuuacacugccuuuuuauuuggaaugaucuuaaauuugcaaauauauuguggagauuuuugucugagccauuugagggucaguuggccacugaauuccaaauucuauaaugucuaccuccuaugaacaagaauguuuuuuuuaacaacaauacagccaccaaaaccaggaacuaaacauugauauauaacaauaaucucaucuguagcccuguaggcauauuuguuuuagcuauuuuauuugguuuuuauguaccucuuucucccuuccagcccuuauuccuuccaaccccccaucaccagguaguagagaaggaaggguggaggagaaaggaggcuaggucucuuuaaacuacuuccugcugacuaaagcaagucuaaucuuccgcuaccgggaaguccagcuucuucuggucucuuuccucucaaccaucagcagcaggagcaggacccagcaggggguacagccgaacagccaggcuucuuccuuaguguuccccugccccucagaguucccucagcccccucuggcauuuggcuuuuuuuuuuuuuucucucgcucaagaguucccagaauuaagcuaucugcacugggcacagauccugccccugcuggagcacgaggcagucagucugcugcuguggauaagcugaaggaggccacaccagggauuaaaacagaaacaugucuccguagcauaacugagguuaaaagaaaccaaaacucgcacuacccagucccgguuuagauugugcaauuucccauguagcuccccuuagauucagaccagcaaaagcaucagguuauguugcaugugguugucuuucugcuuuaauuuucuuuauucuggaacaauucuuccuucuugacuucgugcuuuaaugaccuuaucauuuggagugccagacguuuccucaggauuggagucagcuuuagugucuauggcaggaaugccacagaagugguuuugugucugucuuuuguuuguuuguuuuagccucucucucucugucucucugucucucucuuucucucucuugguuuuugagacaggguuucucuguauagcuuuagcuguuuggcugucuuggaacuugcucuguuuaccagguuggcuugcagcucauauagaucacccaccucugccuccuaaguccuaggauuaaaguaguaaggaugucaccacuaccagaucuguuuuugccuuuugagauaggaucucaccuaguucgaacugguuuaaaguugcuauguaauggaaaauggccuucaacuccugauucuccugcuuucaccucccaagaacugagguuacaggugcaggccacccacacuccaccuugucauuuauuuuugaugauaagauucaguuugaugacaguuugaggugguccuguuacuggugauguucaccucagucagcugacagcaucugcuaggcucucagccaagaagcugcucuuuucucccuuugcuaguugccaguauuuugugaagaagguacuuuuaaaccguggaaaaguacugcucuuaaaauaauaagcugggcgugguggcgcacgccuuuaaucccagcacucgggaggcagaggcaggcagauuucugaguuugaggccagccuggucuacaaagugaguuccaggacagccagggcuauacagggaaacccugucucgaaaaaccaaaaauaaaaaaauaaaaaaaaaaaugaacauuuacuuuuuuauuuugugugucuuauguaugguuguucaugauggcucacagugagugugugaaagucagacucuuucuaccacauggguuccggggguugaacucagugccuuuacucgcuaaucuguucuccugcccgaaugugcgggucuuugucaagcuauccaucacccagauacuuguuaacauuaguguugacuuacuguuucccauuggguuuagacuguaaccauugcugugauuauuuauucugguguuuguguugucucguauuuagccaccaggagucgcugucuauggcuccugugaucuuucacuaggcuucuguugggcucagccauguuacaugaaggcucuccuuccuugccuugccuucuuagguccguggguccccuugugaauguguucccaacacuucugguacccugacaagucccccgggcauggagggugcucuugcagccccaucuaaugccugaugcuuaaauuauucaggaaagaauauuuucuaagugaguguuaacacaaguuuuucauaagguaaagaugaccucagauccauuuaaaauugccuuaguaugugauuugagacacaggcucaauuuuauguuucucuaaaauauuauuaaaagguuuauuccaauaucauauauuaaaaguuuauuugucccccucucugauuucauuuauaaguaugcauuuuaaauuuauagagaugguauuauuauuauuaauuauugguuugcuguuauugauuuauauuugaguuuugagacagaguuuugcuuugcaauucaggcuaaccuugaacucaugaaccucugcuucagcuucuugaguggugugguuauagguguauuccacaugccuggcucccauuuacuuuuaaagaugaauuccuguuacucuguaucuauuaacucuguugcaucuaacugcacauuucaaaacgcauucacuguauuuuacccauacuaugaagaauauauuuuuguaaaaauaauauucucuuguggcccugugucaggaucccuugggauguauguccacauguggagaaagugggugacaggcugcagguccuugucagucagugcuugcgugcuuucccggagcugcugcaggcgcucagcaggcgcucagcaggcgcucagcaggcgcucagcaggcgcucugcaggcgcucagcaggcgcucagcaggcgcucagcaggcgcucagcaggcgcucagcaggcgcucagcaggcgcucagcaggcgcucagcaggcgcucagcaggcgcucugcaggcuuugaagagccugggaaguuuucugcuagggccgauguuauccaggagucugggauuuuuccagauaguaaaucuuugauuauuuuuucuuugauuauugguuguuuacaaacugucucuaauuucauuauguauuuaugaucuucauaaauuguguauucuuguccuuugacaguugucuauggauuuacugucuguuuuugugcuauuugcaagaaucagaugagugguuaagacauuaaguugugcugugugacgucuguguuggugugugaggaggcugguucgucaggaguaccucaccccugugagacagcucucaguccucagaccuaacucaucagguggcugaccugagccccagggcucccugucuguuuuucccagccugaggugagaagugugagaagacaguacuuuccucccugacucucaagucucaaacucuugcuggguaaaggcauugcuaaccucauuuuccuauuaucuaucaacuuuguagucuuuggguuuuuuuguuuuuuuuuuuuguuuuuuguuuuuuuguuuuguuuuguuuuguuuuuuuccagacagcguuucucuguguagccuuggcuguccuggaacucacucuguagaccaggcuguucuugaacucagaaauccaucugccucugccuccugagugcugggauuaaaggcgugugcugccacugcccggcugcagucuuguuaaguaaaacuuauuaauuuucaauuacucauauaugcccccacauauacccucuuuccuucuuggcuuaauuuugaaguguuuuguuuuguugguauuguuuuuuaaguuuucuuuuagauuuuaaaauuuuauuuuauauguaucaguguuuugccuauaugcauauaugugcacuuacauguguaugccuggugacuccagaggucagaagaguaugucagguaccccaggaccggaguauagauggcugugagccacugggugggugcugaagaacaaguguucuuaucugcuuagcuagcuccaggcccaauuuggaaguuuuaagaaguucuuuugugcuuauauaccacaaagauauuuccugcauuuucuuauauuaaccauauauuaaccauauaguuuaucuuuaacauuuaguuuuucuauacuuuuugagccuacuuuauucuguguuauuagaagggaaucuuaauuuuuuccuauguuacccuaacaaacaugacagauucacugaaaauuaagagagaauuguuaaagucaucuuaauacaucuuuauauuauuuguucauccauuaaguaaaauaacuguuuauuuuaagauuaaucucccuuauuguggaagaaggcaguguugauaaagaauuaauagaauuacuuugcuuuuaaaauucuuuuaagggugaauaaaagaaaugggaagggauauuagccguagcucuagccuuauggugauaagucgcugucuguaugacuacagaccagggaagaccagaguggguggggagaagugggaacagaugaacagucuaugcuuacuucgcgagugcggcauaagaugcugcauuuucagugucuuuccucugggguccgugagcguugacuuaccaauagucacuuauacugugcauuaucuucgcauuaagcugucuguggcacuuuucuguuuaaguaagaucguguucucuuuuuaaguaauuuguugcucaaagauuauacccuugcucauuaauuuuuuguguuucacugcaggaggaguuggauuuguugucuaguucucaguccccccuuuccuuauauggcgacagcuguaauagccccuccucuguagagccacugaaggaagagaagccugucacugguccuggaaacaaaacagguaucugccgcucucgcucucccaacuucuauuauuuccauuuuagacaacuuaaguuccauauuuaaaaggcaaaucuuggauuaagcuuauauuuauuaaauuggcuugcauuuaaaaaauagucuauuuauuuuauuuuauuauguguacaaguguuuuaucggcauauaugucugugaaccaagugcaugcuuccugaccccagaagcuaaaagagggcuucaaauccccuggaacuggaauuguagacaguuauaagcuguugcagaauccaggcccacuugagaaacaaccaguauacuuaaagccccuaaauuacaucuuauuuuuuuguuguucugaauaauaacugaaaaagucaaggggaaaaauguuuuaugauggucuuugugaaaaauaguuagaauaggcguggaccccgucaucuucaggagagguuguagcagugcaguuaaagacacugagugaaagaggugacgccucucaccuccuuaagcugugggcgucagucaguaauuuugaccugaccuuuagcaguucauguucccccuucccagagcugcacaggaugaucucagaguaggacguucucuucagucuguucagcuacagaguagcugugcguacgcucauuggugauuguuacucggaagucaggacaauacauagaggacaguauggaacgugauuaggguaauacauagaggacaguauggaaugugauagcuuuucuuaacuuucuucagauugacuuggagguuuuuuaaaauuuuuaaaaaauuuuuuuuuaaacucuagaacauggacugacuccaaagaaaaaaauucagaugaguucaaaaccuucaguucagcccaagccuuuauuacuuccagcagcgcccaagacucaaaccaaugccagugucccagcaaaagccaucaucauucagacacuaccagcccuuaugccacuggcaaagcagcagucgauuaucagcauacagccugcgcccaccaaagguacccauggagacuaugacgcucuguauaauauaaggcuuauauuacacacuuuauuuuaauuuguauuaaguuuuuugagcaugggccaucacaucaggaaaugucccuugguucucaggauuuugcagagaugacuaauaugguuccugccuuugcagagacagaauacugaucauaacuguugcuucuuauucucuuacagcuuuuauugugaugauaucuguauucgaggugcugcuguugugguuguggugguggugguguccuccuucucuucuucuuccuccucuuccucucccccuccuccuccuccucccucuucuucuugauuuccuuuuucucuuucuuuuuugaggcagaaugucauguauccuuaacuggccuggaacucuguaaauagagcaggcuggcuucaaaccagcagagauuugcuugcuucugacuccugaaugcuggcacuagaggugugugccacagcuggcugagguuuuugauauaaaaccacuuagaaugaggaagaaacucugggagacguuuguauugcuauuuuauucugagauuauucuggcuguggccgucuuguuuuguuuuguuuuguuuuguuuuguuuuguuuuguuuuguuuuguuuuguuuuguuuuaggggugguuaggacuuacaauaauaaggaccauuucaaaucagggauguguugagcaauaaaucuggcucuuaauuucugaggagacuguguaguuugauaagcagggcauugaacuagguuuuagaagaccugacuugccaacuggcucagauuugguguuuuucuauauuuuauccaccagauggccucaugcacuuaugauucuacaagaaagucaaaaggauguuaaggguuuauaaacuagugaaagaaauucaggucugaggacuugauaaucuugagauaugugacaucuuuuaggcagcuuagucaucacuguacuuauaucaaucuguguacacauggcuaugagaaaauuuaugcaguacucauuucuccagauugaauuuauuggcccucaucagcacuaggaguuaauaggacuucuguaaauaagcaucaacguuacauuuguguuuauguucauauuugcauuuaagauugguuagcuuauuucucuggagcaucguuucaaugggaaaggcuucauaaauuugaucucaaccaugggcaauagaacauugauaaaaagaacuaaacaagggaguggcuguaugggugaaaaccuauuccuaaugaaagaacaaaaugaacagacaaacaauuugaaaugcccgccuucauucaggagcagcauccuauuuguuuuuuuaaauaggaaaaguagcgagccuauggaauaaguguucuugugauuugcaaauggauguuaagggcugauaaacucuuugaaauaaggcacaagauuuaguguauauucauaaauugaguuuuaggacuaguaccuaaaguauuucuaagaccucaaaaugauuuguaucuuuccaaggcuaagaauuuaaauucaugaagaaccucauuagaguucccacagcuguuaaagcacaugcaugaaagccgaaguaugaccuuagcauggcagcguguaaacgagggcguacccucaagaguuugcuguaaacucuuggcucuguuugagagauaggagaucuuuuuuuguuuuuguuuuuuuguuguuguuguuuuguuuuucaagacaagguuuuucuguguagcccugacuguccuggaauucacucuguaggccaggcuggccuggaacucagagauccgccugccucugucuccugaguguagggauuaaaaaaggugugcgccaccaccuccagcccgagaucucuagcaagauaaagauagauuuuuuuuuuuugcgcagcuuaucaguuccagagauuaaaaguauacauuuugaauuucaauaauuuuauaugaucugaaaacuauauuuuugaugagcaugugccaauaaaaugguuuguuuuuauaauauaaucuuugguauuaauauuauaaucugaaguuuaauuauguaucuuucauacuuuuuaaaaaauuugaccuuggaaugagaagaaggaagugcuggggagauggcuuuaucaguaaagcgcuugccgcagaagcacuaggaccugagcucagauucccagcgcccacauggaaagcugggugcccuagugccucucuagaaguaggcagaucccuggaggucaccaaccagccugucuagccaauugauccaauuucaacgagagaccguuucaaaucuaaggcagagagccacugaagaaguacccagcagcagccucuggccuccacacacaugugcacucacguguaugugcauucacgugaaaacacguacaugcauauacuauguggacaaaaaagaaaaauggaauagaugugauuccugcaggcuuaaugcuuugaaauuugguuucaguuaaauuuucuaacuuuauacuacagugucauuauuuucuugaacucaaaaauccuuucucaguauccuaagagcuugguuuauagccauauauuauuuucuauccaauacaaauucauuuaaaaccauagcuaaauucuuaauaaucguuucucauuauguauuuucucaguccauagaaacugacagacaacccugauuaucuuguguagcugagcuauuuuucugcuguuaagagaagaguacuuucgggcacugguguaccuguaaucccaacccuugagaagcugaagcuagaagguugugagcugaggcuagccuggguccacagcagcuuccaggcagcuuugagcuccauagugagauccugucaaccacccccucacugccacccaggguuuagugguagaaggccuuccuagcauguacaagucccuggguucagacuccagugcccugagaaguaaggauauucacuuaggaauccuuggcuucaaauuuacauuagagugaguauaucuuuuuaauggcagcuuaacuuaaugucuuauucgguacuguuaaaaaacacaguauuuguucauauguucauauauuuaaauacauauauacuuuuauuuguauaucuggccuagguauauauuucuauaauuuaauacauuaauacauuuaguacauuucuccauuuuauaugaauuuauuuuauaacagaaggucaguuuaggggaaagcaaggauuaaacaugucuggcaauguuauguuccaguaaaugauauguauuucaaauuuaagaauuaauuuuacauuuuuuuuguaaucauuuauuuauuuauucauuuacaacuccagauuuuauuccccucccaguccacccuccaacuguuccacaucccauaccuccacuccaucccccugucuccucaaggaugucccacuuccaaucccuauccaccagaccuccaaacuccuuggggcccccagucucuugagggucaggugcaucuucucugauuaaacccugaccuggcaguccucugcuguauauguguuggccucauaucagcugguguaugcugccugguuggugguccagugucuugagagaucucagggguccagguuaaccaagacugcuggucuuccuauaggguugcucuccuccucagcuucuuccagcuuuucccuaacucaacaacaggggucagcagcuucuguucauugguugggugcaaauaucugcaucugacucuuucagcuacuuguuaggucuuucggagggcagucaugauaggucccuuuuugugggugcuccauagcgucaguaacagugucaggccuugggauuccacuuugggccugucacuggaccuucuuuuccuuggacuccucuccauuuccauuccuguaauucuuucagacagaaacaauuaugggucagugcuuugacugugggauggcaaucccaccccucacuugaugcgcucucuuucugcuggaggugagcucuacaaguucccucuacccacuauagggcauccugugcaaggccccucccuuugauuccugagucucucaccucccaggccucuggcacagacuuacaaacuuacuacuuguaaguacuaauaacugaauuggggaaaauugguaacauuugaauucuacuucugcucuacuuuuugaggucacugaaacaaagaauuucauuuuaugaauuugaucuuuuuuuagccaugacagauguuuuuaacaaacagguguucugaaaguauuauuuugauuuucaguuuuuccugacccuuugaaauauaaaacugagcuuuuauaagccauauuaaacuguauaaugaaaaaugccugauuuuccuugaagaaaaauuauaaauuuuuauugaaguuucauuucugguuauaauaguaccuuuauucagcuagauaaagccaaauuacuauggauauuaggcaaggcuuuuaauaccuuagaaaauugacagaggaaaggaaacaggcagguacaguuuuaacagaucaaggguuaugaguugugcuuuccugaggguagugaugugaguucucagaugagcacaaguuuaagauaauggcagcugcaaagacuaggaaacaaugugaagaucauugguuaggcagggaucagaaaggcaguuacugugccucaacuaaaguuuuauauuuuuuggcauuuguagucacuugacucuuuuuguauauguauguauuuguaaaucuuaaaggauuuguuuaaaauaagaaaaauucauauaguacuaaugaaauucagaggcuaguagcuggagaauguagauaugauaagagauugguuaugucuuguuauauugaaaaagauaaaaaugaacugccuugucuguucaugucucuagugaguauuuuugcccccccccccacucuugaguacugaggauugaaccagggcccugugcauccuaggcaagcccucugcacugagcuuccccuuggcccucuuuuauguacuuugugagaugagggucugaaugaacuuuugauucuccuacuucagccuccuuaguggcuacaauuacggccugcauugucaggcuuguuguaaaaaguguuuaaauuguguguguguguguguguguguguguguauccacacacacacuuacucaaggaggcccaaauauggugcccgcaccuguggacuuggaguuaugugcaguugugaacuguucaguguggguacuggaaaucaaauucugccucucugaagaccagcaaacacugguaaccacugagccagcucuccugccauuugguuuuguuguuguuguuguuguuguuuuguuuuuuacucuuuucaguugggucuugcuguguuguccaaacuguccucagguuccggggcaugagugguuccccuuccucagccucucagcuacuuggacuuguaccaccauaucugccuugaaaacagauuguaaaugauagcucaaagacagugaacuugauuggucccauuaaaaacacaacaccagagucccccugaguguguugccuccaugguaucuuaucugcugaaguucucugcuucucuguaaaacagagcuggauguucggcugcucccuuacagaguuacacacugacuccuucucucuuuucuaacccaggccagacuguuuugcucucucagccgacugugguucaacuucagagcccugcgguucugucgucugcucagccgguucuugcagucacugggggagccgcacagcuaccuaaccauguggugaaugugcugccagccccuguggugagcagcccggugaauggaaaacuuuccgugacuaaaccuguucuacaaagugccaccagaaguauggguucggauguaaguacuuuuuaaaaagaaccaaacaaauuccuuuugcuuuugcuguuugcuguuuugaaguuuguuuuauugaaugaaguaagagugugccaaaauugcacauuugguguuugguggagacaguuuuaaugaagcaugaaguaggcacgucuuuguauucuuacuuguuauuaggauauuucauccugcuccucgagucccaaacgagccauucacuaauaucucacagucuuucauaauuccugacugcaauuguuuuuugaaauuccccuggugagagucugcagaugucuuuucauuuuauuuauuugugggguguguguguguguguguguguguauguguguguguguguguauguguguguguguguauguguguguguguguauguguguguguguguguaugugugugugugugugugugcacaugcaugugcacaugaaagucagacaacagcuuggcgaagugaguuuccuccuccuacccugugagucccaggagccaaccucgggucuguaggcguggugggaagugccuaaccugcugagcugccuugcccauccuguucaggguucugaggcgcugucagcacuuccucaggccugagaauuuggucucuuugugguuauuuggacccuuacuuaccuuguaaaucuuaaaauuucuuacuguaaacaacacuuugcuacggucugucacuccuucaagcagcuaaagcuaaagcacuugcuggucaacucuuguuuucuuuuaaugucacugaaaaaucucuucggggaauucaggggaauugaagaccaacgucuuuugguuuugucuugucuugguuuuuuugagacggucucacuguguaucccuggcuguucuggaacucaacuauguagacuaggcuggccucgagcucacagagacccgggugccucugccucccucccgcguguugagauuaaagguucgugccaccaugucugcuuuaugaccugucuccuuguguuuuuggaagcguuguggcagugacuggccgugaacuugggaaugcacuuuucuccuccauaaauaucgcuguaaucucagcugacaauauugugagaacuuguaguaaagcauugcuagugaguaguacaucauccuugguuuagaacaagaguccccugguuuguacugauacggagaacagugcaucuuaacauauggagaagggaaguucgcuuuguggcaucuccuuggugguuggcugugucaaggugaaguugaauguuuccugucuagcuucuggcugucagagacucguugaaguggaugacgaaacaaguuugugcuuucuaugagaaggacguggccacagaaguaucugaugauccucugcauaggauggguagaguggaagggcucugugguuccaaucaguggugugaaggacaaggcuuuacugugaagcaaggugucuugacacagucaaaguacacaacugaauaagggacguuuuuguuaucgaccaaggagaaguagggaagugcaagucuguucauagaugcacuacggaugucagucugaguguucucacuugaucacugaaaagaggagagaaggcuguucugggaggucacuacugugcuuuggugguuggggcccaguagaguuaguaggaucugcaaacuguaagcugccagaaagcccuaaacaaagaagguaagaggcccaggaguggggcucucaggauucagcgucucguuauuccaguuguccugcaacauaacacuguccucugaagaagcaacacaccaggaagacagggaggagguacagaagguguggauguuuuggccaaaagaauucaggaugccacagacaaucacuaggaacagagauguacgaaguccuugcugaaaaauucuacuaugucugaauccagucaaaaucagucuuuaagagucacaaaugugcauguuuuggcagcacauauacuaaaauugggaaaauacagagaagauuagcauggccccugcacaagaaugacacgcagauucaugaaguguccauauuaaaaaaaagaguaucagcuaucugucuaggaguuaaaacaaaaaggcuucuggugaacacggcacagaggaagcaauauuggaaaggcguagcuagcuauagaagcuggcuuucucuucuaguagguaggagauuuucuaguauguaguauguagaaagagaaugacgauagcagaaauucaaaaauauucugugaggguuucauuuauuuauuuauuuauuuauuuauuuauuuauuuauuuauuuauuuauuuauuuaaaaaguuuaaccaguagcuggguggugguggcacacgccuuuaaucccagcacuuaggaggcagagguagccagaucucugaguuugaagccagccuggucuacagagcaaguuccaagacagucagcugcacagagaaccccugucucaaggaacuaaaagagcaugcuuuucacaggaccaggaaaccagaacauuuuaaaaagguggagacuuuuccuuuuauuuuuuuccuuagacaugcauauuuuauuaucauugucuuagucaggguuucuauuccugcccaaacaccaugaccaagaagcaaguuggggaggaaaggguuuauucagcuuacacuuccauacugcuguucaucaccaaaggaagucaggacuggaacucaagcaggucaggaagcaggagcugaugcagaggccauggagggauguucuuuacuggccugcuuccccuggcuugcucagccugcucucuuauggaacccaagacuacaagcccagagauggucccaccuacaaggggccuuucccccuugaucacuaauugagaaaaugccuuacaguuggaucuuauggaggcauuuccucaacugaagcuccuuugucugugauaacucccacugugucaaguugacacaaaacuagccaguacaaucauggagauuaacaagaacagggagauaugacccacucccccacccccaccccaaguacaugucuguauaucccccaaacuaucuaggaccucugaccuugguggaugcgaucaaguuuauaccagggcagucguuccacaugacaggggauaggcgcugguucuaauaccaggcuuucaguuccauuccuucuggggagaccccuuaggagauucagugcugaaggggagugagacuguggggcugucagggacaaggguucagggauuuguccccuuccuugcaguguaaaaguagcauuuuaacuuccugacuggcuuucuggaguacaugaaguggguaaggaagggcauugggugacugcuguguacacagggcuuggguuuaaggucuaagaaaggaaagguguugaagaggaagagguagggcacacagaauuuaacuuaaaacccgacucaggaaacagaacuuauuccucuagcagggauucccuguccuggcuuccagcuguggccuuugcuucuccaacaauucaaagaucccuucaaauaucuucugaauaauuuugaaauuaggaguuuggcauuuuuugugugugugauauucccgaaugaaacuaacaguagaaaacauuugacauuaccuuagaacuuuaaguagaaugauaguaugguguaguuguuaaauauuaacauagucauauuuuuuuuuaacaauuauaauaucccaaguguuuagaauuccagaggaacaaaagaugggaaagguuucuaaaaacugagggcuggaaaugugguccguagcacagugcuugcuuggcaugcacaggcccuagguucaaucuuuaguacccgucccauccccaagagaccaugccauagaagacuguuuaaggauuguagugauucaguacauuaaaagagaagacugaagguagacaaaggagcuaucuguuaggaaagguagggugucauguggacaacagaauucuucuggguuauuccagugggucaucuggaacaggugcagguaagugauagaaagagcucuucaaauccuaagcuuguagauacagacauuauguuuagauacuggaggccaguuuucuuuuuagacugugauuaauaggcagcugaaugcugacagugauggauucccugaaccauuuguaaucuccaaacaaauucaguuaauugcauguuggucuguuagccagacaucuuucauugguuguuugaugugaaagaacauauguucugcuuuugcaguauuuagaggacucugggaaguuuugaguaacuugcugacaaagucuuaguaaacaccuuaguuaggauguuugagaugagaguguaucuguauugaugaguguuaucuuuuauuguuaguaguauuggcucugauucagaaauuagagcugacagaauuauaaaagggauauugauguagucuguguuuaauauaagagaccaaaagacuauuaggaugaucuuccaguuaaacagaaucgcaguuucugagcuguuuucauuuauagcauagcaggguaucuuagucacuguucuauugcugugaagaggcaccaugaccaaagcaacucguauaagagaaaacauuuaaguggagucuugcuuacaguuucagagguuuaguccauuaucaucauggcaggcagcaugguggcaugcaggcagacauggugcugaagaaguagcugaaagcuauauccugagagagaagugggucuagaaugggcuucagugacacacuuucucuaauaaggucacaccucuuaaucuuucucaaauagugccacucccuggugacuaagcauucaaauauaggagucuuugagaggggcaugguagaggugggaagggggaggccuuguuauucaaaccaccacauaggaaaugagucaagacuuuucaaugugaguuuuucauauuucuuugagguagaaaagcauuagucugcuaaucuucccaaggcacccaaaguaaagccugcucuagaaggagcuguagagaggacugagccaccggaacagccucuauguuaguagcaugcauauguuuuuuaagucuccuuaaaugugaguuaguguaguuagucuugauucaaaauguaucccucaguuuuucaugucgugccauuuuugugcuuuuaaaccauaugguggaaaaguuguaauucagaaaacuacuaucagucuuucguggcuuuguaauguugacauggcuacucauucccuaccuguuuugaauucuuuuguuuggcaagccgcauucucuaggggccagcuaccgccauacguagcguugcuagcauaccaucuucugcagacuacauuaagugccacauuuucuguuaugaaacaguuugccuggcucagauuauaauuucagucuuccugccuuugcugguaaaucuguuauguuuaacucuuggaaaccuuaccuacauuuucaagaaguacaguuugguuuuagcucugauccugaugaaaaaaauagacauuuuauuuuaguauagacauucucuauguacucuguuaaaugaaauucuggaauuauaaaguuggcuugguagagagcauggguaucuuucuguugaagggcaguugaauguugccaggugugagguuaggcuggagcauucuguuuaagucuguuacauuguuuccaucucuucuccucucaacaguucaugagcccuaaucaccuuaauuuaggauuuuaaaauuaugagauuugaguuacugggauaaaggaccaugaaaaauguggugaaauuauauucuauauauuuuauaguggaccaacauagcugagaguuuuacugaaauucauugccuggaacaauggaaaggaaaagaucaugaauuaguacagaacuagaaagaaccuaagaggugagagugauugacacuguguugcuagaggcccuagccguuucucccugccuacccauucacucuaugggacaucuauuaaacccuucuucacucugcacacuuuccaaucuuuucugauuggagaccuugacacacaaacaugaacauucauggacacguguacacgugugugcaugcacgcacacacacacacaccuuuccaagagggcuaucuuuuuuugaacuccugugucagguccacagagcuaucauggaaagaagguuacuaagguaggggagaauuccuucccacaugccugcgggcauuaggaauacugaaaagggcauucuccaguuccaaauuggauuuugcauuucuuuuccuuuucucuuuaauuuuuuaaaagagcuauuuauuuauccuauguauaugaguacauuguaacugucuguagacucaccugaagagggcaucagaucccauuacaguugguugcugagaauugaacucaggaccucuggaagagcagccacugcucuagccaagcuaucucuccagcuuguauuaugauuccuuuuuuucuagaaaugguauuaaaaaguucgagauuucggguguuagguugaagugcuguggaugugcucuuuucauccaauggacaaauaugaacuuggaagucuuccauuuuuacagcaagguggaagcagcccuucuccuuuaccagagggacucuguagcuccucuuucaaaguuucuguagggagcaugacaccaagaaaugacugguuaacucccgucacagaugguuauaacuuugcauucuuagcuuguccaguaaggaauaaagcucacuagagaccccccuugaaggauguuucucaagaacgauguaauucuacagucuauuuacaauguaaaguaacgggcacucuacuuguguucuuuuucagaaaccaaaucaaaccucuaaacacuaaacauccaagguccucuuuuagggcuaaaugugaauuggcucuccuuuuauccuaucuuaaaucagagagagaaugaguagacaacuuuuagcaaccgaaugccuuuuaaaaaaucauuuuguuaaagcuuuuguuaagagcaucaagaccaugauauuucuuuaggcugcagagucaaggaaucugucagaauaauuucaguaggaaagauuuggugcucuuagaagcuguccagauuucagaaggaaaaagucacuuuugugcugacuagcuuuuggcuuugcuacuaccaaugacugcaaauaaaagaaaacuaugcuuuguuaaaguauuugcaguuucucuucaauggaguuugggguugucuaaaaauuuaucuugaauaaagcuauuauaaauuaaaauuugugauugcaguggcucugugaagggacacugacaguccucccuccccucuucaugugcugagcugugaugaacucaugcugugucaacauuagugguuuuuugaggcagggucucacugugugucucuugugggcucagaacuuccuauauagaccaauuuguccuugaacucacacaucucccugugucuguuucccuagugcugggacugaaggugugcaccaccaugccuggcuaacuucaaguguucuuuaugucuuucaguuugcuaccugauaaagcuaguaaguaauuauuugaaagcauguugacuuauaucuucaauaauuaaauacuuuacccucuuuucucugauagucuguccuauagucuuaccuuggggcucacccgagggagauagugcuuugcugaucaguuaguucccaucucuaaagcagucgccuucaccaguuuucugcccuccuguccugagauggcucuuuauuauguacacacuuaaagcuuuugcuaaaugaccucuucuaaagaaauaguagcucauguacacacugucuugcaacuugcuuuucuuaauauauauuggagauuguaccccaucaggacuuaaagcugaaagguagggauggugauggcucagugauuaagagcucuggcugcucuucuagaagacuugguucuagucucauuaccaacaugguggcucauaguugccuguaacucgaguuccaggggguaccaaugcccuuuucuggccuccaugggcacugcgugcacaugaugcacaaauaaucauaaaaacaaaauagccacauacaugaaaaauaaaguaaaucuuagaagaaggaagagaaggagaaggagcaggagcaggaggaggaggagaaaagaagaagaagaagaagaagaagaagaagaagaagaagaagaagaagaagaagaagaagaagaagaagaagaagaagaagaagaaggaagaagaagaagaagaagaagaagaagaagaagaagaagaagaagaagaagaagaagaagaagaagaagaagaagcagcagcagcagcagcagcagcagcagcagcagcagcagcagcagcagcagcagcagcagcagcagcagcagcagcagcagcagcuaauugggggcuggagagauggcucagcaguuaagagcacugacugcucuuccagagguccugaguucaauucccagcaacugcauccaucucacauccaucuauaauggggucagaugcccucuucugguguguuugaagagaacaagaguguacucauacacauaaaauaaaguaaaaaaagaaaaaagcuaaaugggauucuaguucauagagauuccauaauucacauuuuguaaucuuuuuguuugugaacauucucauuugaauaacuugguacauacuuucuuuuuguuccuguacaaguauaccugaggaauuccuaaaauuggaguuguagggucagaagauaggugcuaucucaguuuuaauagaguuuacuguuaugaaauauaauauggugaggggguaccuagugugcccaugacaagguguccccugagaaaucaugccacacaacagaccugguauaaggggguuuauuuggaaaagggagugagggucuagagaagggguagaggcagacauguagacagacagcaguguccugagggcagaaaagggcaggggagggggcaaagaaagaaagggggagggagggaaggagggagggagggagggagggagagagagacagagagagagagagagagagagagagagagagagagagagagagagagagagagagagagagagagagagagaucaugcaaagaaaaggugagguaacaggaauuagagacaaucuacuagaauggcauuugauuccacuaggcuucuugcagggaccuagcaacugcuuaugucaucaccugccucugccaggugcuucagugugggcugucuauucucacauguuccuggcugaucucugucucucucccuuucucucggucucuuucuuucuuucuuucuuucuuucuuucuuucuuucuuucuuucuuucuuucuuucuuucuuucuuucuuucuuucuuucuuucuuucuuucuuccuuccuuccuuccuuccuuccuuccuuccuuccuuccuuccuuuuuucuuucuuucuucccuuccuuccuuucccucccucccucuuuuccuuuccuuuccuuccuuuccccccucccucccucccucccucccucccucccucccucccucccucccucccucccucccucccucccucccucccucccucccucccucccucccucccucccucccucccucccucccuccuuucuuucuuucuuucuuucuuucuuucuuucuuucuuucuuucuuucuuucuuucuuucuuucuuucuuucuaucuuucgucucacguagcccaggcugucugagaacuuaguguauaaccaagguuggcucuggauuccugauucucugucucuaccuccugaguggugggauuuccucauauaauucuuuguaguuccuuguugaugugucuauugguuucaggaaugauuucaccuuuuuuuaaaaacaaccccaucaagauaauucauauaccauaauuuuuuuccuucuguguuggagauugaacccagagcuuuaugcacgcuagggaaauacucuaccuuugagcugaacucuugguuuuuuuuuuuuuuuuuuuuuuuugauuugagguguacaauucaguaguuucacauauauuuauugaguuauagaacaaugcuaucuaauuccaaaacuccagucugggccagugaguucacucaguggguuaagcacuugcacaagccugguggcccgaguccugagaaugaucccuggaauccaugaaggacgggggagaagccacuccaugugguguccucugaccacaggcucuucucauucucagcugagcuuccucgagauguugcagugugugugcaaacauagaaguauugcgcuugcuuuuguacugucuuaguuuuuaguguuuguagcucauuuccagcagcaucuuagacucaaggcucuaaacaucauuuuguuuguaaaagggguuuuuaauaaaguguuuaucaguugguaaagcuuuuaaaauuaaaaagaaaacgugggcaauuuugaagcuuugccuuuuaaacugacucaagccucaaaaggaacuuagccauuugugaaaguuuuccuucuacauaagucuucugugcaaacaaauguuuguuuuauaaggaaaacaccacacuuuauagugcaguggcacuaagggacaaauccuuugcagcuguggauguuuuccuuugguucuuuauucauuuuccaaggcacagugcuuggugggagagaccucugcaggcaggaugaucagaagcaggaggggccagccguuggccccugucggucuguuaagccaucugaugugccuagaugggagugugucagugaacuagcgggccagccuuucaauuucauacuuguacauggggcuaacaguggugagcuagcuuccagacauaggcagguccauacauuucuauuuguagauggcacauagaguagccaaacagcacacccuccauuucuguggugacagcucucuguggucucugaaagccuaguggggcuacugaauagguuccaagaggcuuaaaguuagcugacuuugauucaugccuuggcuugucuauucacucaguagauucaaaugaggcuuauuuuauuaaccauuagaguuuuauuuuguuuuugagagagucucuuuggguagccaugacucacuuggaaccuacucuguagaugaggcuggcccugaacucgcaacaguucucuggcuucugccucccaagagcuggaauuacagauguaugccuggcuugaaaauauaguaauuucaauaaauagagauuauauuaugcugccauucuuacuauuuggggaugauucuaauacaauguauuuguaaagucaguggacccaacagaauuuaacccuccucaagaacacugaacaauguguauguaugcuuagucuaaaaaaaaucaucuauacacucuuuuuggucuaggaaguguaauuuaguaucauguguucagauggcuaaagacagcuuccugagauauaguagcagcccuguacuuuugacuccucaauauuucauuuauuucuccgguucucacccugcuuuuauugguaaugcugaauauuuucagaccuacuacaauggaucuuuuucuaugagaaaaacagacuauuuggccacaggugguuuucauuuuuuuuucuuuuuucuuuuuggucugaggcauguggguugucagccuuugaaaucuuaaugcuguguauaaugugcaggugauuuuuuuguuuauagaaaugccuaauccuuguuugagauuuauuaaaugguguaccaucuguaagccucccuaaaucccauagauuaauuagccguuaaaguugccuuuuaucuaacuuuuaguauaaauucuuccaucugggaaccuucucuuuuauguguuugcucaguguuccguggacuucggcacgcuaguauuauuaauugugagcaccagcuuucccaggaacagugaagcugacuacaacuuaugcucagcagagcaaagugguauuguccugagaauguuuggaaauugaugaguaaucaguuugccauggucuugcugccuccccaccucccucccucccucccucccuuccucccuccuucccauguguauguuggguauuacuuugauaguaguuguaauguaagcaguuaguuuuauugcuuaggaauaauaacaaaaacaauucuagacauauauagggcugggaacucuggcagaugaugggugacaucaaccuucuuguggacuuucaguuagaaagggaaaagaaaagaaaguguucuuucgaugccuauguaaugcuuuuccaugugggcuaggacugaaagauggcugacaccaucauguuggguauuguuugguuauaguucaccacuguugcuaggagaugucauaauuggguagcuauaaguuuccuguuauaaaugugcuggcuaguuuuuaugucaacuugacgcaagcuagguucauuuuggaagagggaaccucaguuaggaaaaauuuccacuagauuguccuguggucaaggcagagguauauuuuuuaaauuagugauugauguggaaggguccagucuguuguggauguugucaccccugggcugguggucuugagugcuauugaaaaauuuuuuuuuuaaaaagcaggcugagaaagccaugaggagcaagccaguaagcagcuuuccuuccuggccucugcaucaguuccugcccucagguucccacugugaguucuuacccugacuucccuggauaauugaucacaaacuauaagaugaaauagauccuuucuuuugaauuugauuuuggucaugguguuaaucacagcaguagaaacccuaagacaguuaucuuaaacaaaauugaucuaaaacugcauuuauugaaggaguuacguacaccccacauuagaguuuuuuaaguccauugagaaacagauagacaucaaccauuuauguacauaauaaucuaauggaguuaauauuacucuuguuuuuguuuuugagacuagcaaauuugcuacccaaagaaauuagacuaaugauguaacaauaggccccguauuuauuuuaauguaacaaaaaaauuuaaguagguugugacaugguagauauuuuugguuauuaaacaaaaauaguaucagauaugacauuggguuccaaagucuaaaauuuaaguaaaaagauaguuagcauuguugaaaccauugcaguauuuuggugcaucuuccaaauuuuaagaauauaagauauucaaagaaauagaugagaauaauuggagaggggaagagcuuagaaguugguuaggggaggagauggcauuaagugggaauaaagagugugggcaacagagugugaggacaguguagugauuauggugucgagaaugcugggguuagggagcaggcaugguuagguagugagugcucagucaaagagcccugagagagaaaggagggaaugacugacugacagugccaggaagugaagagaguuuugaagugguagcacacuggguggagggguugggggaaugggcauagaagauaauccauauggccaggagucuguugcuguaguguguggauccauucacaaaaaccuguuuuagagagugacuguagaaauagagaagucacagaauauuugcauugaaaucaacuugaucauuaguacacuugaggugagugaaggacugagagagacaguaaauauggagagugaaagaguagugcucacuucuacccgugccuuugcaggcuuguugguuuuguucuuguuuguguguuugauuugagaaagucccucauauggcccagacuggcuuugaacuggcuuugaauccagagugcuggcauuacaagcaugagcaaccaaccuggcuucuugcauauuuugagagauauacaguauugauaaaagauguugauaacaauucuacaugagaagugaucuaaguaauuggaucuagggcuugggaacuuagacaauuaacuuaggcccagugauggugauuaaagcaguauauauguauuugacccuucauaucuauggauuuugauggauucagcauacugagguagaaaauaaaaaagaacauugcacccauacaauaaauguguagaacuucuuuacaacauaacaaccgcuuacauuguauuagauuaagucauccugaaauuguuuugcaaugguucucaaccuucugugcacaggcgccagugcucccucccagcgcgugugcauccuguggcauguggaggucgcgcucucuccuuccacugggacuggggucagacucgggacuuagggccacgggcuuguggagcaagugcuuuacccacugagcuaccuuucuaguucagacucuuuucuuuuuuuuuuuuuuuaaauagguucagacugaugccggucugcauaccuggcacuguucguggggaucugaggggcucaggccuggccugaguggccaaaaaguuacaacuuuccaaggggaagucagagcaagaggaagucucuuccguggccacuccuauccuggaguagguggcuggcagcaaggcagugggcagcuaggggccaaguuuggggccaugagcaggaaguggcugcagucaggcugucacaccuggcugcuugggccggguugggguccagcgaugagagaacucuucccuggaguguuacagcucaguaagacaggcacucucaggcgaccuuuggugaaauuccuugugcacuuucuuccuuguggauagauaggaccuuguaaacauuugggguggggugggaucuagaggcagaugcuuuuccuuggcuuggucugagauguuagggaugccucaucugcaugcggaaggaagggagguggugucccuacagggcugauugucacaguucucucaauggggugucauggucacauaccaccugcuacauauggaaccuggucgggugucaggaucacauucgggaacuugguugggagugacuuaaacaccuuuuguucuuaauugugagaauugcugggguuccugcaucuguuggaccuuccuaguuuuuggucugguggcacgguccacugccccgcagacugaccucaaacuuggagcaauccuccugcuguaaccuccugggguacuggauuuuucagugugggcuaccucacauugcuccuuugagguacuuucugagggacuuuauaaagaaucaguuagaugcucaacagugugugugcuucagaaaguaccagugguuaggacuuaggaaggcgcuuuugcucagucgacuugaguuuacuucauuugagcagcauauuuaagacuuguuuaaagauaaccaccaaccucuauuuugaccuaagauguuuagaacuaacuugaaaagucagcagguguugauguuuugaugugguaccaugauucugugugccguguaacuucuagaucgcugugcugaggagacagcagcggaugauaaagaaccgagagucugcuugucagucgcgcaagaagaagaaagaguauaugcuaggacuggaggccaggcucaaggcugcccucucagagaaugagcagcugaagaaggagaauggcucccugaagcgacagcuggacgagguggugucagaggugagugcuagcgauuggcuggcugaggugcuguaaacugauuuucuuuuuuaauaaguaaauugauaauuacuuuuuaaaucauauaaaaugguagugcuaagaaaauggggauacaagacgcacaaaaucauuuacaguaggaaaaaaaugauaacagugacccuuuggagauguuuuucucccagcauguuaggcagugagccacaccccuagccugaaaggugaccuucugaauuguaugucuccaacuaccugcaaacaucgucugccuuuggguucuucuaauuuauuacuuucucuuuuuuucuucuuaguuuuuggacuaggccucuguacauagcucuggcuguccugaaacuauauagaccaggcuggccuugaacuugccaagagcuaccugccucugccuccucagugcugggauuaaaggugugagcccuagugccagcuuuuuuaguuaagugaaucacacugaggcuccugaacaguccuauuaucucuucccuuuugcuauuauucuuucaauuuaauuuaaaauuuauuuuguuauuuuugacccaggguuucacuguguagaccugguugguuugggacuuacauguacaccggacugaacuugaaguugugugggaauuaugggaauguagcaccacacugaacuggccuuucucuuuuaaaaauuguuuuauucuuaucuuuauucuuugagaaugucacgcagugugcucugaucauauucagucaucuccaccuuuaacuuuccagaucacccgucuucccuaucuaauuuugugccuucuuuuuuaaccuguaaggaccaauuugugcugccuagauauuuuuacauauguggccuuccaauggacaugguagaaguaccaggggcuucccucuuacaaacaacuuacucuccucucacagcaacucucaaugacuguuagcuccugugcugagaguaggacuucaugcccagccucucuguccacacagggaguucauuugucguggguuugcacagccuuguccaugcugucacagucaccauaagugcacgugugcugugcccucuucuuuccuuguagacaucuaccacauuuguauucuuucugccccguauuucgcacgauccccgaacccuggaaagagguagugugguguguauguccccuuuagggcuguccauucugaagucucauauugucucacuuuggcuagucgugggucucuguguuaaucaccauguaccgcaauuagaagcuccucugaugagggcugagagauguaucagucuaugguaugaugauacgucguuaggaguuggcuuaauacuauguccauucagcagaaggauaggugguucuccuuuaggggaucucaccuguguagucacagguucuuggaccaguaauggugccaggugugaguuucucuuguggagcaguacuaaaccccauuggaaagugguugcuuacucuggugaucuuugggccacuguggcagcaccgggcauguuuugccaggccagucauuauugaagcuagaacacaagguucacagcuggguaagguugaugccugcucuucuucuccauuagugugcaaagcaccuuccagcccuaugaaagcuaacaggucagggugaaacuugcaggacagcaccagcuuguauguuguaugacucaaguaugugguauuucagcaacagggucuuacuguaaaauucuggagagaaacccauaagauugagaauagcccguagugcucagggcucucugggaccucacuggucaguaauuccaaaaguaaccuauuccuggcacugggcuuuuuguuaccuugugguguccaguaaggacauuguugcaucauuauaggguaacaccauuuuaacucuuuuuguuuucccuuuuaaaaaaaggaaauaauacaaaauaaaauguguuuaaucuuugucugcuugaccccugcuaugcuuuuuugcuuucuauugucaugcuggucucuucuguuucguucauaaaacccacagcaaugugguccugaaccaguggaugccugcugguguugcuucuuuuucuguucuuucuauauugccgcugcguauaugaguacacucuaccguguugcugaagacagcaucuuaaaagacaggaagacaagcaacagaagugucucagaauuuuugaggagccacagaaauacaaagcuaaaacuuuuuuuuaauuaauuaauuuauuuuuuacuuauucacuuuacaucuugcucacugccccuuucccagucacccccucucacagucuuuuuccccucccucuccucuucucuuccucugugggagccccuggauaucccccucaccccacccuggcacuuaaaguuucuuccaggcuaggcacauccucucccacugaauccagauaagucagcccagcuaauagaacacaucucacauacagguaacagcuuuagggauagcucccccuccccgacuccagucauucgggacccacucgaaggccaagcucuacaucugcugcauaugugcagggggccuaggucuagccguggauguucucugguuggcgauucagacucugagaacccaaaggguccaggcuaguugacucuauuggucuucucugguuggugauucagacucugagagcccaaaggguccaggcuaguugacucuauuggucuuccuguagaguuccuauucccuucggggcuggcagcaagcacucuuaacugucaccuguaacccuagcaauguacauuuagaaggacagcuguucagaucucucuucagccuuccuccuccugccuggccucugugggugcuagauucaguguccuaguaccugggaccugacuccaaggagccugaugaagacacuugggcagagucucugggugggaucugcacacauggucucuguaauucuagcugcuggccgucugguaggcaccugucuguccugguccuguuacaacccaaccaacuccauaggcucucuggaagggggcccaugucagucauuaagcagccccguuuaugcugaucaggagaccuacuuugaacaagcaagggacaauaaagacuauggcuuuaacauucucaucuuuucucuucuuuucuuucuuucuuucuuuuuuuuuuuaagauuuauuuauuauaugugaguacacuguagcugucuucagacacuccagaagagggugucauuacagaugguugugagcuaccaugugguugcugggauuugaacucaggaccuucagaagagcagucagugcucuuaaccucugagccaucucuccagcccuucucuuauuuucuugaggcuuaccuggagcugguucaaacuuguuucugauuuaugucaauagauugucacucagcuucaggaagggcaggcagccaggcuguucuguccacuguacugcuaguggaucuaggcucuagacuaacccaucccaccaacacaguccaugagucaauucagguauuuugcucaguaccggagggagaauaauuccuuccuuuguuaaaaaagagaguaugggaagcugucuuuuuaaaaguacuauuucuuuaccuuugagguguuuuuacuuuuauuuuuuaugauaaaagauauucauacaacuaguagaaaggaggauucuuaauuacugcucuuuguuuguaguguugacauguaguuucauccuguuucauuuccuguagaaccagaggcucaaagucccaaguccaaagcgaagagcugucugugugaugauaguauuagcauuuauaaugcugaacuaugggcccaugagguaaguaugcaaauacuaaaacuuaauguuaguuauuuguuauuguuuugcucuacucaaaaguaagaggaaaacucauuuguucugaaaaagaaaaucagcauuccagauguguaaagaauaauuggacaggugacacgugcuuucacagaucucagaaugcaucugggaagagaaccauguaggcaugaugagugugacagacagugaacagacaguggccgggcaugugaguuccgugacaugguaguucauggcaugucauacgugcacagaagauuauuuucuugaaugauaaggagaauccccagggaggaaucugaacuuugaauugucauacuaguuugccaagugggauuacgggaaaagcauguuaagacgaggaaacagcauguuaaaaaacaugcuuauacauuaugaacuaagcaguaccccggagcucucgacucuagcugcauauguaucaaaagauggccuagucggccaucacugcaaagagaggcccauuggacuugcaaacuuuauaugcuccaguacaggggaacgccagggccaaaaaguaggaguggguggguaggggagugggggggaggguaugggggacuuuugggauagcauuggaaauguaaaugaggaaaauaccuaauuaaaaaaaaaacaugcuuauaaaauaauauggcauucuuuuaaaaaaacaaaaagucagucgggugugguggcgcacgccuuuaaucccagcacuuggaaggucagaggcaggcggauuuuugaguucgaggccagccuggucuacaaagugaguuccaggacagcuagggcuauacagagaaacccugucucgaaaaaccaaaaaaaaaaaaaaaaguccaguuccuauagauacaugauuuuguuuuuguguuuauguauacauaauuuguuaaauuauguuuacauauggacaauuuaugcauuauucaaaguacugucuuauuuuuaauuauguuagcacauuauucucuuuuaguuaacuucauuacauuuugaaguauagauauacuauuacuugacauauuucagaaauuuuaugccuuaggaacuaguuuauacuauuaaaaguuacugagaauuacaaagaacuuauauuuauuaauauuuauuguguaauagauuaaauaaaauaaauuuuaaauguuuacucauaaaucauacauguuaaauaauaaaaugucuccaaauauuuaaugaugcaaaaaagaauaccauuguuucuuuuuuuuucuuuuucuuuucuuuccucuucuuuucuuuuuuuuuuuuuucucuuuuuuuaaacaaauauuuggugucugaccuacuacuagggccuuauuuaugucucugucucucugcaguguguugugauguauugcuaggcaccaggaucccaugccucugcgucugugucuauuaugauauauuucuaggcuugacauugacaaaaaucaaucagauuuucaugugagagaaguuuacugaggugcugcagaguguggggauccuuaggguuccucagacuucuuagacugcacuuuuaacacaugugcuguacguaucccuuguccuguucauaucauuuccaguucuuuauggguuccacacgugugucugcaugucuaguguguguacaaaaucaucucauacaguaaagagugccccaguuuccucuccuacuggcaggcagaagaaguguucguucauuguguaguuccuagugcuggauauuaggaaugcuuuugcuuguuuguuuuccaucuucugggucaaaaguguuaucuucauuuacuucugucacacuggcuucccugcccagucugagauccacuaggugggcucugugucaggucuucacaucuguuguucccauggucuucuccuuuuuuauuuuuaaaagauuuauuuauuuauuuauuuuauaugaguacacuguugcuguguucagacacucgagaauagggcauuggaucccauuacggaugguugugagccaccaugugguugcuaggaauugaacucaggaccucuagaagagcagccuguguucuuaaccucugagccaucucuccagcccauccccauggucuucaaugcucuuccuucagagaguguuuguuaagugucagcucaggagcuccaugcugaggauuuccuggacauccuccucuccuggguuuuugccaccgccuuccaccccacccuccuccucuccuauguuugcuccaccauccuccucuucacccaccuuucagccuucucaucggcucccucugccucuugacccugugucuucuguaagcuguacuuagcuucuuuccccaaagggauuagaccucuuguucucugagccuugaaugaugcccugcuguagucgucacucacuaaguacugcacugugaauaaaugagugcccuccucucagccagauagaacugccauggggcagcccagcggcauggugcuugacugcuguguaugaggcgccaggcacaauuccuggcaguggggaaauuucuuuaccuaguuguucaguguauucccucuuuaaagauuacuugccaucucgauuaaaaauucauucuucuugcaugaguugcugcaaucuucuugcauguauuaagacauauccaguauugauucacugccuacuugucauaucuuccacacauuuacuuccuguugcuuuugugccugugugcucaccagucuuaaacugaagagcuuccuuuugucuuucagcuuacucuguuaauuuagccgugauuuggaggagcugacauuggcaucccuggugucguuuguauucagcccuuuucacuaguuacauaauucaccacagacauuuuucuccaccugcuaacgucuugcuuugugcucucacuacauuuuccauuuguuaagguuucaaguucuaucuaauucacuacuucucuuuuguagagauaauucaauguucaucccagagcacagauacauuuguauguauucauucacugucucugggaacacgugucuguuucagccccucacagcuuacaagucugugccguccgugcucgucuguuaggcugaacauaagcaggcacuuauaaggcacuuacuguuugcaggugcugagcagggaauaagggauggaggccugaaugaaaggacugucuaguaggagaagcagaaauguaaacacuguagccuggggaagaaugauaaagauaccaugaaugauaaaggcauuugaaaaagaacuaaaaccucauuuucuuuacacucauaucucucaucagguauauggguuuucuuaauucccuggccaucaguuggcaugccuauaguugaggcucaauucacaaacuacuaagcauuuauuuacacaggcuucggaggcagucuuaaacaaacauuucuuuuucuuuuuuuuuuuuuuuucuuuuuucuuuuucgagacaggguuucuccguguagcccuggcuguccugaaacucacucuguagacuaggaggcuggccucaaacucagaaauccaccugccucugccucccaagugcugggauuaaagacaggcgccaccacugcccggcuagacaaccauuuuuuaccucagucagcagccacaguuuugguuuguaacuuaguuaugcagaccagcuauaaauugugcauucucuaguaauuuguuagagugacauacgaaacucauacugcuauuuaaaaacaacucaugaguuucguuggguaaaccgacuaggagagcuauauaagcuaagcucugguggagccacgagaaacuuccacgucuccagagguugauucuccucccagcauccuuuugugccugccaaccuagcucuccagaccuacugguuggaguuuucuggaggcuucaauagauuggcaugaugacugccaacauuuggugacuuaacucaaugucagccucuuuccagucauuggagguaggggaucagacugcaaauuccaacucgguaaucugggcuuagcuuuccuugcuuaggcuuccuuccuucauaauuuggcuggacccuuuuguuuuguuuuguuuuguuuuuuuguuuuuguuuguuuuuaaauaaagauauuugcucaucuccaucacugaggaaaucucaagaguuuuaagauuucugugcugagaacucaggaagacaccaaauauauuuuuuauaaaaccacacucauauuccugaaugagcaaccaaugaacggcuccugggaggccuugugcauagcauucaguacacgagugaagguuaggcuaugaugcuauaaaguaaggauggggucggaggaagcauucucugaguguccguuugagacagcagacaguuuugaaugaguccaugauugucacagcuaucaggugaaucucauuuccaauguagauagagccacuauaaaaugaagagacaaugggcccuucuuaucaagagaagauuuguguucagaaaagaauuaaauggccgagauggaaagggaaauuugagaaugggagagaguuaagauguuugaaaacccugaaggauaaaccagcuaagaucugucuuucucuguaagcugagagaacagaacauuggguugugggaauauuaagaacuuuuaaaguuuugaaauauguuuaaaagcuuacauugaagacaaguaaaagaaagaagagcuggaagauuugaggaaacagaagguucuuaacaacuuggaauguuaccaagauggagaaaagacaaaacuggcugcaaaacucauaaaagcagagaacuauuucuucuagacaagguuggcauaugcaguacacaucaaagcccagagaacaacagggauuccaagacugaaaccugucgcauaaccagauguugagaaucaagauuuguauuauucaagagcgucuuugauuggccccauuguuuguguaucuucaccugcuggagggagucugccagagagagagguguagaaaguuccccgaugucucuuaacaguuccguguauaggagaguucuucaacaacccaguaaagcucucucucuuucucucucucucucucucucucucucucucucucucucucucucucucucacacccuccuccuccaaaauaaaauucagcaacugggcuacagagauggcucagugauuaagaauaguuguuccuauagaggaccugggcuugauucccaguauucacaugguggcucacaacugugcagaacuccgguuccaggauccucuacaggcgugagauacacacuuggugcacagacauacauggcaacaaaacaucuauacacauaaaauaaacaaaucuuuuuauuauacaagaaaaguauauaauaacuccucuuuaaaacaacaauaaugagaagcuuuaagucauuacuauuauauuuuaguuggugcagauugugagcucugucugaauuuucuugaauaccauugaaauaauauuggccaaacaaaaggauaguuuaaucaguguuuucuaaaggauuuuaaauuuaggaacuuaaacuauuauugaugaguuaauuauaauguuucagaugugcaauguagaaaucauuuuaugacuuacuguuauggcccaugugaaaaaaauuuuuugucacacauaccuuaagaaguauuccuugaaagcuuuggugauaaaauauaaauauacuuuacaucuaaaguaaaagaauuugugaaagguaauguguaacaaaacagacucuguggaagaguuuuggguuacuguauagucaucacacagaaaaagaaaauaaccaaauauaacugaauuaauuuuucuaaccuuauugauauuuuauggauggggaagaagagaucuagcuauuuuuggcaugagauucaaggaguuggcccacucuggguggucuagaaauaagagacucuaggcagcaggaaauggcuaaccuguuugagccaggccuggugguguaagacuguaaucuuacacucagcaaagugaggcagaaagauuacaaguucccagccuguuugagcucuacagagugaguucaagggcaacccuaacauccuagcaagauuaugaauaaaaauaagaacgauuagacuagacaguuguuagggguuuaccuagcgaaccaaagccuugcagcauaaaccacacuccuauaauccuagcaucuggggggguuagaaguucaaagucauccuuagcuauauagcaugcuugagagcagcaugggggacauaagaaucugucucagaaaacagucuacagaaucagacuuugguauuguggcuauuugaacugucacuuacuaaagauaaaaugaaacccaaauacacaaaaguaauaaaagauaaaguugauuagaacauuuuggagaaaacuagacauaugcuaaaaugagcaaaacaucaacuaacucagaccaacuauauuggcuggaaagauggcucaguggguagauuucacaguaacuacuuuuggaccuugagcuuggguccucagcacuauuuaauagccaguuuaggcagugggcagagacaagcagaucuaguggaucccaggggcuugcugagagauucacugaaagacccugucucaaaaaauaagguggagauucaguagagaagacucauggcggggcuggugagauggcucagugggaaagagcacccgacugcuuuucugaaggucaggaguucaaaucccagcaaccacaugguggcucacaaccauccguaacaaggucugacucccucuucuggagugucugaggacagcuacaguguacuuacauauaaugaauaaauaaauaaaucuuuaaaaaaaaaaaaagacucauggcauugaccugaaggagaagaacaucauuauguguaguaaaucuuuagacaccucccuauuuauaagcuugucuuauguacucaggaaauuuguaagccccuguucugagcaagagucaggucguaucccugggaaaguagcuucuuccuggcagauugggcugcaguuuauagauuucuguauuguguuuccccuuucauuuuaaaagccaguuaagucacccuuucugcaagugguaaguuccuaucucaaagacauuguaaaugcuauguuguuuaaaagaaucaacaaguguuggggaaagaggguucuuuuucccucuccuauuuuggguuaggugauaggcccugacuagaucugaaaucuggaguuugagaugugagauaugcaggagggagacuaaagcaugccaugaaaggcccagcuggcuacucugcuuuugcaugagacagcacuuuaaggggaagacaaccauagagugugugcaucaaguaugagucaggaacuggcuagaggcaaaggucuuuauuccagcauucuugagguugucagcuuuucauuguuuugcaggaagaauucuagcuucacauccugcgaugagcuuguccccaaaucugguuccaauugugcccccuguuugauuguugagcacauuuggcuguaugauaucaccauuuggcugaauguuaaaagacacuguguaaguuagaugucagaauucaaccaccaaguauagaugggguuguucagccagauucuuaaauguaaucuaauucaagcucuuggcuaaaaauauguuccacauuuaucaaaaugacacauaagcaucgcaaguacauauaaaaauauaucuaaguaccagguguuacugagucaggauuguagagccaacaccagacucuuuucuagauaguuuaauuuacuccugauugucaaaauuuuuaugcaagguaauggguuggcuauguuuucuuucagccuguguagauguuacuguuuguuuuagauugcuccaagucugucuuguucaguacucgauuuugaagauguggaaaauccugcugauauuuuucucuggucugugcuuucucaugaacuauguagagugugcuuccaaggagcaggacaguggcuuuaucacauaucacuuggucaccuucuuccuuagaccucagcuauagugaaacaaaggcuaauugaagucagacacaauauccucacccaacuuucuucuuuaccuggaguagauauaucccugggagggcaucacuuuucaaacuaaaaguugguaacuugugccauuuccgcuccaagagcgggucaguaagaaggugagaaagcuccugucuguguguaagcucagugcacugcuguuuucugcagauuacuauguaaauguaaaauauggagcagugaaugguuuguccagaagagcuauaauuaauguugcaucacuuagcacaugcagauaugaucaugcuuugucagcugcagaucauacacaguaaaggagcaaguggcucagcuuuguacugaguacagaacgaggaaucauaugaaacuugaugugugaacauacaaauguaauuauaauguuaccuaucacuuaggcuucuagaaaguuuaccaucaaugccauuucugucuccagauuugaauuauuuugucauuucagcaaguauuuuaggggucauucugcagauuauucuuaauugcuaauaucuacaugaauuauggacaugugcuacacacuuagacuuuuugauauucaguuuccaagaauaagcagcauuuauguucucuccacaguccaucuaucacaaugcggcccugaaugagcuacaguuuggcaguguauacguagucaacacaguuuauguggcuuucuguaucagugcuuugccagaacucucauuaacgcagcccuucuucucucccuucccuccuuucucuuuaaaaaaaaauuagaaaauaaaaaauagaaauaagucaauuggaagaaaagaaaauauaugaaggugaagacaaacaucuuagaacagucuaggugggcuguguguugauauuauuaaugcuuuguuggugaaaguagcuaguuuugguuuuuguguuauggaacccaaugcaccgaauaguaaucugcuuccccuuugcauuacuuccuuguucccugcuccugccuuaggcagauguuguugugauuguuuuccagauggggaaacggaagacacaguuauuagcugaacuggcacuuugucuucaucacuaggaaagcaaaggcucacaggccgcaagcccuuguggcaggugaagcagucugcacucuaugcagcugcccugccccuucuccuaaagcuuacacuuggcuguggaacaggagagugucgauugguuugauguaagaguuacagcaaagugaagacgugacauauccauaaagcucacuuauuuuuuauuuaaaauaaaaacaaaauccagaagugcccccuauaugccagccacugacccacaacaacacagagauuuuuuauaccuuuuaguuugugcuacauuaagagauaguacauuuaacaaggaaauuggucaugcuguaaauucuuugaacagaauaaaguaugguaggguaaaugguuuuacaagugucuaggggguuguugacauguugcuuuagagugauugcuauuuaacagauguuugagcuaagguuuggaggagaugagguuaacugucuggauaucugggggagaguguugcaaaggccuuagccacugcaggaggccuaguguggggaagugugcuguucauuuucuaggguagguaaggaauguggguacccuuaagugaacaggacaggaaaacucagaaaauaucauggcggcaaaauguauggaaaggaucagauagauauuugggcuuuuuaucaugccagaaaaggggagccaccuaaaggauuugaguuguggagagguguaacagucugaccuagaguuuuaaaaggucacugcaguugcuauguugugaacacaugaacugggaaagcaggaagacaguugugucauuaaguaccccauggcauccuccggcuuuauagaauauguccacaucugccaucucaugugacucucagaagagcucugugacaaauuugcuauuuuucauaaauuuaggaauuuaggccuaaagaacuuaacuaaggcaggcacuugagucacaucuugaauccagaucuccugccuucaguuucugugugcuuuccacuuuccuacauuagacccaaggcuccauggucuuccccagcugagaaucauccagcuuuucaugugugggucucagcaacagcagcugcucugggugaugagaaacagugucacuuaaccuguggagacagcuucaguuuaaaaguggucugcuuguaccuuaaacagccugcccagggcauacuuggguaugugccauuuuacguucagccacucggugugaagauucgcuaucugacgucuuaaggcguaaguggccucacgaauaauggaaaacaguuguugacguuuagaacuccauagaggaaagcaacaaaaguaaugcuucuuucaaacuuuggggcaaaucgaaaccauucaugcucugcugaucuacgcuuuucagggucacuggcccauaacgugagcaaggcucuuuguggaaugauuauccuguggauuagaacuguugugacucuuaguggauacugugucgaucagaguccuagaucauagagacuccaguuucuuuaauauuugcugguuuauuuuaaacuauggacagaacuuggcuuaacugaguuauaaaaaguugaguuaggggccuagggaguugucucagggguuaagagcacuuucuggucuuggagaggacccagauucggcuccuggcacccacacugcagcuaacagcuggcuguaacuccaguucccggguauucaucccucuucuggcuucucagggacuguaugcacaugguaugugcaaagacauagaugcaagcaaaacauaaaaacagauaaaaauagaguuuuaaaguuuaguuaacauuuuuuaucaauauucaaugauagaaaguuaguggauggccacuaacccaccuaaguuagaaagucagcaggugcacacucacucacugaguuagaaagucagcaggugcacacucacucaccugaguuagaaagucagcagacgcacacucaccugaguuagaaagucagcagacacacacuaacucaccugaguuagaaagucagcggacacacacucacucaccugaguuagaaagucaguggacgcacacucacucaccugaguuagaaaguaagcaggugcacacucacucacugaguuagaaagucagcagacgcacacucaccuacuguguguccuugcugugccugagucauccuuuauguucuuggaaauuuauuuauuuuccuaauauuacaaagaccaagaaucugaaaguucauaucagcuguaaucuucucauacccuuuuguauguuugaccacuucaagagcugccaaauuccucuugauauuuguaauaugacaauuauucuuagacaacccugaaauauggcgauggaaugaaauucuuuuaaauacuaauggauacaaggaaacuauaaauaugaauuuauucuugucgcuaaaccuaauuuuucccaguuaguucagaguucaaguauuuuuuccuuuuuagaaauuucacuuuaaagauuaaaauaugcaugaauuguaauccccuugccccacaaaagaaagccaaaaaaaggaagauggugacuuuauuuauuuauucauuuuauuauuauuauuuuuguuguuuuucaagacaggguaucuauguguaguccuugcuguccuggaacaagcucuguagaccaggcuggccuugaacucagagauccaccugccucugcuuccugggugcuaggauuaaaggucugcaccacuguagccuggcuaacagugaaugucuuaauacccuuauuauccagaauagcaggugggcaauaaacucuuagcuuauuuaaaucccaauuguuaaccccucaaugagucccuugcucagaguauuauguugccuuuauauaaugaaguguggugacaugcauuaaaugaacuuuaaacucuuugguuaaaagaaagaaguccccaaaguggcuguggugacauuugugaguacacugcuauuacagaggaaaacaguggcacaguuacaucaauagcacacuuguuuucuaguaaauguagcuaaguagaugucucacagcuuuguuauaggugaaauggacagaacuuaaauaagcucaauauauuugcuggugauaguugucaguaacuauaaauaguggcaugaagugccaggucuccuaauggugguaaagugacugaaggguggugaucaguagacucuuuaaaucuucaacagauuaauaauacugaaucaguuuacuaaaaaaagaaaaaaaucagugagcuacaacuuugccacguugggccauguccuucugucuucgggccuaacugcccaggccucugacugucugcuucagcugcauccacugugaagaaguggcucuccuagggaagaggcugugagaagcacgaguggagguucucagucacuggcagucguuuggacagcuuguugacacacugacguuuagacaagcagcccagaguugcuucauucaagaauuugcacuuccagccaguuaucaggucauagcaacacuucugggcccgaugucucagucagagggccgcugcucuagaggauucugauacagaggagaauaagaacuauuuuaagucauuuuuagaagguggagcagccaaguugacuucucaguuuaaagccugagaguuacauuagggagaccccuaaugggguuaaacccccagcugauagcugguaacgccaaagaauuguucucauggucugcuguccuggcaguggugaggcauaguaaacaaguaaauuaaagccugaaaagaagauggcugauugugccaccagaccaggaaaguccauuagccacggggaacauuacaguugaugcccggaagaguaucaauuaacacaaggacaacauggcuuguuucuguuguauaaauuguuagacgugcugagcguggccaacaaggccgugugcaggcuagccuugcauuauugcugcugucucuuucuaagaugacccucuucccacugugugcugcccguguccacgagcacucucaccccuuccuuaaaucaugcugucuggagccggugugccucgcucagauaacuguugcauuugcaugggaugccucuccucauccucauccuccaugcuugguaacuuccgcuugccaguucggauuaccucaugauccucuguggagccccagcgcucucagcuauuacauuccauagcguucuguuuagcuauguaauuacacugaucacucaucugucugucaaccagucauauccacucuagcuagcuauauaaagcaacacaguuuuguuuuguguuuuuaaaaaagauuuauuuauuuauuuauuuuuagguauaugagugcuauauuugcauguaugccugcaugccagaaauuaacaucagaucccaguauagaugguugugagccaccgugugguugcuggguauugaacucaggacuucuggaagagcagacuguucuuaaccacugagccaucucucgagccuuuaacuuaguuuuuuauccacuaucccccaccuuuggaucuuuaccacugaauagcucucuggaacauaaaagauauuuaguacacauuuauuggauaaaauaaucagacauuugggggaaugugaucaacaauauaguguacccauggaaauccaguuuugaaucuaaguccugacuccaucaggguggaaggucuccccaaauucauugaaggaaucagagcuuucaucuaucaggcaggaaugguaguguacugggcauacuccaagcauaauggaggggcugaacaaacauguuuugucgucuuaggggaaaauucuuaacuuuucuuucuuagcauauuuuuauauagagaauuuuuaaauaccacauauggacaaauuaaaaagcaaagauuuuuuuuuaagucuuaaaaagaaaacacaaaacuuuagucuuuauuugguuuccuccuaaaacccuuacuguuuaacccuucuucccugcugucucacuggucuguuccccagguucaguuguucaguuugacauuauacuaggccucguccucagggucaguggguaugguacgaggcaucuucccuggguucagguagguauccuacuaggccuguuccucaggcuccgggcaguagaccucuucuccagguccaguuagauauccuacugugccucuucaugugcagcaaagcuugcagcauugccuggcugcucaaguaagcauucagccugaaauaaacaauuguaaggacaacuuagugcuaguuuuagcaacauuaaguuuuauacaguggucauaauuugucaguauaccuuuaaaguucacacuaugucaaaaugacagcaugccaugugagaacugcagguggcagugauuucuaguggaaaugaauugagaacugaaagaauaagaaaucagaaaaagauucuagagaaaucuaucugccucuuguuuucauccacucuguacaccugcauuuagagauaaacugcuguaaccucaaaggcuucguuuuuagaccacgggaccguaggcagcccuuuucaucuuacuuccugcuucuacuucauucucuaaauagucuuuacccuuccccagggaauucccuuuguguugaaucaaguccaugacuacuguaaauuauggguguagcauuuuaaaauaauacauguauucaaaaugauaucaauaagccaaauuucaagucaaagcacaugauuaaugaguuuaaauuauucuacuuaucacagcauugucugugugucuguuugccugcuuguguuguggcaaggcuaauaguguaugugacuacugaaagagaacagcuccuauuucauuugaaguauuugcccauugauaauaucaguuugccacauugggguggauuuucuaccucaguuaucugaauuuaaauuucauuuauauguacuaaugugaguuucuauucauacacauuagcuuucucuuaugguaauaaauacccaagcuaagucaacuuaaaaggcaggaagguuuauuuggcccuuggugucagagguuucaguguggccccugcgcucaguugcuuuggacuuguccacauaguacauuaucaggaaguguuguguggaagaaucuucuuaucucacaguugcuggggagcgaaagugagggcacaggaggagcuaggaccccgguauccccaaaagcaugacuccauguucugacuucaucuacuagguucugccuccuaaagguuucaccaccucccaagggacccaggccuucagcauauaagucuuugggaagcauuugaauauaaaccacagcaauuuauauaauguaauuaucggguuuuuaaaagcagguaaaacacugcuuuuguuuaguuaguuuauaaauaugggcuuucauacuuaucaagaguacuuaaggacaucagcguuuggauguguuucuuuucuaggccuuagguuuuugcuguaugugugcaucaauaaggccagucuugcuugcuuucuagcuauuuguagacgugcauaugcaugccuuuuucauuucaucugugucacuuuguuguuguguugguuuggguuuguuuuucagcaugcuggagcaagaaucccgaagagugaaaccuagugugagcccugccaaucagaggaggcaucucuuggaauuuucagcaaaagaaguuaaagacacaucagauggugacaaccagaaagacaguuacaggugagaccaccugcuagccauauugauuuaaugaacuggagcugucucuuaucucaugucacuuuacauguaaauuggucacguggccuuuggcuuauggagcaagugaagugguaaugccguuauuuuauuuuuaugaccaauuuuaagaauaaguuuauuuugaaacaguucccaguuuaggaauuuuuuucauugauucauuuauuuaccuuauaucacaacaccucccuucucccagccccauccucauuugcugagauauaauuauauaaucaguuuguuuguauugacauauacauauauugaaaaacauguacugucuucauuuuuucacuguuacuaugguuuagcacauuuaucuaauauuugugucuauggauagauauugcagaaugauacaguugagccuauuuguggucaugaaguuaaauuaucuauuauauguuguuuuccaacauaaucauaguaagcagaagccuucauguauuugcucacaucagcaugcgauagagugcugaccccugugaaguauaguggacgcucacacacgcgcacucacuguagaggucuggccgacucucaaggggaaaucuaucaccuugaaagaguacuugaccaggcagugguggcgcaugccuuuaaucccagcacucgggaggcagaggcaggcggauuucugaguuugaggccagccuggucuacagagugaguuccaggacagccagagcuacacagagaaacccugucuugaaaaacaaacaacaacaacaacaaaaacaaaacaaaaaaaaaaaaaaaaagaaagaaaagaguacuugaaagauguaacccaucucuguguccccugcccagggucacuacuggaaaagagauuauagagucuuaggucucugaaguaccacagagguuacuggaaaacgacuuaggagauguaagcaaauaguagcucauuaguuugagguucuugccaucaucaucguugucgucgucgucaucaucaccgucaucaucaacaucauuauugguauuauuauuaguauuuuuuaauacaaaauacuaaaaaauauuugugaaacguuugaaaacaucaaguauggauuuguucugaacugaauuuuagaguuuauaugugcugucaggacaccuauauuuuuuuuuccuuugaaaaaaauuaaauuaaaaauuuaaauugcuacuauuuuaaaaguauuuaaauauuuuagcugacacagugauugggcauauuuauugacuacacugugucuguuauuuugauguuaauaauguauaaugauuggaccauaauaauuaguguauccaucaucugagacagauauucauucauucuuuguguugagaacauucaaauucuuuuacuagauguguugaaauacucgaugcauuguggccaaccagaguuugccgugcuucagaacacuuacagucacccucuucuccagucacucuugcacccaguauggacucucaguccacaccccucacucucucccccaaaccauaaaguuuuugcuuucuauucuguggacacgguguguuacacuuacugauuuauauacguugagccauccuugcauuucuguaauaaauccugcuugaucaugauguauugccuuguucguauguuggcuuugaguugcuaguacuuuguugagaguuucaauagcuaugaucaucagagauuugggucuauggaucccucuuuuggguguguucuugucuggucuugaugucagaacaacuuuggaagggcuuccucucuuucacuucauugggcugguuuuagaaaaguuugcaucaguucuguuuugcuaguucguguuuuaagucucauuaaggugccaggcugggccucagcuuacccauguuccuaucucagcuuuugggacagcaggcaggcuaacauguggcaucaugccuggcucacacuggcucuucuuugcaguugcagugcaacugucuagccuggccuugugcuuuuauuuggggggaggguguguggacuuuauaacaaauucaguuuucuuacuugcuaugggccuguucaaguuuucuauaucaucaccuguauuuuuaaaugccucauuuuguuucaguuuaggagaguuaugguuuaaauaauggaaggauagauuauaauccuauuguucaaccauguauuuguuuguuauuagcauauuaccacuagcaaauuucaguugcacagauuuuuuucaguguuagaaguauaucuguauauauucauaucuguauuuuuaauaguauaacuuaucagccaaaugggacacuuuuaugaaagaauaguaguauagugagagcugguauuaauuuuuaccucaggacauagggcaucaggcuuaaaucacaguugucuucuaguaaacaggaaagggugguuuccgcuugaggcaucggccacagugucuuuaggaauucucaucaacucuagcuuccagcauugcucuuuccuguagugauuuauuugcugaaauuucuuuuaucuguauaggacggcuugcagagagccuggaucucugacugucuuuggguuaauagggucugauugucuccagauugcaugcucgcuuagacucuccccuucuuuucuuccucuaacccuguccugucuacccuugcauuucuccuaccugauaguuuucuucucuguauuucuagcuguuagaacaaagcuaaccagcccagguaugcagaaaucauugcuagagauuaaucauauggagagaaaauuacaggucaaaaauacaguuuugaaaucaauuuuggaauuccugguauuauuaaguaugcaggugugauuuucaaauaaccuguguguguguguguuccauauaacuuuagcuuccacuucuuuucucucaugugugccauacucagaaaucauuacuuuuauucugaaauuaguuguguguugagggugacuuggggggcauguguucauuguggcaaaucuuggcuaagugagucacucccuaaaagacuuuuccuucugcauuguuagaguuuuuacccucccucccucccucccucccucccucccucccucccucccucccucccucccucccucccucccucccuccccccucccuuccuuccuucuuuccuuccuuuuuugacuggcugcuguucguaguauuagggauuccgugcagggcuuugaauaggcaaguacucuaccacugugguauuuccuugccccuggauaauugagacaaacucuugcucuguagcacaugcuggcuuugaacuugugaucuccugccuucgccuccugugugcaagcuuauccugcccacucagucuuccuucuuccuuucugauuuuccuuguaagcuucuccuuuguccagaucccaagcuuuaaagcugugaacucuguuuauguccugcuaaagugacucaucuguaccacagccuccagaugcguaaacacgggugauucucaaauuuccguucacagaucggacuucucauacacaugcucacauacccagucaugucuugacuuuuuucuuuuccauauuuaacuaauauuugguuuugguacaauucucaggcuuaaggauaaguugagguaucucacuucucacuuaguaacuucccuuuuauucagcaaguccuaauuaugagccggacucuggcuuccugacuuccucuucugucugucccacgugcccagagcucuucagcagcuuuccuucugagucuuuuucucacuugcuuuugucucguauacucuuccccuaguuucugcgcagcugguuuccucuugucuuuuagccuugccaucuaugauccuuucccuaguuuuaucugaaguagauccugcauacuuugcuguuugaguccugugcugcuuuuacaacaguuaauaugguuuugcuguauuuuaugcauuuguucucuuggguuugcucugcuuuuccuguuagcucuuugagaauagacuguugcucucucuuggguuacccagcacauaggugccgcuccacaaauauugaaugaauaaguaaaaagcaugaagccuaccauguucacuuguauauauauauauauuuuuguauuuuagcauacccaauuuguaaauucauaguaucuuauaaaaaaauacagaagauuucuuagugagcuagauuaagauacagacugaaggauguacacaguaguaaaugguccugguucauaaucugauuuucaacucguacucuagguaggaaucaugugacauaaaacaguagcaaagggacaaacguguacuuuuuaaguuauugaguaacuagucauugucauuuaguguuuuguuagugauucaaggucauccaugguuuuaaaauuuuuguccagcuuuucaacuuugucauuuuucuccugccaaacauuuuaggucuuccucuacccccacuucacacaaacuugcuuggagagacugaguuuguugacacaguauggcaaaugaccacaaaccuguagccuugucauauaacaaucaugucuuuuccugucgacugcuaacucaauuaauuucuccuccacuccagcaauagggaaguuuauugaauucacacacagcaggugcugcccaguaaauaguagcuaagcaaaugugaauuacucugccagcucuuagaaacugagagaaugacaguccaccauaugguuuauauuuaauucuuucuguuauguucauuucaaucuuacaacauguuuaauuugguauauguuuauuuuaaugaaaacugacaguaguaagcuuuauaaaauuuaugauacaaggaaaugauuuuugucugucuuuguuucagcuaugaucacucuguguccaaugacaaagcuuuaauggugcuaagugaagagccauugcuuuauaugccuccaccuccaugucaaccccugauuaacacaacagagucucucagguaacggguguggacuggugcagaaacuaccgaguggccucccauggcaaacuucaaacuuagcaaagcauuucuucagcuuuaguaagaggccaagagaaucugacuugcauuggauaacugcaagccaggauaacaauuguccagguagcgauggugauggguccauucauugugauggucaucugcuuaggugggucuuguuugaaugaaaggaugaagugaauguuaaaauuuaggguaaggcuagacuuguggacuuaauauucucagcagauaauauccuuuuuuuuuuuuuuuuuuuaauuaggaaggugauaucugacuauguuauucuggacauauauuccauuauuucucugaauuuugaacuuaugauugaggagguuaccuuauaacaauccaugucuuauucaaaauuuaaaaaaaaguauuaaaugucuuaguuuucuuuuuuuucaaauuaaaucaaaaagcauuguaauguagucagauauguugggcuguucuuuggguccuauagaacaauuaaauuaauuuucaacaaaagaauaagccaguuaacuacuaucaaauauauuugauuacuuuguuuuauagguugaaccaugaacuucgaggcuggguucauagacaugaaguggaaaggaccaaaucuagaagaaugacaaauagccaacagaaagcccgcauucuccaggucgguucugcuugugucugaagaaaugacaguucaggcucuggggauccccucccaggggacuugcuuucuucccugggagauuugggaacuucagccucauuuacuucucacuguggcugcuucugaugccgcagccauugcugcugcuuccuguacucccauuccgucucucuucucucucucucuagcaggcaggguacuguaucaaagucauuaacucuggcuguuagaacagccucagcgucuuuguagcuggaugagauagaaagucaucucuuacuucauagcucuaggcuuuaggaggaaucacaaugaaauagcuuccaggccagggaauguaaaugcaaauguugaagccccaggacagaucaguuugcauauuuacagaagcucaagaaguugaguaaagcuggggguugcugugacugaggggagaguggucagaucugagagagcuuagcgaacgcuagggcucuggucugaacuucagauuucauucuaggcaugaaggacaccacuauuuggugaggggaaugacuugaucugauuuauauauuugaaaagucuuuuuggcuaggacugguagagcucauuagugaauuugggagcaggauuguugacuuccaggcuagccugaaauauauagugagacuuugccuaaaaaugaaaaagaaagaggaaacaaaaaugaucauucuaggugcuacacaaagcagacugauggggagugggaguggguguaggcaggucagguaaacugcauuccaguggucuagaugggaggagaucuuugggucuauucuucuguguuagauaugaagggguaggaaggaauggagaccuaaauauauuugaaaguaaaacuguuaaggaauugcugcuauaaaauaaaaaggaauuggugauaauuucugugucuuaggugcuggauuaauacugaugccauuuauagagacagaaacugggggaggaguuagagacaggaguuaagagcuuuagauacagauuuuagacagucaguugaagaaguccagaagacagccacauauccaagucuggaccguaggagagaaguugaggcuaaauauuuaauuuggggugcuacuucccaaugugaaacugaagaggagagagagugugauaaacuagugcaaggcauugcacaugugugggcuacaaagaccucccuuggugucuggacagcaagauggaggacaagaaagggcaguguggcucccauccaagccgacaggcuaugggacagugaagacaguuacuauuaaaucucaccauucgaaccccccggagacccuggagccucuuuuacugugucugugaugacagaagcccagggaagggaacgugggaugguaacagaaaaguggcaguaauugcugcagagaauucuccagggauggggauagagaauaagagucaagaagaagguuugguuuuaggauggaaaaaaauuucaucugcuuucccugcuugccauaggugcuaauagaaacaucuugcugagcauggugguacucacaugguggcacuuggcuuauauccuagcucuugaagggcaggagaaagaggcaggcaguauucaugaguuugaggccagccuagucuacacaaguucuaagccagccagggcaacguagugagacccugucauaaaaagaaagaaagggaagccggguugaaggaaggaugugacaguaauuugcaucugaauuuuaggccaucuugggcuacauagugaauucccagccaguuuggguuggagaacuagaguggaacucugccucagguugggguaagagguggggaaagggagagagaaagagggagagggagagggagagagagaaugaaugagaaugacuguguuugggugagcaagcuuaacugucuauuuggaaacaguacauaauauguuuagaagcauaguugagcucauguugagccuucugagggucugugacugugauugcccagaaugggcuuuucuagccuguugccuucgguggcagcuuuuugguuguuaguacuccuugaggcuauagucagucacagccagggcuguaaggaccugaccgacccaaaggucguccugccauuaugcauguauaucagcucccugcucagccagagggaaaggagacacugcuuccuauuuggagcaaguuuaucucacuggcagagucuaaaugauccuaaccccagugacagaagguucgagucacgugguuuucagcuuccauucuuugccguauagaggaagagcaugggagucagaaauaggucacugucaguagauuaucucacuaagcuaauuuaugaaaaucagaugauaauucuuggccuaaauggaggguuuugucuugucuuuauaaucugucacacuauucuuuccuguuuuucauaacugugaaaggguuuuucucuaauccugaaagaauucuaauguaagggaaguaaugcuguccuaauuuuagcccauuauuuauagauuuguaguuuagacuacagccccuuucucugcuauuuuggguaccuuucucuguauuggacacuuagauaauaguucagaagucuaggaaucuuaucuauuaccgaaaaaggaacgacauggaagaaucuguauuugucuaaguaaaggagguucugggcuagcuaggagagcagucaucugauguuaugugauguuagucaugugauguuagcuguaaagcaugcaagaauuccuguggucucugucuuuguguuggaagccugcaccugcucugcagcucccccacccccauuucaacauucuucccucgugaguauuuauuuuagauauaaaaaaaaugucagucuuauaaaguauucuguaagcuugguaaacugacauuucuuugaaauuucuauugcuuuauuagaguaucaugucuuugauuugacuuguucccuuuuauagucuuacccuuuuuagacuggagcuauuaggaaagaucaagggugagugaaaaaugccuucuaagauuaaggcaaagcaaaggcacuguagguagaccacacuugaaaggacugguuucaggaggcugaacaauaagaaauucuagauaggcauggcaguguccuucuccaggucucauguucaggaggccaaaauaggagaaucauuugcuugagaccauccugggccauaugacaagacccucuuuuuuuuuuuuuuuaagauuuauuuauuauuauacauaaguacacuguagcugacuucagaugcaccagaagaaggcgucagauaucauuaugggugguugugagccaccaugugguugcugggauuugagcucaggaccuucagaagagcagucagugcucuuaccugcugagccaucucaccagcccaagacccucuuauaaaggggaaaaauuccaaagcuucuuagacuaagaaaacgaugccagauacaagccaauauuagcagggaggaaaaacagcagcauagauaaauaucccaguaaaacuaacagacuauaaaaaauaaagucacauacacagagagagagagagagagagagagagagagagagagagagagagagagagagagagagagagagagaaucccagcaacuuuuauuuuugcauuuuuaaagcaggaauagaaucagcuaugaaguuauaacuuauaagaaugcaaagggagggucagguagaauuauauaaauaaguuguuuguuuauuugagauggcucuuacuagguagcccuggcuggccuggaacuuacuauuuagaucaugcuggccuugagcucaacagagaucuaucugccucugccuuuugaaugcuggacuugaagcuaagucuucuuacugugcaaauauuauuccgagguaggcugagaugaugugacauggaaguaauggaccuuguauacauuauuuuucccuauacauauauagcuaagauaaaggguaauuuguaaguuaagcacaguaagagacaaacaacagaauucauaacauuuacaacaauauacuauaauaaaaccuccaguaucauuacucuugggcuuuuuuuguuuuauuuuguuuuuuuuucgagacaggguuucucuguguaguccuggcuguccuggaacucacucuguagaccaggcuggccucaaacucagaaauccaccugccucugccucccaagugcuaggauuaaagggaugcaccgccacugccuggcuguacucuuggacuuuuaaauaauauuaucuuuauacaagcacugcuauagcauggcaguugaucugaggacugagaugccuacuaagugacuaguguagcaguuauggauaugcauggauguauuugcuagucaucaaauaaggcccuuguuguagauccagaaauuggaaaccuuauggucaucuucacacacugguuccauuuaccaaaaguacuuauucucuuuuuuucccuuaagcauuuuguauuugauucuguuuuacucuauaucauacuuuauuguuuuauagaacuuccccccagucauaccucaagcuucuuacaggaaaucagaugucuaaauuugaagccuuacuucauguaaagauggauguaugaacacgauaauuaaugaauuccaggagacuuauagacuaguguuuauauaucaaaaacacuuauuguuguaaaguagcagcaaggucacuuccuaacauaauaggaguaagauacccuugaauucugauucccuuacaaaauucuccuaaggauuaacucacaaaacucucaggaaaauaagaggagagaauacaaagcaaguagcuugugaaauagagguucccaguauggcguagguuggccacugauggucccauacuaaacuguucucuggccuaaaagagucauggguuagacaccuuucaugagauacaaccaauagguauguuaccugugaggaaugugugugcaacuuggugaauaguggaaauguuguuucauuuugaaucuuuccuauuucuuacgaaugugucuguaaccuaauuucugacaaauagaaguuguaacuuguccugcauuaccuguacaacucggucauaaaccuugcuguguggagacugagccugggcgggcuuucugggaaccuugugggaagucccugaaaugucuuuauaagacagcagagauacagucucagccuacagcaucgccugaaguauuccuaaugacaaaccuagguaugagucaguaguggaaauuuuuguguuauuucuuaaacuucuuucccucuuuuagggugcucuggaacagggcucuaauucucagcugauggcuguccaguacacagaaaccacuagcaucagguaagaagaugcagaaguucuuggccaaagagcuugaacugucuuuuaguggagugaaaacucacacuuccuuugcaugccccucugaagacuuuuauaucaguucaaaugaacaugcacaaccagccagaaaucccagcaaagagcucaccucucucaaaucucuugaguacagauuuagucagaagguuuuucugucauaauuuuguuguaaacacgaaguacccauugcuuucuuguucuugauuuuuuugaucuguuuguuaauucucuccauccaccucauugguccagggucacuguuguuucuguuguuccaugagcuccaagcuagcugguccucaggcccacagcugacucuucugucccagccucucacaugguugugcuugugcuggauuacaguaguguccuuugaugcagcucuuuuauguggauucugggauugaaguggacuuuguguauuuuggcucuuguagcagguguuuuuuaccuacugagauaucucaucccuggcugggcgcuuuauauacaucuuaucuuuaaguugauagaacaacucagaguauauuuuauauaggaaaaggcuggggagucaaguuuuuguuuuuuaauaauuucuuaaguuaugaacuaagugguagaacuaggcaccaggccuugucugugugacuuaguacugcauagcaugacaggagauuuugagagaucccagagagcucaguacacagcuguucaaauggcaucaucaagagagugcaagguaaaagagcagagugggaggcaacccugucaugucccagaggccagcucuaguggggcagauuuguagucauagccuuuguaacuugcucugugaaccaagcaaauuaauguagcagaucugagaccccauugaucuuccagcacccagaacagcaauagcaauaaaaacgugucauuugcauaagucaaauguagcagaucaucacaugacacccaauaaauaugugccaauuaaaaaauguuaaaaaguaaauaugguuguuaaaaugcuacccuuucgacugaaaguuguucuugagauucagauguggccuuagaauggcaggaauagggaaggcccaucauguuggaauauuaaugguauuuucuaucuucucacuaguaggaauucugggagugagcugcaaguguauuacgccuccccuggaaguuaccaaggcuucuuugacgccauccgcaggaggggagauacguuuuacguugucucauuucgaaggguaaguucauucugaaagcagaaagcaaauauuuuagcugcugaacacaaggccucaggcugauaggagaaggcacagagguaggcaggaggcaggauaaagucagcagugcaggcgcagcaggccgagggagcucuggggugcaggagcauggcacugaugccaggcugcggacugugcggugagaacauagaccgcaucugaguuuuauuccuggacacccuauagccgugccacuuguuucuaaccagugggaaagugaaauaggaaguggcgauugccuauuggugcguuuuaagccaaggccuaugugguaauuaaggaacagacuucugaaaggcuuaagauuaaucgugggcugauuaauuugucaauuguggaguguuuagaucuauguucccaaguuucuuuguucauuuuuuauuuccuuuuuaaauguuuauaguccuuggugaaaaaugaauuaaauagucagucggguuauauaagcaaaaguguuuauauaagcauuuuugaauguuaaagauguuagaccacaugagaaaagcacggccauuuauagcccaucugcuuuuccuauaaaugacaguauauucuccuuagaguuuccaucugaugucccguagagugcucuacauuaaccaggaaaacagaaaugguuggaguuccucagugauuugcuuccuuagcuauuucuuaaacauuuuuuuaugcuuuuaauuccauguaaauaucgguaugugcauguuagugcuguaagaacuacguuucuguuccugugguaaaaccacauccaaggcaacuuagggaagaaguacggauccugagguaagagacccugaugacagggugagcaagcagagagacagagacacagagagagagacagagacagagagacaaagaauauuggaaauggcauaagucuuuaaacuuccaaaacccaccuccagugacauacuucuuccaaccaggccauuuucuaagccuccccaaacaguaacuccagcuggggauggagcauucaaauacuugagacuaugggggacauuucauccaaaucuagacaauuacauugcccacaaagaccagaagagagugucagaucccuuggagcuggagucacagccugauacugguguuggaaacagagcgcagguccucugcaagagaguaagcaguucuaaccacugaaccaccucucucuagcugccuaagucauuuauuuuauuauuuuauuuuuuauuuuuucuuagaaaauuuucagaacacucauauuuuguaaaguaaggagaaauuugauuuauuuuuuucuacuauuuuuuuaacaguuuuuauuagauauuuucuucauuuacaauucaaaugcuaucccauaagucccuuauacccuccccccacauccugcucuccaacccacccacuuccgcuuccuggcccugguauuccccuguauuggggcauauaaucuuugcaagaccaaggggccucucuucccaaugauggccaacuaggccaucuucugcuauacaugccgcuagagauaugagcucaggggguacugguuaguucguauugcuguuccuccuauagggcugcagacccucuucagcucucucuagcucuuccauugggggccauguguuccauccaauagaugacucugagcaucuauauuugccaggcacuggcauagccucacuagagucagcuauaucaggguucuguuggcaaaaaucuugcuggcauaugcaauugugucuguguuugguggaugauugugguauggauccccgaauggggcagucucugcaugguccuuccuucugucucaucuccaaacuuugucucugaaacuccuuacaauggauacagaaaaugugguacauuuacacaauagaguacuacucagcaacuaaaaacaaugaauuuaugaaauucuuaggcaaauggauggaccugaaauauaucauccugagugagguaacccaauaacaaaagaacacacaugauauucacucacugauaaguggauauuagcccagaaacuuugaauauccaagauacaauuugcaaagcacaugaaacucaagaagaaggaagaucaaaguguggauacuuugucccuccuuagaaugggggaacaaaauacccauggaagucauuuauuuuuaaaggaaaggcuauagguggucuaugguuggaaaugaguauuuauagcaguagaaugauuuguucucauuucuuguugccacacccuaacagaaauugucaguuaacuagcuagugcuuuucuaaauuagaaauuuuuagugccuugggguuucaggaggagagacaaucggaucuugaagacuaagaacauuggcuauucuguauuacuguaucuguaugucuguaucuauuuguauauccaguuauuuaucagacaaaccaggagguuuggaacacuuuagcuguggcaucugaugaucacagcauuuucacagaauuccuuugcucaucuuguucucccaaauaauuaauguacucaccagccucauggugucuuuugccuggcaggugggcugcugugaauaguuucauuaaggcuccaacugucugggcucaagagaaggaaggagcuguucuucuguugauagaauuacguuuaagguuaaaggaaaaguaaaccuuuuagaguggaccucguucucuggaaggccccgaccugcgcugccgugacugugucucugagcuuccuacagaagcauguuuuaauccuaguugaggauaugcccucauuggauugaacaguauaacauagaauaaaaacagcagaugucaagccauggguggaaaucauuguuaacaauguuuuccuagggaugagaacaagucacucucucucucacacacacacacacacacacacacacacacacacacacacacacacacacacacacacagagacacagacacacagauacacagacacacagacacacacacagauacacacacacacacagauacacacacacacacagacacacacacacacacacacacacggaggauggagaaagagagagacuauauuaauauuaaaggagacuauuuuuuuuaaauaaagaggaugaauugugcuuuucuaauuaauuauuuauuuauauuucaaaugguuccccuuccugaucuccccuccacaccccucgccucccccucuccuuugccucuaagaaggugcuucuccacccacccacucugccucaccccucuagcaucccccuuugcuggggcaacaaaucucuacaggaccaaggacuuccucucccauugaucccagauaaggccauccucugccacacguaucgggagccauggaccgacucauguguacucuuugguuggugguuuagucucuggaagcucugaggggucugguuaguugauauuguuguucuucugugggguugcaaucuccuucaguuccuuaaguccuucccuaucuuuuccauugggguccccaggcucaguccaaugguuggcugugaguuucugcaucugucuuagucagauguuggccaagccucucagagaacagcuauaccaggcuccugucuguaagcacaucuugacaucagcaauagugucuggguuuggugucuguagaugggguggauccccaguuugggcagucucuggauggccuuucuuuccuucagucucugcuccacucuuugucccugcguuuccuuuagacaggaacaauucuggauuaaagauuuugagaugagugaguagccucaucccucaacuaggggccuugucuauauacuggagguggucucuucagguucuaucuccccucucuuggguauuuuggcuaauguccuccccauuagguccugggagccccucacaucccuggugucuggggcuuucuaguuccccuccuucccuacuucccauugcuacauauuucuauucauucuucuggcccucugggcuucucuccugucucuucccuuaaaaaaaaaaauacaagaauuacauuuuucccacauguguauaaaguucuuucucauucuuuuacuguggaaaaugguguuggaaaauuacugauuucucuuuccauccuuugauguucagauaguucagucugaacauucuuucuguaucuuuccucuaauuaaaaucuauuauuuuauaucuaggaaaaccugcaacaucuuuucuucugccccaccccccaagucuuucucguuuuaacaguagggaaauggaaguuuacuuuauugcauaaacugugucaugauucaggaauccaauccuuaaauaccuggauugcucuuuuuuuuuucuugcuaagaugaaaauauaagaaguaaugaauuacaucauacuugaccuuaucuucuauauuuugaugugaaauacuuuccuaaaaguuucuuugaaaauuauguggcaugagucggaggagguggacuuugcucuuguugguuucuuaaucucauugacagaaaugauggcauuggaauccaggaauaaggaaauuguagcgacccaagucucugcuuagcaagagccagacacuuucaauccagccagcagcacagcccuuuguuuucuuucacuacuuacugagcauguacuuacccgaaugccuuaacagcuaaagaaguacacgugagguugauaaucuaguggauaccauuauuuaauaaguacaucccacacugcuguaccugcugaucucuuuacuguccagcugcuaacauuuuuuccucuauagcaggcuugcucuuggguagcuaccgaggcccugcuguaggucagcaagaaagagauucggagggagcuucucuguugcuuuggcuuugucugcgcaucuuugccuccgcacagugggcuccuccccuuuccucuccucuuggggcuccagacacucacaccuuguuuccccauaagucuuuuuccuuuuucccucccuuuaaacuuguuuugguaugauuuggaagggcagggugaagaauagcuuuucucaaacuuccaaggcacuuugaaugaacuauacauaaauaaggaaaaguuaauuugauguuucuuuuucuuaguguguuuguauaauaguuuauuuagggagggugcguggguuaaagaagguaagcacaugaaguuaugaguaugggccagcagcagaugcucagaagaggaaaguuaggaaagugacuccaacgaggaggaaaaaaaaaaaaaaaacggagaagggugaggaacacugugaccuuagcugucauuccagugaccuuugaaaugcuguccauacauucuucuuuccaagacaguuuuaaaaucuuggggccguuucucuuuaagaacagguuuucuggcuagagagaugaucaguuaacaaacugcuugguacauucauuuaaaagcuagacaugguggcaugcagauacaggaggagcccuugagcuuauuggucuauagccaaauuagcaaagucugcauucaguaaaagaccuugucucaaaaaauaagguggagccauuauguagacuucuggcuuccacccacccaaaucuacaugcaccacacacacacucaguaccagaaauggguguggggagcggugagagaaaaaacacaggucuuuuauauauucacauacacauauaugaauauuauuccaauuuauuugcuauuuauuuuuucaauaagauagauacauaagaauacuuuugcauauuuuuaguuuuuguuaguuuguuuuuguuuuuaguaccuguucuucauaucauaaguaaacacuuuugugucuucuuggguguuucaaaugcauuugugauauaaaggaagagcugagcuucagccauaugccugacucagagaugguuuuuuccuccagguguucccucuuccucaagauaguaccauauuuggagguggauuucaugccuuaauugcuuguaagacauagaugagcacaucguguauauauggcauaggcuguaaggauuaccuagagccauagggacucaccauauaugauauaggaauugaaguagcauagcaaacugguucagcagcaaauagcaccuagaacaccaaugucuuucuuacacauagcugagucagauuccucagacacaaaggucauuaucagucaguugguacucucuuguaugaaggacuguuguggggauuuagcucaccaugugugcucuccuuuuguaagccugaaacguuaugccuggggccacacugugagaaaaccugaacuuuagcuguacgcauccucaggagaugaaugcuugcuggugcaggcucuugaaccuucauaaacauuauuauaacacaauaguuugauuauuuuaaaaacucuuucuuaugucagcuccugauuuuuaaaucagaaacacucuuccucucaucugugucauaagucuacuaauggcaggaagcagugugugcuuguuaauuacuacccugauacucaguacaggcagccacucacuaccuguugaguauagauacuguggcuguuagaaaugcacuguucuucaugcauuucauuuacaagguauuuuccauguuuggcauaaagaagugcucugcacagcauaagcuauguggcgugcaacagaguuaggcagcacuggcuucucccuggagugcuccagccagagucacagcagcuuucugucuuggcuccaagcugucaaggugaagaaacuaccugaugaacugcgaguguuucucagugucaucaaggagaaccuuaaguuacucuuacucucauacaaauguaagacagcuuuuuggagcagaugggcuguaauagaccucucucuggucuuuggcuuacugugagcucuggagaaagguuacuguccuauaccagauuuaagcaacaugcucgaguacaugagucagaaacuuaaagccuuagacagacuguagaaaaugcucugaugauugcaaacuuugcuuggugguguuauuuacaugaaaugcuugccaaagguguauucccaugggugaccacaaaagcaauuuguugcuagcaauacauauauuaauuuccuaauacauaaagaauggccucuucucuucucuucucuucucuucucuucucuucucuucucuucucuucucuucucuucucuucucuucuccucuucuucuucucucucucucucucucucucucucucucucucucucucucucucucucucucucucucucucucucuccuuuuggagacaggguuucucuguauaacccuggcuguccuggaacucacuuuguagaccaggcuggcccggaacuuagaaauccaccugccucugccucccagaugcugggauuaaaggcgugcgccaccaccgcccggcugcauauuuucuuaauguguauaauuuaaaccuuaaaaguuuaauuucauaugcaaagcauauuaagugauuagaaguacuugauugcauacaaaacaauuuuacacacacacacauaaugugcuuagaagcagaggaauuuccuuacugauaagauaaauuagucuauaaacguugcuuuaagaagucagugcucucuuguuugcagaguuugcagcuuggguguacacagggucagccauuuucuucugccuuuucuuaugugaccuucaagccaaguucuagcugaacaaugaguagcugaccuuggaguaauaauugcauuuuagaaaacgucuuaccucagaagauggaauucuuuuuaaaaguccccuguuuagaguacucuuucucaguuuugacuuuccuuaagauggacuugcauucaggucuugacauguauuauaaaacaauagaacaggguuauuuaaguauccucuucauguaaguuuacuuaaugagagccaggugugguggcacaggccuuuaaucccagcacucugggaggcagaggcaggcggauuucugaguucgaggcuagccuggucuacaaagugaguuccaggauagccagggcuauacagagaaaccgucucgaaaccccccacccccccaaaaaaaaguuuacuuaaugaguauauuaucaguacucuuuuuauaaucccuuuucauuucauuauacauaaauuggcaucuuuaugcagacuuuguacuccacaaaguuguuuucaauauauucauuaauuccuuauauauaaccauguauuucuagucuuauuauugaugauaaaauugaggcagaaggagguuaaaauaacuuuaagaugcaaaaagcaucuaauacaaaaagcauuagaacaauggcugaagcuagugacacuugucuauaaucacaguccuugggcagcucugcccaggaggucaugaguucaaggcuaacuaaccuaggcuucuaaccaggcgccuaagaccagccugggcuacagaguaaaacuuugccucaaaacagcaguaucagggugugguggcacaugccuuuaaucccagcacccaggagauagggaacagccugguguauauagugagaccuugucucauaaagcaagacccccaaagcagucaacagacaguaaguagggaaauacauagaucaguaaaugugcacugcgacacuuacacgcgugauucuagcacucaggagaaugaggcuaaccuagcagcacagcgaggcccuaucuuaaaaaugaacaaauauuuuggcagaauuuaauaguugauagaucaacuuuugauaguuuuccucacauuaaauuucaggguuuuuguaaugguggaaaauuuuucuccaaacagagauauauucgaagaaugaauauauauauaagggccugcaguuuagcuuucagugugccucuuacugauauuuacugugacuuagaacaaacacauaacccucguaucuuuagauuucuuaucuauaaagcaacaaccuuagagaggacugucacuuccaguuuagcuuuagaaaugugguuuuuauuucuguaguuucauguguguguaugggggaacaauguuucucuagaaggccguggcauugcuuuaaacucuuagaugcuacuaaauaguucagucuuagaguuuugaaaaacaacaaaauaugaaguuaaaaguuuugugauggcugccaguuuugugauuuacuuaaugucccuauagugcacaauauaucaaccuuuaguuauuauuucuauaaugaaguuaucccauuuuacaaguuauggaagugaaguacagaaaguuuacuguaacaugguucaaaaguggcagagcuagaauuuaaccuaggcaaguuucagcacagagucugugugugugugugugugugugugugugugcgugugcgugugcgugugugugcacguguguguuuguguguguguguguauguguguguguguguguguguguuuguuuauuuaaaugugggagugcucugucugcauguacaccugcuugccagaagagggcaucagauccaccaugugguugaugagaauugaacucaggaccucugaaagagcaaccaguguuccuaacuacuagccaucucacaaacccagagucuguggaauuaaucauuuuccuacauugccauuuuaaaagcuuuuauuuucauaucuuucagaacaaucaauuuggaguuucauucugucacuuucuuuguccaaacacauuagaguugcuuugauuuauuuccaaagagaacaagaccaaggcaagcccuugugaaaaaccaagccaccugcuagaauguauaauuguauaggaaaaacacaacaagcagaaaaccacaagggagcauuguaagagcaggaagagaaauggaagaguguacuacagauaagggagaaaaacaucaaccuguuuauuuuguuuaaaacuuagaggaagaguuccagaaagaggcugucaguagcaccaggugucauagggucccugagaaugagaaaugaaaaaucucacuuaucuguaucgacugaaaguacucgugacugugggcacauucaugguggagggaucaaaaaggauccacacuagagauaagagagagaaugaaagagauccaauggaggguuugguaaauauggcauugaguagaagacaugagugcuuguguguagucagggagagcuugacugugcuaggcaagcacuuucucccuacagauagagaccacugcaauugguuacccuacacauaaauauaggaagaguuauguuuugugcuugacagguguucugaaggacauaaagcaagucaaugcaauguucauucucauauguagggauguuuuuauguuuaaaguaaagcauagagaaaguugcagaguguuuuuguuuauuugcaguaggacuauaaagagaaaggguauauugaaucuaaacuguauuuaaaaauuaaagcaauguuuaaacucuucccaagauauuaaaagucuuccaggucaugaauaauuguuauuaauaaaugaggaaaagacuuuaaaauauaaacguugcuggguggugauggugucugccuuuaaucccagcacucgggaggcagaggcagguagauuucucugaguucgaggccagccuggucuauagagcagguuccaugacagccagggcuacacagagaaaaccugucuugaaaaacuauauaauauauauauauauuaauagaacuguuucuaauuaaauuuauauauaguuuucgagguucuccucauauaaaagcuaaaaacuagcaaaguagcuuaugaaaucauuuuaugucuuaacagaguuuggugcaagccuuucaugaugucacaaaaguuaauuauggaggaagcaauuaucacauuauaggaaacagcuaugguuuaugauucaggucugaaacacucaugucauuuccaucuccucccuccacaugcagugacuuguucauuuuggacucguacuuguuuaacuuucgacaccuucagcaacguuagaccucgaguuucauuauuucuuccugaaaaaucuuaagucuaguaauugugugaucuaugugcacacauuacugcuagcuuacugagaagauacuguuugaagagauguagcaucucuaguaugguuaacccaucgaugccaucaggauggauaaguagcuccaaguugaagcaaacaucuaacugauuaaugacuuacuguuggcuucaugucuguugucucugcugugguguaaguauauugaguucacaaaaccucucugucucugucuuccuccuauccccaugacauagcauagugccagguauguagcacuuauucaacaaagaauaaaugaaugaaaaauuaaugaaauggaugccaaauccaucacuuugguacuaucuuuaaguuauuuuuguaauagaaaaugugugcuacagcagcuucuugagcauuuacguguauguaggaguugcauguauagguguggaugcauguacauguauauggacaaguguagaggucagaggucagcuguggguguugucccucuggugcuucccacuguauuuuuaaacaggcuuucucacuuggccuggaacucacuaaugaggccgaacuggcuagccagugaaccccagagaccuuccuaucugccccucccacucugcccaucccaccccacccaccccaccccagugcugggauuacaagcacauaccacucugccugaauuuuuuuguuauuuauuuuucauacacuauauucugaucaugcuuuuugccuuccucaccucuucccagauccucuccacggacccucuaacccaguguucuaggaucaaacucuggucuuuaugcuuacauagcaaacucuucaguggcugagaucuuugcccagccuccuccugagcaucuuccucagggccaucucugucucccugacuggagaaaucagucuuugaaagugaaugagugaacucaagugcagcucuacaagucugagugucacuguguucuaacgagguuccagcgagaucuucauguuucauauuugagaaacuaaccuugguaauauguaaacagaggugauuauuuucauagauuuuuguaucacuuuaaccuccagaaugacuaagccucagacugauuaguuccggaugccuuuccauaaugugcauuugugauguccuaaaggacacuacuguguuaaccuuucauucacugugcaguauguauuuuguuaaaaaaaaauuaagaaacguuugucaacuuaaauuguagacuaauuuuuggauaauuuaucucgaguagacugugucugauuauacaaugcuuugaaauaaaucucuguagaauggcuuuugccauugcaugaaaaauaccuuugagagaaagacagcaccaguggcgcagggagaacagauagaggcccuugaggugaccugaugguagcguuguaugcugagucggcucugcaugcagccucuuagcgggcguguucaugcagcuuuguagucugaacuacgcagagaaguguaaccucuuuucuucucucuaucccucuuccaagaaugcuuuccacaacagccugagcucuauucuuucuccaacagcccccuucucaucccaugcuggcuugucugcauugcagggaaugacauggccuuuuuuuucucuguugacucuaucuuccuccuucaggcagcugccaagauuuacagccugcuucucuugggauauuucuuugaauaaaaaauuccuugagguucaaaaggucagggugcaauggggacuaccaugugccaaaguugaaagauuugggguggguagaagugggauuaguaaaaacagugacuuauguaagggaauguguccaguucaaaggccauuggcucugacucgaggccuugaagaguggauaacugagguucuuuuaaacugcuuuuaagaauuaucauuuuaccucauuaaaaucaacaggaauuagccaggccugguggagcacuccuuuaaucccagcacuugggaggcagaggcccaggcagagacagucagaucucugaguucauggccagccuggucuacaaagccaggccguucuagagccaggacuacacagagaaacccugucacaaaaaacaaacaaaccaaccauaucgaugagaauauuggaaucucacaaagaugucguccuacagcuuuuuucugaagcauuuguaguuuacuagauuucauuuagguccauuuugaguucaucucuauacuguauuuuacauuguaucuguguguguguuuguauguuauauauaucacauucauacauguggugcauuuaugaagaucagaggaugacuugcaggaguugcuuguccuuuuucaugaccuggggaucaaacucagaucauggauggggccugggcagcaagcaccuugucugcugaggcauuuugauggcccuugaguuaauuuuuacauaugguacgaugugugacucagagucuacuuuuuacuugugcaaauccaguauuuuaugaucuucggugcuguguuuucauccaguauuuuuuuugaaagaagaauuccagcaaagccaaguuuaaaagguuguaccagacugccaguugucuuuggcguggagaguuuguaccguuuccuggagcuucauaaaaggaugucuugugguugaacucccucaaccucaaguguccagccucagacucaaccaggaaaguguuauuuacauauucuuuggaagcauaacuacacuauagauaauugcagcaauugugucaugggcagaagaaacggccaaaccaaauucuagagaccagaugagacaaacacauaggggcuaaggaaugguccuaaaguaagaggaacuaaaaaauaagguccuugucggagcugucugcuacucucugcucuauuggugcuuuauuuuacuuaauuuuuauuaaaacauucauaaucaaaccuuaaaaugaauguuuuaagauauauauuaauauauauucuuucugaauauauaauaaguggcuucaagaaaaggaaaauggcagaguauaguuaauaagauaaccugaauucauauuaucaaguaguccaucuguucugaagaaucgccuucacuuguaccugagucuuuagggcuuuagggcuuuuuaguuaaaaaguuugugucuuagcgaguauguggauggggagauaguuccguugaugagcugcuuguguucaagcucagguuccuguggcugacucagagacaguguaaagaugcugagcgugaugaucccagcaccgaggaggcagagagaggugguccaggggcucccuagccagucagacuagcuggccugcugagcucccagccagugagagauugucacaaaaacaacguggaugacaccugaggauugacaccugagugugaccucugaccuccacacacauauaaacacacgaacauguacacacaugcacacaagaaauaugugagacuaauaacaagccuuucauggucaaccaaguuccccuagucacaagaaagucccuaucaguuuacugcuauuuuaccaagguuguauucaucauagacuaaagaggauacaguauuaucuauuacuauauaacacaaccaaagagguccaaacuaacauugaaaauuuacuucaguuuuauguucagugugccuaguuuuaaauaacauuuaaauuuuuuuccuucaguuuggugugcuguaugccuaguuuuaugauguaaaacaaggaaagucuuuuuccaccuaguguaacauaaauaccgauuuuacuguugaacagguaucuccaggaaauggaguugcagugggaaacaucacuccccacacacuucugacuauugaucaauuuuuuguucaucuuuaagagaaagccaaaauaugagaaauccccagagcaugacaguuuuuuucccuuaaaagauguauuuccucacaucuucugaggaauugcuccuauuuuucaaauuccuuuauccaaguuguuaacuaucuuucugcauaguugccuuuuauuucuguauauguuuuaaaaacccuucuaacuguagcugccuuagaguugguacuugaaguuauaaucaguuuuacugucauucauccaacaagaaaccauaccgcaguugacaaaaacaaaaaaaccuagcacuuguagaguuuauguucuaaagacagauucuuuuagaguuuauauucuaaagauagauacuaaguaaauauauaaguguaugcaauaaaauaucaguacuaagaagaaaacucagcguaaggaaggagucauucuaaguggucacugagaaauuauuuuauucagaucacugcauguaauucuuuggcuuggcuuuuaaagaguuuuuuucuuuuugcuagugguauuuuacaaaagaaacuaagaauuguaugugcaaagaaaucugaaaauauagccccagcuaguaaacagagauaucuaagggaacuaguucuuucgcuaagcgcuguuucacuuguagaagugaauguacauccgaggacacuagcaguucuggagcggccucagugugcagcggccccgggaaccugcggacggagccccgaggugcaggaguuagucagcuccggagcguuaacgcuugcgcguuuucucacaucuuccucgccuagucauucagaaucuuguauuuuugccaaguaaaacaaaucucauacuaaucagcuauaaauaagcagugggagcacgagucagagccagcacgaccuucuccccugugcaccuccccgccguucccagcaccgaccuucuccccugugcaccuccccgccguuccccucacgcucgguuugcacaaaugagcagugcuguuaacuccuguucuacagaccaacucugguucuuuagugaaggcugguuuuuggaacuaaguaauuaguagugcucuggcgugucccuagaaucagagaagaaugugaacuucugugucccuuuagagggaggagaaaaaaagaaaauucauucccuccuuuuuuaugggucuagaaggugccugccuucuaggcacagcucagcagcuuuucaggggaaaaugaaagauaaauggcuuuaaaguccuaucucuucuguuagauccucccugguaaaacuuuauccuagucugcgucauuauuuauucacucaguaccuuucaccaaaucugguguuucauccauaaaaacaaguauguaaacucuuuguuuucaaguaauuuguaguagugggagaaagugacucaucuaaaauuacagcaucgugguaagaaacagcauaacacggaaugcauaggcucccguggguuugguggcuucaccgcccucgcuguuguauguaagacguccauccagcgccuccaaagccuggugagguagguacucuuaacuccagccuacaucggcugcgcucucuuccuucaggaagaagguagcagaagaguuuagagcgcacucaggagcgugagugggacugugaagccauggcacuucacaugagaggcgccugugugaggaggacucuccagcaaagugguuggaaugugaagugcguucaggaaacuacaacauggcagagucacaacgacgcuugugggccaugccuagagaauuugguucuuagguagaagacaggaucaggcuugcauuucaugaauaaacuauaauuguuugcacaggcauuuagaagagaguuuacuucuaaaggaaggacuuucuucuccagcuugacuuaagucuacugaaugcauauacaguaaacgaaguuaaaaucuggaaggaccguauuuuacuuuuucaggaguuauguaaguuaacuauaaauacauuguaaagauagaaacuaaauccaugggaauuucugugagaggccauguuuggggguguagucauacaagcgagacugacacuaucucccugaagugcuuagcguuuccaggcuguugacugcucuaugcuaccuguauucccaucucccccucccccacccccagugauuaacuccccccuuaccuuccccugggggggggggaaaggaaaacaaaaaagguuguucuguuugacaaguuuuuuaaaggaagugaaaaaugauuaucauaucuaaaagccauuucucuaagccacuuuuuuuaaguggaacuuuuuucuucaggaguuuuuuucuuuuuucuuuuuuuucccuuagucauuuuauucguuuaccuuuucuugaacaguguuuuugcugaggaggaaaccaccuuggugaaaugagccuugauugauuauacacacuugacucuaaaguugcugcaaaaguuauuuccuaagcaauauuuauuuaaauguaaagcugagacuuuuuucuuuuuucuccauuaauuuguuuauucauguuacagccuggucacagccuaccuuuucccucuccuccccaucccacccucacacacucuuccccuacuuccccucccuucuccugagagaaggagaggcuccccauagguauccacccacccugguacauaaguccuagcgggaauaaaugcauccucucccucugaggccagacagugcagcccagcuauggggcaggaaauccaaagaccccacaacagagucagagacagccccagugccaauuguuaggggacucacaugaagaaaaaguugcauaucugcuacauauauguaaggggcuggaccuaggcuccuuuaugcucuuugguuggugguucauucucugugauucuccauggacccagguuaguugacucuguagguucugugguguccuugacuucucuggcuccuucaauucugccuccacucuuucacaagacucucugaacucugccugucgguuagcuaugggucucugcgucuguuuccaucagcuucuaaugaagccucucaggaggcuguuaugcuguuccuaucugcaagcauaggagaguaucauuaauagugucaggaguuggcuuucuccucugggaucucaaguuaggccaaucauuacuuagccauucucucaaucucuucucuaucuuugccccugcacuucuuauaggcaggacaaauuuuggguugaagguuuuauagauggguugguguccccucccacuccuggaaguucuaccuagcuauaggagguggcuucuucagacuccauauccccugcugcuaggagucucagcuagagucacccccaaaguauuccagucccagagcugccccccaccaauuuguuuucugucucccaucccuccuucccuccccuccucucccauccaguucucucccuccaucuacuucagaugucuuauuuuauuuccucuucugagugagauucagccauccuccuuguuacucaacuucuuugggucuggauuguagcgugguuaucuuguacuuuaugacuaauagccgcuuauaagugaguacauaccaugugugucuuugugggucuuguuaccucacuaaggaugauauuuucuaguugcauucauuugccugcaaauuucauguucuuguuuuugauaacugaguaguauuccauuguguaacuguaccauguuuucuuuaccuagucuucaguugagggauaucuagguuguuucguuucuggcuauuacaaauaauaccacuaugaacauaguugagcaaguguccuugcgggaugguggagcauccuuuggguauauaccaaggagugguauagcugagucuugagguagaacuauucccaauucucagagaaacagccagauugauuuccaaagugguuguacaaguuugcacucccaccagcaauguagagguguuucccuugcuccgcaucuugccagcaugugcugucgcuugaauuaccuuggucauucuggugggguaaaaaggaaucucaagcugagacuuuguuaaccaauauuuuucuuuaaaauuuuuuaaguuacauuuuuuauuuuuauauuuuauucuugggcgugggaaugugagcaguggguccgggaaaaggaauugagguugucaggcguagugagaggcagcucuuccugcugagccaucgcacugauccucgcccagcauuuucccaauccacagcaucugagguuuacaggcccugcucuuaggugauauggccaccgcuccuaucuguuucuuucagucguaagcuauucaaccgugugcauucugcaguaagugcucugacuuugaaccccuuuguguuucugacuguagcaguguuuguuuacaaagugcccaacuucugccauuugcuugguuauccuucaccuugaguguuugacuuggacaagagaagaggauagauuccccugugaauaaggugaauucauuuguuccauuaaacuguauuuuaauugcuauuuaaaauuucuucccugagcuuguaucuggaaaaauauauuuuagacucuggacuuauccuuaaaauggguaugaauauuuggcucuucuaacccaugcaguuuagauauauaagcuguuuuaggggagacuuuauuuucacaguaaaauccugagcucuagcaagguaaagaaaguuuauucuuuucuagccagacucaauuauguuauuaaaaagcacaacagugaagccugaaaggaagacaucacccacuccccaucucacucaggucucuguuucccugguaaggugcuccgucugcuucagaaaaguaccagggacucugcguccaucccagugucagggcaucuggauguaaugcaucuaacuguacacuggugugcaauggacaguacuaggccggguacugccuagguuuucauccaacaucagucaucuaagcuuuaaaauaucugcucuuuauauaauauagccaucgucuuucacauguuccauuuacucuuaaacugucaaacuguaugccagacugaaauaaauuguuccuaaucccaggcaugccuuuuacuaagaaaauauguaaguccuuuguagcuaaagauuucugcuguuugcauuucucucccuguccuaacacuaugucauauugaauuggugguggaaugcuuuuauaaagcuauacuauagcaauuaaucucugugauuuuccuuuuccuacaagugguuggaaaagcuucuauaguaaauaagccuacgcaggaacuaguguuaaagcaugaugcccaaguaugaaucauuugccuauuauuaguucugagucauagagguccccuccauuuuugagacaggaugucaguguguagcuuugguuaacccugaacuugcuaugucgaugagacuagccucacauuccuagacacccaccugcugcuuuguccugaguguuggcaagaaaggcugcaccacuacauucccagguuuucaaaaacacaacugugagauggggaggagauuaagauggcuuugguguguguguaugugugcacgcaugcacaccaguauaugugccacaacuccugagugaaugucaaaggucaauuuuuaagagcugguuuucuccaccgcucucaggccuguaaacaagcucuuuuccccugcaucacaggccccuuuguagcacaaaagcuccuaaauugugaucagaagcuccacaggugguagaucuggcuuuaguauaccaugaaauaucuuccuaauuucuuuuuuuagccaaaagaccaagaaauggugaaauaguuuuucaaaaccaucuaaguaggauagaagagccaugauuuuaaaguucuaaacuuaugaguguagaguuauuucuaguuuuuuuuuaaucaguugauuacaaugucuucuuuuaucaucagagacauuuacuagaagucuucugagaguuugauguagaguauuuacacauugucuaaaucagcagguaacuaaaaguuuaauggcauuuguuguguuuucuaauuucuaaagggcucucacuguuuagaaauuugaauuacauaauaacccaaagcucaacagucauaacaaaauaaauguuuuauuuauuuuaaaggccuucacuuacugugaagggugacuauguuuuaauguccuaguaacacagcaugcacaccuugguagaggaugacuguuuauauucccuuuuuuuuuuuuuuagauauuuucuuuauuuacauuucaaauguuguccccuuuccuaauuuccccuccaaaaauccccuaucccuucccuuguaccuguuuuaauacugaaguuuuguuuaauucuagaugcacacaauaauagauaugucucagucacccuguuuuccaaagguccuuaggguugucuuccaggcugugggauauuugccugaggaaguuucucuauuagaagagauauauaccucgaugacugggcaucauucugcuucugcaucugggcuccagccuugucaucacccugcaaucguuuuguuacuuaccauuugucuuccucucucccaaaagcccuuaauucugucuguaagguacuuacaaagaagcuucuccuuuuuugucuuuugcugaccagaugagcuguuucuggcugugugauuugcugugaggaagggaucucacuccuguuggugcauaaauauuuccagaaguguuagugugcauuuacauuuggcauguuaagaacuguacuacucucuuugaaaaaaaaaaaugacuugguccagcuauaggaauagcccaccucuguucucugcauuacaaguccauuccuuuaaccugcacagauaccuaccuguccuggugaaauuacuuaugggaaguagaauauauauagauuucauuauuuguguuuuacuacacguaagguauuuguggugguuugaauuggcuuggcccaugggaauggcacuguuaggagguguggccauaucagaggagguguggccuuguaagaggaagugugucacuguggagguggggcuuugaggucucauauaugcucaagucugaccaauggaaucagccuccuccuugcugccugcagaagacagucuucuccuggcugccuucagaucaagauguagaauucuuggcccuucugacaccaugucugccaugcuucccaccaugaugauaauggauuaaaccucugaaacuguaagccagucucaauuaauuguuuuccuuuauaagaguuaccuuauaaaggugucucuuuguagcaaugaaacccuaacugagacagucuucuauauuggaugguuauucauuuguggguuuuguuugguuuguuuuuuuuguuuguuuuuuuuuuuugcccuuuuugaugaaucuucaacucaauagcugaauuuuaucauuuaaacauacaauauuucagcaguaagcucauauagugucuuuuguguggagaaugucaagugcuauuguuucuuaucagugaaaaccuugaaugaguucaugaacaggaaguaaaucuacaaucaggagaauuaaauuccucucacaguuuggccauauuagcuucuuauuuaaucucguguuccauaaacuuuuacaacaauggcauauugaaaguaauauuugccucaagugauacugcuuguaaaguuuauuuugcaguuucuugauagaguuuccacuuuauauuucagagacauaaaaaggugguuuugcccuuauuauuuauaggaagaaauucuacagcaccccaccacucauucaucacaaagccaagucccaaaauggacuaucuuccagaucagacugggguuuuuccugcacuuuagugcucuccagcaguagaagaaauuaaguuacauugaaagaauuccagaaauauguaagcaaauagaauucaaugaguuaaccuaacauuuccuccagggggagaauuuuguucugugaaguugagaaaaguugauuuucuuuuuuuuagaauacacuguaauuuuuucccaacuaaagauuauguaaagaaccaauaugguuucuaaauuuauauguuaagauaacuuuauuuuguccauaaaaaauguuccuuacuagggcuagggagguggcucaaugguuaagaguacuucuuauucuuccagaagaccugaguucucuuaccaacacugaaggaacagcagcucacaacugccuguacuucagcuccagggauccaacauguccuucuggcaccugaggguauaccccgcacauguggcaugcauucacacauacacuuguaguuagaauucuggaauguugguuucuuuaaaaaauagaaauauaagaauauguuuuuguuuuaaucccagguguggggauguggcacugcuucaaagcagcugacuaugauuugccuugcucucgagcagaggccugguuuugccagcugcagaugguuucugcgaugugugugauaugugggacuuuucagagggucuauaaaugcguagagcccugauaggugggguggaugguugcugguuguucggggaguugggugaggcuugcucggaguugugcucaaagaagaaacaagaaagacauuagauucagggaucucuaucucucuccccucuauccuuguuucucucuuaucuagugauuagagguuaaacuaggggaguaugggggauaaagggugagaaaagaagaacccacacaguagcaaacaucagccacacauauauauaaacaaauaguaaaucuuuuaaaacuguccuugcaagccugggaccucagcacaccacaguccaaauccacgugaguuuucuacaccaccagcaguguucucugugugguggaugcugcugugagcccugggagaaagaccaggagcugcauuauaggagauucuuuucacuauuuuuucacuauuuaauguguagauuugaguccaccuucacccccaaacccugcuaaaugaaguucaucauggcuucugcuccauuccccagaauacuguagaaugaaugggggaagcaggggacuuguaguuuucuguuaagaagaaagccucccagggcuuuuuuccuauaagacaccucucauguaaagaugcacuaucuucaguuuaacuaauccuaaaaugugcuauaaaugggaaauacuacuagauuuuuaacacauugaauaaaaauguaaaauauuucaauaauguuuguguugacuccauguugaauggucauauuuuuagauauauugaauuaaaguagauaauuaaaauuaauucuauuuugacauuuuuguuauguacauuagagauuuuaaagaacuguuuggcuuaugugcguguaauuauguguauauucauugucuauaauuacagguuucacaaagacauuuucugcugucguguguuuucaccucuccauauuuuccuuuccccauccccuaacucccuuacuuccagacagucuugcuucuacuuucauauauaugugugccuauacauauaucucauauccagauaggauuuuauguaucuauauaaaaucaagaauccuaaaaugagagaaaauacaucuuuuggggcuuguuauuucuuguaauaugaugcugucuguuuagagguguccauuuucuuuuaauuacauaauuuauuuuuucuguauagccaaaucaaacacuauuguacauauaugcugcuuuuuuuuuuuuuuuuuuuuugagacaguuucuuuguggcuggccucaaacuaaguuuguaaaccaggcuggccucaaacucaccgagaucugccugucuuuuaggccacauuaucuuaaucuguucaucuguugaugggaacucggcuaauuccauagcugcuacaguaaucauguaugugcaagugucucugugggauucaugacuuggaguccuuugucacauccucaggagugguguacuucagucacaguccaguucuaccuucaguuuuggggguaccuucaccacuuuccauagugccuggauaauccauccccugcaguauguaaggcagaucccuccccccacccuccccgggucagaacuuguuauccguuuccuuggugaucugacugggauagauagaaucucagugagcguaguuucaauuugcauuucccuggugguuaaagauguugaauaucuuuuucauauuuuauuaguucuuuguauuucaucuuuugagaacugucaauucauuucauuagucccauuuuuaauucagguuuuuuuuucuaauuuaguuuuuugaguuccuucuauauuucagauacuaauccacugacauuuggauaacuagcaaagaauuuuccugcuauuccaaaagcuuucucuucgccuggucauuucuugccauacaggagauuuuuaaucugugcaauccuauuggucaaguccugguacucuuuccuggucuguugaguacuucuccagaaaguccucaccuguaccugugucgugaaacauuccuguuuuucuccagcaguuccagaguuucaggcuuucuguuaggaucuuugauccauuucacauugauuuuuguacagagugaaagaucuggcuucauuccccuguaugugcuguucagauuuuccagcagcauuuguuaaaacaucugucuuuuuuuuuuuuuuuuuuuuuuuuuuuuuuuuuuugcaguguggcuuuugugucucugccaaaaaucaugugacuguagccauguggguuuguuucugggacuuuugucccauuggaccuucuucuguuucugugcuagcauugucaacauacaaaaccacagcccaggacuccaagaggacagguuauucuggagcgagauaggaguggccaugauccagggccagguuuaaguuaccucaaauuccaugucuuagcaugguaacaguugauagacguagaacacaggaauuguaaaccaacacacauugaaguacauuggugaggccaucuguugggcagguuacagcaagugaggaagcucuacugcuggucucagaugcugucuaagagcauucuugccuuuuggguugguggagucuuguaucagucaggguucucuagaguaccuagagaacuuauggaauggaccacucucuauauaagaaggggacuuauuagaaugacuuacgggcugugguccagcuaaugcaacaguggcugccuaugaacugaagcuuuaagaauccugcaguuguugaguuuagucugaauagaguccugaagauaccacugaaggaauggacgugcuggugaggcaagaacaaacaggcaaagaauggugcuggagagauggcucaccaguuaagagcacuggcugcucuuccagagauccugaguucaauucccaguacccacauaguggcucaugaccaucucuaaagggaucugauacccucuucuggcaugccaguguacaugcagcagaguacuuagacaugaaaggaaggaaggaaggaaggaaggaaggaaaagagaaaagaaagaaaaaaaaaagaaaagaaagcaagcaaaacacagagacaccaagaaaacaaaaaacccaggcaaagaacaaaagcuuccuucuuucauggccuuagauaggcuuccagcaaaagacauggcccagauuaaaggcgugucuucccaccuuaaagauucagaacagaagugggucuugucacuucaguuaagcaaaaaucccucacagaugugcuccuccauuuuuggguuuuagguaguuuuagauguagucaaguugacagccaagaauagccauuccaaaucuguucauauguuacaaaaggacuugccaaguagucucaaggauauuaggucacauccagaggugggcaguaaauagccaugcagaggcuaagacaagcccaggauacuuggcucugugacugcagcaugucagccugucuguacucacugaugcucuaguucugucuguuagccuugucuuauuuguccaguguugcugcaguuuccuuccagcaacaccaggucauggcacaaugguggcuugguaacuguggcucucugguggaacucaaauggguguagcgaccccuccaguguucuuuaugcucaggauugcuuuggccaccuggguucuuuuauacuuucauaugaauuuuaggaguuuuuuuucugugaagaauugucauuggaauccugauggggauugcauugagcuuagagauuacauuugauaucccaacuuuucauuuuuuccuuuuauugaaaauauuuuucucauacaaaauauccugauuauaguuucuccucccucuacucuuccaaguuccuucccaccuccccuccagaucuacucccucucugucucuaauuaggaaagaacaggcuucuaggagguaacaaccaaagaugacaaaauaaaauauacgaugaagcaaaaaccaucacaucaaaacuggccaaggcaacccaccagaaggaaaggagccccaagagcaggcacaagaaucagaaacccacugguucauacacucaggagccccuuaacaauacuaagcugaaaggucauaaugugcauuucaaugaaaacuauucagagagagacuacacuuugugaccaggccuucucaaagaccagcuucauuuugggacuaagaaugccuaaauuagugguggccagaaugccccuaaagcaugucuuagaaauacuguaucuuuggacuuugggcaagaaccuaaaguaucaguauucuguaccauuaguuuagggauguuccauacacauuagaaauaagauaggagguaaauuggaguucuuguuuugaaaauugaaauacuguguuuuuagcuggacaaaagaugugcaccucuguugaugagagugcuugaaggcaggucagguucuucuaagugcuccuuagaauaugcagugacauccccgaggugccacugagucccugcggcacugucaggaguuacucacugcucucuucucuauuauuuuuauauacuuugguagaaaagagggguuaaaaaaaacuuaauuauuuauuuuauguacaugagugcaguguagcugucuucagacacauaccagaagagggcaucugauuccauuauagauuguugugagccaccaugugguugcugggaauugaauuuaggaccucuggaagagcagucagugcucuuaauaacugcuagaccaucucuccaauccccaaagggaggguuuuuaauucaccuuuuuauucauucuaguguuaugcacacaucauacuuaaucuuaaucagaaagcugagaagcacugaaaguguuuugaguuaaguuuaacuaaaggaaaagugauucaaagccaagacaguugauucucuccuugucuguaauacuuacuguacuguuacagcugaacacauccaugaguggcugaguguacugaaggaauauguagcaauguugagauuaaaaguuaaaaaucaauuaaguuuuguguuauuuccugucuuccaacuaagcauuucuuauaucacuguacugugaaugcuuuaaagugcccagccaguucuccuucauggucgccaugauuucagucaguggcucacucugcagcagcggcaaguuauucccaacaucugcaccgucagugcucauguccuccaaguccauugaaaacaaugcucucaccccauucacaggcuccaucauucuccacuguuuuucuagccaagaguuaggggagaaugaguguaauauaucagaguaaggagcucuggcugcuuaucuguggucagcuacacaaugcuucauuuguuucuccgguuuucuguauguaaaaagcuaaauaguuucuuaaauaugaaaagguagcuuguuaaauauauaaagaaaucuuuaaaauagucuuaauuugcuaauaaauguaaagauaaagcauucugguugagaaauauuucauaaacuuuaaacagcuaaauaggguaaugugagcauggcaucuacuaucucauuucuccacccauguaguagggaacuuuuucucugcuguuuaccuagcagauccaaggacagaguuacuggauguggguauuccacagcuuccuccaguacuuccuuuaggggcaccauguggaacugaagaaacucaacagacuguaagauugcucccagguuauaugggaagaggcccuuuagccauuuuugccagcauguugagcuggcaguuaauauuuuuaauaagcaaguaaaugaacauaaucuuagccgggcaugguggcgcaugccuuuaaucaggcagaggcaggcggauuucucaguucgaggccagccuggucuacaaagugaguuccaggacaaccagggcuauacagagaaacccugucucgaaaaacaaaaacaaaacaaaacaaaaagaacauaaucuuuuacauuuaaauggccaucucauaaguuuacauuaguuuauggauuaggaagaauaaagugcuuacuuaugaauguaauuucugcuuauaguuuuagaucaaagauuaagaauacuggagagaaaugaagccagauauuuugacuagcacaauaaauuacuauagcuuauuaaaaaauaucucuuuggcuggacaugaccuguacucccaguacuggguaagccaaggcagaaagacugagagucugaagccugccugacuacagcaagucagucgugagggccauacagagaaaugcuuaaaaaaaaaaaaaaccaacaaacaaacccuaauguuacuguacucuaugcugaacucuaagcuguguaugugcgcguguguguguguauguuguuucuccauuccauuuagcaucugaauaguacauuguguaaaguucuguaaagaaugguguaucuuguugacacaaaaaaggaagcagaaauuuugcauuaaauauaaguaaaauuugauagaugguaauaauaaagaaaagcuauguuuucuuauuauugcugggugugauuuucuuuuaucaagagaaaucccagaaucuacccacguggugggcagagcccagugcuaguaguuaaaucaaaugcccacacgagggaagaguacuuuaaacauguggggucuuaaugucauuuucgguaguuguuuuuaaaguauugcuuuuggucuggaggauguccauauaaugaaguaaaacuauggucagcacaguuggaucuaaaucccaguugggucuuuuuaccuccuggguguggggccugcugaucccuuaggucucuucaugcugugacgcugugcauagaaucaucauguaauuuccaccguacuuauugauuuuuuuuaaaaaaauguaauagacuuuaaagaaaacucugugugacaccgagcccugagaauuuggguguagaggaaguuucucgauauacagugacucacagggaaacacugugcuuaucuacuugcuuugaaggcuacagaugcacauccagaugcuacaucucagggaaucacagaggcagagggcacacaaauacccaccugguauuuauauggguucugcagaucugaacucaaggccucauggugcuuuaaccaaugagucaucuuccuaauccccagcgggaagauuuaaggaauuaagaucuaagaaugauuauaaguaaaggugaggauauaacuucauauaaauaaaaagaauaauuucaguauuaucaacagaaccauagcugggcgugguggcgcacaccuuuuaucccagcacuugggaggcagaggcaggcagauuucugaguucuaggccagccuggucuacagagugaguuccaggacagccagggcuacacagagaaacccugucucaaaaaaacaaaaacaaaaacaaaaacaaagaaaaccagaaccauaauaagaauugccugaacaacccuaacauguuaaucaaaauagggauagucaauugauacauauuauuauauauuaauaauuauucuuuuagguuucaagucaaaaauaguggaaacucuugugaaugaaucuuuaaucuauuauucuacugugguuagcauauauauuauauauaaguauauaauauguaauauauaauacauauauauuuauauaugaucuuuacagugucugauguacaugaaugacagguggccagugccuuuucuucuccuuaaggcagggucucucaacuaaacccagggcucaccaguaucccccuagccagcucacuaugcagauacugucuuugcuuuucaagucugggagcuuggaacuuuaggagauucaugccauggacucuguguguguguguguguguguguguguguguguguguguguguguguguaaugguuuauaaauucugagaaacucaaauuauuuucuuccccagugucacauauuuuuauauuuauuuaacuucgcaggacuuccuauggaaugcuggcuuguuuucuuuguuucccuugugcugagaauuuuuuuacuuucuuaugcgcucauugcuuauuauuccacaucauuuauauauuuuuuuaguucguuguuggugggugaagucuuuuaaugacuucuaugaaugucagagaacacacgcauuugaucagucuaaagagugaacuaaugaucauauucccacuaaaagauuuagcuuguuuuaaaagugaugauccaaaacuuggagcaguuagcuaccugcccaaauccccuagaacaauacuguguuuguagaacuccuuuccaagagacucccaucuguucaaucuuaguugaugagggacacagugugugacuagcgcuccagugcaggacucacaacacauuccuucuagugcuucagcauuaauugaugguucauagcagcgguguggagggcuagcagagacagucagcuccgccauagacucuccacacgcugucuugaaaguuuucccgcaugggacacuauguuaaaauaaaauauuuguaccuguucuucagaggcaucugugaaacaucugagcucugaugaggaaggcaaaugauuucaaauuagucugauugucauuaguuguccuuuguguguuacuguuucuaaugaagaccauauuuccuaauuggacaccuaauuguuuccucaguuuucaaauaauaagcuucuugaaaugugucuacuucauguucuguugacuuaagacuuccuuuaacaaggaaagaagaagguccauuuacuccuuuuuaaaagaugugacuggacauugguggugcacaccuuuucaaucccaacacuggcgaggcagaggcagguggaucucuaugagucugguuauggacaaucaagucuacauagugagauucaggcaaucuaaggcuacauaguaaguccuugucucaaaauaaauaaauaaauaaauaaacaaauaaauaaauaaauaaauagugacaauuuuugauuauuuuauuauuuaccuauaugccagggcucuggacuaaaaaaaaaaaaaaaaauccaacuuuuucuuuuaaccuagaauccauauuuguacaucuguccuaaauuccuuuaauuccuagugaauugcaucagacuguaaauauugaucagcaguacuuguuucuguuggaaauacaauuaaauccacauuuaguuguaaacaagauugugaagguuucaaaagcuuuccuaaggauaugaguaauuaccauggugacuagggagccacaagcugaccggagcaauuauuaaucuguuuuuauuaagucaugucuaggauguaaggaaaucauauaaaaugaaaugggggggagggggagucagcucuuccuuguguaguuuuuggccaaaauauucucacuauuuaaucacugaucacucacguucuaucuguaaaugaaucuuaaaaguaaauaagguagaaauggacauauaaacacaaaguauaauguauuaauugauuuaauagugauauguauaggagauuauggggccauaaaaacugaccaguucauuuuaccuuagccuaggugguagagggaagaaaggcaagagaaauaaauagguuugaauugacccuggaggguugagaacagaguugacacuucaacaacauccuaaugauuaauuaaaaaguaaaacuaauggcaaaacaaugucagaugccgugagacucuaucacuccugaguuggggaaugcauaauaauuaauucacucucaaaaagcuaacugaagcaaacaugccuuagaacaccaaagcacaagcuagaggguggaaaacaugaauuagaacuuugucaaaaguaaaaucuguugugagaaaaggaugccaucuauaaugcuguaagacaguuuauccaauguagaaaccacuugcaaacuaaauauauccuaagaggcaugcacccagaguguccaaacaaaucuuauaauucaauaaaaaggcaacccaauuaaaaauggacaggaaaaauuaaagaccaguauaggugucugucaguauaugaaaggaugaagacauaugguacacauguacacaguagacuaucauucugucgggacaaugguuagaacgggaguucauguuaagugaaaugaggcagacuuagaagagcaaguaucacaucuucucuuauauauaauaugagaaacaaagguccucacuucauaguaagagcacuguagacucguggaaacgaggcuuuuauuuuaugauuuugcagucaggcaucagccccaaauggcaggugagcugacuggagcaaagaacaaucuuuauaacccugaguucaugguccuuccugccuuucucauuaucugaguaaucggggagggguuauaaaggcuuacgugucaucuaggugucaucuuucccuguccccaguguuuuucuuuuucucaacagaaccauguguggcacuuuacauccuauuuauuuuaaagccuaacaggcucgugccuugcaggcaagcuuggccauuaguaauuuucuucucugaguuuuuaguuugcuugcugauauguucacaacuagaggagagcaauacaugcauguacauuagugcuuagcuuguuuucucuacucuucuaugaacuaggauccucugccuaggggauagugccacccacagucggcuguguucucauuucaauuaauguagucagguauguuuagauaccugacuacauuaugaauauguuuagagcacccauuuccuagaugauuuuaguuuuugucaagcugacaauuuacacgaaucaucucucucucucucucucucucucucuccuucuagaaacugagaaucacugguaugaaaguucagguagaacuggguugucacacagugguagacuuaacauuuauaagccuuggguuugauuccuggagccaacaaagaugggaauaagagagggagggugggaaggucagcuagcuggacuauugcuuccuugugcucuguacccauacugccauguugccugcacagccacaugacauuuggggagcuuucuacagagucugauauaagaaucauauuccaaggcaaacuuguuugaccuuauuggaauuucaaacucauuuuucauggugaccuugccagaauugucaagauugcauuacaugucaaauuuuugcucuugucagaauagaaauguuggcuccuucuugggccaucuguuguacacuaaugguuuugauuuauucuuugucucccugauacauauuaguggugcagauuuauuuuuuuaauuuuuccuguuguuuggucuguaguuuuauugcauacauuaguggcacaaauaccacauucauuuuagcuauuucuacugacugugucuauuugggggaugaguaaugaauguauuugcuuauguuuuuauuauggugagcagcucuacguuauuuaauaggcuuugcaugacgacauuccacuuaauuuuacuaccucuaauuuuuuucuugcaauuuuuguuuucaugguauuuuauuauguguguuuauauauuuugaugaauucaaauuuccuaauuauuucuucagugaguagacacuucggguuucuaaucaacaguuuauguaacuacaggaaaacaguauuaguugcaaauguuguggauuuaagcaguaacuuugacaugcccacuccugacugcugcucuggcucauucauuuuugagauuuggcagcuugaaagauaguugggcagaggaagagauauauugugacaguagaaaacuaaagcguccggagauggaaguuagagaaaacacagagcugguuuuagaauaaggauggauguugguugguuuuuuguuuguuuguuuguuuuguuuucaaucugguuuccauauuugaaaaacaagccaucucaggaauucaguggauauaggccacguaugaaauguuaagaggucguuguugucaguguuggccugauacgcaaaccucugguucccagcgggucaucccaaugcaggagagcugcuuggugcuguacuugaagccuuugcugacugagaauucucauucaucgggaguagcuauucuagguauuccuuccuaucacagacagacgcccacacugagccggaguuuccucauauaggagaagcuguuucaucuaguaugacaugaacuggcuaagaggagacuugaacacuguguguuucauccaauuauuaauaauuauuucacuugccagcuuuugauguaaacaucagggcuuuguuuuuaagacuaagucuggugcucacuuuggcagcacauauacuaaaauuggaacgauacagagaauauuagcauggccccugcgcaaggaugacacacaaauucgugaauuguuccauauuuuuaaggagcuaaaggggucggcaacccuauagaaggaucaauaauaugaacuaaccaguacucccccagaacugugucucuagcugcauauguagcagagaaugaccuaguuggccaucaaugagaggagaggcccuuggucuugcgaagaucauaugccccaauacaagagaaugccagagccaggaagcgggaguggguggguuggggagcaggggagggggaggguauaggggcauaggggacuuuggggauaacauuugaaaaguaaacgaagagaauaucuaauuaaaaaagaaguggaaaaaaaaaagacuaagucuucuguucagaaucccauaaaucauacucacaauccauaugccauaauuucuaguuaccauuuuuaauuacuuucaguuauaauaagaacuuacagauuguuaaacaaugugguacaaacuuacuguguuuugugucacuuauagcuuugcaguaagaaaaauaaagcuaaucuccuuacuuugaucaaguugugugguuuuacuuaguuaucaguuuuauauaauacugaauacaguuacacucccaagucagcaauuagaaacucuaauuagcaagugguuuaauaaguuugugugaacucuguggauauguagaaccaacauuuguuaacucuaguugggucuuaauuuuauuguaagguauugucugaauuccagcuaaggaacaugccuuauacuuuugcucagucugucucugaugcuuucucuucuuuagaaaggugaaaugccuuuuaaugcuguagugugucuucauacuuggauugucuuuuacaaggugugugggagagggaauuggagaacuguauacaaaacugguguuuuggaucacguauuauggccgauacugggaaaagcugaugcuucguucucaccgugcagagcuuugaugcuuuucuaaauaauccaugggcguaugaggaacaaagcauuggcuauaauguuuguccacacagauuuaucccugaagacauccuguaucagcccuauacugcacuuucagaagcccaugugacaaugucuuaaaauaagcaaugagacuuugaauggcaguguugagguguauuccuuuuuagagcaauauccuuuuuugcauuuuccuuuuauuucuaaauagcucaacuuuuguuguaguugauuauuuuaacuaacggaauacaagcgaaacgacuuuguuaaaauccaucaaauuauaccuuggcuuuuccaaggcuaaaauuccuccaugaguucauuaauauggauuuagauaaaaugagaggggggucccuaucaagauguuugaauaauaaauguggcuuuucugugcaguuuaacauuaggaaagagauaguggugcaugccuuuaaucuuagcacgugggaggcagaugagucucugugaggucaaggccauucuggucuauauaguaaguuccaggccagccaaggcuacuuagugauacucugucucaaaacaaaguuaaugaagcuaucccugauggugccgaccuuuauugaauuucuguugaccaaauaccuuuaguacugauucacaagcagauacuguaacaaguuguuauacugagcucuagauuuugacagaaaauccgaugcaguggugaccuaggaaaaucaaaaugucaucucugucaccuaacuuuucaagaucuuacuauggccccuccgucaccaggcucccuuuguccugucguauugcucuguaauccucuggcucagccuccaucgcagagcccacuguggcuacuccagcuguacgccauggcugcuuucuagcuggcaggaggagaacucgagccuuccaucaucaaagaagugcuuucaccaaggccucauugccucaccuggcugcagaugagucugcuuucugcccaauuaaguaucacagguucuauuucuaauccaaaauuaucguaaccgaagagcacauauuagaaacaaaucaccaucuaucucucagugcacauuguuuccuccaagagaauaaaaaucugaauuucuagucuuuaaaacacucccauagcauagugcugaguaugugguaggggggcaugcuggguaaguguuuucuguaaugagucguagaagucuauaaacaccugaugauugauugaaguuccugguuucuacucuuauaacuaauaggauuaauguucuaaaucagagugauaugaacuccagaaaauaauucaaauuucauuguuggcuuaacagccauuucuucccaaagaaaguaagguaccuauuuaacaaagcaacuacaguccuaacuauaugugcaauauuuuuauauaaaauauugguaacauacuagcuuuggaucccuucaguucugaucaguaaaauaagcauuuuuaaguuauaggcuccaucuugugugacucccuaaauucuaucccuagcaaugggaaaacaaaaagcccaggcacacaccuguaagcccaacucucaggaggcagaggcagaaggguucugaccagcugcacugcauagcaaguucuaggccaacuuauuuacauagcagacccuuaaacaaggaauggcuaucccacagucuaaugagagacaaaacaggcuaacuuuaauuauguguauaaguaugguauaauucuuuuucauaaacaauagcauaauuuuuuacuuccugcuacaaaauguaggagacauuacauuugaaaaaaguccuguuuagaaacauccaggucuccaaaggaaacucauaauuaaaucugagccugacucuaacccgucaccaauaugaucuaaguguguuuguuuuuacaguaaccuuaauuugggcuugcaguuugaggguugcuuuguuauucaauuuagaacccaugaaacaauauuuuaauuauaggaacuaagcuauuuauaaauuucauaacaggaagaugagcaaauuguguuucuucuaggauauaauuuauuauauugcucucagaaaugugugaucuuugugucuaacaaugcaguuaaacaaaacaggaaaaggaaagcaaccucuuucuccagagcugggauucucucagacccucacucuucuucccacccuuggaaaguguguucucaugggauauggcucugaaucccacaaagugccgcaguuaccagaagugucuccacacaguucugguuguguccacagcuuggcauucguggucuagguuuuuccuuugcuuugcugauaacuucauuuaucagcuacaucggaucugacauuugaggaguucaugcauagggcaaguuuguugaaugaaugacagugacuauaggaacaacaaaaagcaacaccaaguagguucguucaacuuggguucugucuaccucagccuaacaugcuccuguaaggagcaauccugucagagcccuuaccccugugguaauuguauguguuuguuagggagaguuguuagcaguacuaguuaauaucaaagucauaagucuuuuaugaccaucuacaaauguaucuauauuuuccaaaacucuugaccuccccacuguucugcggccagccucuccuuggcuuguucuuacuuugagcagcuguguggcuggagaccuggcagcccagauacuuugaaucacuuacagguaaucaaaagcugucugucauguuguagaaauguagaaaacagaguucuuuaaauucucuacuuuaacugugugcuuuuuguggguguguguaugugcagaugugcuuguggguguaugcauugugugcaaaggucagaggcuagucucaggcauuguuccggggacaagguuucucguggccuggagcccuccaguuacgcuaggcuggugagccacugagucaaggacaucuuguaucucaccucccuggugccgggacuccagcacaccccccauaccuggcuuuacauagacgaauucugguauugaacuuaggucuucauuugcacagcaguuugcacuaccacuucagcccacacacauuuuagugugcuuuugucacagagagucucuaauagugcagcauuucaccuuaaaggaaagcacaaagcaggcagggccccagagcucuggacccaaguuagccuuuuacauuuuggaggacaaaagauucugucuuuuacaguuugaaaaugacuggaagccacguuggugucuuguaacauaauauaccucagcucccaucauucuauaggguuggaaacugauaccuggacagaggaugcagucuuauccagaucacacaccuauguaggggcaugacccuaaucauauauuguuaccaaaaucucggaguauuagaaaacugccacagugugucugacaguggcagccccaccucugaaaaauauguauugcauuaagauaauuuguaauuuauuucuucuaagccaaguuuauauuaaaaaaauuaaucuucaugaccugaguaaaaagcauaaaucuggaguguuccuagaguaaaccagucaucaugauguuuaaaacacuguucuuuuuuaauuguaggaucaucugcuauuaccagcuaccacccacaacaagaccacaagaccaaaaaugucaauuguauuaccagcaauaaacauaaaugguaaguuaaaauuuugauuuguuaacccaagaguccuuugcuuaaccaauauucucuugguuaaugagagggcauucaagacagucacucagacaaauucaaacauauauuauuuuggaaauguuucucacuauuuuauaaaaauauuaauuuaaauuucauuauucucauuuuaagcuacuuaucacacuucuuaagauuuaucuuuauuauuauuuuuaaaauuuauauguauuaggagagguuuaaacaggccagaagaggguauugggcccucuggagcuggaaugaaaggagguaguuguaagugagggcacagagauuccaccgaccuagaccacacuguggguagaaagaaaguuuaucugucagagggcagagaacagcaggcggugggaaggagagaaccuacuuauccgaguuguccucuugucucuacaugcauagcucuaaagauucucaugagauagccauacuacuguuugaugaaggagaauuuaugcgcuguauuguucauacugaucggucuccuucuccccucucuuccugaagaauaccacauuauuuaaguuucaaaugugcuucuuuccaagcuguggauuucccauguuauguuuucauaaagcggcucucuuguagcccuacccugccucuuucauuuccucuagcugcccuuauuucccgcuuucuucuuacaucauuaguguacccacuuugaauucugcaucugcauaccacuuugaauucucacaccauggcuucaccaauuagcacagccuuucuggaaaguucuucuacaaaguaacucuaaaaauaaaucuauguuucuaaauggaugaagcaguguuggacagaacgccucuaugcacuggaugggacgucgcuugccaagagugacuauggcuuugaugacugguuggccguugcauaggaagaaugucuucuauggauaguuugccucgguuacugauuguuuagucuguaugagccuucagaagacugcgggguuuagacuagagcggcuugcauugggucuuguaggauuuugauccuuccuugauacaaggagcugguugcagaacccacuguucuaacugaccuucagagucucuuuuucuuucaggaagaucucguucacucuuccugcuguguggcaaaaaaucuguuuuuacucaaacagaugguuuagcuuucaacaaauaaaaacuagaggucagcaucuacuuaagccaacuuuuuuuauaaauuguccuaacuuuaaaaaaucugaauacuucauuuuaugcacaucagagugggccuaucaugauacuggaaaguuaagauccgugcacuuugucagaauauugaaccauuucauagaaccucagacuccuguauuucaaagcuguucaauaagcauggcuccagcuccucuguggacucucugauguaggaccaacuggaagcacuagggaucauaacuuucuguggagcauugcguaguucugucggcacuugcauguuaauucuuuguuauuuaagacaucuggauacagagauaugauaagccagcaucuuuucaaagauguacauaccgaauuuuuguccacauuaggacauaauuuuccacuuuuauaguaagaguuacagagucuucaaagaucuauauuuuuagaguuuuuauauaaaaucuuucgguuuuucgagacaggguuucucuguauagcccuggcuguccuggaacucacucuguagaccaggcuggccucgaacucagaaauccgccugccucucccucccaaguucugggauuaaaggugugcaccaccaccgcccggcuuuauauaaaaucuuaacuaaauauauacuuagguguguguauguguguguguguguguguguguauguguguguguagacuugggagaaggaagaguagccuuuggacucugaaauacucaaagauuacuugccucuauauuuauuaaaguuuuacagaagcaaacauguuuuaaauaccagaguuagacuaaauaaugagacaaauguaaacuguaaaguaguuuguggccgaggaaggaauugguagcaaggccaugguaacaaucccuugaaagauaccuaacacccaccauguucuuccacccuucuuacuauagaggagagaacuguaugagaaaucugauccacuucucauuauggaaguauagacuagggcaaagaaagaccaauguccauggauucaagccauagacuaucaggauggacaaggccuuaguguauagccaucugugcuaauucccuuucaggguuuggauccccucugaaacauuuuguucaguggccaaccaguugagauauaauuacuuccagggacaaucugccugcuuuaaauagcuuugacaauuguaaauucuuccuuuucugucucuuccuuaauccaugguguuauagaugaauauaaucuuucuucugcaugauaaucuucagcuguuugcacauugcauacccuaugaaucgcuacauuccaagaccuaguuuuuagaggucuguucuuucuuuuugucaugucaccaggccugccucagaagccauuuuucuuuccuuuucuuuuuuugagacuaaaucucucucucugcuaguccuggcuguccuggaauuugcuaugaagaccagaaugaccuugaacucagaacugcuuaccucugccuuccgaagugcugggaucaaagacaugcaccauuauaccuugcuagcagccauuuuucuuuggucuuguuacuugcuuccaguucuggucauucucuguagaauagauucagucuugucauaucucuugagaaagcugaugaacgaugagaauaaauagaaguaucuucagauucuaugugguauauuucucuuuuuuucauuuauuuauuuauuuauuuacuuaguuuuuugagacaugguuucucuguguagccuuggcuacacagagaguccuggaacucacucaguagaccaagcuagccuugaacucacaaagaucuaucuaauuuugccucccaagugcugggauuuaagacaugugcuuccugcccaacuucuaugugguuuaugucuauuggugaagccaaugugauuuuuccauuuaauuaugauuuuguuuucugucaaauacagucuacuaaguuuucaugugugucacugcugagccaucuccauccccucuuccuuuucuucuuugcuguuuuuguuguuaguggugaugaugauggcgacgacaacagcaacaacuuggggcugaaauuuagacugauuuuuuuuauccugauuccuuuuuuccauuaaauccccuaguuaauaacuauucauguccgcaguguaacugcaguguaauccccuaguuaauaacuauucauguccgcaguguaacuuagccuugauaugccagaauaaugaacucuuucaauuuuguaacauucaucucacuuguaaucaaccaauaguucauuugucugauuucucugcuaaauuuuauguuaagaaccuuaucuggggccagcaagauggcuccucagcuaaaggcacuuaccaccaaaguaaucccuuaaacucacaugguuagaaggggagcaccagcuccuacaaguuguccucugaccucacguguaugcuguggcccaggcacacacaaaauaaagaaauguaagaaauguaauuguuuuagaaagaaccuuacuuauaugucuuuguuauuccuagugccuuacaaaaauaacugucaaauacauaaaaggggcuuaaguagaugcuguauuaguuacuauucuugugucugacaccaaauacuugacagaugcagccuaagggaagagagauuuauuaggcucccagaccaaaaagugccauccaucuuguuggagaaggcguaguaguuuggucugaggacagcgugaaucugucuacuucagcccuuuuggaagacugaaauaagccuaauguaaaccaagcauugccugcagaagccaguucaucaaggccuuguaugagauauuauggaguuugauuaauccugugaauuugaggagcuacuaagacuuugaacagggaggaagcaaaaccaguguguguagaagauaucccuaaggcucacggaugcaugagguguacagggaacauuaaagaggaggggcuggaaaagaugcagaggcagacugacagggagaagggcugcagacugcauccuccgggcaggaugcacucagccuuggcagccauaaccuugcugcagcagcuguggugccugcauugugucuacacaaaaaugaauugaggaggggcucagggguucccuacaccuuccugcuaaacuauuugccacugauagacucagggagagggcauuuccucaguugucuacccacuagugauccuauaagguucuaauggaucguuccaauccaguguucacacagauguccuugauuaaacuaaaugggucaaaaagagaacugaaagucuugaaucugggaaagaaccuguugagguauugaugguauuguuaggaggaaguuggggagggaagagaauaaucagauuguguuauauacguguuugaagcugucaaagagcauacuuaguaauacuuagaaaagauuucccuaacaacaguauaaaagauuguaaaggauggugcuuuuacagagacuacaauuggggaguuauccucuaggcaaaaaagaaacaaaaaagaugauaauucaucucagcaaaaacaauuuuuauacauaugaguuaucuauuuccuaauucacaaguugccccuaaaccuacugguuuaaaagaagagaucuuauccacccugugccugagggucagggagcuuagcagccugguucuagcuccagguaucucuugagcuuccaguucagaugcugucuggauccagagaugucccugggucuaaaugaugugccuccaaauucaccuacauggcuguuggucuccccuggggcugcuuauggcaucacuucccucaaagcaacugauccaugagaaugagaaagguuccccuccaaccucacacaccgccauuccuccugcauguuuaugguuaccuagaccagccacgcuugucaagucagaaauacucugauggauuauggagauaaaaaggacagaauaagucacauaaaaacuauucuauuagucauuucuuccagcuucuucuugccuagaacaaauaaauaaagcauuugcuucacuaaaaaccaaauuaaauccccacuauaaauguuaaauuccuuugcaauuauugcuuaguuugaugccauaaaauagaauaauuugguuccacuuuuguuuuuaguguaauguuguuguugcagcucagugugauucaugccucagagucaguagcuuuccugggaagcaggacacauggagaucauaaggagucguagagcugggaagcauagucuagcagagcucccugauagacaaauaaggagaggcauaaaaagaugcugggugguaaagagcggauccagcccggcuacuugaauugcugagacuagaacacauucuuccaggucccaggacacagcacugcagcuaagugacacagccaucuguucacaucacugaaagcacacagaagaacaacuuaguguuugcugagggcaaagauaaauauauuagaagcuauuucugucaucuguuggaaaaucaucucauugugauauugauuacugugugacucugagauaauuuaauacaugaguaaguacauaagaaaaucauagcacugcuacgccuuuuaugguuuuuuuuuaaagcaggagcaacuuacuugacaguaaaguauuuguaucaguuuuuuucauuuuaaagaaugagcaaggcuccaugaaaaggacugugagcgaauuaucagaaacaugaacugcacuguuggagcagucagaugguaggaauagauaaugcugaucacucacaauagucaugagguuuaaaguauuuuuuuaaauagaauguuugguuuuugagaauugcugacuaucuauugcauaguuuggggguuuagggguaaaauauuuuguuaauucaaccuuauuacaaaggauuauaagaucuuuuaaauuuuuguuaaaaguagucauauauauuaugacacauaaacuguaggguaauccaguaaaugaacagaaaguaauucaaauaccuuaagauccauaaaacuuuacuuuaagaaucauuuauaccucucuuccaggcccccgucugccccauccauaucacggcucuagcuaaagugacucacauugacucccagacuggacccuccaccaucuacccacaguagcuuuccuuuuccucuucuuggacuucaucagccguaaggggcuguuuuccaaccucugcaaaccuagggugauggcagaacacaugguaggaugcaggguaccacugaugauggauccuucauugauaguaauucuucuccugaaggcccagacccuugguaccuaaacuacaaugaggaucaguguugacgcugucaugaagcaucaauagauuaggguuuuaaauucagguuuaaaucuccccuuuuaagcacccacuaugugcauuaaauauauuucugcaucuguugguccucacagagacuauuacaagguagguauuagccauacuuaacuauuaagauaacuaagaagguucaaaugaccauaacuggacuucaugguccauugcaagcaguauucuguagaccgagccucucuuaagaacaaugugugagugagugaagacuguaaauuugucaauguuaauuugcuguuauaauugcggaguagcagauacuguguugcugaccucauccuccaugaugagaacaaagaggaagcauuucuguuccuaguaagacuugcucgcagacuagcuucuugcguguuuaaugauaagccagcuguuuucacugcguauuaaaguaugaagaaacacgaggaccauaaaguacagcuuuccugggauuuuaucuaauuaaagacuuuuguauaaauucauuccauccaaauuuagaagacaucaauuucagaguuugcuuacuguuccuuggcauuuaaacauacaaaacccccuuuuagaaaacacuuuccaaaaguaaccaccagccccuuccauaaaccagccugucccagaacaauaaaccagcucuguauucaaauacaaugugacauuuaguagagaaagagucugucugcucacauuuuugucuacauuacuuugugugugaccauuuauuuucccagggaaacugguucacacuaagucugugauagcugauaggaaccauugaaagaauugaaacagauaaaucuccucuuagccacccauucuaaggaccguuaauguugccuuuuuuccuccucuucuaacaguuggguuagcuccugcauacaguuaaucugugggugccuuuguagacaguuggcucaaaucacauuacugaaguuuucaucauuguguuaguagcuaagagauaccaagaugaaaacuauaugugugugcguguguguguguauguguauauauauauguauguauauguguguguauguauauauauaucucccaagaucuacaucaacucauauaugguacagaagaauauucuguauauuggaagacaaggggauaauguucauguauccacuuagccauagcuguggucuuugagcuaccauagucucuuggcucccagugagagaaacuguaugugggguuucugaccaaagagucugacuuggaaguucaaaaagaagaaagccauauggaugcuaguguaccccacugguuucacugaugcugaacccugcuuccagcaguaguuagagcuggcuccuacacuacuuccagggcuuccauaacuccaaagagauuuuaucaccuugcuccuuuguggucuaaagcuggugcaucugauuggcagagacguuuuaaucccaugaaagggccagaaggugggaacucuuaccugcaucccaggacucagcaggcuaagacaagauguuucaugcucaaggccagccugggcuguauaguaugacagccagaaagggaugggggugagggggacgacacacaagagcaucugggacauaaagcaucugccccacucgugucuacacucacuguagugcagaucugaguguccuacagugucugcacuacacacuaagauagugagacccaggcucugcuuuacaaggugggaugcucucuacucuuaggaagggaugccaguggcucuaaacuccucuauuaacagcauuuugaaucaucugagaagguuaaagaugaacagccagauagauuacugaagggagaaaugcaaugaguuuaguuuauuaucaccaaaaaagaaaagcgguuuuaugcaccauugaugaagcacagugagcggcugggcacugcuuacacauuaccuucucagauguuaagguccacaaccaucucugucuggauugggccagucuuuauaauguccagggaaauuacccaacucaaaugcaaaaggccuuuaguucucacccuggugagcccuuaaaccagguaugugacauaugagcaaguaguucaguuagugccuggaucuauagagugagcaagcugaagucaauaaucuuguugcuguuucuguuuucuuucgugguuugaggaaggguauugugauguaguacaagcagaccucaagcuuguggucccccugccucagcaucccaacugcuaaaauaagguaagucauuucuaaauuccccuauugguaccuaaauaguguaacuuguacaugauaggcuacugaaauuauuuucaacauauguugauuuuguguuuugugggcacauaaauugggcuggggacauagcucaguuaguaaauacaaauaaaaaaaugaaaaaguucaguccccagggcccaaauaagaaugccugguguacuggcauguguuuauaauccaaguacuggagaggcugaaacaggcaggucccugagauuggcuggcuggccaguugagucuauuuagugagcuccaggucagugagagauaagggggaaaacauccaaggaauggcacacgaacacccaagcacuucugccuucuggucuaugauucaaaggaucgucagaucucuaccuccuguuuaguuuguuguuguuguugcuguuguugucgucuuguuggguuaguugauuuuguuuuuagaguuguauuuccccacacuguaugguuugaucucacucuuugugagggccuuuuucauuuucaagucccaguaauuuguuucucagacuguaagcugcaccaaacccuacuuaaugcucaaggauucccuuuaugauaaagaauucuaauguuucuuucaaaaguuacuuuguuucuacaugaaauagaagauucuucacauuucaaauaaggauauuaguuguugugcuauccuggauccauuggagggcucuuguccugauuuccuucaauugauucagugacagguggaugcagacugcucagggaacauguucuaauuauauagauucuagaaguuguaagauccuucauuauuugccucaacugugcuuaauugugucaugcaaaguaaugacaaucuaaucuucuguaaaucuguuuuaugagcaggucuggugauagcuuuuaaagguaucauaauucugaauauuuacuuacuauaugauaguccaaccuauuaagagauaacauaaaaauuauaugauaucuccaagcauuguggcacacaccauuaaucccagcacucaggggcagagguggguaggucucuaugaauuuguggccagccugcucauucagauagauagauagauagauagauagauagauagauagauagauagauagauagauagauagauagauagauagacagacagguagauagauagauagauagauagauagauagauagauagauagauagaugauagauagauagauagauagauagauagauagauagauagauagauagauagauagauagauggauagauggauagauggauggauggauggauggauggauggauggauggauggauggauggauggauggauauauauaugaauaugaaucacuggaaggaaaggcuuuagguguaauuuuagugauggacaauuauuaccagaguagagggagacaagggauuuuaccuagggucucacacaugcuaggcuuuccuaggugagcuguagccucagcaauaaauguuauuuuaaauaaaacaagugcaacauguaaaggcacugcucuccuuaaagcauacuauaaccuucagcucuugguaacgaauugagugacccugaaugaacuugagcaauccguuucuucagaggggcuuauugaaguaguuucucaaguccugauauauuccuuuaaaaauugaaguccgugcuccuccccuugcccucuccuaguuccucuuaccccugucugguucucaguuguguuuccuaucagcucagcauuccauuggagcgcauaccuccucuugcuguucucaccucagcuccucacucauuccacagcuucuuuaccuuccuggaaccguuuuauccgccacaugccucauuccuucacuucuuuaauuuccucuuuaccgucucuacuauaaaguggcauucuauugccaccugucacaguauagcaaggaccaauaaaugcaagaaauaugauguuugaagaggauugaucuguagacuguggaaaagaugacacagauagagugugcuagucaucuuccucuugcugugacaaaauuccugagaugaucaacccaaaaggagaaaauguuuauucuagcucaugauuucaggucuuggccuguuguaaagcauuaugucauggggggggggcaguugugaaggaagaugcucacugcaugggaugaaggaagaugcucacugcauggcagccagguggcagggaagacacugaguuccaaauaucucuuucaaggacaaauaacaucacuuccucccauuagcuuaccccuaaagauuucaaggaccucuaauaguaccgucagcuaaagaggaaaccuucaacaaauggucuuggagaccuuguagaugcaagcuauaacauggcguuuagauggugaagagcauguaaauugauaauuaucugaccccaaagcaagucaggaugauguauacuaugucuccagaacacaugcuacaagcagaaggugggaaggaaucucuaaagccacauuuucugauaaguauugaauuuaaaaggaucuauucagcucuuugcauauugucuuauccauuuuauugucucuuccuuggagacuugcucuugagaaaugcuucuaucaugaauacaagucuacauucuuugguuguugaagagagugguuacuuccuugguuacuuugggauucccucuguuuagcagaggagaggcaugucuguaagaacuaacuugaaaacaucugccuauuagucuauuuaccuauuuuucuuuguauuuuccaugauauuuauaaaucccccuuuuuuccugccuccaccuuuggguagaaaaaucccuuaggucuuucaaagcaucaguauucacugcugcucugauagcaccuggcuccuccgauugccucuguagcuuacucagugccuaggcauuccucuagauccaugguuucuggaaugcauaugagauuuucuuucacaacuauguuauauucacaucuuuaugcugagaaugucucaggaaccauagagauacuguuguggguaagccaaccuggaacguagucuuccagucuacuaaacuaaugaauuuguuuuccucaggugugauuuaguugguucuacuaugacagcaaauaccagauaaagagaaaauaaacuuuacaaaguuguacaaagaacaaauguuucaugacagcagguuuggagagagcauguuuggaggcagcagguuugguggugacaguuggcaguuuugguaacaguugggcaaguuuggugacagcagguuuggagacagcagguuugguaacauuuggcagguuuggaggcagcagguuugguggcaguuggcggguuuggagacaguuaacaaguuuggugacagcuagaauguuuugguuuugguguucuauucuaaagugugaggucauuccaccgcugggaccacuaaagccgguucccacaguaacccacauuuugcugaguagagugggaccagcucccauauacgcugcuuuuuuccuggaacagcacuauguaccaaccacucccaggagacuccucucccaaagaauaguacuuccucccuacuuucauuuaagacaucuuuuaggguaaauagggauuuuuuuuacccccacuuaaacaaucuauguagccaaggauggcuuccagcuggcucuauagcuccauaccggccuucaauuuauaaucucucugccuuagccucucaaguauuaggauuuaaagagaucugauuuuucaaggaaucuuacagauacagcacucaguuguaaaaaagacagauacagaugaaauugucacaaaguucuuuagaugauuagguauuuaacuaaacagauucuuuuuuauuccauauuaaucacaagugaauguuuuaacaugaccaaugcucaugcaagaagccauaauuaaguuuguugggucacauaaaaaaaaaaaaccucacauauuugggguggaggcuuguuggagcuguaccagugcucacuacagcagcuguaauuaucacauguguaauuaugcacauacaugcuuaugugcaaggcuuguugggaaaagaaggguuucacuagaggaggaucagagaguaaauggugaaauugaccuuauauggcuguguggaacugucugaaguaaaugagagaaaauguuuaaaugaugcuggauuuugaaaaggcaguguuaaaauuauacugacuagcauguacuguaagcuaaaaggucaaaucauuaaauuguguaccaaaauacuuaguuugaaaagcuguccuaagaaaugaaauauccagagauuaacaugcauguucacauggacucuaagauacaugccauaaauggugcuguggccugaauaugcaaaguuugagccuuuucuuucagagaagagcuuaaguguggccaguucuccaccccagcccgauugcucgcagccaccauugccacucaggaggaccagcauacucuccuaaaaggaagaacaacugcaaggagacuucuuaaaauaugaggaacuuuaacauuucacuggaugugucugaguguguugccugcauguaucugcauaugucaugugugugcaaugccuggugaagccagagaaggacaauggaagcccuggaacugaaguuacagaugguuaugggugugagccuccacauaggagcugggaacugaacccagauccuaugcaagugcagcaaguccucuuaacugcuaagccccaucuccagcuccaguaagggaauucuaguuaaucuguaacagcuuucucaaccucaaggagauauugguauuuaucauguuuugauuguuaccucuucucccuucaccacagacuuuuuuucuuacuuuuaguuuauguguggguguuuugccuacauauaugucugugaaccacaagugccugucaucuaagaagcccagagaggggguuuguuggaucuucucauuacagucaucugugaucugacauguggaugcugagaaucaaaccuaggucuccugggaaagcaggcagcgcucuuaacagcugagccaaaucuccagcccugcuaccucuucuuaaaaggccacagagcuugcucuucgggggaagcauccagagacagaccuaaggucaaaucugaugcuuccacuucacagcuauguguucugggaaaauaauaugaacaccuaauauacagauuuaugauguaguaauaacgggcccugcuugguaccucauaagguuuuaguuugguuugguuauuguuguuuugauaauguccaacuuuauuuuguuguuguugagauagcaucuugcuauguaguuguggcuagccuggacucacuauauaguauaggauagccuuaaagucacagagcuccaugguccucugccuccugagagcugggauuaaaggaaugugccaccaugcucgacaguuauaaagucuguuuuaaggauuaaauaaaguguguauugguucccuucuuguuuuuauaaccuuucccacccaucauuacuauaagccauuaugcucuuucucauaaaguauuuuauugcuuuuguaugucuaguugcacuagguccugagcauacguaaccacagcagugugcauggcuguuacucaguaguguaaccaaacuuagcuccaauaaaaagcaguguacagacugaaaacagcgcaggaaauguagcaaauucuucaguaaucccucccuaacccucuguuucuccagaaccuuuccaaauagcccauuucugaacauucggcaguaggcugagccauuguguugcccaaaaagucacgguugaccugagagccugguuuggagauucuacuuuguacauuaggcuuauuuucccagacaaacccaaacuuaacagagugugccugucacaucgacuggggucuccuuuauacacugggcuucugugggaaguguucuucuguauuuuuaucuuaacugucagauaugagucagcagcagaacucuagcuccugaggaaauaaauuagaacauguaaaauggagggcugacucauggguuugcugugauggagaggccagccccuccaucuguuucccaccagaacguccuaguccaacaaaucucaucucuuccaugucucccuucucuggagcccuucaauggcucccuacugcuaccgagauuugucugaagcucuguggacaccucuucuccccucugcgcgucaucgcccccuucccgccccaugcuugguuccucugcagcaccucacacagugcaccacccagacgggauguguuuccuccacuuacccacccagaauuuccccagcucaaaagaauccuccaggucuggcuucagugaacuuauucagaaagccuucuugucuccuuucuaucgcccccacugccaggguaggcagcccaccuccuuguucucccugcccuguacuccuucccaucucacacuuagccccucuguguguuuacauagcugcccguuuuacuagauggcaagugcuuuaauugagggccaggucuuacucaucucuguuucuccaacacccagcacauaacagcugcuguguaaauauuuaugcaauugaaucauguugaucauaggaacaaacuuucguugggagaacauaccuguugucuuaaaagucugggggaaaauuuauuucuaagacccuacuaauugaauaugcgaguuauauuaaauugggaauguuagucacugcuuucaaaauaaagauuaaauuaagcauauuuguagcuuuuuaaagauugugucauaucuuagugcaagaccccaaguagugacuauacuuugguuguuuaggguucaugaugcccagcugcagaguaagguguuuguguguuuagaaguauuuugacugggugagcuaaugguaugaaaggaaaaagccacuguuggucuggaggagcaguuagguacccuucuguugccuucucuacuuuaaaguuuuuuauucccccauccccaccccaaguaaaagaggcucuuugaagaaauuuauggccuacacuuucuaagucauaaaccaaccuaguuuucaggcaguagcuugacuucuguggagaguaacuauaacccauauaaacuaugcuauuaaccacaacccauauacacuaugcuguuaacuauaaccccuauacacuguacuguuaacuauaacccauguaaacuauguuguuaaccuaacccaaauauaccaugcuguuaaccauaaaucauacacacuaugcuguuaacuauaacccauauacacuaugcuguuaaccauaacccauguaaacuaugcuguuaaucauaacucauauacacuaugcuguuaaccauaaccuauauacacuaugcuguuaaccauaaccuauauacacuaugcuguuaaccauaaccuauauacacuaugcuguuaacuauaacccauauacacucggcugugaauccaguugcuuaacacagaggaccccaggguuuucacugaagaaacccagaaaacaacucaaugauucagguuuuaaaaagaccagaauucaagaagcugauuaggcaaauuuauuuuuaaaaugaaagaaagauaggaaacuugccaaauuuuuuaguguuuuuguaacacuaaaugggcacuuaagaaauauaaugcuuuaaugcacuguuuucucucugaaacuguuuguacugugugauagagaucugcugcugcuucaaguuagucucccccuccccuguucuuucccuaccucccguuccccucuaccuccucuucucuucuuccucuccuccucucuuaucugugauugaaauaauaauaauaauaauaaguauaaguauaaguuucuggauacuguuuuuaggacagacagauaaaucuguuguuuuccaauauagccagugcccugaguuguuuucacugugguaucuucacucucagucacacuugugugagcaguaggaguacugcagucuuuaacacagugaugucacaaguguucaccccucaucccuucaucaccccaggaaagcaguggcccauguacacugaugaacaguggacacugcaucgauuuccuccacagagcaugaagcaggggaaggagggcagguuagaccccagcaucgcugaugcucagagcugcuaccugggcccugggaugcacaggcacuuuucacuccuugcuguauugaaaguauguugcuugcugccauuagaugcuuggcauaacuaacucuugauguaaccauguaguuggauacuaguuucucuuuugcaguuacaauuacaaacacuugcuagcuaguaacagaaagagcuagccuuuagauccauaauggauugugaagccuggcauuuccacuccgccacaucaacuccacaugguaacaguacucagguuuuacaccuuagaacauucuggaaaccuuccauaaguaccaucacagugaacaacuaagaacugugcaaauguaacuuguuacccuguaucuugaaauaaacaagcuguuagucagaguggcauuaugggucauagccugagcuccuucugcucagucccucccuuugccucucaucuaagaaagcgacucagucuucgaagccucccuauggcucagauccucagggcccucgugcuguuuucucccaacuugcuugauugucuuucucaguucuguagacccugaccaaagcaguccucucaguggcuuacucugcaugacugucugugcuucccguguagccuguaccauuccgugccuuccuuuaccccuagccacccaucauuuucaaacacuauuugcuucucuuauuuccugucuacucuacccucaccauuagaaugcaaagucuguaagaggaaaccuuugugggguuuuucccuuucaguucgaacaccuagacuaggcuagggcccaauagugauucaguaaauauuuaaugaaugaaaguagacuagaaaguggaaguaaagaagcuuuuucuuaaaaugauauguccugaaaguguacgaguuuaguaacccuagucuucugguccacauuccaugcuucuucagcuugcagucucauaggcuaacauccagaaaaagauucaaaugauaauauaaauaaaaccagguuaauugugaauacuuuuuaggugauuugcaucuuaaguaauuguuccucaguuacuauacuauggggauguaggcuagcccuucuuuggacugucucugagaagcaauaauaaugagaaugaauuacagaacuuaaaauaaaccugaagaauuugugggccugauuccuaaggucuaaaaugagaccauaugucauuucuaagacuggcacaauucuaacgugaaucgucacaagaaugugugaaaugcuuaguuuucuuuauaacucaguuaauucuguuuauaagguguucugcuuauucuggugauagacaauggauauucuauaacuucccuuaaucaacauguguuugaguuuccccuucuaauguacaaaauagauuuuuuuucuuuugaccucgcuauuuuauacugaagacggcugagcucaugcagccagguuugccugccgcagggaaacuccaagcauugcuuccucuggguuacccacaggccagacaagccagaaagcaggccaggaaacucaggcggaacaggccugucuggucaggaaaggaaguaugucuacaucaugucccugcaucccuugccacucucaauuaagaauauaccccuguaagccaggccgguggcuuuccaacucugcacagauuuuggcaaauaagguuaaacgcaguguugacaucucagccugguuaauuucuuugucagaaauuuccuugagagagaauaagauccaguucccuaaagauucuguauccuucugagcaggaggcagcuuuccacgcuugugucugaauaggagcugucaggugcacagcuugaguaaagaguguggucuuccuaugagaccgcugcuauggcuucagacacagugacccugcagcuguggcaacagaacaagucugagaaaggaagaucccacuuaguuacugaggcugggacuugauccguaguuuaugcuaaacucguacuugaaaauaaaauggcagcacccuuggucacccgugucuuacccuguuuccaucagcuccagaaggagcuauucuuuugagcacuuuuauauaugugcggaugggguugagacagcucuguggauuuuuuuggacagaaauguccuuaauuuauuguagccauuacuucugucacuguaccagauaauguguuugaacuuagucuuuuucuaaaacgccacucaauucuuucucugcucauucuagaaagacuuuuacuggaagaccuguaauuaucccacaaaacagcaauaaauauaaucuuaaaaauaaguuuaguaauuucuguuagaugugauaaucuucuacaauguuucauaucccauccugugaaauguuauuaguucuucucaacccccuuauauauuuagucuaagaaccugauagcaaaucacuugaagauaguaacuguuauguaaacguuuguacccguuaccugcaugcauguguguugguaauugccacguggacuagccagccugcuaacaacacuuuacucugauucugccuucagaugcucaguccccagccaucugcauuuacauuacugguguuguaucccaccuaaguuuauuuuauuuuagauguauuugucaaguguuuugucuguguguauguauuuaaccacauguguaccuggcacccaaggagguagagaggguguuagauccucugaaauuguuauuaacuauucagauaacagcuauguggguucuggaagucaaacccggguccucuaaaagagcagcagugcauuuaaccagccaccccaccugaauguuuuaauguaaggugcccaaguucccuagucucucaccugcagcagauuagagucaauguuaggaacauggguuuggggcagggauguuccucauguauuuuaaaccuuaugcuaacccucuugggagauagcugucuugcuuguuguugaguuaaugagcucuuucagcaacuuugaggaaccucuaugaagaucagaaauucaaaugacauccuugacuuuuuuuuuuuuuuuaaucuuaauggugaugauuccuaguuaccaccaggaaucucugggcauuugcccuuauaacucuucucauucuguuuggaaugcauuccacaaggaccuggagaguggagcagacccaguuucuuuuuuucagcuaugacugucauuuucacaggugaccgugaggcucaaaguaaccauauuaaccuuaaggugagagucugcccagccugcuaacaagauuuugggggcucaacggauggcucuggcuccacaaugagagagcuagcuacauuaauauaaaguuuauauuaacucaaaaagguauuuuuaaaggaaucaacauuguuauaaaucaugaguaaggcuguuuauauuuuacacaaguauguaucaaacuucauagaaauaggaaaguguuuuuuaauuuauuuuuauagagaucagaaacauuccauagucauuaaucauauaucugagccucugagagaagguuuguaggcaggcacuccuaagguuucgguaugggguaucgaauagugccucaguuuuacucaguacuggccucuucuagcuucggucagcagccucccacuuaccugagcuccauggagaucguucccguagugcuuugcuauacugcuuuccagcuguagaaaaagggaaauucucguucuuucccagaauggguuguuuucugauuauuucaucugcaggagugagggcugaaaaugccacagugagcugcagccauuggucagacuaagacaaucaccagcuguuucuuugcuggaaagugguaucuaccuuagcugauaacuuucaagaguuaaaaacccugcaugcuauauaagauaaauacaguggggauguauuaauuaaucaauuugcuuuacauugugaucacaccuuccucucccucuuuuccucccagucccucgccucccuccaaagaagcuugucaaguggaccaggagcaucuucuccugucguggcaacagggcagcccaguuaggggagagggauccaacagcaggcagcagagccagggccagccaaugcuccugcuguuaggggccccacgugaagaccaagcugcacauuuguuacauaugugcagagggccuaggucuguccuaugcaugcucucugguuggugguucagucucugugagccccuaugggcccagguuaguggauccuguagguuuucuugugcuguacauaacaucuuuagcuccuucaauccuuccuccccucuuccacgugauuccccaagcuccaucuaauguuugucugugggucucugcaucuguuuccaucaacugcugggcgaagccacucagaugacaauuacacuagguuccugucagcgaauaggaauaucgugaauagugucagguaggcucucucuuaaggugggucucaaguuggccauucccucaauuucugcucccgcuuuaucccuacacaucuuguaggcaggaaaaauugugggucuaagguuuugugucuggguugguguccccauccagguaaugggagguggccguuucauguuccguauccccuguugcuaggagucuuagguaaguagucacccucagagauugcugagcguugccacugucccagcguccuagcuugugcagagaugcucuccaucugcuucccguucucucuccacccuugacccuccuguucccuccccauacccucucccaccauccaccacugauggcuaauuauuuccccuucucaaugagauucaagcauccuuccuugagcccuccucgggacuuagcuucuuuggggucuguggauuguggauuauccuauacucuauggguacuagauauauaccauguacauaggauacauguuugucuuucugggucuucauuacuucacucaggaugagaguuucuagucccauccauuuccugcaaauguuaugaugucauuguuuuuaauagcugaguuguauugcauuguguaaauguaccauauuuucuuuauccauuguucuguugagggccaucuagauuuuuuccaguuucugggcuauuacaaguaaagcugcuaugaacauaauugaauguaucuuugugggauguuggagcaucuuuuggguaaauacccaggagugguauagcuggguccugagguagaacuagucccgauuuucuuagaaaccacuaaauugauuuccaaaguggcuguacaaguuugcacucccaucagcaauggaggaguuccccuugcuccacauccuuaccagcaugagcuguugcuugaguguuugaucuuagccauucugguggguguaaaauggaaucucgucaacauccucagucaucagggaaaugcaaaucaaauauaguguuuuuuaaauguuagaagaaaaaccuuaagugacuuaguacuugacugcauuucagcuaagaaugggauuggagaauuguauuggcuuagcuaucucagaucucagcguguuguuuggauuuauagauuauugugcuugguuuguuuguuuuuaaagauaaggacuugauauuuaguccaggcuguccuggaacucuugacucuucugccucaaucucugaagugcuagaauuacaggcacauauccaaccugccuugccauuuguuaauaagacuugccugcaagaagggaaguguguugcaaaacaguaaggggcauagaaauccagacauuuuucugaagaccuguuugcuugguuuugcuuauguaaaguuguccauuaguuguaaggaacugggagaguuaaacacaugugggcacauacaugugcucacacacauauacaaaccacacauaaugugcacauguacaaaaacugaaucucuaggauauauacuugagguggcuuucuuucauucaugcuuagcacaguucucuaaguacucguuucaacuuacacucccugucugccagcuuccuuugggguuauuuccacacauuuauguguucagugacuguugauaaaugaauugcuucuguguacagcaaggguucagcauggauaaaaacucggggagcugacuccucccagggauuucucuuugacguuaggccuaccaugucucugagaaaccucaggaguuugccaacucccauccuccagaccugucugugugcuccaagaggcuguguaccuagccggguguggaaaggaaggacgccaucuuucuuagaaguuaaaggaaagcaugaggaacaguaguauuugcuguuauauaaacugcuuccuguacauuucuguuuggaagaaaauuaaugagguuaucuaaauuuguaauaucucauucauuuuaaccuguucaugggcguuucuacuuuugaauuuuucugucauuauguaagcacuaucauauauucauacauguaacgauacacucacacacacacacaaauauaaacaguuucuuacaccucucagaauuuugaaccuucaugacucaaaaucauuguaugaucuuuaccuuugcuguuacccaguccucacagaacauuuugccaggacagucuuggugauguccuccugacuuucucaccuuucuguucuccgguuucuucauuuucuucuuauacaggccauguugugaaagucugcacuuggguucauuuuucuuugcacaucacaccagagcuaguugucuugucacuacugaaauggauucuggauccaaauauaaagguaguaucggguguggucuuguccucuuggcaagcauuuccugaauuucugaccuggauacugcugccuucccaaggggaaggucccaucaaugaugguuccuuuccucugagguagauaguuggucaugaacucuaguacauauauuuucugugucauuuccugauaauagcagauccucaagaagccaagaagaaaaggagcccaaacauguuacaguuauauuuuaugaauugaaaaaaaaugccaagauguuugauaagcugagaacaguuaguccuacuaggccucauuaucuuuuaagacucuacagugcucuggaauucuucaucacuaaucucauagaagccacaccugcccaacauaguggguagaaauauuguacaggucauuucaacauucuggaaaaaaauauaaaauucucauucauugacuuuuuuuuaaaugcaaguaaaugaggcugggcauggugucugccuuuaaugcuagcacucaggaggccaaggcaggcaaaucucuaugauuucaagauuagcuucaucuacguagugaguuccaagccagccaaaguuacaacauaguaagacccugucucauagaugaguggguggauggauagauagauagauagauagauagauagauagauagagccauugaacauuauuacuauuaguaucugauaauauaugagaagaaauauucaaacauuauucacccauuaggcuccaguuuaaaaaaaaacaguuaaauuuauauaguauuccucaagagugcagggcaggggcacaauuagaagaaccaccugaacaagagugacaugggcucuugggagguaguauuuuggagcuguugucuuuugguucuggguccucacugucacugugcaguuuaaucaggauauccucugauggugagugauucugauacugaaagagaucugauuuuuuuuaaaugauaaauucuugacuuuucuaaauuuagggaaaaauaauauuccuaacucaaccuaaccugauagaauaguuuuaagaauagcuucuguagccgcacuacccaagucaagaucuacuuugccuuuuuuccagcuaacuggugaggcaucgaugucugugguuuaguugcuuuugucucagaaauggaaacaauaacagugauaaucacaauuauaucugaucuuagaguuuaugagaacaaucaauucggucaucaguguuuuacauauagaaguauuuauuaaauagaucaacaaccauguuccuagaaauguaauguauauuaagcacauaugaaaauuauauauauuaaaauguauuaaugaggcuuagacuaauauaguaauaaugggguguuuguuuguuuguuuugcuuguaccuaguaguaaaucaagaccacuaaagauguccuuugagguccaguggaucuuauacagucauuauuuuaggcccacauacauguauugugaugucauuucuaaucuaacaggacaaaacccuuugcuguucaaaaucccuguugucuuguggcuauaaaccuacacuauucaacaaauucuaguuuuguuaaaaucgaaugugugauauccgucccccacccccgguuuuuucucugccuuugaacauccucaauccuaaagucuucccaucagagaaacuuguuucuuuuggcaaagggcaucugugacaguugcugggaacucuuugucccuuauguguucuuacaucuccagauacuuccuguuggaagugcuggcugugucgccaucugcggagacaguugcucagucaguguucuugccagccagugagggggaccuccaggcucacuccccauaucuccuuuaauuuuuaccccacucccaccuuuuuucagcuauuucuuaaccuaacauuuuuuucuucuuuucugugaugaccuuaacacaguuuaauaaaaugggucauuuacacauugcuuauaagggcaaaugucggcucuggaguucucauggaagguuuuuuaggagcugauacucaguguaggccuuacaggaugauuagaauuggacuagauagagaaucugaguggguaaauuagcagaaaagguuuccccguuagucaaaacaccuaaaaccaggaccugggugacaauuagaaguauauuggcacaguaaaguuagacgugagaagccacaacaagcagaugucauuuuagcucaucuuuauucuuuauucauugugcccuggaucuuguguuuuuauugagguuuucuccuguguccccagguaaaguacaguucucagcagcauagccuggcaccgaccagacuugcacagagcaaacuccuucauuaggauuggugucugagucuagaugaaaaucugucuuuggcucuagagagauggcuuagcaguuuugggcacuagcuguccuugcauaguacauaagcucauuuccuaacuuccacacuggcagcuccaaaccaucaugacucuaacuccaggguaccagucacccuccucugguugcugcagucagcaggcacaccaacacauagugcacagacacacagguaaacaauugugauggccuuccugcuugucagcuugacuagaucuggaaugaacuacaauccagaauuagagggcucaccuaugauccagaucuuaaggcuggaagacacaaguuucugaccuggaucuuggcaaggagaucuugaggcauaguggcuaugaaaagcuuaggcucaggcaagguaguacaugccuuuaaucccaggagacugaggcaaggagaccucugaguucaaggucagccugggacacaccuucuucugauacugccacuuccugagcagagcauauacaaacugucacaacacucauacauauaaauaacauacauaaaucuuuuuaaaaaucucucuuauauacacuuuuuuacaaaguacuaggcaagacuugucacuuuuaaaaauucagcuguauguaaauuuuuggauauuuaguucuguuuacagucaggguucugguuuuuguguugaucaucuagcaacaacuagccccuggcauaccgugcuaguucaguuauuguguguuuacaagcuggucagaauuccacauugccuggaauuuuuccacccucgguguucagacaccuuuccuggcuucccagacccuuccgagcauucagaacacauuccaugccuccuuucaucucuucuccuuuuuauuugccugauggauuuuaaauguaaaauacccaguuugugcauuuuaccagacuuggaucaguguucugucucauucucuauauuucaaaaggccuagcacacaagauauuuuuuaaaauguugcaguuuccacgguucuguugguagaagcauaaacccagaacgccuucacucuuuuuguggucuguuuucccagguagacaugauuuguuuucuuucuuucuuuaguucauucauucuuucuuuuuaaauuagauaaauauuuggaguggggaaaagcuuaugagucuuuuuauauaaguugguucugaauucccuaaccuaauguuugccaugcucccuaucaucaggaaacccgugacuuucucuuagagcccuccacaugaacagugaaaacaucaucuuuaaagggugugcugugucucagcuguucauguccuaacccaguuucucucuaaggacccuuccuccccugcccuucuaagucagucgucuccagacccucccucagggccugcuuugaucacuguagucacacugaggagcaaacuguuggcaucaguugaagcuccuguccuuccaggaugugcucaccuggugucagggcucaaggucuuaaaggaguagcaggagccucaccugcgcccgcugcucuggaugcccgcuguguaaacagaggccuagaggccagcgcuaguaagacuuaagcaagaucaacuuacccggaagccuccauggugacucaaccuguaggcucagcauugggaaggguaaggcaggagagaugccuugaguucaaggcuagccugggcugcagaguaacaucuuauuuuacaaagaguuaccaagagccuguuuuuuaaucuguccucuuuaguuguagcaauuucaaacaucauaaugauuggugagccugcucacuuaccaugcagcuggguuacacgaaacccacggaaggaggagccuuuuguaagaccuucuagagcaaaccagugcuacagacucuaaucuuuaaagauguuggcaacauuaugacucuuacuugccauuaaauaugaaugccaaaaaauguaugcagacuguauugcagaagauauugucuuccaagauuccuuugcguucacuuacuguccaggucugauacagucuuccagcauugcucccaauuaccauggucuaguacuugucaccaccaggagggaguaauggacagaauagauuguaaaacuccgagccucuugguugggcuucauauaacaauaccguuucaguugcuaggagcuccuugguuuggaauccaauuugcuacuucaguuuuccuucagagcaucuaagcuuguauugcuaagcccuucauuucuccuugauauuuaagguauucaggaacucuaguuaucaguuuaaacugcagcagguauguggaccuaaugucuucuacaggugguuuaaaccauauuagagagcccaguccuguucuuaaacugucaucuggauucugaguuaauccaaaaaaaaaaucaguaauauauauuucaggucucugacauguguuuuccauuauuuggucuucugugcugcagugcaugcgugugugugcauucauacacagaaagacgcacacaggggccgugguuccaaaaggaaaugacugguguggugccuugaaaucugaacuuggucacauguucuaaaugaaaugauuccaaauacauuagcagaaugucuuccaucuucuacuuucuggaaaauaguucaguugagaaacacuggcuaacuucuagacaucgaaauguauaaagauaaauaauuugaaagccauugcguggaggcaugucuuggaaaauuguuguuaagcugcuauagcaauggccuuaaagaaaagguuagugcacagcagcaggcagcuguuccucaucgcugcugcggcugaaaagaagaagguuagcuucacuugccucaaagacacagaggggaguauaagggagccuuaucaucuguggaaucgguuggugcacuggggaagauggcugaggucagaccacaggcauacuuucccuuggauuuaaaauagaagaaauggaccauagacuacaaaauauacuacaaaacuaacaaguuacuugauuuaucucagguuuucuuucuuuuuuuuucuuaaccccauuaagaaucugauaugcuuuguuuuccaagacaaauaaaaacuuuucaugugguuucagagaaccuauagaaguauguguuagaccccuuugaaaauaccccagacuagaugucuccagcuuucccaccuucuucugugacaagcucuauggcucacuuuccccaaacggacucugaagaucagaugucaaacuuuggguuuucuuccaaagugcuugacuuguauaguguaaaaguucaaagaaaggauaauggacagggaaaaaauuacuuuuaaucugagcucuuggucacuaaaaaguauuuaaauuuaaaaaugacuauuuggcucugcaugaucuuaauagauagaaaagcagugugaaaccaggcucuccccgaaacccagcuccagauucacagaugaaaccgcagcagcucagaugccacauuggcuacacagucuucuuccaaguucucugagcuucugguguagcugugauuauucagcugggcuugagaaauauuauguguuuauaauucucucaucauuucauuuacuacaaguuggaaaaugaccacccacauuacaaauaagggaguaauuuggcucuguccuaaaauaaaaagcuuccauccccguaggaagcauggagggaguauagcauguaucugaguaucuuacauucaugaugauggagacugcaggcaugacucaguggcugagggcacuugcugcauuuccaaaagacuuuuccagcacccaugucaggugcucagucuccuaacccuaguuucagggaauccaauucucuucugguaccugcaucccugcauauaugugugugucacaucauguaugcccagacacacauaauaaacaugaugcuaauaaaucuuuaaguccaugacaguuacccuguguagauauuuagcuggagucccuguuccuucuugcagaugcuacuaucuguaagagcuaagcacacagaaucgcacuugucucauaggcauggaaccaggaacuccggagaugucaguugcccuacuauaguagugaucuagugaaaaaaguucauaaguaucagauguuaugaugucuucccuguuaaguucacaguugggagacucuaauggaauuagaagcugcacugguggggcuggcaaaauggcucagugguuagagcacuggcacuggcugcucuuccagaggucuugaguugaauucccugcacccacaugguggcucacauuguaacuguuagucccaugggauuuucuggcaugcagauguacaugccgauaaaacauccauauauaucaaauacauaaauacauuuuuagauuauacagguaacaagggcuaaccuuccugaccauuuacauuguuggucccuuucacaguuccuccuaucauuguaaggcaaaaacggguuaaacauucuucccugugcucugcucugcauugcucuaaacccucugaucccacugcuuugaaaaugcagcucacugugugaaaagcauacaagacauggugucugcacaccgguaugauguggcguuagcuuugaaaguaauuccagcccuuauuuaaaaaccaaaaauagcacuuucaguauuuuacaaaagaguguauacaguauuggguuucauuauagcguuucaugcauucuuuguuucugucauuccuauucccuuaccccacgucuccuguccccacuaccuguccucuuguucuuccucuuccucuugccaggggcccuacaacucucaagucaugugcguccugcugcucuuucccucugcccuacgcccuucucuacuuccauggcucuucuaguuucaugacauguacaccccauacacucacacaccacacauauauacauacauuuaauuaaaaucuuagauuuauauaugaaagaaaacaugcagcaguugucuuuuugagucuggcuuauuuuaauucacauaacaauuuguaguugcacccguuuuccugaaaugccacgauuucacuuucccccaguggcuaaguaaaauuccauuauauacauguacugugauuuaucuggugauuggcaucguagugauugugaauaauucaacagcaagcuaucucugugguagaacucagaaaccuucuggaagcauauuccaauuugucaauucuuaaaacuauuuugcugcugauggacuacuuucagcaaguucuugccuaugccuuugucccgaagugguuuuccucuaccaguuuuagcuucucauuuauuuguuuuauuuugugagacagggcuucucuguguagcccuggcuguccuagaacucacuuuguagaccaggcugaccucgaacucacagggauucuccugccucugcuuccugagugcugggauuaaaggcaugugccaccacaucuggcuugucauauuuuauuuuaaagucuuugauauauuuuaaguugauuuguuguuguuguuguuuguuguuuaagguaagagacagggaucaaauuucauccuccuaugugcagaaaacaaagguuuugaagaguuugucuuguuuccaaugcauauuuuuaauacucuugccaaaaacagggucucuguagcucugugggcugguucugggucccuuauucugcaccauugcucuguguaucuguuucugucccaggacaugcuguguccacugugccucugugguagaaugggaagucagguacugugacagcugacauuauuuucucugcuuaggagugguuuaacuaugcgggcucuuuuguggguuuccuaugaauuuuaaguuauuuuuucuacuuacguaaaaaaaugucauuuaaauuuuggaaucauacugacucuauagaccacauuuggugauuuggucauuuccauaauuuucuguuaauucaugaacaugaaaagccuuucuauugucuagugucuuuaguuuguuuguuuguuuguuuguuuguuuguuucuuucuuucuuucuuucuuucuuucuuucuuucuuccuuccuuucuuucuuucuuucuuuuuuuaauuagauauuuucuucauuuacaauucaaaugcuaucccaaaagucccuuauacccuccccccgcccugcuccccaaccuaaccacucccacuuccuggcccugacauucuccuguacuggggcauauaaucuuugcaagaccaagggccucuccucccaaugauggccguuuaagccaucuucuacuacauaugcagcuagagacacacgagcucaggggggugcugauuaguucauauuguuguuccuccuauaggguugcagaucccuuuagcuccuuggguacuuucucuagcuccuccauugggggcccugugauccauccauuagaugacucugagcauccacuucuguauuugccaggcacuggcauagccucacaagagacagcuauaucaggguccugucagcaaaaucuugcuggcauaugcaauagugucuggguuuggugguugauuaugguauggauccccggaugagacagucucugcauguuuguucuuucugucucaucuccaaaaguugucucuguaacuccucccauggguguuuuguuccccauucuaaggaggagcgaaguauacacacuuuggucuuccuucuucuugaguuucauguguuuugcaaauuguaucuuggguauucuaaguuucugggcuaauauccacuuaacggugagugcauaucauguguguucuuuugugacuggguuaccucacucaggaugaugcccuccagauccauccauuugccuaagaauuucauaaauucauuguuuuuaauagcuaaguaguauuccauuguguaaaugugccacauuuucuguauccauuccucuguugagggauaucugaguucuuuccagcuucuggcuauuauaaauaaggcugcuaugaacauaguggagcauguguccuucuuaccgguuggaacaucuucuggguauaugcccaggugagguauugcuggaucuucugguaguacuauguccaauuuucugaggaacugccagacugauuuccagagugguuguaccagcuugcaaucccaccaacaauggaagaguguuccucuuucuccacauccucgccagcaucugcugucaccugaauuuuugaucuuagccauucugacuggcgugagguggaaucucaggguuguuuugauuugcauuucccugaugauuaaggauguugaacauuuuuucaggugcuuuucagccauucgguauuccucaguugagaauucuuuguuuagcucugugccccauuuuuuaauaggauuauuuguuuuucuggaguccaucuucuugaguucuuuauauguauuggauauuaguccccuaucugauuuaggauugguaaagauccuuucccaaucuguugguggccuuuuuguguaauuaacaguguccuuugccuuacagaagcuuugcaauuuuaugaggucccauuugccaauucucaaucuuacagcacaagccauugauuguguuuccaucgggaggcagaggcagguggauuucugaguucaaagccauugauuucaggaauuuuuccccugugcccauaucuucgaggcuuuuccccacuuucuccucuauaaguuucagugucucugguuuuaugaggagcuccuugauccacuuagacuugagcuuaguacaaggagauaagaauggaucaauucucauucuucuacaugauaaccaccaguuaagccagcaccauuuguugaaaauucugucuuuuuuccauuggaugguuuuagcucaauugucaaagaucaagugaccauagguguguggguucauuucugggucuucaauucuauuccauugaucuaccugucuaaauuaacucaaacaaaucaguggccuuucucuacacaaaagauaaacaggcugagaaagaaauuagggaaacaacacccuucucaauagucacaaauaauauaaaauaccuuggugugacucuaacuaaggaagugaaagaucuguaugauaagaacuucaagucucugaaaaaagaaaucgaagaagaucucagaagauggaaagaucucccaugcucaugaauuggcaggauuaauauaguaaaaauggcuauccugccaaaagcaaucuacugauucaaugcgauccccaucaaaauuccaacucaauucuucacagaguuagaaaggggaauuugcaaauucaucuggaauaacaaaaaaccuaggauagcaaaaacuauucucaacaauaaaagaaccucugggggaaucaccaugucugaucucaaauuguacuccagagcaauugugauaaaagacugcaugguacugguacagcgacagacagguagaucaguggaauaguuucuuucuuuagugccuuaaaauuuucauuuuaaaguuccuuuaucuccuugguuagacacauuccuaggggcuuucuuguuacuggggcuguuuugaauggaauaauugauucuaauuucuuuccuggcaaauuaauuguugguauguaggaaaacuacugauuuuuaacauauugguuuuguguucuggcacuuugcuaaaaacagagauuuaagaguguuuccaucgggaggcagaggcagguggauuucugaguucaaggccagccuggucuacaaagugaguuccaggacagccagggcuauacagagaaacccugucucggaaaaaaaaaaaaaaaaaaaaaaaguguuucccagcuucgguguaucuuaagaaguggaaccaugguuuccuuuaagugcagaaugaugucaccugaaaauggggucaguuuacuucguacuuugcuguuauaucccauuuauuucaucucuuacugcucuagcugacuuugagcauucuuuugaaugagaggaggaagaaggcaccauuguauccuuccagauuuuagaggaaacguucccugcuccuuuaauguugacuguagguuugcuauauguugccuugauauguuuggucuguuccugguuucuuuaagcuauucugaaggcauguagaacuuuuccagaaacccuuucaguguguccugaggugauuaacccauuucugucuuuaagucuguucaugugcugcggcacauuuguugauuugcauaugccgaaccagccuuguaucccugaaaugaaaucacauuuguucugaugugugaucgccgacgcggucccuuuguucauguguccugggcuuuuccucugaguagguuuuguuuggaguccugcucuaccagcucugcuagccuguugauauuugcuaggagggcugauucuaccuuugacucuuaguuuguggauaacguugccaguaaguuauuucuuggagacgggaaauaaguuuguuuuuuaaugcagucaacuuguauuauuuucaauggucaguugaaguuauugcuuuuaagguuauaauugagagaugcuugcuauuuccaaugguuguuagcaguuguucuggcuguuugaauuauugguaauuuuuuuccuccuguuaauauuagggguuugcuaguuuccugugucaugcauaaugaauugcuucucaucucugcuuugguucaugaauaagacugucuuuuuccuuccgccuuguguagucuuuaagugaguucugcaaugccagcuuccuuaucaggaauuacuuuacuuugugcucaucuugagaugucaggaaauagcuuauugcguacaguguucuugcuugguauuauuuaugguuagggcuugaaguaucucauuccaugcuuucuuagcuucuaagguugcuaacaaaucuaaaguuauucugauauaucuucauuguauaugcaucaacuuuuuccauuaugccuucuaauauuguuucuuagcuuuauacuucuggcauuuggagcaguuaguguuaauuguuaacuugacagaaucuagaauaaucugggagaugagccuuugggcaagcacaugggagauuucgugauugcuuuacuagagguaggauggcacacuagggauggaguuguucccuggcuggacuccucaacuaugcaaauggagagcaggggcugagcaguagcagcguccaccucugucugguuccugcuguggauguaaggccaccagcuucaucaagcuucugccaucuugacuucuucuccuugguggagaggccagaauaaacacauccuuucuucagguuccuuggucagggucuuuuaucccagcaacaggaaaaaaaaaaaaaaacaaacaaagaaaaacaagacagcaucguaguuuaacuaugauacgccauugaaagguucucuggucauaucccuuuggggcaauggcucacauauuugaauauccauuuccuucucuggcuauaauuuuacugaguaaauauagucucugcccuuaggcucuaagucaccuccuccugcccauguuuugguuuucagaagacauaucagcauucuuggaugcuggucauguucacuguccccagaagguuuagugacaauagaaguaggguaccuguuaggaaacuugagggugugaguaucuaaguagugaaaugaggggaugggaaagagaagaggagggaaguaggaguaagaaagaaacgauaggguuugaggcugagauguagaggaaauccuguggagacaguggccucagaugaacaacuaaugcacaaaagugcaagggauuucaguagggaaugugaugagcagaagacauagggccuuaguauuucuucuuuguugggaugaugggauagguuucuuccuccuccucaguuuucuuguguaucagucuccacagguugagggaaggguacagcucuuacugaaccagugaagacucuuggagaacuaaguugaggaaagggcagggcauauuggcacgcagaugcagaagcugauaaagcucuguagccuugcaaguguauugacugcucccacccugaacccucuguugaauccugugucugcuccucugcagauaaugugaucaaugggcaggacuaugaaguaaugaugcagauugacugucaggugauggacaccaggauccuccacaucaaaagcuccucgguucccccuuaucuccgggaucaucagcggaaccaaaccagcaccuucuuugguuccccuccaacaaccacagagacgacccauguggucagcaccaucccugagucguugcaguagugcccgagcugcgcuggacagcagagacugaagagcuggugaagaugcugcucucugccucuucggcaagcagagacuugccuuguacgcaacuccaggggaagaggaagagagaacaggaagugcgcugcuugucaccguccacccagugggguggaacaugcuagcgagcaauucucugguggcagugcagcccugugggcagugucgccugguguugguucugcugugucaucuuuagugcuuuucucaauguguguuugguucucaguuaucuuccuucaggucagacccacuuccucuucuguccacugcacuuccuggugcaguaaagagauuuguauuuaaagcuuuagaacacaugcucaugugguuuccaccaauuggcuuucucucuccuuugguucaaauccauucugaauguuauacuugagaaaacacauuucaaaaaaccgagcagccaaaaacaucccacaaagagucaaaacaguuuagaguuuggguaaagggauuaucuccaguugguaagaguuuauuuuuacuugugauuugugguucagcccuggacaaauaacuguugugggggucacagagugagccacacacuggagacaagggaagggaaggccagugguggaauguaaggggaagugacuccauuuucauauguauuuaaacacagaguuccuguggccucgguaagcucagagcuauagccacccucaguguuggaacucggcuaaucagcagagaucuucaaagaucucagggcacaugcuugccucucauuguggacccucagcccagagcauacuccugugaaaccagacucagcaaagggacuuggaggucacuaggcuuaagcaagacuagagaguuucccuuaaggaccaacagugcacagagcaagcauggcuucccagagaagcugcagcacaguauggugaaguucucaguuuuuccaguggaaagaugauaaaggaauuaagcucucuuuguuguugcuauggcugugaacauggcuuuaauccuagcaccauuuggaaggaaaggcaggcuuuguuugauaucagccuggccuacauuucaaauuccaggacaggacagcuaaagcuauauaaagaacccaccucaaaaaauagaugaaugaauaaaugaguaaauaaacaaauacaaacaaaaagcaaaguuauguucacauauauuuuauuguauuuugccugcuuccuucaccauagcaagcagccacauuucuauugcacuguacauuguacguuacaaguucacagaaauggaugccaggacucaugucagucaugugcugccucccuucccaggauuucagcagguucucauagacucuucccagcuggcuugccauugucagguggucccauuccaguaagcacaauggcggcuaaguccucuucucucuacaaggagugacacacagucaggucaucuuuugccuguggccccauuaugccuggcacuguucaccaacaacuguucccuggacagcacugcugccaucuaagcuaaggugagauguuuucagggcagggccauucuugcugaauucagugccgcaguccauccugauuggcucucgggugauuuucagacaagaccuguuugucccgggggcugguccucuaaugggugccaaggagaagauaccaaauacauggaguaccuuuaggaguagccauuugugggggaggugggcuacccuguggccauguccuuccugccugugaagcagcucaacacgaggaugugacuguggcuguggacagaggcagcacacgcauuccugaugcugaucugcugagacacgaauagaaucugcagugacuccaguguaccagugccucagaucaaagaccucaauagugucacguuugcuaaggcugaugccucuccuacagguaacaguggggaugaccguuggaaggcacagccaaagagcagacagaaguuaagguggccacagcacaggucagggauccaaggagcuggggaggacugcucaaaacuagucuggaagcuugccuucucugcuccugcugaccaucagguccugucauuaccacucucagguccgucuuaugagaugaggaauggggcccuccucaggggagaguuucagaaaugagggaaaggcaauuauagauagaaagaaguauccugccauuuaaauugcugaaagagcuagaaucccugggcucgguaguuuguaucuuaauguuugugcgcuagcacaggcccauuggagaggaaaagcuguuguccugggagcaaaguaagcagccauucaggucucauuuuuuauuuugguaugcuugcccuuggguguuuauaguccggaacuguaggagcuauguauguacauaauauauauauuuuuuaauuuauuaaguuuuaaaaugugauuuuucaagauuaugaaaaaauuaaauaaauuugagcuagagaaauggcucagugguuaacuucgcuuacugcucuuccagaggacccagguucaguucccagcuuuaagccaucucuaacuccauuggggacaggcuaggggaugggauccucuaccuuuuucaggccucugcagacaccagacacacauaauggugcacauacauguguucaggcaaaacgcuaauauacauaaaaaauaaaaacaaauaaaucugguuuuucaaucagauaaauucccagaggaagucacuccaccuguuacuagauaauuuugugcccugggcugaugguacugugauguugggaaguguugcuagaggcuggcaguguggucuuuccuguguuugcaagccccccacuuuuaaauucagugggaguaacugcauguucccuccuguuaacagaacagcuucucucugcaguuagcucauaaaacagcuuccuuagaauagaauggaaacccacuuucaaguuaggaggugaugagaacggaugcuugagagaugaaugucagcagcacaaagcuguccccuuugccuuucuuucucauuagcaagaaguagacccugggcuggccagauggcucaacugcugagagcucuugcugcaucuccaggagacccaaguuccauuccuaacacccaugacacagcccauaaccccuaacuccaguuccaggagaucuaaugcccucuucuagucucccuuggcaucugugcacacauggcauucacuaacacaguuacacauaaauaauaauauuaaucgugaagcagacaaggaaguacucaaaaaguuacauaaugugcgucauuccugaauuuucccaauaacugucacuugaaaacagagggaacugacuuucucucguauguuuaaagugacugucgugguucaaucuuguuggcccaaaucuccauccuaggcaaauauuccccagucguuacagcugcccaaugcuguuagucauggcugccauaacuagaacauuuaacucaagacaacucccacaguuccacugugagacuguaagacugggaauuuaucuaauuaaaaagucagucuugcuguuuuacuaugaaacuugacagaaauguaccacagcaacaaaacuaggaaucacgguugacuuccucccacaucaaaaacuuccaguccgacuucugcuuuaauagcauguuagaagcucuugcauuuccuuaaccuagagagccagcguuccuaugcaguggcuccccauucuggucucauggaggugcccccaucaccacaacaccccucccccgugauagccuucuuuccaccucagccugggagcauugaccucauccuucagcagguacauacaccucaacuuccacaugugaccuguagcucugucauaagaaucaacuucccaagcucuccgcauagucccagacuugagaguagcuuauugccaccggcaaacucguaguccuuacccaccuguucuuuggucaguuauggggcauuuuaauuuacauaaguaaugauuuuuuuuuuuugcugcuaauaugaacaccaguuauauuuuuaaccaaaagaaaaaaaguaaggccuagaaggaagauaauggauugaggacauugucauucccacccugauagcacuuggaaagagacauuuccucccuggugcccacuacaggaauugugggugauuuuuaaguaacuacuggacugccuaggaagauauucccagaguccgaaaggaacuaugcacauagagaaaauacaguuuucuccuaccuaaggaaacuauuaguauucuauuagcuuauauuuuuaauaacuaagcuuaaaacauaguuuauuuuggauauuacuagaacuugcagcaauucuaauaucugucagguacucauagaaucuauggggaaaaaaaagauaagacugugugauuaggaaacuuugugagucauggcauggccagccagugucacaaagcaacccugugcuuggcuagcuuuaagcauuacagacuuaguacaugaaaagacuuaauuauauuggguucaggaacuaaagagucaaugagucaucuguggaggucaacaaauaacacacuggugggcuuuuuguccuccgucaagcuggugacuauagugaaaugaagcaggaaguguagcauauuccccaggaugcuaguuccagacugaaccagcagacugaauucacagcacgugugugucaauugaacuagccuaguucauuaucaccucuacuuucugggcaguugccaggaugcaggagaugaagaaagcuacaaagcacugcucucuuugagauucuagguuuucuuuucuucucaucaugguaaugaggggcagugaagccagagguuuaaaugagcauagacccaugguggaugggguauguagcuuagauggaagacugcuugcuuagagugcccgaagccauggcuuccuucaccacauaaacuaggacgguggagugugcuuagaauccuagcauuugggagguggaagugggaagaucgggaguuaagggucaaccagggauacgugggacccugucuuaccauguguggaagaaaugcaggaaaaauguauuguucucucccugaauaauuauguccguuuacaauaaauaaugguggcagacuauuucauauuuucaaacaagucuuuauaaugcaauaccuguucuuccucugaaauccaaauaaagacuuuuaaaacuuuguugucugucuguacaaagacaaaaacaaaugaaucuucaauguuaagugguuaguaaugggaauggaagccuaaagaggaccuguggcuuguggguguuuagauaaaacaccgagcuuguuucucuguccucccacgauggaccaaguagaaauuugcuuuauggaauccagacauguguacuacagucacaucaaggaauaaaauccucuaaaaccca

SEQ ID NO: 499 - RNA, 817 nt, Mus musculus
ugaauguaccacauuuucuuuauucagucuucuguuguacaucuagguuguuuccaauuucuggcuauuaugaggcaucaauaggcaacaugguugggcaaaugucucaaaugguaggaagaguggcuuugcuggaucuugagauagauucccauuuuccugaggaaccuccaagcugauuuccauagugacuguacaaguuugugguccuaccagcaacggaugaauggagacuuuauuuuucugccuuggacuuuagaagguuggguggaaaagcugcucuaaauggagcuuauuuaagcacacagcccgagcacggcucacaucaccuuccccagaagcagucauuuucccuauugccaugguccucccacggcgcugcugagcggcuggagcuauuccgacacaggagucagucacucuagccggugacuugguggcgggcagcggcugccuggcuuccuggcucugccauguuggaagcgcaggguucuaaccauggcugcgagcgccaggcuccgacugccagucccgccagcucggcagggcacgccguggaagugcggcccgggcuguaucuggguggggcagcggcaguggcggaaccgggccaucugagggaggcgggcaucaccgccgugcugacgguggacucugaaccggcuuucccggcuggggcuggguucgaaggucuccggagccucuucgugccggcgcuggacaaacccgagaccgaccugcucagccaccuggaucgcugcguggccuucaucggccaggcucgcuccgaaggccgcgcgguguuggugcacuggug

SEQ ID NO: 500 - RNA, 5671 nt, Mus musculus
uauguggaugcuugcagcccuccugcuucugggugagucaguaaugagggggcaucagcaggauuuggggagggggagaguaugacagggcaggguuaugugggauaagagagcagccaccuuugcugaccucagguuucauaugguucucugucugccuuggggugaugaaauggagcuagcuuucucaaagcuggguaauuugguauggacaaaggaaacucaggcuuucccaggaucaagagucuuuccugucacugaggacaguccucaaccucuuccuucuuucuugcuuugcaguuccaagaaguggaaaagcugguaagucuuauacaucucucauccaaguuuugaugaguuccacgaggguagaugccccaguuccuggcuguucugagaugguauucccccccccacucuugcccaaucuugaugacuaaauguucuugagcauagacacggucagaaauggcuuaugauuaauagauuccuugucugcagccucaugucuguggucucccucauugccaggguugguuccucugugggcugggacccagaaacugguguuucccaacaauucccaauccugggacuuuauuuuugggcaagcaccucaucuuacuuuacuuccucacacggccccaucccccacauccccagcuacucuggagaagccuguacugacucuacacccaccuuggaccaccaucuucaagggagagcgaguaacccugagaugugauggauaccacccucugcugcuggagcuccggcccauuagcacucucugguaccugggccauguccuccugccuucccacaagaagagcaucgaggugcaggcaccagggguguaucgaugucagacacgaggagcacccgucagugauccuauccaccucucugugucuaacggugagugcuggcccuacuggcagaguagacaucgggcuauucccaggggacaagaagaaaaaaaaaaaaaaggucacacagaaccaccuugagucucuggaguaggcagaagccugcaguaaagauuuccugguccaaaagccaucccccuccccgucuuccugauggagcaugaagcaaauuaauauuauuaauuuauuaaguggggugaccugguuucagaaagucaaaaauugugcucuccugacacuacuggaacccagaauccuaaguucccccuccucugucucucugucucugucucugucucugucucugucucucucugucucugucugucucugucucuguuucucucugucucucucugucucucucugucucucucugucucucucugucucucugucucucucucucucucucucucucucccucucucucucucucggaucccugacuggccuggaacucacuguguauacuagguuagccuugaacuacaaggauuuuuuggugucuaccucuugaauacugagguaaagccauguaccacacccaaacagaguccuguuugcauauuuguuuugguuuguuuuuuugcuguuucucuaauuuuuuuuuuagacauagucucauuuuguagccuaggcuggcuggccuggaacccacagagaucaaccuacugcccccuucuaagugucuuccaagcgcuaagauuaaaguugugcuccaccacaucagcccagccaggauucugaguuuuaaugucuaugugaauauaaauaaagggauugaaacuggggguuguuucauggcacuagacuggaggccaagugaggagaacaagagguggagaggaggugugucaaaaugccaaugccacauguaaaucuccauagcgagagaggcuaccggaggugggagguggcaggguacaaggaagagaagagggacggagaugaaggggaggaaacaauuaaagauguguuuguuugaaaaaugaucucauaauuaaaguuaauuauuugugaucuuaaaaaaaaaguagccaguaauuaugcaucuguaaucuuacacucaggaggcugaggcaggagaauucccacaaguuugaggccagccuaggccauauagcaauacccuuucucaaaggucuuuuuacaaggaaugaaauaagaaaaagagagaugaggcagaggaagagacgggggaagaaggaaggaagacaggugggggggauuggacaaagaacuuaauaaaacuucugcuguuggcacauauacaugagcaccuaggagucgaucaaggagcaacugucucgaaauauuugaagcguuuuagaacagggaugagaacacugggugugauggugcaggccugcagucccugcacccaggaagcagaggcaggaggaugagugcaaaucugcagcccagccagggauacauagugaauaacagcccguauugaacaaauaacaaacaaacagaaccgccaccaaacaacaacaacaacaacaacaaaggggauaggaaaaguaauaaugguauacccaucaaaguacauaauuagcugugucauauggaggauuaauaaucuuuccugggcagauguucauuuuuauuaagcauuuaaagaacaccagucaguguuucaauuagcauucuacacuuguagagguuuccuguuggaggucauuaaaguggaagcacgguuggccauagcugacagacagacuguggcacagaaacugcgacuugcaaagcuuucuggacacagggucuccugcauaugcagcccaagcaugccuugguuuucaacccucccacuccagcuuuccaagugcugggauuaccggcaugcaccagcauaccuggccaguggaauucucuuuguuagggaagaauagcuacaaugagggcuggagagauagguuaagaaugaaucaugcucugggacagaacgggacaucgggucauaaccaccugaaacuccagacucagaggauacugcacccucuucuugccuccucugacacuugcacauacacucacgagaacacacccaccuggacauguacacacaccuaauuccaaaugaaugaaugaauagaugaaauaauuuaaaauuuuaugauaccaaaaauggcauuuaggaugcccuaaggauagugucagaugcagugaugaugauggugguggugaugaugguggugguggugaugguggugguggugaugauagugaugauggugguggugguggugguggugauggugguggugaugaugaugguaaucgugguggcacauucaagacgcuguaggauauaucuaaggcuguucucagagaagcuuccuucagaagauaaggccuaacaggaccuacuggucugaauuuaagcugagaagcagugucuuuuggguugaggaaauagcuuuacaagggcccuggguucuauacagaaccuccccccccccccccgagcaguucagugugauugggucuagcuuguguugaaugaaaggugaggcaagcuaaaaagaaauggggucagggaagagguuaucaggggcuaggucaggaagggcuugaagucauacuguggggucuaugguugguuuugaaaggagacucuauggggcuggaaccaaaucugagacaucuuugcuuccuugguaucguuuucuuuccuccuguuuagucaggaucccaggugcuagucaccagaccagaaaauaggaaaaaguuuuggugaccgguggagugaaaacagccacagggauuguggggggauugcgggccugggaggcagggggggggggagggagcgggaggaagggagacugagaagggugaccugcggagcugggauuucuugaguuggguuggguuggguuggguuggguuggauucaucuuauugagauuagauuaguuucuuuguguaacugcccuggcugcccuggaacuugcuuuguagaccauggaggccucgaacucauaaggauccuccugccucuacuuccccuacugcuggaauuaaaagcaugugccaccaagcucggcagagacggauuuuuuuuuuccugaagaguaaauacuaucugugggguccauugcagacuggcuaauucugcaagugccguaugcugcgguguucgagggagagcccuuggugaugcgcugccguggcugguacgacaaagucgucuacaaacuucacuacuaccacgacggccaggcugugagauauuuccacucuagcaccaacuacacggugcugcaagcgcgagccagcgacagcggucacuaccagugcucuggcaccaugcguaucccaguggagagugcgcccauguucuccuccaagguggccgugaccgugcaaggugggcgagacgaucacagggaaguucuagggcuggaaucggaaggggaaagaggaggcugaaccccgcgggcugcucuauaggugucccuucccuauggcguauauccagguuacuuguucuagcuagggcucccacuuaggagcgaggaguucuugcccugucugaagggcgugcuacgucacuacgcacuacgaaggggacccguagcuguccccuucaagucuagagaaugccaacugauugacagcuaggauggaacuuuuaucaccugucaggauuccgccuccccucaaacugucuccauccuucuccguggccucaguuuccccgucccacucauucuuucuccuuuuccuucucguucucugggucaaggaggaacccucuccagauaagggaaaaagagggauccggggcgguggacagguuggcccuggugggggucccauugcucuugcggccuacgagcaucagggcccugaggccgcccuccccgcagagcuguuccagacaccggugcugaggacguuaagcccgcaggaggcgcgcggccgcguggugcugcgcugcgagacgcgccugcacccgcagaagcgggacacgccgcugcaguucgccuucuacaaguacagccggccggugcgccgcuucgacuggggcgccgaguacacuguccccgaguccgaggucgaggagcucgaaucguacuggugugaggccgccaccaccagccggaguguacggaaacgcagcccguggcugcagcucccugggcggggugaguggcagcucagcaucacgccugccuccugcaucccgugggucaucccgcagucuuccuaccuucccaucuccgcccuccagccccugauagcuccggccccgcguggagcagucacgggugaccaggcguguugcguugcaggcccuguccuggaucuggcguccaccaccgcgccagucgcacaggcugcagccuuggggccgggggacaagccgcuuuccuuccggaagaccccaguguccagauccguucagucagucacuuccaucccgaacagcaccuuugcagggcugcaguuccccgcgggccauguugccaccgccgggccacacgccugcgcgccccugccagcguccgcggagcagucgcgcgaagcucuucagcccaagguggaccuccugcuucgcgagaugcagcugcucaaaggccuucugagccgcgugguccugggauuaaaggacccacaggcccuccaugagcuuacagagacccccgagacacccaauucucacguuacugugaaccccgcaaccccagagaccacugucauggagggccgaguggacagcuagg

SEQ ID NO: 501 - RNA, 10010 nt, Mus musculus
agagagaugaagccucacauugacaccuagcuuuuauuagucuuauauuucauaacuuuaacauuaauaagauuuggggacaggaaauuuuuuauuggggaaaaggguuguccuaugcauuauaggaugguuaucagccuccuuggcuuguaaaugccuuaacucauuaaauucuaccagcacagacauccuucucacccugugugaaacccaacugucuaggagacacugcuaaauguuuccaugggaauauagagaagagaaauuaccccccuccaguugaaauugcaguacaaaauccacuuuuuuuguuuuuauuucucuuuaaauucuguucuaggcaacagaaagaaauuccuggucuagaaugcaaaaugacuuugucauggcuaaagaaaacauaguuauagggaaauucuggguauaacccuguaugcauuuauuuacacucgaacaguuccauuaguuuaacuaaguaucaaaccagcuugcaaaacuaugccuguauaugcauaguccagaaagagcuggaauuauugcggugguugaauauagcgcaggugaauagcucacuuucauuugucagcaaccuucgugguaccaggcuucagguagacagacaagucccucagcuccaugaccagaugaccgaggagagcucuuacaucuuguauuuguuugagaagaagcugcaucuggugaugaaggugggggucuggggaggagaaucuuggcugcucagcagaagaagcagguggugggggcagaggaccgagagcuucugugggaggaguuuccgaagcgguugguuucugaagagcuggauucaagauggaggaauaagcagaguuuaagggaccuaaguuaugggcaggaagcacaugcaagucgaaucugucuggucacccuguaauccuguaaucccaguacucaggaggccaaggcagaaggaacacugcaaguucaaacccagccuggucuacauaguaagcuguauguaggucagccaaggauacaaaguaagaccuuauccuaaaaacuggagggaaaaaaaaaagauaccugacucuggcccucacacuguuagcuucuaagugaggcaaacaacuucagggcaagcuccuauaagaauguuucuucaaagucuuccuuccuuuauuucagcuaaaacuguagaacguaaacucaguauacccugagguauuccugccuaccaccuuaacuuucucuccaucuuggcuaagcacacccccaaacgugucuaccaucuuuucuuaacucacgaguuuaaagugagcaugcucagagugcacugcuuaacugagaauguuuaagaauggaccaaccuuuacaugagugaauauauaaaccucccaugggaguugaaugaaccucccaugcccuguuuacuuggggagggagggucuugcuuuggaaauaacaccugcacucuucuugccugacaucaaaaaaaaaaaccaaaucuuucuucacucuugugugccuuuguguggugguuugaguacaauagcucccauaggcccauggggaguggcacuacaaggagauguggccuuguuggaggaagugugucauuguagggacaggcuuugaggucucaguagcucaagccuauucucuucugaugccuguugaucagauguagacuguucagcuccuucucagcauuugucugccacacacacugccacguucccugccaugacaauaauggacgcugaacuguaagccagccccaaguaaauguuugacuuuauaaggauuaccauagucaauggugucucuucacagcaacagaaacccuaacuaagaccuuuggcucugcuuauuuuggaauugaacucugcgagaugucaacucacuguguucgguuacggaaucauuguuuccucuuuugugaaaguggccgugguacucacuggcagccagggcacgaagacucuuacguccuuccuaaugcaaacuuuagucugaggcuugacuaccucugcuugagacucuuuaguguggacgccucauuguuaaacaguccaguuuguucucuuucaaggcagaauuuaauuucuggaaguacacucuggggucaaccuucucuuuguguguguuaguuguucaucuuugcuucaauuuuccucugcaugggucacccgaggcacccuuucuucaggaugacaaucacaacucucucccacugcuuccaugugacacuuucauaugaccuauugugggaagccacaugugccguugcugaguggcacugacuacugcuggccaccacgcauuggacaaacaaccaauguguacauaugcaguaaaguuuuuugcaaagacauugccuggcccaggcaugauaaugagguucuguaagguacugagaguauaaccaaucagaugugagacaugcaaaugagguaugauaaugagguucuguaagguacugagagaguaaccaaucagaugugagacaugcaaaugagguaugauaaugagguucuguaagguacugagaguguaaccaaucagaugugagacaugcaaaugagguaugauaaugagguucuguaagguacugagagagaguagccaaucagaugaggaacaugcaaaugaggcuuagugcauaaccaauccgggugugagagacgccucuccuaggccuauaaaagcagcaccaguucugggcucggggucuuuuugccucuacaaucaagcucucccaauaaacgugugcagaaggauccuguugcagcguuguucuuccuggccaguugagcgcgaaagaaccuaucuucaagauuucucaucagccuaggugacuccuaagugugugucaaguuguauacagcuuuccuaaugguaacuucuaguaacauacauuguacucuuuguagagacuguuuguuuguuuguuuguuugagaugaggucucaaugugcaguccugacuggcccuuucuagauauuaucugcauucuagguacgaugcuuccauaaauguucagaucauauaggaaucuugcauucuauaaggagauacaagaggggccagcuaaggucuuggcuuguuccacaguccaaggaagacacucucuuucugaacucucuucuaccuucaaagacuuuggauuauugcccugucucuccugcaucuauucuucaucucguuccuccagaguucgguugauaaacccaguccugucucacacacaccccacaggugcauauacacauuaacucacccuguacccagaucuccaguugugggcucugcuucgaaaucugucuguccucagucacugccucacaccaguaggagccagaguguucuucugaggcuuuggggaucuugaguucugaagagacuccucugacacucagugaccuuccauccuuguagaaagagaagaggaggcgggaagcugaccucugcagggccagcuuugucugacagcucaggguuacugagccucccucuuggggcucacuagaagguaaggcuuugagaacuggggcugcaaacaacucuaggaaaacgacaagaagugaagaagaagaggucaacaacagacccauaacuucccucucccauccuuuccucugguucuacuagguguggguucucuuuaggaaggucccauuugaacuuuucaucaacuuccuccuccuuuuccucuuccuccuccucucccuccuccucccuuccuuucuuucuuuuccuucccuucuuauuucuucucucucuucccccuccuuucgcucccuccucccuccucuuccugcuucuuucccuucuaggcagggacuagaaaagacaauccaggcucuggaucugugaacaucaaaaaccauagaucuugauggugcuggucucucuguuccuucucacccaaaucuaccacagcaacacucccucagaugcucaccuuggacagugauagccacaggggaugcagccucucggcucccaggaccagggcuccugaagaugccacugcagugguagugcccaccgucugacuuuugcaccauggugauggagaauucacuuuuagguccaggaggacccaaggcggagcccucucgguagaagauaaccugagucaguggccagucuugccaggcgcggcagugcagaaccaaugugucuccuucaaauaucaauguagcuggaccuugaaggaucagccagucuguggcccaaaguaagaguucaguauccuccgcaucccuuaggaagucccaagcaauguucauagcagguccccuaaacuguccaggucacuuucaacuccuacuagaccaccuuacugcucucuucccuuagaauucauauaacaauggcaaagaccucuuucuuccucugcccucccccucuacuccugcccuccaguccccaaaaauacugguuccccgggaacaauuuuuacuuagagauugaacuuaguguuacagacugcucacgguauuuccucacccugucuugugccuucgugauugacccagagucgagagaauaacucuagggcauuuuuuucuccugggaguuaaggauggggaacgucuaccuaugccaguucccugaguggacuggggcuaccaggagugguuugaggcacugggaucucaccauaggacacgcugagauggaaggguuuacugaauguguagcccuugaacuggaagccagcuucacuggauugggucauaucgccaucaucuucaucacccucgucuuccucagcagcagccuggcagcugccuugcucagugcugacaaguccuucacacuucagagucucugaacuggcagcugcuggggagggagagucagagaaugauacugcaacuuggggaaagggaauaagaaggacccuccacaccggcuccucuucugcccugggaauaucuucucaggagagaagaagaagacaccaaaccucucuaagaggcuccuaugggucuucacugggauggcuuugaccuuggcucauuggcauucacgccuccuggugaaaagacuaugguuuggggaagggggggggggaaugaaggaacaguaaacucagcagcaugacauccagcuguugguucaggaaaucaaaggacagugacagccaugaccccacagcaggaggaagaaaagaugagcaucagauucuagcauccacggugugucacacacugcugacacauuggugcacuguuuaaucuucacaagucugccuuucagauaagugugcucacugucaucugaugauuuuuguugaugaugaaguuuuaugagcaaggucacacucugcaguccaagucaaccugacacucucuauguagcccaggccgaccuugaacuugcaacaauucuccugccucagccacaggaauaagcuacaaggccggguuguccauccuauaaauuuuaaagaagcaguucuacaaaaucaaauuuaaacgaguuuaaagaaagacuuggggauuugcugggagauagagcaguuggaaaaccgcuuaguuugcacauugguggagcaaacauagccuuguaacuccagugcuugggaggcaaagauaggcaagauccccaaggguugcuggccagccagccagcuagccuaggcuacacagugaggcccagaccaaugaaagacuaugucuugauaaaauaaaacagaaagguagaaaagaucuaaggaaugggacacuugauguucucugauccacacuaacacauguacacgugugcguguacacccacacacauacaaacauguaccccacacaugcacacaaguacauuuaaaaaggaaagcagacaggcaggcaagccuggacggcagaacguuugccuagccuacaagaggcucuggguuugauccuagcgacaaggacacccugagagucgagaauggagcaagaaugucagggaugacugcaagcucagaagcaggguuuguuuuacuucaguccgagucuacuuuacuccucugagccuccuuggugacauccugcccugacucucaucuucucgaaauuauuuggcucuuuaggguagacuauguuaucuaaccauuggacugagcgcagggaccccaauggaagaguugggggaaggacugaaggagcugaagggauugcaaucccauaaggaagaacaacaauaucaacuaacuggacccccucagagcccccagggaccaaaccaccaaucaaagaguauauauggguggguccaugguacccgauacauauguagcagaggauggccuuaucugguaucaaugggagcuggagcacuugguuuuguggagguuuguugcuccagcuaauggggaugcuagcgaggugaggugggagugguugggugguuguggaagcacccucuuagaggcaaagaggaggggggaugggauggggaguuguggagggaaagccaggaagggggacaaaauuugaaauguaaauaaauaaucaauuagaaauaagaauauguugucuacaaaaguagcuaugcccccuuuccccuuuguuuccccuuucaagucuucauuuuucuuuuuucccuccuuuucuuuuucuugguuuuagagacaguguuucucugucuagcucuggcuguccuggaacuugcuguguagagcaggcuguccucaaacuauggggucugccugccuccgccucuugagaacuggcauuaaaggcaugcaugaccaccagucaguccauucuuugcucuucaguuaucccuuuuuccccuagugauggcaaagcucuuuccccauuccccccucccugcuacccuuuacugucaggcugcucugguagcgguggaacaauucuuugccuccgggucaaaacuuuagagacuucucccuaccucucuacaauaucucuuagguccaugacugacccaggauagguaaugucauuucucccugcucucccugcuccuugcccugcuuaguccucauauucauauguguuuucuuguucacuccacucucucccaucccgggcaccuuuguucucauccucucccagugcccagacucucggacuuuuuuuaaacuuccuuaucaaguguacuuccugguuugcacugucuugguacccguagcuccgcccucuucucucuaccccuuuucaguuccuccacuaucagaugucugcgcucaguguccuuuuauuuuguuucggagacaaaauaauaaaaccucagagcuggagaguaggguuagcuauuuaaaaaaaaaaaauccuucuuggucuugcagaggauccagguuugguuccugacguccacauaguggcucccgaccgucucaaccuguaguugcaggagaucugaugcucuccucugaccucugaagguaucaggcauggaguuggugcacagacacacccucagucaaaacaguaacauauaacguuacuuauuugauugauuaauuaauuaauuaaaguuaaagccuugcuggcuuaguuggcauuuccuuauaugguucaaugggagguauuauccucguuuuuacaacagggaaaagugaauuaggauauauuaaaagugauuuuuuuucuuuuuucuuuucaugguuacaauagacauuuauuuaaaguguggcauagguagaacaaauaauucuuaaauugugauuuggguugaaauaacuuuguaaaaguauggugagaccaggcacauccacagaucuuaacuaaaagaucacuucuuugcccacucuucucuuucuuuucuuucccgaauaaccucuuuuagauaggguucaagguagaauuuguccuccucauauuuuguccacggauccuuaggcaagaucugaugcaucauagucagguccagggcucucuuaauucgaaaaauccugucauuauaaagguccucaggaagccuucuuauggcuucuuuuacaucuucaguuucuuguaguguaucaucucgcauuaaccccaguuuauugaauccugcagcauuauaauaccacuuucgaaaaccauccagccacuugcuugaugcugaaacagcagaucggcccgccauuuugaccugagagugauuuuuuuuuucuuaaacaguauuuuauaaugcaucccuggauggucugguacuuacaaugugacuugagcugacuuugaacuugaggcaauccucaugccucgggcuucuuagaccugagauuaaagguacaugacaugcuccuaugcucaacagaaagagaauuuuuccaagugauauaaaaguaguaacugggagaggagccggaagucagaguaccugauacaagaccacaguucuugcuacaaaaccaaaaaccugggccucccacaaauagcucuggguuugguggaagaccaugcauaagaaaggauuguuguaguguuuggauaacagcaauaacaaagugucaggggcagccacuggggauccaacaaggcuucuuucagaagaugcucucaagauggagucuuuaaggauacuuagaugcuuguaaagggggaggggacuggggagucauggcagaggucauuucagauggagcuaacaauauaagcaaaucucggaggcagauaggaaucugggcugugaauggaaaugcaggcucauugaguuuugugagaguggaagugggaaggcuuuggguaugccaaagaggcugaggggguuuaguggguaccagguuugggguuuuaugugccacaacaagagcuggaguuuuagaagucacuccggauguagagagaauucauccugugagacgaggcugagacaggguuggcaaggaagccauugcccagcucaguccuaagaaaacauuuguagugguccagagaaggaacugguugagaaagcaaguuaggaggugacauuugucaaugaugaugaugcagagaaugacaaaggaagaguuggguuuccagcagagggcuagugcagugagcugagaucagauaaaaaguaaaugaaaagaagugaggaugcaagaaugugugaacucaucucuggucauguuguguugguaccagguacauggacacacacacacacacacacacacacacacacacacacacacacacaugggucaaaaugccuguguaaagguuaauauucaaaugugaaggucaaaagcagaauuagagcuggaaaugugcccgaggcucuaaaauauacaacuguucagaaaaaacauacacauacaugcaaacuggagggagggagggagggagggagggagggagggagggagggagggagggagggagggagggagggagggaaaagauuuaacuuuagagcacacuggaguuuauggaaggcaaagaaaagcuacugaaggaccaaaggacaucccagcaguaaacagaguaaaugacagugacagucaggaaaacagaggcugcaagagagaauaagcagccaguagggcuagacaaaacaaagaaacccaucacgguaagaaccgaaaaguguacagggaccugguuagagcagaggucacuguacccuacguaauccagacuccaguggaggccacgcugcaagcagggaaggagguggagccugcaagcccgcacugcccuuccaagacaguuguauuagaaaaguaagagcuaagauuugcaguuggcaaaggcuucauagucagaagggacuuuuaggauggaaacuauuagacuuuuuauauuuagaaagagccauucaguccuucacgucugacuugucuucuaucuguccuugucccgccugagcaguaauucuuugcaaagucagaacuaguccauucuucuuaccuuugaggauuuccucaagauuuggcguaucucaucuccacaccagcauucaaacacuuuacuuacccaguaacaucuggguugccaggagcacagcagggcagacauaaagggcccacugugugagcgugcagcucagcuucauggugacuggguuuauaccuccugcaaccccaacauacugauuuu

SEQ ID NO: 502 - RNA, 4646 nt, Mus musculus
cacacacacacacacacagcacagccaugagaagcacaagcaccaacaauugauuccaugguccuccaugccaagcccugccucccuuacaggucccucaaugaccaucccugauggucgcacccaggguuguuacacugcaucuucugccgccccagcuguuaauggggaugccucgguuggucagguguuuguuuauuuauuuguuuguuuguuuguuuguucuugcaccugcugcugcuggugaugguugucuuauggcugaugcuguuucugaugcugcuccucuuccugcugcuguugcugcuacugggugugcugguccuuacugagggucguggaaagaacaggagcugaagcaccccagucccugccugggagcaggcugcaggacccaugccugccgugcauccccaauccucagcugcucucuggcauccauccccucaugccuuccauccaucacaguuuggcuggcuccugcacauucucaaaugacuggcuagcgugagaugcacacugggcacccaugcaacuuggcaccugucuuuugaacuucaggaaauagucccaggggguuugaccauggcuuguuucucagcuccagcugagcaccaucaaugauuuguccgugcacggucgggcgaggucucaccuugguggauccgcucuccugcucauuacucacggaugauucuccagcccuggcugaucuggaccacagauucuuggcucagaaccccaaauggcuucagcagagucuaucagggacucccaagaugcccucugagugucuggggugggggcaguugggaucgauauaaaaacaacuuagugaguccugccuccgucuuaucagcuccauugcucuccagauguccuuccaagcugccugggagagcacagggaacuuggagcauccagcuugagccuuuccagcacagagcucaaagucccuccacccuccccaaagagguaccugccaggugugucccagcaauaccccacuccugguaccaauuucugucugagcuagaguuucuguucuugggggucaaacaccauaacccaaagcaaccuugacaaggaagugcuuguuucauucaccuuaauuaaggcuggcucagaagucccuccaggagggaauccccaguaaggagcacagaggaaggaagugaugcagaaaccagcaacagagggcuucucccuacaggcuugcuccaccugcuuuccucacagcucaggucugucaguguucugagcagagaaagagggucacuccaagauggauauaccaaauaugcugccuugcaggcagcagagaagucgugccucagugaccuaacccucccuggaaccuaacccucccacacaacagcauauuucuugaucgcuacacaaaacucguuggauuucuucuuuuuccuuggcagaggaggcuaaagcacuuuccuccuggucacaaaaucccuagccuuguguguagaguucaugaaggaaaacagcaggucccugcaacauuuguccuuacuggguacagucaucagugcgcgcccauguguguuuguguguguguguguguguguuucuguaugugcguguauuaauagauagauauagauacauacguauacauaucaugugugguuauauguucauauauauggguauacauaaaagauuaguguguguguguguguguguguguguguguguguguguguguguguguguguaaaucugugucuguguuaaaugaaagaaaucacuacggaugcuugaacuggacacucauuugugacuacucagauuacuuucuuuaaucaugcaaggcauucugggugcaccaagacuguccugugacccagaacuggcuccaaggcuguaaggcuucuuccccaaaacaaccacuuagaugagagaagaccaucucgguuuucugcaaagauuguuuccaagucaaaggacuuucugagaacaaaucucccuucuguugucuacccaagacaccgugaaaaacaaugauuucgcuguuaccuuucuucuagaugucaggagcauacuggaauuccacugcuccagaccaccugcacaggggugucccguccucgccgcaacucccccauccuaacaccauuccuaccuucggcgagcugcuccacagccauuccugacugcucuggauccuaccuaccgcagagacuuugccugccuuggggaaguuuuucucaauucagagucccucuucacaaguugagcugucaacuugacaaacccccaaguagaacagaaccgaaggugcaucuuugcaggcggcaugugccccauucccacacccacacccccccagccccacccgcccguuugggagccugcuaggguaggcugccccccccccgccuccccccacccccacccuccgccccacgcgcacaccccggugucuguuucgcacagccuucucuccuuacacggcugccccgaggccggccgcacagucccuucuggaugcccuuucggacuggugcccccuggcgcccaggaaucgccuuugguggcagggaugggguggagucgggucggaauaagcacugugugugccgcccgcaggaucugcuggcaccucuccccauguuacccauugagguggagcacaguccucugcucagcacucaggauccggcacugugcuggcagggucaggacggaggcgaccgggcagggcacgcauccgcugggcaaagguuucuuucccgacucacauccgccacaguggcuuuacaacuccccgaauauccucugcucgcccaaaccgcuccgggggcuugcgugggaaaucguggcucgccucgcccacaauggcggucccugugaagucgaggcgcgggaaccacaccaugagcuuguggcucugcagcggacaucugcuccgcaauaacaauugcccacuggaaccccuuccgacccugcaaccgucccucucuccgugccaccaccaccaccaccaccaagaccaccaccagcaccguauuccauucuccgacaucuccuauucauaguccaaaaaccaaaaaaacaaaacaaacaaauauacauaauacacagaguugugugugugugugugcguguguugucuguauguguguguauugauagauagauauagauagauaccuauaccuuucauauaugguuauauguucauauauauggguauauauaaaagauuaaugcgugugcgugugcgugugcgugugugugugaagugaaagaaaucgcuacaggggcuugaaguggacgcucauuugugacuauucgggaaagcugacugggcccaugggaugcgugcgaaggaugcuaugcacgcgacgcaguugcuccaucugaggcaggugaggcagguggggcgggcuagcuagaggguuuguuccagaccuaagagcaggcgaugaggaggagauggaguccuguugaggcuccaugaguggcauggguggacgaguguuugugaugcgggcggcgugugaggaagguccgcuugugaugggggcgggugcguagucuugguuccaggguaagcagggagucuguaguggagaggugcaaauuuguugugugggggcagagaggcugggccggagugguagugugggaaaggaaugggcagcgugcagacagggagagcaugaagcgggaagacgucuaugggguaucgggucccggagagugugguggugggagggcgcgagugugugugcauguguccacgcgagcgccacggggccacgcgcuaauggucgaguuguguuguuggugugcguugguguugggcaaaagugagcgagggaagagguuuggggaagugagggugcagagaggaagaagagaggcuucccugaccgggaaucgaacccgggccgcggcggugagagcgccgaauccuaaccacuagaccaccagggagcgucggcccgacggccacggcuaccgacuccuggagacacucagacacacagccucuccgccaccguggcagauacacugcuugcccgccuggaagccuccggccuccggcggacuacuacaggcccgcccaaugcuuagucccuccuuaggaggcuggaguucggcguugggcguugggcguugggcguugggcguugggcguugggcguugggcguuggguguugggcguuucgcaauccgcgccucuaccugcccugccucuugcccccugucucugccgccaaccagggugcgaccuccuggacuaggcaccgcugccccugccucuucucuucccgcccguuccaaaguaaaaaggucuggcacuugggcuucgcucgcuagcgcagccaggcgacaagcacaagcucagaggcgccuggcagggugccccagggcucgggaccuuggcaaaacgugggcacgcugcguuggccgggaaucgaacccgggucaacugcuuggaaggcagcuaugcucaccacuauaccaccaacgcugcaccgcugggacggcgcccacacgacgccgccgacugacagacugacuccggacagagcccagagccuuccacgacgacgccuaccgcugacuucccucccugcgcacgcccgggugggugacccgaaccccgaccaca

SEQ ID NO: 503 - RNA, 4654 nt, Mus musculus
uaagagagagggacacacacacacacacacacacacagcacagccaugagaagcacaagcgccaacaauugauuccaugguccuccaugccaagcccugccucccuuacaggucccucaaugaccaucccugauggucgcacccaggguuguuacacugcaucugcugccgccccagcuguuaauggggaugccucgguuggucagguguuuguuuauuuauuuauuuguuuguuuguuuguuuguuuuuucuugcaccugcugcugguggugaugguugucuuauggcugaugcuguuucugaugcugcuccucuuccugcugcuguugcugcuacugggugugcugguccuuuaugagggucguggaaagaacaggagcugaagcaccccagccccugccugggagcaggcugcaggacccaugccugccgugcauccccaauccucagcugcucucuggcauccauccccucaugccuuccauccaccacaguuuggcuggcuccugcacauucucaaaugacuggcuagcgugagaugcacacugggcacccaugcaacuuggcaccugucuuuugaacuucaggaaauagucccaggggguuugaccauggcuuguuucucagcuccagcugagcaccaucaaugauuuguccgugcacggucgggcgaggucucaccuugguggauccgcucuccugcucauuacucacggaugauucuccagcccuggcugaucuggaccacagauucuugacucagaaccccaaauggcuucagcagagucuaucagggacucccaagaugcccucugagugucuggggugggggcaguugggaucgauauaaaaacaacuuagugaguccugccuccgucuugucagcuccauugcucuccagauguccuuccaagcugccugggagagcacagggaacuuggagcauccagcuugagccuuuccagcacagagcucaaagucccuccacccuccccaaagagguaccugccaggugugucccagcaauaccccacuccugguaccaauuucugucugagcuagaguuucuguucuugggggucaaacaccauaacccaaagcaaccuugacaaggaagugcuuguuucauucaccuuaauuaaggcuggcucagaagucccuccaggagggaauccccaguaaggagcacagaggaaggaagugaugcagaaaccagcaacagagggcuucucccuacaggcuugcuccaccugcuuuccucacagcucaggucugucaguguucugagcagagaaagagggucacuccaagauggauauaccaaauaugcugccuugcaggcagcagagaagucgugccucagugaccuaacccucccuggaaccuaacccucccacacaacagcauauuucuugaucgcuacacaaaacucguuggauuucuucuuuuuccuuggcagaggaggcuaaagcacuuuccuccuggucacaaaaucccuagccuuguguguagaguucaugaaggaaaacagcaggucccugcaacauuuguccuuacuggguacagucaucagugcgcgcccauguguguuuguguguguguguguguguguuucuguauguauguguauuaauagauagauauagauacauacguauacauaucaugugugguuauauguucauauauauggguauacauaaaagauuaaugugugugugugugugugugugugugugugugugucugugucugugucugugucuguguuaaaugaaagaaaucacuacggaugcuugaaguggacacucauuugugacuaaucggauuacuuucuuuaaucaugcaaggcauucugggugcaccaagacugucuugugacccagaacuggcuccaaggcuguaaggcuucuuccccaaaagaaccgcuuagaugagagaagaccaucucaguuuucugcaaagauuguuuccaagucaaaggccuuucugagaacaaaucucccuucuguugucuacccaagacaccgugaaaaacaaugauuucgcuguuaccuuucuucuagaugucaggagcauacuggaauuccacugcuccagaccaccugcacaggggugucccguccucgccgcaacucccccauccuaacaccauuccuaccuucggcgagcugcuccacagucauuccugacugcucuggauccuaccgcagagacuuugccugccuuggggaaguuuuucucaauucagagucccucuucacaaguugagcugucaacuugacaaacccccaaguagaacagaaccgaaggugcaucuuugcaggcggcaugugccccauucccacacccacacccacaccagccccacccgcccguuugggagccugcuaggguaggcuacccccccccgccucccccuacccccacccuccgccccacgcgcacaccccggugucuguuucgcacagccuucucuccuuacacggcugccccgaggccggccgcacagucccuucuggaugcccuuucggacuggugcccccuggcgcccaggaaucgccuuugguggcagggaugggguggagucgggucggaauaagcacugugugugccgcccgcaggaucugcuggcaccucuccccauguuacccauugagguggagcacaguccuccgcucagcacucaggauccggcacugugcuggcagggucaggacggaggcgaccgggcagggcacgcauccgcugggcaaagguuucuuucccgacucacauccgccacaguggcuuuacaacuccccgaauauccucugcucgcccaaaccgcuccgggggcuugcgugggaaaucguggcucgccucgcccacaauggcggucccugugaagucgaggcgcgggaaccacaccaugagcuuguggcucugcagcggacaucugcuccgcaauaacaauugcccacuggaaccccuuccgacccugcaaccgucccucucuccgugccaccaccaccaacaccaccaagaccaccaccagcaccguauuccauucuccgacaucuccuauucauaguccaaaaaacaaaaaaaacaaaacaaacaaauauacauaauacacagaguugugugugugugugcguguguugucuguauguguguguauugauagauagauauagauagauaccuauaccuuucauauaugguuauauguucauauauauggguauauauaaaagaugaaugcgugugccugugcgugugugugugaagugaaagaaaucgcuacaggggcuugaaguggacgcucauuugugacuauucgggaaagcugacugggcccaugggaugcgugcgaaggaugcuaugcacgcgacgcaguugcuccaucugaggcaggugaggcagguggggcgggcuagcuagaggguuuguuccagaccuaagagcaggcgaugaggaggagauggaguccuguugaggcuccaugaguggcauggguggacgaguguuugugaugcgggcggcgugugaggaagguccgcuugugaugggggcgggugcguagucuugguuccaggguaagcagggagucuguaguggagaggugcaaauuuguugugugggggcagagaggcugggccggagugguagugugggaaaggaaugggcagcgugcagacagggagagcgugaagcgggaagacgucuaugggguaucgggucccggagaguguggucgugggagggcgcgcgugugugugcauguguccacgcgagggccacggggccacgcgcuaauggucgaguuguguuguuggugugcguugguguugggcaaaagugagcgagggaagagguuuggggaagugagggugcagagaggaagaagagaggcuucccugaccgggaaucgaacccgggccgcggcggugagagcgccgaauccuaaccacuagaccaccagggagcgucggcccgacggccacggcuaccgacuccuggagacacucagacacacagccucuccgccaccguggcagauacacugcuugcccgccuggaagccuccggccuccggcggacuacuacaggcccgcccaaugcuuagucccuccuuaggaggcuggaguucggcguugggcguugggcguugggcguugggcguugggcguugggcguugggcguuggguguugggcguuucgcaauccgcgccucuaccugcccugccucuugcccccugucucugccgccaaccagggugcgaccuccuggacuaggcaccgcugccccugccucuucucuucccgcccguuccaaaguaaaaaggucuggcacuugggcuucgcucgcuagcgcagccaggcgacaagcacaagcucagaggcgccuggcagggugccccagggcucgggaccuuggcaaaacgugggcacgcugcguuggccgggaaucgaacccgggucaacugcuuggaaggcagcuaugcucaccacuauaccaccaacgcugcaccgcugggacggcgcccacacgacgccgccgacugacagacugacuccggacagagcccagagccuuccacgacgacgccuaccgcugacuucccucccugcgcacgcccgggugggugacccgaaccccgaccaca

SEQ ID NO: 504 - RNA, 10417 nt, Mus musculus
cuuuguguuccgggcuugguggaugguacuuuuuuuguuuuggguucuuuuugguuuuuuuugguuuuaguuuuuuguuuugcuuugcuuuucaguucuucgguuuuccucucacgcgccaguuucuagcuagcgucguuugucaaaguuuuggccaaaaucgccgagugguuaccguuagugcguuuaccugcccgaguguuuauuuuguagggcucgcucugccaggcagccacuucuccggcuuauuuauucccugaggauuucagaggcucacuucaccccccuccuuccaaguugucuuaaaaauccccuaguuagcuggcugagacacccaaggaaaaaugcuaguuuggccuucuucugaacuuggugccucccguguuaggcaagcacuauaccuuuaagccauauccccagcaagauaagcaaaccguaccccaaauugggccguagggagugugucgugggcugccagagggccauccgccaucccuuucaauguuggcauccuuucucaccaccuccuuuaggccuggcaauuccaggguuugagcugcagcacgaaccaaacucccacuggccaaagacaacgcucuuuuguuuauuuuuucagcgauaugugggugacacccacagccacaagagccuagggguguggaggagaacccgcuuugauuuauauauacuguauauccacgguuuugaggauuccaagcacagaaaucaguugcagagucucucgacugaggaaagagagaaagacaugaaaugaaaugucaaaguuccugacccugggcgcugagggguggcaaggcaaagggagaaagaauaaaggggggcagcccagagcaacucuuauucuguagcaaaucucuuuuugaauguauuaauauucagaucccauuuauauuuagcaaucuagcucucuccugccuuuuuccuuucaggauuuaaauagcacaaauucgcuuuuuuccccccuucaucaaaugaauaauauuauuuugcauuuuuguaacguuagacaaagaaagcacuuuguagacuuuuagggaccuuugagguucucucauccaacccuccguucagugcaggaaucucuuuugcaguguuucuugaucuucaagauggacgcgacacaauucagugccagcuaccucaaaacauaaguuucauguugguagcaguggcugugccuauagucccagcacuguggaggcugagguaagaggaucgugaguuugaagucacucuccagagacagguaaaagagaaacaaacugacauaaagaaaacagcuuuuagaauuuaguaagaagguccaucaguagaaaauuguucuaguaaguacagcuuucugcuccugaacucccucccagacaucgcuccaacccucucuaacccagcuugcugacacgccuacaguccuaguacuuagugggucaggugcucaggucauccucagccuuggcagcauaccaaguuccaggugaccuggacuacacagacaguauuccagaaacaaaaauaagaauaaaauguaacagaugucccuuuaauuuagcucuuuguuuuauuuaaaugguuguaugucuguauaccacgugugugcuuggugcuccgagaggccagaaaaggaugccaguucccuccuggaacuggaguuauggaccugugaccuucuagguaggugcugggaaucucucuccaugcucugaaggagugguuaguuuucuuaacugcuaagccaucucuccagccccaucacguaggucuugaacauaaauguacuuuuggcuuuuugccagucugugaaagcccuucgggagauucaaagauacaaaaacacacugcucuguucacccaaagaacuguauagccuuugcaaugucaguaaagaaagaaauauaaaaguuaacaacuuggggauguagcucagguagaaugcuugccuaccauacacuaagcccuggguucuaguuccagcacuacacaaaaucagacauaguaaugcacaccuguaaucccagcacucagggccuauaaagcucagaaggugaagggcaucccugccuacauagcaaguccaggcuguagggacuggagagguagagagagaauaugcaagccuccaaaaaagguauagauaagagcaguggcuagauaaagagaaaguggaaggaggugaaaucugccacgaaccaugaaacucaguagaacuaugaucugagauacauggaaaguauuaagagacuguuggcuucacacagaugugccuauaacgucucacaagcaagacuaagcugcgcaggguagucgaugcuauauaaucucagcacucagaaggcagaaaaaagaucaccacaagcuccaggccaguccaaucaaaacugaaaacuguauguguguguguguguguguguguguguguuuauacauagauagauuagauagauagauagauagauagauagauagauagauagauagacagacagacagauagacagauagauagauagauagauagauauagccuguucuaagcaaacaauggucacugcacucaaccuccauaaccuacagauuagcugauauugaaguucagaccauaggggcuggagcgaugaaucaguggcuuaguacuugcuguucuugcagaggacccagguucaguuuccaguauacauauaguggcuuauagcuauagauaacuccagcaccagagaggaucaaauacacauacauacauacauacacgcaagcaaagcaguagaggacauaaagcaaaauaaauaaaucuaaagaaagaagacagaaauuccuauuuaaaacauuaagcuguacucuuuuauguuauuguuugagacagagucucucucuauagcccuggcuguccuggagcucacuauguaggccaggcuggccacaaacucucaggauaagucucucucucucucucucucucucucucucucucucucucucucucucucucucucucucucuccugagucuugggaugaaaggcauacacuaccacacccagagagcuaaacucuuuacaguuucuuuaaaaauaagcaguaaaguaagaaacaaggaagaggagaggagagaguaaccccuucagugaaaagcacagucauuucagauaaucccaaaagaggcaagaaaaagaggcaggaaacugaauaccuccaaaagacuuuguuuguuaaauucgucuuaaaacucagcucaaccgcauaacuugugguagugggaagggauaaaaaacagaaaacuggggccuagagagauggcucagggguuaagagcacuggcuguucuucuggguucacuuccuaacacgcacauggggguucacauccauucuaguuucaggggaucugauccccucuucuggcuucuacgcagagcuucaccaggcacauacaugaagcacauauauacaugcaggcaggcacuuauuacacauaaaaauaaauaaaccauuaagaaauuaaaaagcuuaacucugguuauguagacauuccaaacaucucccuuuguuuguugagauggucucugauagcccaggcuagcuuugaacuccugaccuuccugcuuccugcuuccaccucccaagcacuagaaagagaggcauaaaccacaguugacuuucuaguucuuccccacaauucuucaggagaugcuuacagcacacgagauuaacuucacccucuucagucgaucaucugagaccuucacacuuccuguucagacuucuuuccuagugaacccuuucaagagcccccacaccaaaucaaacauggauggcacaaacauggaugcucuaaaucuacacagagcuucacaaaugucacacgugcacacacuuucaccucagcucuuaccuuugcuguuccaucuagccauugccccucccguucccuuuuucaaaauggcugcuccuucaaggucucuagacaacacugcuuccuagaccugauuccucuuuccucugaacuuccuguauuaaguggcauucccaccguucugugcauuggcaguugaugaguuugcccucuguuucuccccucugccuccuccaacuagaucuugagcuuguagaaagaacugaauuaccauucuaauaugagcauucgcauuccccaacguuucaaauagccaccaggcaggccaauacgcagucuugaucauuuaaacugcugcauugcauaagguacccuaacagacgggagaaaucugggcuucuuccuggaaguuuccugguagagaaaaucuucuaucuggguagaaucuaccagauacagggagguggaaaaaguuguucccagagggcuuuauagucuacaguguugccguagcaaucagaacaacagacacccuaauuugggagugcucugaaagaaacuugccucuagguccuagggcucucaggcaaggagaccaagaaggauuccuuugccauggccuuuuggauuuagguuucucagcuugucuauuccucagagaagugugucuaugccccuuuucugucccucugccucacccuaccccaacauuccaaccuaggguagggggaggucaguauacacaaagcccucuguguaaggggugguauguguccccccaccccuccacccagcguauacaaugccccuucugcuccaugcccccugccacccuccccaccaccucuccauugcacaugccaggcugcaauuggucacuggcucaggacagcccccucaugcuggggauccaggggauuuuaagcagguuccagaaaacacagcucaguuccuugucccccgcucucuccaccccacagacacucugggccuuugcccuaccccagcuauggcucccggggcucccuccuccagccccagcccuauccuggcugcccugcucuucucuucuuuggguaagugaagccacugagucccagaaaccugagauucgguggucucucagcaacuucccccauccucucacccuucacugcuaagagccagcaagggagaacgagaagaugauguccuguuuagguguggggaaggaagguauagaucauucaagggaagcaggaaagguauuucacgcagauacauaguaaaagagaucacagagagcucccugaaaaaccagucagugacuccucagauccaugcuaacagccugucaggaagcaaaaagaucuugggaagagcgggaucacacccuggguucugguccccuuucauccccuaguggcacaagaaguacuuaaccuugauuacccagaagagacaagucagggaguaugaauuaaugaaugaguucacucucugugguuucagcuucucagauggaauuucugucuguggccucucaucuauacugugagugaacccuaggaucuugucccaguagagccaucuuuuuaaacuggccagccauuuccccuuaccuuuggcaggugucaagugagcaagagaccaucaaagcaagguuaguuaaguagagccuuccaaagcaccuggcauccuguguaagcaguaggcaugaugggguaagagcgagggugggcagcaggagagaggagcaguuagaaagcccaagcuuccuuccuuggucaaguucaacuccuuggguuguaaacccaaaucuuagaccuuucugcuuuaugucggauguucuggauuauauugugaugucccaaagcaauguugaagacagggaguuggagaaagccuugguaaaggaaacaaggagccggggagucuaaggagcaaaagagcucugucccaauccuagagccacugagcagaguugagaagagcaaagauugacgauauaauaggaggaauagaaauccaaagaaauaaguaacccucuguguuacacuggggauucccaagaaggcucucaaacagaauucccaggagguaaguaaaagauauggcaugcuaagaugggagauucgggacaaugaggggggagugggugugguaugagcccccaacauuggcuagacaaugggauuuuguuugguugccuccuccuaaagaacagaaaagucuauaauuguuccuacccagagccagcccacacacauagacugccugggaugacucuccauguguggguggcuuagagggguggcacugggccaagaugaccaagaagagggugaggauggauggucggaccacagagguccacaugcagaggcaccugggugcuggacucggggucuuuccuauaucuagcuucuccuugacaaugaguccuuccuccccuggauccccagucaugguaaccugggguacagcuggcaggcuugacaauugugcccagcaagaggacuugagacuucucuaguuuuccuccucuuccuccuucuccuccuccuccuucuucucuucuccuccccuucuccccuacccccuucccccuucuccccuucucuccuucuccuucuucuucuuccuccuacucuuccucuucuuccucuuucuccucuuccucuuuuucuuguaagaauuugaaguuacuguacaguggcuagcaguaugauuuauauccaugagucugcauggaaagcuaucucagauacauauguucuuaauccaaagccaaaaagaaaagugcaauauauuguauauacauuauauuuuaaagugcuccacaaaacaaauuuagccauuuguuguaaguacccguacaucuugaguuuauugcauuuauauugaguuggauacauagagaaaauguaauggugguucuaucuggguggaaacuuaaugaaagaaauugguuguuggagugagugucaaaguuagcuuugccugcauuaguugaauaguuuaugagaacauaugcauggaaugguggagcauguuuuuaaucccagcacucaggagaaguagcagcuggaucucugugagucccaggccagccuggucuauauauugaguuccaagauagccagggcuacauaguaagacccugucuuaaaacaaacaaacaaacaaacaaacuugguaugucuugauuuauuuaaaauauucaaaacucugcaucuaauuaauugcuuaagaguuagauaucaauuguuggcaaguaugguaauuccaauauucagaagacaggggcaggagggccauaaauucuaggagaguuugggcuacaauggaagacugucucaaaagaaagaagggaaggaaggaaggaaggaaggaaggaaggaaggaaggaaggaaagaaaaagagacuaaaacagaaaaugagacuggauacaguccaccuucuagaauccuaaagaaaaucauggauuccauuuccucuacacugcagacugcccauccagguacugaccagaguugacccugcuuagcuuuaagagauaugacaaaauuggauauauccagugugcuauagcuaugaacuugagggacauucuuuaugcugagaccuugagcagauaaagcauuuacauuuaccaacugaguuagucccagacagauguaggccucccaacauuuguuucuuugcuaagaccuuuccaguaccuuagcccugacugcugguuggccucauguucucuauaacuggcugggcccacugugugcaucucauuucccucuguuuacagugcucucuccagcccuggccauugugguuuacacggacagggaaaucuauggugccgugggcucccaggugacccugcacugcuccuucugguccagugaaugggucucagaugacaucucuuuuaccuggcgcuaccagccugaagggggccgagaugccauuucggugagugcgggggcggggaggggcgcaggagggggguguccugggguuagacaacagauagguacuuaaaacaacggaaaagagaaccugggcuacagaagggaaaauguuuuaugcucacaaacucaacuguagaaagguaaucugggauccugagucuggagccaagucuugggagcuuuucacacuaggauucuuucacacaauuuccaucauuccucauagaucuuccacuaugccaagggacaaccuuacaucgaugagguggggaccuucaaagagcgcauccaguggguaggggacccucgcuggaaggauggcuccauugucauacacaaccuagacuacagugacaacggcacuuucacaugugaugucaaaaacccaccggacauagugggcaagaccucucaggucacgcucuaugucuuugaaaaaggugugagaaggaacaagggacaggguucugggaggcauuucaaagagggugucagggagggcugacagacugagaagggcaaauagcuucaaccaacagguggugcaagccuuuaaccccagcgcuggggaggcuaaggaaggguuugcuugggucgaauaaugaagucaagagcagccugggguauauagcaaaacugaaggaugagggagaccggcagauaagcaagguuggcuguaauccuaauacugcaaagguggaagugaccuuuguaaucugaaguucaaggucguauuuggcuacauagcaaguuagccagacuacuuaaagaccaaucugggccacgugagacacccccccccccaaaaaaaaaaaagugaaaaccaaagaugccgagaagagaaggcauccuggcuaaaauuuucacauuuccaaugauuggaaauagguguagagaagcaacauagauauagguuucugcuuccaacccacugcgugcgaaccgcguaucucuucucccuccccuccuagugcccacuagguauggggugguguugggagcagugaucgggggcauccucgggguggugcuguugcugcuguugcucuucuaccugauucgguacugcuggcugcgcaggcaggcugcccugcagagaaggcucagguaaggggcggagccugacuccccaccuuuauccaggauccccuagacugcuucaguggugggagggccaaaggaaagagggaaguugaguguacuggguuucagggaggccaauccugcugcaaccucucuugccacagugccauggagaaggggagauuucacaaaucuucgaaggacuccucgaagcgagggcggcagguuaguagggcuugggacuggggaggagaacgcugggaaguccgggacagcagugagggacgggugggcguggucaagcccaaggcugaccuguacaauccccgcagacgccagugcuguaugccaugcuggaccacagccgaagcaccaaagcugccagugagaagaaaucaaaagggcugggggagucucgcaaggauaagaaauagcgguuagcgggccgggcggggggucgggggucugcgacggaguccuccaaaggcucucaggugguggucaucgagauggagcuucgcaaagaugagcagagcucggagcuccggccugcagucaagucccccaguagaaccagccucaagaacgcccucaagaacaugaugggccuggacucggacaagugaccgucacauccaggcccugucagagcaggggaccuaggcuccucuuuuucccgggucuaggugcuuuccucuugcuccucagcccugcccugcccuuaccucccaaugagauguaaaguuucauuccaaccuuccuuuccaagucuuguacuccuccuucgccuuuaccccucggcuuuccaggagccuagggacuaacccuacuccucgccugccccaagggcuguguguuuggugccugucucucagacaccgagaagaaagggaccuugauagccucugcccaacuccaggccacuuggccuucccaucucucccccccccgcccccccccccagcugauccccuggcuccuuccugcucucccuuuccuaccuucugguggcccagcuccacacucuguccucgggcucaaauccacaucgugcagagcagacucuccaucaggguuuauuuagguugcugaguauuuuuuauuugcccauccauucuuucguuuguuuaccugagcccacggccccaugaccgaggaccaaugacgucauguggcuuuugcaguuccccacuaagucuuuacuggagagccaggcaggcaagcagcgcauaaucgaugcccucugaccacuacggagcacaguucugggacuccgagauuuggggaaggaaagaaaaaaaaauggauccucacaggucaggggugcaguagggggcuuuaagaaaugucuucaaaauaaauaaucagaacaggaaacgccagcgagaaugggaaggaaaggaaguggcuacacccccgggcacaguggacuguuaggacuuuucuacauucuguauauuucuccuaccaucuccaaauguccuuaaauguuuaauaaacacugacauuuccagaag

SEQ ID NO: 505 - RNA, 4804 nt, Mus musculus
caaaaugaauugagucaggucucuggcagcuuuauugggggauaaucccuuuccauuguuuagugagagucgaggaucagggaaggaaaaagaaaugaagcaaaggaggcuggaagaagagaaaugucagugaguaagucuuuaacggagauggggaccugccaguguacacugauguagagccuagcuagcaucauuaugugaauaaggucagccaaccuucaaagcacagaggugaccaagagggcucggagagaauuagaagugggaaaagaaugcagccaagcacgucuguucugaagcuacuggggugguuucucaugcuucagagucucauaugucuccuggcuccggguguucaggcccugcaggagaaucagaggacguuuaggaaucugagugcaucacagggcccccuuccaccucagacuccauucaaggucauucccaacccccgccucuuuuucugaccccuaagguaggaauaaaaagagguucacucaccguguagacagcaucugcuuucuacagagauggaaagagcaaggcauuagagacccaccuucuccagggccccucaccauuuuccuuccuacccagggaguaucugggucaagagcaaugguagcugccuuaagcuaggcgcacucccaugauugcucauuuaccagugugacuacaaacacacuucagagcaacaugcaacucuccaguguauuaauugucaccucuguaggaaaacugcuaauuaaggucgaaguccaccauagcgggguauagccucuggacuuggugcaacgugggagacucccuuuguuagcagggguuuucccuuuuugaccuugucuggggaguucuaagcccacacugaggaaugucacauggcuucaauuagauuuuaggaccaauuucuuuacuccugagaaaaccuauucagccagaaccugagauuccagaaaugcuuccccaugcuaaugaggcauuccagacacccuaagaccccagccaugacauuuacccuuucugguugucccugcccucagucccccaaagcuuuauaagucuugaaucacccuaaauaaaguugaucugccuacugacagugagucccgguagggucauucaucaaacguacucacagggcuuccaaaaacaucucugcucccuuagcccgcguggaucgaauuggccaaugauccacgagggcggagagacccacacacuucuacuugauuauuuccugccuggauauuuuauuugcaguucagcuagauagcaagcagguuguuacccauccugaggagaggggcaggauacagauuaacaccuaagacacacuccaucccaggggcgucagaccucaggcuaaggccccgggaaagguugaaagccagaaaagaaacgcugacauguagacgugggagacuccauaccucacggcuggcuauagcugccuuucggaccuggaucuggaguggggaaaaggaaaucagaaaaggagaaguugggggcccaucuuuuucccuucagaccauggggaaccccucucgcuccccuucuugcugucccuccacccccacuucugggucugguucuuagaccacccugccuuaccuugagucgacaguagaguaggguaaggacaauaccauacaaaaacaggacagcauccaggauauagcagagcugcggcucucccagggcggcugaggggauacagggugcccaugggacccgguguagagggaagggaagggccaucccucagggaagggaaagggguccuucuuccuuucuuuuuucuuucuuucuuucuuucuuucuuucuuucuuucuuucuuucuuucuuucuuucuuucuuucuuucuuucuuuucuuucuuucuuucuuucuuucuuucuuuucuucuuucuuucucccucucucccucucucucucucucucucucucucucucucucucucucucucucucucuuucuuucuuucuaagguuuauuuauuuuuaugaguccacaccagaagagugcaucagaucccauuacagaugguugugagccacaaugugguugcugggaugugaacucaggaccucuggaagagcggucagugcucuuaaccacuaagccaucucuccaagcccauggcagccuucuaagggaagaaacuaacucccucucuagacuauuauuccccccuugccccugagaccauggcaggagugggacaggaagcauggaggguucugcuguacuaggacuuagguuuacuauagacuucccucucuacccacccggcagcucucuuuucaguauugugguuccucuggcaucauugagcacuuggucuaccucaaggacccauuggaguucacugggcugagacaaaaaaaaaaaagaaagaaaaaaagaaaaaagaaaaccucagcccaaagggggaggggagaggaaaauaguggcaaauuucagcagagaaaccacaagaguaugucucuguuaaguccugugaccuguggcugagggcuggacaggaaggaugugagccggggaagggaggcaagacaauuacacuauuauuggucaucuucucagccucacugcuuuuugucucaccagacacuuaacgauaccaaaaaaccaaaccaaaaccaaagcgacugcuuuuugaggcucuagagaugccauuggcuuugcacgggaagcuggauggugaccgacgacagcucaaaggaaggaccacaaacuaaguuuaaaauacggauuccucguccugcuauucugcccuguuaaucacgauaggcuucuaagaagggaaguuuaugcaacuagaaauaaaaauuuuaaaaagcaucacacaggagcugaaagagauggguuguauaaucccagcacuugggaggcugaggaaggcgucgccaugaguuugaggucagcccaagcuacauagugaguuccaagaccagccuaggauagagugaaaucaaacaaacugcuggugguggcacacacaacuuugaucccagcaccugggaggcaggcagguggaucucugaguuggaagccagccuggucaacagagcaaguuccacgacagccaaggcuacacagagaaacccugucucaagguuaaaacaaaacaaaacaaaacaaaacaaaacaaaacaaaaaacacgcaaaaaaaaaacaagaaaacccccaaaucaaaggacacgggaacugaacaugguagccccauacaacuaacuacacaaggcuaaggcaggacgauuaugcacgaugccagccugggccauaugaugagauccugccucuaaugcucacacaggaucugggcuccagagacuucgcccagucuuauuaggagagauaaucugaugucagccugcugcagggaccuugacauuuuuuuuacaguccucagcugauacauaagacucuaaguccaggcacuucacauugccuguccucuuaucgguugacaaaaugguguagcccugcccacuuccacacaagucagguuaacuaagaucaguaaaauucuuuuugcucuacagcacucacacucaugauauugcauaaaucucaaaacuacccugugaaagauacaccaacuucaccauuuuauggaugaugaaacccaggcacucagaaaagcuaagaaaacacucagggccagaguugagcaacagacuuggaacucaaaucuagguuuucugcucccaaagucugugcuuuucucugugacccuccuucccagucauucucuguuucccuaaaguuuaaccccaccucugaaaaaaagccagcugucaaucagcagugcuuuucaaaacuccuuacugggcaugguggcacagaccuauaaacccagcauuuggaaggagaaggcaggaggaccaggaaaccaagguuacccucagcuaaauagggaguuucaaggcuaacuugggcuacaggaguucccccuaauaaccaggauugacagaccacacaguaagcgacgcugaggggggguucacaggcagagcagaaccucagagccgcugcuucgugcugcuuuuggcuuuucuucucagcugacgacugagacuacaggacucugugcucugaugccuacguuaucaguucaaggaacggcguggcccucaccauccccagaaaugguauuuagacuccccugccuuacucccaagcgcagacaggcccuugucuauauagaggguuaucuaguuagcugauaccagcucccaacagagcauccuaugguguugcugaucaagaaaaguaacuuuccuaaagcuguucucugugcuguacaguccagaccccugacaaacccacccuucauauaggcucuaaagucaggguggaaagagagagagagagagagagagagagagagacagacagacagacagacagacacagugauaacaaggaaagaaagaauggcugugccuggguggggacccaacagggcuaaauucagaaucugcuucagcccucccuggcgggcuuggcucacccagggccuucuuccauucucaucgcccagggccagccuucucccauccccaauuccugcccuagauucccacucaagcccagcuaacgcucccugaagccuuccccuuaccugcuuguuccaccaaaaggagcaagaacaagaucacggcugagaucauccugggugcgcugggggcugcggcgcugggagcuggugaucgcgcugcgcugacagaacugcgcagcugugcccacgaacaguucccugaccacaguucccuccuuccugccacgccuucg

SEQ ID NO: 506 - RNA, 16419 nt, Mus musculus
cugagcuuaggggccaaaagguggcuaauuuaauauaaugucuccuuuucuaguucaugcacagaaagccugcgcagcuaagugcgagcacgugcacguuuguuuacacacacagagacacacagccuugucucccaccagacacaggccucgaaggagcagcugacaggcaaggcagcucgaggguggugcuuucgcucaucggucuauuucuccgaacacaauauccuggguaccuaaaagguuagagaaugaaauguuaucaccagagguccagaggacauuaugauguccaagaaacuccggcccagaggccaggacacagucuaugcugaacaggaaguguuugguuuuugcucccauacagaaucccaaaccccuugucuuaaacaucuugcuauauaauaaaaaggucucauaccuaugauggccacgacaucugccaacaugugucccuuagacaucuuguccaaaccagccugcagaaauggggguggcaacaguguaaacccaagucugcagaaaagagcucuuaaaaaucucacccaaaggcuggccggcgugggaguauacacgguuaaccuuagcacuggggaaggcguucaugaguuugaagccagccuagucuacauagagaauucuaagccagccacagaccuuguuucugucucaaaacaaaacaaaucaaacaccaccacuacaaaauccucaaacugggcacaagagcucaugucuguuauuguagcacuugagagucuaaggcaggaggaugaccgugaauccaaggauagcucucaaaggguuccaggcuaauuuggguuauggagcaaaacugucuuaaacaaacaaaugaaacaaaacaaagcuucaccaggaguuggguguggagauucagaccugugauucucacaccuggagggcuaaggcaggagauaguaaguuugacgccagccuuggcuacauagggaguucuagacaccauagggcuguauagcaaaguccuaucucaaaagagccaggugcuggagaaaugguccggcaucuaagaacauguacugcucuugcagaggacccaggauuggcucccuaaaccaacagcaggaaguuaauugguugucacuuauaacucuagcuccaagggaucugauguccccuuuuaaucucugcaggcaccugcucucauguggcauacauauauaaauagacacacaaguaaguuaaaaauaaacacuagucgggcagugguggcacaugccuuuaaucccagcacuugggagacagaggcagguggauuucugaguucgaggccagccuggucuacaaagugaguuccaggacagccagggcuacacagagaaacccugucucaaacaaacaaacaaacaaacaaacaaacaaacaaacccuaaauaauuuaaaaugauagcggaaaaagaauaacaauacucaaccaaggucaguaaauuauuaaugugcugcaguuagaaucacugggauugucuuaccaggugggcaaaaccgggagccuugaucuuacaccgauaagggcggcugcugccaucggauaccaaguauaccccaaacucucccuguccaaggaagaaaguuggaugccccauuaguaggaaaggcucucuccuaucaaacccugucuggcuucccuuuacaccucugugagcagugagggagugcuucguucccugucugccucuggccacccacaacccagaggcucccucccccgccccccucaccuuaggagcuucaauggcaguauauguggcuccuggaggaacuugguagcccucuguauacagcuuaaagugaugaauuagugacuccauggacgucugaaggaaggaaaaggaagcaucaagaaaccagauccaucuggcugcugguggugcacaccuuuaaucccagcacuugggaggcagaagcaggcagaccucugaguuugaaaccagccuggucuacagaguaaguuccaguacagacugggcucuacagagaaacccuaucuaaacaaaacaaacaacagaaggaaaccagauccaagcucuagccuugggcuuuccccugagagacagcaaucucuaccuucagagagacuaucagcccacauguaggucagggagaguaaagguggaauauacggugagcgcucgcugugagaggcugagucuuagcaaguuaaacagaaaagugggauuuaauccgagcuccauucuccgcggcuaccggccccuugcaaagaccccccugcucuucccuccccugaggccaaccuucaucucugcucgcuucgguggggacacuuuggcgucaucaaccuugaucuccccgggaggcaucuuguucagacacugcucaaugauucgcagggacuggcgcaucuccuccacacgacacagguaccugaaaugaugagacagacucagaacaagagaaagcagaccgaggggugagcaggagucuggauggaagccucgggagaccugaaacauggucaguaaaugguccucaguuuccccuggcacagucucucugcuuggcaugguugcccauacacaucccgaagugccuggauucuacugguaaguccuucuccaaaucaccucucucucuuuucuuucagaagguggucuguacuuucccuccuuacccucacucagaguuuggacugcagaguaagggaguugaauggaaagauaaacaaagagaccggcagcagcaaaucuuacucagggucaguaaacaggaaaagcgcugggucagaaggcuucggacuccaauccagacaggcuaaucccuagcuuaugcuucagccuucucggcuacaaaugcaguccaaacuaguucuaagauagcauggaggcacacgggguggggguguggguguuggggagaaacuggcggucugauuugguauaugugguggugaggggcacacuggggcacacuggggauugugacugcuaaagacacacucuaccaagucuaacacauuccacgggcuccuacagauacuaggaaacagagcucagagaagucaggcaggaaugaagagcugagccaugauacgaaucuuaccuaucguagcaguccccucgagaaccgauaggaacaucaaacuccaccuggucguaaacgucauagggcugggucuuccgcaagucccacuggaugccugagccucggagcaucaccccacuauagggcauaaugggcauaggaccguccuccgcaagaaaggacacgcaugccucccaccucccucccaccccccacaacagaggacaugcaugccucccaucucccuccccacaucuggcuauggaacagaaacuccaggcauggagaggacagcaccaaacacaccugaaacaagacacugggcuguacaccgggcuguaccucuacggccucuccuaccugaauccauaguuaagugcgucuuccgcuguuacaaccccaaugucgacuguccuauuucgccagauucuauuguuggucagcaucuauggacggacaaguccagugugcugauauucuucgugacaaucucuaaacgccucuguacuuacgcucugcuggguacuaaaaccccaccagccuuucugggagauaaagguaucuuucucgcgucgaguucugucucaccuccuccaccucaucaauccgaagagagaaguucuuggaaaacucauaaaugucauccagaagcccaagagguagguccuagaagccaaguggugauccugucacagcaccgcuucucaaaaggccagagcuccggcagcccacacugcccuccagugguggcagaggagagaggccagagagcagcucacucaccuggugcacuccuccaggucggauauacgccgcgugcauccgggccccagacacccgcucauagaacucgaacaucuucucucuuucuucaaacauccagaagaaaggagucauggcaccgauguccagggcauguguggugacagccaugauaugguuuaaaauccgugugaucucuccaaagagcacugugagacggaaagacggggagugauggaaggggcuggaaagauggcucagcggcugcagagaaaggcguuugcuaacaagucuggagcccacaugguagguaggaaggaaccgacuccccagaagcugaccucugaccuccccacacacgccuugauguauacuguuucacauuuacgcacacacaguaaauaaacaaauauauauuaucauggguguuuuuuuuuucuuuuucuuuuaaagaaagaaguaugugggagccgagggcucaucguacagaucauucuggguagaaucuggaaucuaaacaucacaguugaguccagggcacuuaagaugcccguguucgacaguggacagcagaaauaaacauaccucggauccacugugcccgaggaggagguuggauguuuagcaacuucuccacagcuaucgaauaggccuguucauuacacaucauggacacauaguccaaccggucaaaguauggaagggccuggggaaacagggcaucaaggucacaucuaacagaccaaggaguccacugcugcuagaaaccuuccucaugacaggcacucaaaguuagugcuuaccuuuagagccuucagcuaagcaggaugaaauguccccaaaaucacuaccaugaugauuuaagacuagcguaaaauguuuacaaaccgacuaucuaaaaugauuggagauuuaccauuacuuugauuuaucauguugacaauuuccauuguaaaaauacucuuaccauggccaaauuuuaaguuaucaaaauguaacuaaacacacccuugaaacacacagcccaaaaucauacaguaucuucuggauacagaucaacugugucuauggguuugaggccagccuagucugcuuagugaacuccaggauagccagagcuacauaguaaaacuuucucucaaaacaaaauggcaaaacuacacauauacagagaaagagagacagagacagagacagagagacagagagagaauguauaaucuaauuucuaauaguaacuucagcaacuaagucauaacauuuccuaaaauugcauccucagccuuccaagcccguguaaguugacuucagcacggaagccuuucagagagcgccuuacacuucuuucuccuccuggucccuuaaauccgagacuuggaaggggaaagggaaucagguuuauaguaacuuuagcccagaaugucaagaaagcuaagucccagcugccuacuaagucaggaccagcuuccaggaagaaggcgggguuaaaauccucccugggacagccuguucugguccuggugucacuagugacgcaggacgaugcuacaggaguuaacccaugaaagcugggaccuaaagccaccacugcuuuggcucccuggaggaagucacagagcugaagucacagagcugggucuaagcccuuuaucccagggccuuccuucauaacaguaagaaaaagaaaaagaaaagaaaacaaaacaaaacaaaaaaaccaaccaaccgacaagcaaacaaaaaccaccuuuagaaucuauuccagauccaacuccuuccaacccgaccuucaacuauuuaggucacacaguucuucuacgacggcaaacucugucacaaaccuccuccggucacucugacucacugaguguuuugaaaacaaaucaagagagugggaagacacgagaaucagccauuaaucuaaaagagcugacaccucauucccccuucucugcccuccgggacacucgcuuugacgcacucauaguugaggagggaaacugaggcacuagagcaaugauaaaaagccagaaaucagacagagagaagcuggcaggggcccccagguguaaggucaggaugcugaaagaacccauccagccccacauccuuuagcaccuucuccacacuccauccagcccugcuaaccucagagcacuaacccccaccacuccccgcccugaagcucuggggcagcaaacccaucaggucucagcccuccccggcugccaucagcaggccccuggucaccuccacaccugcagauaggucuuguacucaaugagcuucuccgugccucggugcaggagcccgaugugagggucacauuuccgcaccaucucuccacucaguuccagcacgagucucaggacuccgugggcugcugggugcuggggcccaaaguucagggucauguuggucaccgcuuuuuccuucaaaauguccacaucugagaaguggaaaauaagucagggccaaaugauaauucccuuggggaucccccugguacagccucuggcccaccguuccaucccuuguuagcaccuucacuccaauaacuaggaagauggcuaacagguggaaaaacgaaaggaagcucugaucauuaaguucauguuacaggccccaggguggugguucucaaccugugggucgagaccccugucaagcaccgcuuucauggucaccuaagaccaucagaaaacacagauauuuacaucacaauguauaaaaguagcaaaauuaguuaugaaguaauagcaaaaauaauuuuacggcuguggucaccacaaccugaggaaguguauaaagagcugcaguguuaggaaggcugagucacugccacacaacaucuuuuacuuuguuguugugcugaggauagaaccugggcacaagcuccaccccugagccaucccccaccuccuccucucucagacaggcccucaccagguuauccaggauggccuugaacucacuguugucuacacuagugacaacugugccucggccuccugaagaacugggcuuacaggccuguuaccaggcguggacacuauucuucuucuguguuuguuuguuuguuuguugagauaggguuucacuacuguagacccaacuggccuggaacucacuauguaaaccacaaugcuaugaauucagagaucugcccgccuucgccuccgaagcacugggacuagaaaggcaugugcuaccacagcugacaaacacuuacuaguuucauuuuuuaauggguaugugugugccugaguguugcgagccguccagcggcucacaaggaccgguauaccugaauggcaggccggcgcugaaagagagggaaacuaggagacgagagaaagauagaaccaagacaguguucugaucaagguucaaauuuuuaauggcggacacgcuuuauaaaggagaggggaaaguccauucccgccaaaucauucuuggagcccagcugcaagugaccacguguaggcuucagaacagcuaggcagcagguggcagcaguggcaguggcagaacaauagagugauccagggaggcaggcuccaccccaggugaucuccuuaguggcaacaaagucaagccuggcucagccugcuucaggcuuaugggaggcuacaccugcguguguacauaugugugccaugugugagcaggagcccacagaggccagaagacaucagauccccagaacuggaguuauagauggcugagagccaacguaugggugcugggaauugaaccuaggucuuauucaagagcucuaaaccacugagccuugccuucuuaccuguaaguaucaugauauaucuaaauguaccugauaaauggacaaucagugagaaauacacucuuaaguucagcauggaagugcaugccuuuaaugucagcacaaagaaggcagcggcagguagaucugugaguucaagacagcaugaaagagaaagauuacuacuaaaugacagggcuguucacuguuuugagaccggggccaccucaaacucacuaccacuaugcaguugaaggugguaaccuugaaauucugacccuuuugccucugcuuucugagcacugagaaguccagguuaugccaugcuggguaucgaaucgaacccaggacccugugacugcuaaaccagcacucuacgaacuggacuacauucccagcccaaaaggcaagguuguuuuuguuuguuuuguuuuuggcuacagggucucucuacagaguucuggcucuccuggaacucacuauguguaccaaccuggccucaaacucagagacccaccugccucugacucccaggugccgggauuaaaggcauaugagagcaugcaguuuuuacccucaagaaaccgacacuuuugagccaggcgugguuguuguauucuuagugcucaggagguggaggcaagcacaugcuuggucuacacggugagcaaggcuccaaaccagccaaggcuacauggcuauauggugagaagcuaucucaaaaaauuacauaaacaaauaagaagaaagaaaauuagacuuuaacuuguaaucaauuacaugugaaaacuagaaacagaugaaauuuguaaguuaccaggcaggguuuacugggucaggcaugaugaugcugccuuuacucccagcaguuggggcaaggguagaggcaagugauguaaacccucucgaaaugcccaagaccuaacacaagacagagcuaaccaagagugaugacgauagccggguauggaggcauacaccuuugaucccagcacuugagaggcagaugcaagcugaucucugugaguucgaggccaaccuggucuauagagugaauuucaggacauccagaacuacagagugagaccguaucucaaaaggguuggaagagcaauagaaaacggacaucaggagugaggacgaugggauuuuaaacggaagagcugaagaaauggcugacagcugagagcaccugcuguuccuguagaggagucagguuugguuuccagcauccuacacaagugguucacaaccaccuacaacccuguucugggggaugugaugcccucuccuguucucuguaggcaacuguacacacacaaccguccuuauaaaacagccugguuugggcugcagaaauggcucagugguuuagggcauugacugaucuucuagagguccugaguucaauucccagcaacccaugaugcucacaaucuggugugcagauaugcaugaagacagaccacucauauacauaaacaaaucguuuuuuaaaagcugccuggugcugggcgguggugguacaugccuuuaaucccagcacuugggagguagaggcaggcagauuucugaguuugaggccagccuggucuacaaagugaguuccaggacagccagggcuacacagagaaacccugucucgaaaaaccaaaaaaaaaaaaaaaaaaaaaaaaaaaaagcugccugguacauguaugaacaggcaaagucauauauauauaaauauauaaauaaauauuuuauuuauuuacauauauauacauaaauaaaaucuagggcuagaaagaugucucaguugguaagagcacuugcugcucaugcaggauauucacaaugaaugaauaucauucaggauauucaugguucaguucccagcaccuacaugguggcucacguugggauaauuucuugugcugcacuguaaucauuguauuucugcacccagaagagauuuacguguaagccaacuuugguguugucauuuuaugaagcauucucuaucgcagugcuucuccaucgccuucugauugguuuaauaaagagcugaacagccuauagcaaagcaggaggggacaggcggaaguucugagcagagauagaacucugggaaagagccagagguaggagauuccuugaauggguacagaacggaguaagaggaaacuaacggcucacacacagcagaacuuagauuagaguaaguggguuaauuagauuauaugagcuaacugggaaaucacaucgcuaaggccugagcuauaauaauugucucugugucauuaccgggugguuggcgggcugagacucuccugugauggacugauaaucagucauaacuuuaguuacagagaggaucugacgcccucuucugaauuccaugggcaccagacacacaugugguagguacauaaucacacacaggccaaacacccagacacagacagauacaucuaaagagacuuguuuuuaauuaaaaaaagagaaaugauggaaaaaucuacaugguuuggugacuuauuggacagauguggaggacaagagagagagagaaaaaaaaaacaagaugacuaaaugguuuccauaccgaaaaacaaucuggguaccacugauaaaaaccaaaguaaucccagcauauggaaggcucagggauccugauugaggccagacccuguuccuccucccccacccccuacccccgugugugugucugugugugugugugugugugugugagaaagagaaagagaugcacaucugguucccguggagggcagaagagagcagcagaccuccuggaacuggaguuauauagaugguugugagcggccauguggguguuggaaacugaacucggguccucucaaagaccaagugcccuuaaccauugagccguaucucugucacaagacccuguuucagaguaugaaaaacaaaagagcuaaguuaucgugacaauuuuagaauuugaguuucuuuaaaaaaaaaaaaaaaccacagaaauauuguaggaaugugcuuucguuuuaaucccaggugugggaugugggcugcuucggacugucugcagcagcugacuaugauuugccucuagcagaggcgugguuuucccagcugcaaauaguuucugugugacacuuggaauucuuaacacuuuucagggguauauaaacaccccaagaggcggggugguagcggauggguacucggggguguggguugguugcaguuuuuuaguagcugugcucaaagaagaaacaaaaggaaagaaauuagauuuagggguuggucucucucucuuccccccccuaucuuucguucucuccucucuagugauaaggagugaaauaggggagggguaaagaggagggaaaaggagaagccacaaaauagcagacccgcuugcuacacuagccaggcagcgguggcgcaggccuuugauuccagcauuugggaggcaaaggcagguggauuucugaguucgaggacagccuggucuacagagugaguuucaggacucccaaggcuacacagagaaauguugaauuaaaaaacaaacaaacaaaaaacaucagcaaagauuucugacaacuugaaacagcagcucuuagcacucaccauuccaaggaggagguuuccagugggcuguuuccuuggagggguacaugacagcucccgaaaacugcucugcccauucaauaucuggcugccacugccgagcaccucuggggaauuaaagauagauucuauacacggggcaugagcaguaugugugguucuucuguuccaagucacuucucaaaacacguuuuggagauuauaauggaaucacaacauuucucccuucccguccagccccccauaugccccuccccacucuccuucaaagucauggcuuuuuuuucacuaguuguuauugcaggcauacauauauuuguauauacauauauauuccgaaacauccuauccacucuuaugugagcccgaagaaggauggccugaauggcagagcuguguucuucaaugccaagucacugacacauauaucugggacauacaaagcuggggucgaagcugcuuccugaauaugaauguugagaacaucauguaugcaugguaaaccuaagauuacuaagagacagggaguauggaaggcgggaggagagagggaaagagcauaggcgagcaaaaaagagggaacuggggaaagagggcucagagaagagggggucuccuucggauaugggagguacucucuagccauucaucugaaggguaggauauuucaucccacauauuucgcuucugacaaaaaaauaaaaauucaucucccuuauuucccauccuuugccacaggaggcuggcugcaccuaggaaccuaggaagaaaucuggucugcgugaggaggguuacaggccugggucauucucuccucaggggucacagagcccuugaaauguccucagaguggagacauugcaguucugcagagaccgcauguagggaccgccuccuccucaccugcugggcugacuuggcaagcggaucccagacccgggccgcagcaccggggcuccgaccccacggaggcagcgcagcgcccucagggccgccaucuuuaccgggcugcagacuguaggaaggagagccgggcggaagucgcucccgcgcgcccccuggugggcuucccuucuuaucgccacaacggaguccccaucuuggaagcuggcagggaggucaauugcgaacggaacaacauccggauuccgcuucucagcuucacuugcguuucaauaacgacgacugccgucaucuuuaguaagggcgucccucccacggcuucucugggcgugagagauuuacugcucucuccugaggcaacuucgcgcagaauccagcacuucccgcuagguccacgcucugcacucgaacuuuccuuagaaacugcgcucccucuagguccccuacgcacucucuguaugggcguuccuugacuaucuuaccaucuuggucagucuccugcgguaguccugcuuuccgacagaagcccccaaguuuugaugacuaucucuuuacuacgaaauccaaaaguguucauuuccagagguccggaaacgggcuugugugaagggacucaagugcagaugggcaagucacaacaaacgggaauucacagccaaggccacgagcggugguggagcaagggggcacuuggugcaaagauaaggaagcagcaauuuacaaaugggaggggaaaugcucugacagugacucuucaaucccugcgaugcccaagucacagacucagggagcacccuuagcaauaccuaguaacccgccuccauccuggacggucuuacgugccacagucuuccucagacguaucuaauaacauagacauguaauaauuccaggacucugagccuaauuuuguauggacaaagaguuuuccugcccuggagacugauuuuugucuuuuugucuccaagcccggcuccagcugggccacccacucuuugagguucuccaauuuucucauuggaaagagaccuccuccacaucucccccagacagggucccugggacauaggccaccagcggugcagcuggguggagcagacagaccaggggaguggcaccgagcauucuuuguugcagaggaagaggagaaagccagauuucuaggcuaaaaauugaccuaaugggaagcauaccaaaggguggggccagagauccguuggcugugggaacugaccaagaccugguguagacaaggugguccccagaaagucaaggcagaggcuugguccccuuacccucuacagccaccucuccuuuucugggccuuucuuccugagauauaguuuaaacacaaaauguggugaugaugggaggggggguuccucauuuuuguguuaauccauccuaugugaagucaagacagacucuagcuugcuuagcccuggggguaguucaagcaggaacugggaugagaacucuuggggggcuaccuaggacacugcaucuuuugugccuucuccuucugccagcaccccccuccccacgugcuguagcugccacucuguggcccuuugucuuucacugcuuagucacacucuuuguucucagcucagauggggggauggaaagggguaauaagaguauccuggugacagcuccucuugccccugucccuucuggucccucaucccuugugugauugacuccuccugccucagccccucugcucaggaccagggagggucagggcaugugaugggucaagaggugagacuggaaaucaccagaggguggguaguucaggaagugauaggcaccaggacagguauuagugacgggagcaggaagggagggggaagaggaagcauucugaggaauaugaugugggggacaggagcugaccaggcagagaaugaauaaggggacaggggcaggggagguggggcuucucugggaaagggaagggacugcugaguguacucuccuuccuggggauuuccuggggaaacaaguggccauaggguggagugagcagaaauugccccgcuccugaaugcuucauuuccuugccuugagagagugugcuuugguuucuuagucccccccaguucuggaagcagaagagucauuaguucccuccucuaacacccacacacauacacauacuggucacuauccccaucccagguucucucucucucucucucucucucucacucucucucucucucucugagaugugugugugugugugugugugugugugugucuccuccccuccccccaugggaaaugaggagucaaagauuacuagauauuccaggaacuauuggauuugaaagguggggucaaggaaguagcagagaugacuucugggugagagagagagagagagagagagagagagagagagagagagcgcaggucuugucuaggugagggucuggcugacuugagguagugggggugugcugggguagcuggguguggguaggaacggggccaagagccugggggaaucuccugggagcugagccagggaaaugggcacucaggaaguuggggaggaggaggccuaggguggaauggcuguucuaugcuuuagacgcugggguaacucggggggggggggggggcuucagagagggagggagggagagaaggagaaugaaugagaacagaccuacucuggauguuccuccuauaaaaagacaaguaguuagcuccuccuuuucugucuguuucuuucuuguuuccauucuaacaaaguucuaacagcugucuccuugccuuccuguguguaccaccucuucuucucagugccuuggucccauccucucuucuuucucuccuaauguuuucuuaccuguucaccacuuccuuuuaaacccagacagcuuggcucuaacagauuagccucugggguaaaggguagcauaaaugacuuccucaaggaagugaggaagcauaggcuagaccaggcuggauaggaaggaccugaauucucccaggacagagucucaucugugacugcuguccagacccuuucccccaguccugaccuccccuggggcucugucccacaaaaaaaaaaaaaaaaaaaaaaaaaaaaaaaaaaaaagaccgggaaagagacagcugagggcugauggugggauuugggaaaaaagaugugucaucagcuggcucagugccuuaaaugcaucugcuugcuagagauucccuuccccugggcaagucccuucccuccccccccccuucuuuuuuaaggaaaaaagaaaaccacuaaggucuuugggaagcaaugauacauccuccauccuucagagucccagugaccaagcuucuggcugaguggcuuacagaucugccacucacacacagagggcgguucuggaugcuuaaaagagcuggaggggagagaggcuggggagaacccggggaagacccacagauacacagaaacgagagagacagaagaggagagagacagagacaaagagacagcagcaggaggaggaggaggaggaggcaaagacagggcgagcacugaggcaaagccagacagcugagcagagggagaagccaaggagucacagacaaagaccugggacagaaaggcaaaggaggaaguuuuggagcagaaagaacccgugggcacuuuuccugagcccaggggcuguuuucuuuuucaucuucucugaaagucccuagcccauuuaaaaacuuugccucagauuuuggcacaagccccaaagcccuucuggcuuuaacgaggagccuuccacaguuaggguguggagcauuuuggugccgcagauggccucaauccaucccagcugcagcccggguaccaugucccagaugggcuugcaucccaggaggggcuugacugggcacuggcugcaaagauuccaacccugcuugccgcuucacacugugcaguggcggaggcugcugcugcuggccuuccuccuguccuuagcguggcccgccagcccccucccccgggaggaggagaucguguuuccagagaagcucaauggcaguagcauccuaccuggaucaggcguuccugccaggcugcuguaccgauugccagccuuuggggagauguugcuacuagaacuagaacaggacccuggggugcagguagaggguuugacuguacaguaccugggccaggcaccugagaugcuggguggggcagagccagguaccuaccugacuggcaccaucaauggagauccggagucgguggcaucucugcacuggga

SEQ ID NO: 507 - RNA, 11811 nt, Mus musculus
cuggggagaacccggggaagacccacagauacacagaaacgagagagacagaagaggagagagacagagacaaagagacagcagcaggaggaggaggaggaggaggcaaagacagggcgagcacugaggcaaagccagacagcugagcagagggagaagccaaggagucacagacaaagaccugggacagaaaggcaaaggaggaaguuuuggagcagaaagaacccgugggcacuuuuccugagcccaggggcuguuuucuuuuucaucuucucugaaagucccuagcccauuuaaaaacuuugccucagauuuuggcacaagccccaaagcccuucuggcuuuaacgaggagccuuccacaguuaggguguggagcauuuuggugccgcagauggccucaauccaucccagcugcagcccggguaccaugucccagaugggcuugcaucccaggaggggcuugacugggcacuggcugcaaagauuccaacccugcuugccgcuucacacugugcaguggcggaggcugcugcugcuggccuuccuccuguccuuagcguggcccgccagcccccucccccgggaggaggagaucguguuuccagagaagcucaauggcaguagcauccuaccuggaucaggcguuccugccaggcugcuguaccgauugccagccuuuggggagauguugcuacuagaacuagaacaggacccuggggugcagguagaggguuugacuguacaguaccugggccaggcaccugagaugcuggguggggcagagccagguaccuaccugacuggcaccaucaauggagauccggagucgguggcaucucugcacugggacgggggagcccuauuagggguacugcaguaccguggggccgaacuccaccuccagccucuggaaggaggcgcccuuaacucugcugggggaccgggggcucacauccuacgccggaagaguccugccagcagccaaggucccaugugcaccgucaaggcuccuucugggagcccgagucccauuucccgcagaaccaagguaggcaacucuggagaucaugccccgugcccguaucauuccucccgccaugucugcccuacugaccccuauucacccucucuccucccacuuccacuugcagcuuuccaacuucucuccuucucucugccuuucccaucuccacuacccuuucuuugaaaaauccuggcuacucccugcuucgguccuuugcuuugcucugaggauucccugagguaggucagauucucugggccggaaugaccucucccccucucucccccgccccuuccuggcccuggagucuccugcugacacaguucccagcaguaaagcucucccaacagccuguuggccuaggcucuuuucucugccccagugauuuuuuacccccacccccagcuacaggaguaaaauuugaggcccgggggauugaguuuuuggcuucugauguuccguuuaaaauuguucugguaaacugcaaacuagggcaggaggaggcuggcaucccauaccucugggucaaucuucuucccacacugugggcugacugcagggcugccugaggcacuauccucccucccucccacuccuggucuccccccuucuucuccccccacccuuccucuagcuuuaauccagaccagacacuccuuccacacccgccacgcugagaucuggcuguggcccuagcugcugacugaauuguuccuccaaccacacagugcagacacgucgccgcagcucagccucuaguccuacucccacaagccccgccacacuuggggacccuagcgccccuccucccugagucagucccagcugcuuuucaccucuggggcccacuuagccaugaaacguggcaagccuccucuucuuccagaacgacagcugauucuucaacauuaccacaaaaacacugggauuugggguuagggggagggcccaaaccagucagucacuucaggaauccugaggcacacgugagggccagcuaacucggcugaauucuagaccccggaaugaagggaggugagagagaucucaggacccuccucucucucauuuuuuuucuucuucuccucaagcgcuucgcuucucugaguagauucguggagacacuggugguagcagaugacaagauggcagcauuccaugguacaggguuaaagcgcuaccugcugacgguuauggcagcugccgcuaaagccuuuaaacacccaagcauccgaaacccugucaacuugguggugacgcgccuggugauccugggguccggccaggaagggccccaaguggggccaagugccgcccagacccuacgcagcuucugcaccuggcagcggggccucaacaccccuaacgacucagauccugaccacuuugacacagccauucuguucacccggcagguaaggccucagucagcaccacaggaaagggaccacaacccagagagaggcacaaccacuccacgggccaugauggagaagaugccccuggaguuacacacgagccuggcgccagccgcacagccauggggugucuaugugagcccugaccgugcuggccccagcgucuaguuccuugcuaaccuggauaucagcccuaagcaucgucugugcuccuucuccacaggaccuguguggggucuccacuugugacacccuggguauggcugaugugggcacagugugugauccagcuaggagcugugcuauuguggaagaugaugggcuccagucagccuucacugcugcucaugaacuggguaaggaagcucuggggcaguguggcaccugaacuggaugugaggggggcugaggauacucuaaugauauaaggggcucacuagagaacaaacugagguaccaagauaucuuccuucccagcccuaaguccagggucagaagcccucugugcucugggugcagacaagcauagauucuuccccccuccccccaagacaggguuucucuguguagcgcuggcuguccuggaacuuacccuguacaccaggcuggccucuaacucagaaauccaccugccucugccucccagggacugggauuaaaggcauaagccaccacugcccggcucauggauucuucuaguaaauaaaauagcagguggaaacuuacuuugaacuguaugcacauacaugaguauucauguuuggaaggggcgagaguaagggaauaggaguggaggauugggaguguuagcaacaguggaaaguaagcagagaggagccuuuccuuuggggaagagaagauagggcaauaggggcuccacauugaaucuucagagaaccacgaggggaucugagagcggggcagggaagguagaucugaucaucgacagcugcacccaaguguaugauggagcccugggaggacacgggauggacccucuagaugccagcaggaccuuuucucuuauaggccaugucuucaacaugcuccaugauaacuccaagccaugcacuaacuugaaugggcagggggguuccucucgccaugucauggcuccugucauggcccauguggacccugaagagcccuggucgcccugcagugcccgauucaucacugacuuccuggacaaugguuaugguaagcuggugacaccuuucucagaguagagacuuaauuccugcccucucucacuggaugcuuauuucuggaauauucucugugggccacacugaguccuccauguguguucuaucugcuguauguaaugggguaagaaaugcugcugccuuggugugguucccacucccuaugacaacaaauagcacagauaagggggugagggagcuuauauuggcuccacacaauuagaacugacccuuuaagggccagcacugucccagauugaaacggacuggcuauggaucaguugaccaucuugccacucaauaaagugugcaaggcugcagaaugacuaucuccagacaaaaguucuuauuuuauuuucuguaugugugcauacaugcuugccggggcccuuggaggccagaaagggggucuuggauccccuggagcucgaggcaguuagugagucacuugauguagugcugggaacugaacuggagaccucuucaagagcucuuaacuguggagccaugucuccagcuccccaaagcagcugauuagaagcagucucaggaauucuauagaugggcaugguggcacaucccuuuaaucccaguauucagaggcagaggcaucugugaguguuugaggucagccuggucuauguagugaguuccaggacaacgaggacuauauaagaagaccacaucucuagaggaacaagagaaagaaagaaagaaagaaagaaagaaagaaagaaagaaagaaagaaagaaagaaagaaagaaagaaagaaaagaaggaagagagagagagagagagagagagagagagagagagagagagaaggauugugcagagaugcuaugaaugguggcauaugccuauaauccuagcauuugggaaacgaaagcagaauugccacauggcuucaggcaagcuugggcuguguaacagugagcuccaggccaucuggggcuauagagugagacugcccucaagacuccaaguagggcuggcaagauggugcagcagguuaaggcacuugcuggcaagccugagagucugacaaccagguuucagguuguccucugacuuccauacaugggcaaacucccuucuccugaaugugauauauaagugaaugugauuuaaaaaauaguuuugaaaacccaaauucuggggcgggagagauggcucagcaguuaagagcgugacugcucuucuaaaggaccuggguucaauucccagcacccacauagugacucacaaccaucuguaaugggaucugaugcccucuucugguguguuugaggacagcuauaguguacucauauacauuaaauaaagaaaaaagaaaagaaaagaaaacccaaauucuacuaguuguagaaauuuucaaacccaaucugggguuuccaccccaccuugaauauucaguucccaguaaaugacacauacaacuuuauauuuauaauaagucauaaucagcacaagagcugagcagauaucuauccucuaugcuaaugugccuguuucccaaccaauaaucccacuguauaauuuaccauguuugucugggcugcucuuagccaagccacauggccauuauuucaugacucaugaauccuccuccauucuucaccuucucucccuccugguucuccucuggcucccaagcccagaacccuaaaccccaccuaugucucuucugcacaguuauuggcuauaggccucuuuauuaccaaucaaaaauaacuugggggcaaccaggucuugaggaaccaguauuagcauuaaaauacaaacagcaucaggccaacccacuacaaguaguacaacccacgacgacaugaugguggugaugaugguggugauggugauggugaugaugaugauaaauucugcaguggguaagaccagguggaagcacuuuccguuccuacgccgauugaguucuugguuuacaugcagacauguggcuauaaguuacuucacuucucugugcuuguaguuagcuaguagguaacuuagauguaauagcagccaguaccccacaguagugugauuaguaacuuuguauguuaacccccuuucagggcacugccucuuagacaaaccggaggcuccccuccaucuaccagcgacuuuuccuggcaaggacuaugacgcugaccgccaaugccaacugaccuucgguccugacucaagccauuguccacagcugccaccgcccugugcugcccucuggugcucuggccaccucaauggccaugccaugugccagacgaagcacucaccuugggcugauggcacucccugcgggucuucacaggccugcauggguggccgcugucugcacguggaccagcucaaggacuucaaugugagaccucagggcauggcuuggguaacaggccuagagaaaggacuggcccuaagcaaggccuaaccccaucuccguucugugcccuugcagguuccucaggcuggaggcuggggccccuggggaccauggggugacugcuccaggacuugugggggugguguccaguucuccucccgggauugcacgaggcccgucccccggaacgguggcaaguauugugagggccgccggacucgcuuccgcuccugcaacacggagaacugcccacacggcucaggugaggggugugaagaugggagcccugggaaggggugguggacaggaaggauugugucuugaguccuggccuaaggugcggauugugucuucuaccggggaaauuaucuuucuagaacuaucccuggaaaucugugagggagagaugccaagauggcuaaaguucugagggucuagguggaagggugugugggauggugugaggagagagaggcucagacuguuugcuuuaugccuguagcauugaccuuccgugaagagcagugugcugccuacaaccaccgaaccgaccucuucaagagcuuuccagggcccauggacuggguuccgcgcuacacagguguggccccucgagaccaaugcaaacucaccugccaggcccgggcacugggcuacuacuacguauuggagccccgggugaggaccagagaccucggggaggaaauccuugacuggauucuccgcucuuucacuuuugacucugucaaaguauugguccccugacagucagucccucaguggauaggcuuccugaagaccgcuaacucguggacaccccuuuuguaucacagaguggcagguucaaggggaaagaagcccuagcaucuuuggacgccccugccuucuccaggaggcuauacaaaauuauuccugcaaguuuguugcccccuaguggccauuggcagcugcaccauuaaguuuagaguuuggugcugggacuaaaaauccuggcccucucaauuugugauauuucuaaaccucaaaaguucacccuuagaaauugugagaccuaaagcauuuugugcuucaccugaugcauagccagcgcaagaacacugguuacguguaucauuauuauccuaguaaucccauacagcggaagucuccccuacaucucucccuuuccugugauuuuccgauuucaccuuccagauguuuuaccuuacaaaccccugcugacuuagcaagaacucuaauuaacaauaucccuccuucgcuccucagguggcagaugggacucccugcuccccagacaccuccucugucuguguccagggccgcuguauccaugcuggcugugaccggaucauuggcuccaaaaagaaauuugacaagugcauggugugcggcggggauggcucucgcugcagcaagcagucgggcuccuucaaaaaauucagguccuuucaguaguucuugucugcucuguucuccuggucuagucuuggggcccauugcuuuccugcccacucagcacuuucuguagucucagggagagacagaugaguaggugguuacaaugcagcgcuccacauguugaacacagagggcacgagagcucuugaaggcaucagggaaggcucccuugggcggugaccucugagcgaagaguaggaauuggacaggccccagggaggccaggacuggcaagacauucaguaagcaguagugggagucagagagaagguuaagaaagguacacuugcugguagcuccuuucuaggguggacagauaaccucauaaaagcuugaagaaguaaccuugucuuaggguuucuauuccugcacaaacauuauggccaagaaacaaguugggaaggaaaggguuuauucagcuugcacuuccucguugcuguucaucaccaaaggaaaucaggacuggaacucaagcaggucaggaagcaggagcuaaugcagaggccauggagggaauguuacuuacuagcuugcuuccucuggcuugcucagcuugcuuucuuauagaacccaagacugccagcccagggauggcaccacccacaaggggcccucccacccuugaucacuaauugagaaaaugccccacagcuggaucucauggaggcauuuccucaacugaagcuccuuucucugugauaacgccagccugugucaaguugacacacaaaaccagccaguacaaaccccuaacacauacauccacacccagacaaacacaguauggccagcugaaaggauucaggcgaugcugaguucuuuauuuacuuuuuccucacagguauggauacagcgauguggucacgaucccugcgggggccacccauauccuuguacggcagcagggggggucuggucucaagagcaucuaccuggcccugaagcuuucugacgguucuuacgcccucaauggugaauacacgcugaugcccuccccaacagaugugguucuuccuggggcagucagcuugcgcuacagcggagccacagcagccucagagacacugucuggacaugggccgcuggcccagcccuugacgcugcaaguccugguggcuggcaacccacagaaugcacgucugcgguacaguuucuuugucccgcggccagucccuucaacaccacgcccuccuccccaagacuggcugcaacgcagggcagagauacugaagauccuucggaagcgucccugggcaggccggaaauaaccucacugucccggcugcccuuuuugggcgccggggccucggacucaucugggagaaugagcaggcuucugcaacugccuccugcuaaaacacaguagggagguguagagggugagaucugccugccucacugccccaaaccgcaggcuggcccugcccuggcuuccugcccugggaggcagugaugucuuggugaauggaaaggggcuaggugacaguacccuaucuacuaaacugcccccucuacccugcaggucacaggaggaauggggggaagacaggguggguccugggcccuaguuguauuuauuugguauuuauucauuuuuauuuagcaccaggaaaggggacuagggucuuggggaaacucacccauuauagcccuaaccuagcuaugaaauccaggguguuggugacaaauaugagugguguguguguguguguguguguguguguguguguuuauguaugagguacaaccugcccugcuuuccucucccuaauuuuuuuuuuuuucugggaaaaggaaagucaaagguaggacugccuucagggaguaagggaugauuguguuuuuaaauugaaguuugcuauuuauaugcucuuuuuggagucagacaaauguggguuauauucuggccccgcaucuuugagcauuaguuuucucaugugccaauaauaaucccuuagaaauugguuguaaggauuaaaugauguuaauaaagaacuagcauagagccucucacucaguaggugcucaaggaauggcagcugcugcuccugugguccuuguucucccagucacccuccacagaggcucugccaggcacucgaaguccacaaggauucaugucacuugugccuaucuuuagucccaggcucaggaccuucgguuggcaggacccuguuuaggauuuggagagaguucagacucucagauggccaucuugucuauuacuucuguaggcacguaagcaccugcagcagacauaauaaacacuuggcaaagauagucaacaagaacaugaagguacaagaacagaacccaacaacucccuggacacaaacaggagcuuaguuguaagaauggcggaaggggcagagaagggaugauguaauagcauccuggcauuccaggagcugguggaucugaacuugaguuaggguucagcaucuuauuaccugggugauguugggcaagugcugauaagugaccuuggaguacaagucuguggaauggggccaguaauaacugcucugacagcauugcucugugcucaaggauuuucaaacaguaaaggccguuguaacaggagaggugaccuuuguggugacagacugggacagugacuccagaaucaaucaaaguaagcccaaccaacaucuaggaauggaauucaaugagaggaacaggauguggucugguauugccuaauaaucaacaaagcaaagcaaagccaaaaaaaaaaaaaaaaauccuacaagaguggagccaucugucaaucuguccagugguggcggaaugcgaggaccagcacuggcugaaauggaucucccuuccuugagggguaaccuagucagucuuaugugcgucagggacuggcgaaagugucaguggagaauuucacaugcuaaguggcaaaugcagagcuucuaggauuguggaagggacugaaugcugagguaggaaggagcuguagguuaggaagacccugaggugaggguggacuguggagacacuaaaggcaucuugcucugccaaaggagaguaggggugagagggggagaggcaggcacagagggcaaggcuguuugugugcuguauucauugggaccaggcuuggcuggucaaguucuaaacgaggcagggcagagcguuguagagugcucugugccuuacaccagcaagcacaguggcugcucucucugcaggcuugagggaagggcuggcuacacuccucucuuuagcgugcauugcucucacucccaugcuugcucucugaugugggccuuguggugcuucuaccaaccaggcagggggaggcagcaacaggacaguggcaucuucaguugcuucaucucagugguaagauuggaccaacaguauguuuauggaacuuaauacuaugaacucacgguacaagcagagcuuuguugaagugaagguaaaacacaaaugauauacggccguguccuuaaagagcucacacugcauccugggggaggggggagguugugcagcacauguccacaaagagagucaagggucagucugaggagcuauaagauaaaggcaaaauggacuuugugaagcuugagccuuguaccugagcaccagggcucaggaaggaggaacgugauuugggcuuugggaagugggucauuaugguaacgcuucucacauuucuuugagguucuuggcaauuuacuuuguaagucacugucauauguuauuuuaaagaaaaaccacuuuguucaccagguaggguucuuacuggcacgaagaaauuuucuccuugggagguagaaacagaugggucggaauuucaaggcuauccuccguggcaacaucauagcauaaaggccaguuugguuacauggaacuuugucucaaaagaggagggggcuggagagauggcucagagguuaagagcacugaccacuuuuccagagguccugaguucaauucccagcaaccacaugguggcucacaaccaucuguaaugagaucugacgcccucuucuggugugucugaacacagugacuauguacucauauaaauaaauaaaaucuuuaaaaaaaaaaagaggaggaggaggaggaggaggagguagagaauuuugaaggcuagagagaugcucagccguuaagaguacuggcugcuccuccagagaaccugaguuugagugccagcacccauacggcagcucacaaccauuugcaacuccaguuccagggaaucaauacucccuuuuguucucuguggguacuuaggcacgcacguggugcauagacauacaugcagacagaacacugauauccacaaagugu

SEQ ID NO: 508 - RNA, 6571 nt, Mus musculus
aggccccgccccagcgcccgcuuccaagauggcugcagcgauaccugcccgguuguccggguggcggugacgacggggagcagaccagguauggugggcuggggaccacggagagagagaguccucggagaaagguuggggaggucgggggcgggaagagaagaaguucugagucaaggcugaaaaaucagauugagcacggacagggucucggauggaaauguggacgcgggccgguugcuuucacauugcacaguaggggcaagcgcaagagaccgggguggaaugggcguguucgaggagaaugggguucugauccccuucccuucgcgugcaaggcucugaccgaccacgcccuuccaggugagccggcccaggucuugggccgauccugucccagcccuuccgcucuggucccuucaccuggaacgcuccuccccacccccacuaaugcuagagaaagguggaaaggggagaggacgccacccccacccuucuccgggccacgcuccagagcuguugccugcggcucccaagugaccaagcacccuauaccugcggaggcgcuccccgguaccuaaagaacagaaagaaccuguucccuauuuuguuuuguuuucuggccacuccaaagucccguuacguaugucuugccucucuaauaguugggguugcuguuguuuggugccuucauucauuucccuguccccacgcccaaaccagcucguuuuguuggaguauagaggguuaguuacggaccugacacaacccagcugcagguaaccugagaaccuaggaacuuucacuuuccaaucaaucacuuucccucacuucccaugauggcaaagcuguuucuucccgaacucuguuguacaggugacugguuauccuugcucauuucugguucccgcuggucccagauuggcuguuggaaugcuuuuuuucuggccccugugacaguuccaauuugagauaaugccucauaucucugcuccccggggaccuccuggagcccccacgauccggaacaaggcagcgugaacacagguacgugugcgucucuucucucagaaagccugaaaggacuucugaaguguacuuggaacuugaaugauguaagccuucuugaggguaaagauacagaguagcugcugcgagugcuuugggagaagugggugaaacuugcugguaguugcuuaccuuucuuuuuaauuguuauucauuguugaucgaucacaccaguguuccuuucugugacuuuguucccugccugucuuuuuuuuuuuuuuuuuuuuuuuuuuccuuucccuggccucgcuuucaucuccuuaccugcugcugaugucucuucuggcuugcucucuuccuguuugcuuccagaaaucccuucacuccuuaccuagcucucaagucaggauguugcggaggcugcuggagagacccuguacauuggcccugcuugugggcucccaacuggcagugaugauguaucugucacuagggggcuuccgaagucuuagugcccuguuuggucgagauccgggcccaacauucgacuauucucauccccacgaugucuauaguaaccucagucaccugcccgcagccccuggagcugcaggggcuccuccggcucaagcauugcccuacuguccagaaagaucacccuucuuaggugaguagaaaggaaagacggugaagaagagaacaagguuuggggguagggagucuugggcaggcaugcagcgagccuuagacuaauggacucuaaggugggccgauguugugaauucagagguaggcucuugggucacaagcuucccauggccugccuguuguaugggcucuucauacccuagggugggaaucauuuccccuguagaugagucuuggcuuaauuggguaguucuuuuuugucuuccgcuguagcuucagugugggacaagaggaaguuacauaguucccuaaaauaagaccaugauuagucuaagguagagccugccugcugcaguuuuuggcuuccaggaacagucuucaugacgggaaaucugaggcuuguuagauuucugagugagcugcugggaaacugagcucagaaucaggcuguuuucuccaaaccucuucucagguccugauaccuacccauuuuaucccugugccuccgauuucugaccuugccuuucccuaccaacaguggguccugugucaguauccuuuagcccagugccgucacuagcggagauuguggagcggaauccccggguggaaucagggggccgguaccguccugcagggugugagccucgcucccgaacagccauaauugugccccaucgugcccgggagcaccaccuucggcugcugcucuaucaccugcacccuuuccugcagcgccagcagcuugcguacggcauuuaugucauccaccagguauccccuucuccaccucaaaugucucuucuuucaucuagugggucugugggguaacuguaagacaguggacaauagauaacggagaagcacccagccuuucucuucuuaccauguuauacccaugcuuauucugugaggguauuccuacuuuccuguauuuuuuucuaugauuuuuuuuucuuuguugaguggcuuaugcaaacuugaaauuggucaaggaugagcugaaauacuuguucuuuaucaaaaaaaaaauuuuacuaaguuuauuuuguguacgagcguuuugcuggcauauauguagguguaccaccugcaugcuugguaccugaggaggucagaaaaggacaucguguccugaaacuggaguuucugaugguugugagccaugugaacugugugggugcugggaauugaaccuggguccuguccucuaccagaacaacaaaugcucuuaacugcugagcccaucucuccagcccugcaacugcugacauauauugucuugaggaagauguuccuuugacaugagacaaacagcagaagccaauuaacaguuaucacaugauuguuagcaaucgaagaaacugaauguaaggcacaugcugauauguaagaaaaguuuuuuuuuuguuuuuucgagacaggguuucucuguguagcccuggcugucuuggaacucacucuguagaccaggcuggccucgaacucagaaauccaccugccucugccucccgagugcugagauuaaaggugugagccaccacgaccggcaagaaaaguuuuaauucgaauaacuaaaucaaaaaagugguuggguuuuguuucguuuucugagggugaccuuuaauuucugcuccuccuguaucuaccuucccacugcacaugcuacaugcuuccuugcucgcuuuuacauggugccgagucagacugugcugagggcuucaugaaugcuggauaauacucugccaaaugagccccaccuccgggccuuguuugguuuuuagucuacucagaaucuuccugucucagcccccugagugcuagaauuagucaggucccaccaugcucaucgguugaucuuguucuuccuucucugggccccaucuccugcuugggugcucucuucacuuuggcacaaaugcagucugcuuucuccgugcauagcccgcucccccuucgcuaucuucuaggcuggaaauggaacguuuaacagggcaaagcugcugaacguaggggugagggaagcccuucgugaugaagaaugggacugcuuguucuuacacgacguggaccuccuuccagaaaacgaccauaaccuguaugugugcgacccccggggaccccgccacguugcuguugccaugaacaaguuuggauacagguagagggcauggaagggcauuagaaaguaaggaaaccaacuuuguagaacgagagcagagaggauuguggguagggauggcuguucaaauuugugaaccgcagggaucuuuuuguccuuagccucccguacccccaguacuuuggcggaguuucagcgcucacucccgaccaguaccugaagaugaacggcuuccccaacgaguacuggggcugggguggcgaggaugacgacauugcuaccaggucagacuucuugccacaucucuuucucaaacccugaccacaguuuucaacacaaccccugagccucuugguucugcaccaagcccacucucgccuuugaccugggcaggcuuugcccaucgcugcccauucugccaaauuuccauuuucuagguagaucagguugaugauagucuugguaaaggggggaagaucaauuggaaauaugggauaugaaauucuagaucucaggagggggucuaaaagacaaguuagugcuuuguuuuccuagacuuccaaagaaacuacuucugugagaauggggggagggguuccgcucccuagagccccagaucacccuuguuugguuuugguuuuguuugguuuuaugagacaggguuucuguguagcccuugguauccuggaauucauaauguagaccaggcugaucuugaacucacagaaucuaccugccucugccuccagaugcugguuuaaagcaugcagcacugcugccugcccaucuuuuuguuguuguuguuguuuggcgggggacugauuugcauaaugccaacucacuucuuagcaugugaaacauuccuuaccuuuagccuccagugaacugguuuuguguguaguacguuugagcuuaguaugcugcaaccauugccucccuccccuuaauguccccugaaaugacaucuuuaugugaauucucaucuccguguagguauuucauauugugaaaauccuagauguauuucuuucauuucaaaccacugucaccucuccuugccucuguguuucaggucuggcuuguuuuaagguccggguuaucccucggcugccgcucugcucuuucccacauggcagcagcugggaaggagcuggguagcuuagacacuauuucuaaguaagaauugcucggcuagggaggcagcuugguggucaagugugugcuuagcauccguaagccccacuuucaaugcccagcgccaacaagagacggagauacuuuagacaaaagggccccuuucucuauucucccaagacuccacgggugguuucuaggagccauuuagaaagaagaugcaagaauuaagaaucuaccuuugccaguuguuguaaagccccagggcaccuggcaccaggcccugcggacuuacacagccagccuuaccuucuuucuguuugcuuuugucccgccuugacaugcuuggcaguauuuauuuauuuauucuuccuugccagacaaguaaaaucgcuuucugugucccagccuauaccaucacucucugugugccccagccuaugccaccacucuaucugugccagccuaugccauugcuuucugugugccccagccuaugccaucaaucucugucccagccuaugccaucacucugugccccagccuaggccaucccuuccuuagugggucuacuuuucccauucacccgacagcagcaguuuuccacucgagcaccuccaagacucccucacuuuucucacaggguccgccuggcugggaugaagaucucucgaccaccuaccucugugggacacuauaagauggugaagcacagaggggauaaaggaaaugaggaaaauccccacagguaggaaagaaauguuuauuggagucucggguuuccugucucuuuaggacacucuacaugucccugaauucuagacucuuccuuugagaucucuuaaucuuacaacuucucacccucagauuugaccuccugguccguacccagaauucuuggacacaagauggaaugaacucacuaacguaccgacugcuggcaagagagcuggguccucucuauaccaacaucaccgcagacaucgggacugacccucgggguccccggucucccucugguccccgauacccaccugguuccucccaggccuuccgucaagagaugcugcaacgccggcccccagcuaggccuggcccucugcccacugccaaccacacagcuccccguggcucacacugauucucugcccacuguaaucaugagacugaauuggagggguugugucccucacaccucugcuccucacugcucucagagggaugugagggaauuaacccuagugcugugcuagggggcagggaccucuucucacugcuagauuggagcugggcuccucuagaccuggagguuccucuuucuaggggucaccugucagggcuuaugacugugaaucuuugaugucauuuuaugugacgaauccugggaguccucugccccugggguaggagcagggcuggaccccaagucccuuccucguccauggacauuacucuuuuccaagagugaccuggcuucuccugggaccucugugaauauuuauucuauuuaugguuccuaagaagcugucugguggaggaaaccccuagccgggcauuuccugcgagugcuggaauggcugcuccuccucuggucuuggccccggaggggcgggggcugggauuuugauaucuuuucuaauaaaggacuuugucucaccu
